United States Patent 8,067,671 (METHODS FOR GENETIC CONTROL OF PLANT PEST INFESTATION AND COMPOSITIONS THEREOF) - sequence listing, part 2

SEQ ID NO: 651 - DNA, 4594 bp, Heterodera glycines
ataaaatggcaaaaatctcaaaatatggacataaatttctcataattgagtgcaaaatttcttcaaatttattggttgaaattgcatatgagatacatttccaaattttttgactcggtaaggcgctttgacaaagacggctttcgttttgcaattagtcagtcaacattcggaaattggtctcgaattttttcggcaattacgtgcaatcattttaaaagaaaaaaaaacataaaagctaaaatttattaatttttttagcgcaaaatcaacaacaaaagcgaaattttcgcttttttgcttatttttgacataatttattaatttttaagaaaatttaaatttattcaatattctcgagaaattttggcgaaaaaatgattttttgaaaaatttttcgggttttgggctcaaaaaggctaatttagctgctgggggcctttagcttggtttgaagcttttaagatggatttatatatccatatttttccatattttggcattttccaaaaaaacccctattagaacggcccccatcagctaaattggccgttttaacctcaaagaccagaaaatgctccgaaaaagacattttttagcaaaattttgtcaaaaaaaattgattaaatttaaattttcttaaaaattggttaatttatgtgaaagataagcaaaaaatggaaaatttcggttttttggtcgggtttttttgaaaatttacccctcaatttagaaaaatttatgtccatatttttgccattttatgtccatattttgagatttttaccattttatgtccatatttcgcgatttttagtccatatttttaccatccctagttatgataaaagtcaaactatctaaacgattaaaatggaaaatcatacataactcgtgctatgccaactcgtaaggctccctgatgtttcgtcactgggtactaattgggtttgtatccacatttttggtcaaatttttcagaagcgtagccagacagtcaggctggctgcggcgggtgggggtcggggtcactttggcgcgggccattttggcgccgcgaactttaaagtgttataacttttttcttatccaaccaaataaaataattttgataccattaaataggcctaacaaaggagaggtacccaagtgaccatgggacttccgaatgaaactttcagggtaggtagattaccccccctttgtattataaatttttttttatttttgctaaatgaagcttctggccgagatatgaagcttttcctttttgccttttcaatatcattttcaaagaatgtaaagccaatgtgagcgtcggtggcctggtggttgtgccttccatacttttttcttcttctaaagttcaattccccaaccctgtaaataattattttgtttttttttcatatccaaattagtttttaagctttttaatattaataaatttgaacataatatttttttcatttttattcgacattaattttggcacatgtgataattttggtagaaatgagtgaagcaaaggaatttgtcacaccatgcacatctaatcattataaattccgaacaaaaagtgatttgacagtgatcaggaaaaattgttgggaataaatatttaacgggatgagaaaagttggaaaattcatcattttgtgattcaatgtagccccccttatgccaagaataacgacgaaatgaccgaaattttggagcacaaagttggaaatggattaaactttgaagtttaacaatttcatcacgatggtaaagatttacaggcagatcgtcaagcacaatgcgatccgaaatttttctgacaattgacttccaagttctttaaataaattagaagtcagatctgttttgggaccccacctgaacaaatacaaatcacatggttgtacgaatccggtacaccctggaggtattgtctcgagacatatgttgtccctggcaaagtcagttgatgatgatgggcctgttggtgctgctccaccaatggccgttttccattgaggccatgagtcaagcaacactacagcttttttgttgccgatcactttcagtaaaaaattgtcaacaaaaaatttagccatttcttttgtcataatgtgggaacggccggcaattgctgttatgttgggagcctatgagatgttttttgctttaaaaaatatattctgtttatactttgaaaattccttttttgggaaattggccactcttttcagcaataattatgagcagtggagtgtacagtaccccatgggctgaaatgatggggcaaattgtatagctatgggtggtggcagaaatgctttgtgccctgctttccactatttttgtcccagttatttccaatgtgtgaggtgaatggagttcgagctgaaatcctgactgatcactgttcagaaccaagtccggtttcagttccaggacatgttgtttgactctgttaacaaaatttgctgattgttccaccaaattttccttatcaactgaatattttttggtgacgaattttgttatcttaattgcttaaataagtgtgataatttgatcagaaaaacctttctggtaacaattcttttggctgatttgaaattcttaagccatcgtcgaccacccttgtaattttgaatcttgttttgcgattcattgttaattttgagagcccatctccgcaaatcaatgtcttttatgggcagattttcttttcttttttcaagaaaaatgccaaaaagttgggaattgagcaattttaccgccgatatgcgatcatgatatgtcgtttcaaatctttaaatgattgaacagataatattttcattttttcgcacctcctgagccttttcaaatcagcttcacatgtgatccaacgaaatcggcttttcatcgatgccaagctccgaaatcccttttcagtgccacggaaatgtcgtagggcactgattttctcggcaaatccaacatgcggggaacacaatttctttggggagggcgcataactcgatgaagatgactctaatgcaaaaactatccaagaaaaaaaggcatactgtacttgctggagaggaaaaactcccttcactatcttcactttcatcatcttcaaggtcaaattcctcgtcaaaatcttgctgatcttctttttgatcaaaaacggccaattcatccacaataaggtcttccaaagtctcaatttctgacccttgttttgcacaaaattccaatgtgttcaaaaaatcctttgccagttgcttttcctctggtgttaattgggtgggagggggggctttaccatgataatgttcttgcaataaaagaataacgtttgttggatttattggcatttatttgggaagtatttttacaatgattattaatgcgacgagagtagatgagaggaccgagaagagtagcaacgacagaattttcaacacttactgataagcaaaataggtcaatagacaaattattctctcatataaaataaaaatgaaaaaaatattatgttcaaatttattaatattaaaaagcttaaaaactaatttggatatgaaaaaaaaacaaaataattatttacagggttggggaattgaactttagaagaagaaaaaagtatggaaagcacaaccaccaggccaccgacgctcacattggctttacattctttgaaaatgatattgaaaaggcaaaaaggaaaagcttcatatctcggccagaagcttcatttagcaaaaataaaaaaaaatttataatacaaagggggggggggggtaatctacctaccctgaaagtttcattcggaagtcccatggtcacttgggtacctctcctttgttagtgaattaaggtgaaaaagcagaggatgaagtagaactgacgccatcaggaggagacaggtttttgagtcagtttaaaaaatccaattgaaaaatagtgtaactaacgccagatttgcaaaaagaattttgcttcttatgaattataaaaaataaataaaataaagtgtagtgttattataaaaaaaatatatatatatactatgaaaaaaagaaagtgttttgatgaaaatataaatgaaaatgattggaaaaatgacatttttgaacaattaaaacattttgtctcgcaatcaatttttatgagtttccggcttcaaaatattattgaagtttaagaaatgtaaaaaatagggccacaaatgcccgaaaatgttccttaaaaaatggggcgcaaatatgcgggccgcaaatttccatgacgctaaagttaagccgcaaatgcccgattgggtgagccgcaatgtcagattcgcaaatgtctagagaccctctaatgccgataattttgtatgaatctaaggatttatcctcattttgtggttttttgataggtaaatggggattttttgaaatggggatttgaggattttgtggcttattgagaaattttgaggattttttgaagcttttggggaaaatcgtcagaatttgctacattttatgattaattttgataaattgtcataatgtttgacaatcatttaatttgggtttttaatagagcatcaaaacgaaaatct

SEQ ID NO: 652 - DNA, 916 bp, Heterodera glycines
tgccacagacttttattttaaatatttgtatcactgacgcagcattttccgtttcataaaaaaatcgtaacatataaaaatgggacatgaaattgggtgagtttaaattcaactttttgcctgaaagataaagttagatgattttccaatcctcaattcttctcatcaattatgtaatatttttgccgaaaaagtaatttgacttaaatccataagtacggtggggtgtccgagcagctccccatctaccaattgcctaacgaattcaatgtcaaatttttcaagaaaaatagcaagtgtatttaatttcttttcttttttttgctcttttgttatcaattagaactgttttaaacaattagggtttgtcataatgatggaacagaaatgtgattttttcgggagtcacccccaactcatccatagacccaacagtgattggacctcaggcaaaaaaggagtaccgcgactatccattttgcccggggcaatcactgtcctgtatgtacttttcaattgtacagcatttccaaatcatttccattccattcctagtttgttttgttgtgagctataaaaacattttcaaagccaaaaaatcatgaatagagcaatcgagagctaacggtcaacctaataagaaaaaacccctgagggagagaatttaattaaatccaaacctccgggggtccgtgccgggtaccgcggggtaagcagtgctggctttggcttcatcacggcacccgaccttttaggccaagttaagctcagcgttgcctaacttgccagatcggacgctagcgcatgattccactgtaccaagcaccccaccggaagttcatcgaaacaaaaaatatataaacccctaaatttcgagtccgctcggaggcatgacaatttttgtagaagaaaaaga

SEQ ID NO: 653 - DNA, 5337 bp, Heterodera glycines
  misc_feature (5273)..(5273): n is a, c, g, or t
  misc_feature (5302)..(5303): n is a, c, g, or t
attcagctcttccaatgattgttgtcggtgcatgcctacataggaacatgtctgggtttgattgttggaaggggcctgccaggaatgatcacggggtccgacagggcaccgcagtacagatcgacagaaattttcgaaattttccatcctggctcggcttcttggcttattgcttcggacatcaattttttgaggattttttaaaaattgttttcgggatcctcatttggtggacatttaaaataaaagtgctgacatattctttaatcccaaattttttgttttccttcacatgtttttccacctcttcgtaatacttgcccaagtctgggctcttccggaaataattacgggtatttctcgagcgccttacgtcttttgaaatttcttggaaatttttcttggacattcttaaaaaataattagcataaaaaagttttcgtaaatattgaatgaaataaacaagccaaagaataaacacaaacacaaaattattttaatgatatccaaaaggcaacacattatagtcaacatcaattatccccttcttctgcactggctcgtattctttcattacatccctcgagaggactcgacagtcccttgtcggcccaattttctcaggataacgaaacacttttttgaacccatcccgatgattcaacaccatgtctttgaacaattcatagctgaattcgttcctcctgtccaacgtcatcccccgtatcttcgttttatgccaaatcacatcatctttcttcctcctcattttcaaggcgtactgttttggacccgccgacacatactccaaaatttcactgtctgaatactcacgattcatctctctgaacaaatgtttatagaaattttcaaaaaacatcttttaccccaaaaatttcccctcctccaaaggacaccgacccttcggatgagcaaaagccagagaatcttaatgttttaattttatggaaacttttctaatgtccacctgtgtcacaatacaatagcttatacccctcctccctgtagacctgctccatatactcgtacaactttacactggcagcactcgtggtccacaatgacaaaattatgttcgaaactttatgctcctttataaactcttgcttcttctggtatattgctctcatcacaccctcatttatctcaatcggtctttaaactcaatcgtgtcatctttgatgagctccgtccatctttccaaattattaacaatctcagtcacagaaagtgtgttcctcattgaaaatttcccccataaactgttcaatcccttaatatttatttgttttttgaattttatttgtttttctcaccaatttggcgatcatacgtagcccagggttaaacaccattttatcatattccaaccaaatgttgtacttggccttgtacatttcaatgaatgctctcttttcctcctcatttctcacctccgagggccagcccgacgcctccacctttattttcaagaacatgcgcacatatcctttgaacagctgactgtcaaattgctcaaagtgataggcccgatagaagcctattactctatatcccaacgccaaggatttccgcagttctatcgaggtgaatgtaccaatcaaagctctccgctctggccgatggttacattttttgacatccttagccaacacaaactctttcttcgtttttttcgcacatgtataacaattggggaagagaagcatattatcaatatgcatagggaggagaggataaagcagttcctttggggggatgaccttcacctttagcaggccatcatagggcacatcgtcgggcaccgtccaattcacatcgaattccctgctcaccacaattttagggaccccaaccggataaggggtgtcttaagcgaaggaaaatttcaaaaatgcaagcagattttttaccataattcacaaacggatacaagcttatgatatcgaacatcgaaatctcaacttcttcggttgcttttgcgtacaaacaaaaaggcattgtccgtccccccgcgtaagcatccctcggatttattggacccttatccggcacagcgtcaaagaacctcttcatctccctattttttttcaagttctctttcacatcgcattcctaaatttgttcaataatcaataaaatttgaaattggcacacccaaacttcctccaccgagaagtttttacatttttccctcaaaaactccattcgtgtctcagttcgtcggaaatttacttccatacaacgcccattgggtcctatggtccagggcaaaaaacattttggacatccatgaaacgcacatccctttagcaaaaaataaaatagggaaggaaattctgcctacctgaaattcaatgatttttttctcagctccgatgatacaatccacttttaatcccccgatttccacttcacccccattgcatgcgtgtctaagtctcactcttttgctttgagccaaccattcaaaatacttcacggcaattttgctctgattctcggctctctcataaccgccttccggaataattgggagatgattttctctcaaaaattttgttcgaaaaattctcatcacaacccccgcaattgttacactgtccttcaacacatccatcccatcagtaatctccaaaaacaattgccggaatttcaaaattgcctccatcaaaatttcgacgtcattttcgcaataaaccttgagctgctctcctaaaattcaattttaaaaggaaaacagattttctctaacctagctcaaattccattctataattttcattgtgccattttaccaatttagcacattcctcctccttcatattgtccggacaataatcttcaaggggtggtaggtgtgtcaatttttttccaaagttcacatttttgttgtacttatgagggaagtacaactttgctaaggttttcaaacccaaagtctttggaagatctgccaacttgttttggctgagcagccagaaatcccgaaaatacacaccacgcgctttcatttgataaatcttcaggtctgccatcatcaactcggtttcgacccctctttcagtcagctcttttaacacaaaatgcgagtcgaaccttccaccataatgagcaaaagcaaccgtttcaaatcgtttaaatcccaaaatccaatcaacaaattcgctcattggttcaaacccatctgctacagaccaagtgatcatccgcggaccattacaaatttcgcattccctctcttctcccacacaaacactacaagtatgcgcggcactaacaagatttggtttgtgttcgcccccttcaaccgtcgtctcgaggtcataagccacaatacggtatgctttctgctgtcggagtttgatttttttaatgaaacattgccgacccggatgatagactttgcaaattctacagaatttctccccgcacgtgtgttttgatcgtgtttgatatgtttccccaaatttgttgcatttcttgtactccctacaagctgtctttttgtgagactcgaaacaatcattgttgtagaaattccgattgcattctccacagtgtatcgcctcacaaacatccaaacaggggaacccgaaccccatccggcaacactttttgcagcgctccctacattccattcggtgacggtctttggtccaaaatgtcacctcacagcttacacaaaaatttttgacggcgaaaaattgagtaacagattttaaaccatcccaatgttcgcccactcttatcacacaaacttcgttttttcttactcccttccctttgaaaatcggtctaagtccggttttctaaataaaacaatcacacgaagtttaggaaatgttcgtttaccatatcaaacgcaacgatacgaaatatatctgggaattctttgtcccaaaagttttgcacaaattcgaggtgtttaagcccaaaagttttctcctgtgtatttatcccagccttttccatcaaaaccaatgctaattcatgttgttttttccctgttttcatgatatgtcggaatttatcacgagaaatttcacgtccaaccgtttgataaagcttagcgaactcgagtgcataaaatatacctaaatattttcataaattgagtttcatttttcttctcactaaattttccctttggtgttggaatacgccctagttctttgacatcagcaaaaaaggatgagttgaacatttttcaaagcttagatatttgaaatggaaattttaaagcagaaaaaatgtacatggcttaaaccaagttttttcatgacacatttcaacaaaaaatttatttcattaataaggcggtgggtattctggaaaatcatcaaattcttcttgttgttcttcttttgtccaataataccatgctgcacaaagaataaagagcaccagcgaaaccagcaaatacaacatgagaagcatggcaaaagagaaacccaaaaggaaaatgagaaattctgacatttttgctgcaaaaactaattaaaaacgcattgagatttaacaataaaatggcataaaaccacgaaaaactaaaaaccaattattgtacatttaatccattgtgactttcaaaaaccaaacgagatatttttaacagatttctccattcttgtttctgtgacatcagcgaattgaaagtccctctgatacgctttttagcccatgacgacatgagatgattgctcaagaagactgtagagaattttgaggaaggaagggcttcaactatttcaaacaatagctcaggtggcagtggcattgttagctaaaaaagacacggtggaattctcttactatagcggcacagaaacaaaaaaactaaaacgaaaaatgactaaaatcaaaacgaatccaattattttttcgatattttctttctggttaatttctgtgtgcgcggcactaacaagatttggtttgtgttcgcccccttcaaccgtcgtctcgaggtcataagccacaattcggtatgctttcttctgtcggagtttgatttttttaatgaaacattgccgacccggatgatagactttgcaaattctacagaatttctccccgcacgtgtgtttgtttcgcgtattgtgtgtttccccacatttgttgcatttcttgtactccctacaagctgtctttttgtgagactcgaaacaatcattgttgtagattttgaaaggcgaaaaattgagtaacagattttaaaccatcccaatggtcgccccactctatcacancaacttcgttttttcttactcccttcccnnttgaaaatggtctaagtcccggtttctaaataaa

SEQ ID NO: 654 - DNA, 6609 bp, Heterodera glycines
tgactttcaaaaaacaaacgagatatttttaacagattctttcattcttgcttctgtgacatcagcgaattgaaagtccctctgagacgcttttgagcccacgacgacaggagatgattgctcaagaagactgtagacaattttgaggaggggaaggcttcaattatttcaaacaatagctcagggggcagtggcattgttagctaaaaaagacacggtggcattctctaacgataacggcacagaaacacaaaaacgaaaacgaataaatgactaaaatcaaagccaatccaattatattttcgttattttctttctgattaatttctgtgtcgtttaacattttcctaaaacttaattctgtcacttaaatttttaggaatcagggaattttctcaaccctttacataaaacgatcaatcaacaaaaaatttattaaaaatgcatctgttttctcattaatgtgggggtgagcggggtcaattggtctcccaatccattgttgtcttggccaacggatcatttgctgtggattttgccccaacggattgacaattggaggcgcctaaataaattcacgatgatgattttgggtttgaaagttccgaacttgaagagcttcgttcctttgtgcgacgggcgggacgcgaacgatgacaggtgggaaatgccatggttggggcggcacaagatgagcctaaatttctcctgtcttagaaaaaactgcgggtttaggacctgatggggcagcggaagtggtaggccgttgattggatgatggtgatgttgaacaggcacaacatgacgcaacattggttgcccctaagaactcaaagcggtgaaatttgggtcaaaagaaggcgaaaaaggtcatgagtttttacctgatggggcagtggaagtggtaggccattgattggatgatggtgatgcggaacatgtacaacatgacgcaccaacggtggcccctaacaaatcaaagatgagaaatttgggtcaaaagaattcaaagttttgacctgatggggcagtggaagtggtaggccgttcattggatgatgaacatggtgatgcggaacaggtacaacatgacgcaacaacggtggcccctaacaaatcaaagataagaaatgttggtcaagagaaggcgaaaaaaggtcattttttgacctgatgaggcaatggaagcggtagaccattcggtggaggttggacatggtgatgtggaacaggaacaacatgacgcaacaacagtggcccctaacaaatcaaagataggaaatgttggtcaagaaaaggcgaaaaaaggtcatgagttttgacctgatggggcagtggaagtggtaggccgttgattggatgatggtggtggtgaacaggaacaacattacgcagcattggttgtccctaagaactcaaaagtttgagaaatgttggcacaaaatagggtcaaaaaacagtatccaacctgagggggcagcggaagtggcggaacattcacaattggaaaccggatggggtgttgtggggcacggagggcgttgtatggcattggtggaccctaaagcccaaatttgacaatttgtggcaaagcaaaaaaagcgatttcgatttcgacctgacggggcataggaagtggtcggacgtggagaagagggtgttggacatggtggtgcgggactgggaatacacgatgtggcatttgtggaccctaagacccaaagctgtgaatctgggcaaagaaagctcaaaagcctttggtttctgacctgacgtggcagtagaagtggtggaaaggggcggcgaacagggccttgacgaaatgccggcggcacccgggcaattggacgttggacagctcgtgcgccaatgtccagttcctgtctttgcacaatgttttggtgggcggcattgccgtcaccgtcgtcatcgtctgagcttacatcttccgccggccgattgcctaaatttttgggggataaaatggccaaccatgaaaccgtttctctcattgtcaaagcacaaactcaccctccacaacaggaattggtagtccaacgattggtcgcggagttggggccctcattcttttgggagatgttggtggagttgggtcacgtcggctgcgttgcatgttgtgccagtctttgcgccatttccttcaaaactggttgataaaatacatttaaaggaatggtttacaaaaaatcagaaacagcctctttgttgaatggcatttggtgattggtttgggatggatcgaacatttggccatagtgttttttaaagtcaaaaacccatgcgttataatacgcggaatagtcgaaatccatttttgaatttggtcagcaaagaattttgaagaatgaacgtggaaatgaatagagccgcattaccccgcttaagtttgctcctccctttgccgtgccattgcgattggctcctccctcagcacggctgtgattggctccaccctcagcccgccacggacagcaaacaataatgtgaatgattgatgggggaaatttgaatatgattttgtctttctgtgccatccctcccccatcatcgccactgttgggagtgggcaaaagaaatttttttctcaatttcgttggatgattgatagggaaatttgaatatgcctttgcatttcggtgcgcttctcccctgccaggcaccactccgttattgcccactgcgatgggagggcaaaaatggactgaaagaaaatgaaatttcttcgcaagtttagttttgattgacagttcagtgtcataaaaaagaaaatttgaaggaccaaacggaattgtcataaaaaattcaaatgcgaaggacgaaagaattgcgattgcaaaaaaaccaaaaatagtaacgatggacaaaaaatttttgtgtgtttgtgcacaatttacgttgggcaaaaacgaatgagaacaaaaaaacttgttcgtttgtgcacaatctatgttgggcaaaaaatgacgtttgtatatgattgtgttgtgtaaaacataaatgataggaaaaaattttgcgtttatgcacaattgtgaggcaaaaaataacggagcaaaaaacttgtggttgtgcattttgtgggagaaaagtgacgaaaaaaaggaataatttgcaggagatgtcaatcaaaaaccgaaatgagaaggttattagtcaaatgagcagtagatttgtgtaaaaacttgtccttggtagtattttttggttttgacgtgtcgtttgtgcggttatttaaagcggttgaaagttgttgtgatcatcattcgagcaaaatggacgtaactcttcccgtcagcaactcggcaggtgaatggatcggagaggaacggagggatggtgttgtgctctatgcgccgtggacggacgagtggcatgtgcaacagcagcagcaacagcagcagcatcaacaacaacaacaccaacaacaacaacagcaaaacgaggtgcagcagcagcaacaacagcttgtccggcgaacaggcacggggtggacgcggtttccagcatggaacgaaccgctcgttgccaacgattggcgagagaaggaggaaaatctgatccaaaggaagagactacagcgtgaaaacccggagtattgggcgcaaatattggaggaggaaaagcgagccggtgaggagcgccgcttaagggatttgcggttagagcgcacatgggatggctacaaggaaggccacttcgagcgtcggcacaatgacggctcgttttttgaggccagaaaatttcttggttcaaatcgacagaatgactttttttcattttcagtttgttgctggggtcgggaagacagtggttggaagttctggaggagggctttggtgaatgatgttggcatgggattgaaagtgttaagattaactatgattggggatggtatttgacattaatcgctgataaataaatttttcgttgagttggaacaatggggaagaggaggggagggttggaataagttggtaaatgttttttcacagaattttgggaacacattaaaatataataaatgctcacgaataatattggtccgcatagtgcatcgactaacattgtgccagcgtcaatccccctcccgtgccggcaacataagccacacaaaatagccaccaatccatccccatcctctgccggatgttggcaactaaaaccatacatctggcctatccatctgtgggtgggaggcaacttaagcctcccaatccctcctcaacccctgccgaatgttggcaactaaagccacacacccggcctatccatccgcgggtgggaagcaaagtaagcttcccaatccctcctcatccactggcaggtgttgacaacgtaaaccatacccacggcctaccctttcgagggtgggaagcaacgtaagcttcccaatccctcctcatccccctccggatgtaggcaacttaagcctcacatccgaccttttggggcatttgaatccaacctcttattctcaatccttcattggttgacatcatagccatataaacccatttgattttttgattttaaaaacattaatacaaaatatgtggaaaattaatgataaacaaagaaatgtcaatggtcggcgggaaggttaaaaaacttctatgtaattatgggtgtgtacaaacgtccttgagtgtttcggaaaaaacgagtgacagagagcaaaaattattgcttacgtatgcaaaaaacagccaatcagacaaaaaacacctatgggttgctcctatttaagtagctagctgctcgctgctgctattcaaaaatggagcacccctttgaaatgcccgtcgatttggatgattcccttctatcattggatgtgtcaccgacgaactccttccctattgatcctcccctggccgacgtagattcgtttgtccctgatttggtgccagaactgggcgacgactcggccgagtatttgtccgactctgaggaattcgaggttgagcgaatatgcggccaaaaaatcgaaaacggccgacagttctttttggtgaagtggaaaggatatccgaaatcccaaaacgattgggaaccggaggaaaatttggtcagatttgatcgttttcgaatattctttttgcccataccgttaattttagctcggttgtcagcccaaaatattacaatattggcgtcgtcgccaatacgataaggagtaccgggcccggacaaaggacgacgagaaatcggccagagggggaagaagaagaagagcaaagcgtatgaagaaaagccaaaggccgccgtggatgtggagccggatccggtggaaaaagcaaaagaagagatgggcgctacccctggggaggtgttggaggaagagaccgaaggtctggaggaggaggatgtgtgtaaaaaagggaaaccggaatcggcagatgcgggaccagaggtcgaacaattgaagaaaatgctacgtgacagtggccaaatgccgatggataatgccccactacccctaccccgctgggtgcggggtagtggggcatttaaaaaaaagtacaaaaaattgtacgacgcaatgactaataatatgggatgatgttgaatgtttatgtattgcttgttgttgcctaataaataataaaaaaatcaaaatcgaaaaaccaattagaatttaaagaaattgacagtattttgtattttccattgtttttctgtatggtgtgactcactgcccccccccacacccgccacaccaccgaaaccacacccattaccccacatttggatgatagacatttggaatagtgtgaaaataaaatgtaaataaaatttggtaaaaattgttatgatttataaattgaaaaataattattagggttaataaatgaataaaaaaatttttggtaaaaataaaatttaaaaaataaaaatgaaattgattaaacgaataaggttaaaattttgaaaattaaattggaaattaaatattaatttaattatagaaataaataaatatggaaaatggaaattaaaaattggaaacaattaagaatagcggattaattagaattttaaatataaaataaaatttaaaaaaggttgggtttggttttgaaaatttaaataaaaattaaataagtttagaaaaaatggaaattaaaattggaaataaattaaaaataataaataaattggaatggaatgaaaaaaattaaaaatgaaattaaatggaaaataaaataaactaggaattaaaattggaaataaattaaaaataataaataaattggaatggaatgaaaaaaattaaaaatgaaattaaattgaaaataaaaataaaaataaaataaaacaggaattaaattggaaataaattaaaaataataaataaattggaatggaatgaaaaaaattaaaaatgaaattaaattgaaaataaaaataaaataaaacaggaattaaattggaaataaattaaaaataataaataaattggaatggaatgaaaaaattaaaattaaatggaaaataaaaattacataaattttaaaatgaaaattgaacattaacaatttattttttgtgcagacagtcaattaacacatgcgggggggggggggg

SEQ ID NO: 655 - DNA, 8781 bp, Heterodera glycines
  misc_feature (25)..(25): n is a, c, g, or t
aaagtcaattgggtgcaatgttttncgggatttaccaatagaattaaagaataaaactgacaacttattaactgaaaattataggtgaatcagaataaaattcaacattcgggcttaaaatccggagaaaagtcaattggtgcaatgttttcgggatttacctatagaattaaagaataaaactgacaacttattaactgaaaattataggtgaatcagaataaaattcaacattcgggcttaaaatccggagaaaagtcaattggtgcaatgttttcgggatttacctatagaattaaagaataaaactgacaacttattaactgaaaattataggtgaatcacaagaaaattcaacattcgggcttaaaatccggagaaaagtcaattggtgcaatgttttcgggatttacctatagaattaaagaataaaactgagaacttattaactgaaaattataggtgaatcacaagaaaattcaacattcgggcttaaaatccggagaaaagtcaattggtgcaatgttttcgggatttaccactacattgaatacacacattttttatcgattgattttaaccaaaaggtattggcagtaatttctctgtctctagccaaaaggtattggaacacattttttttgatattattgattttttttttatgcgcttacaatagtacattattattgattttttttgcacttaacatatttttatcgattaatttgaaccaaaagattttggcaggttactgtctgtgtctctaatatacagaatattttataagtagtaccatattattattgattgatttacattattgattttatttaaatttgattttatttattgatttggtttattgatttataaaatatgaagtttttttttaaaaaaatatttgcttgttcatttttaaatttgtttgcctctttggtcttaagctatgtgtagtcatcgatttccaaaggttgtaacaaagagcattgggtttagtcataataaaacattctctttttggatgtgtgattttcaaaaaaaaattattattaaaaaatgaggcataagttgcaaattggccgcgatgttattgatatattatattttttgcgggaattctccgcacaaaacactgttttgttgacggtgttcagaaatgaaaaccgggaagtgcataattgtacttatccgcgaggtggttctccggatgagctgatcaccattcagcttttattgttgcaaaacttggcgccgtacgcctttgttcggtattaaaaataattaaaaagtttaacaaataatatatttttaggttcgatcttgaatgacccgtgcataaagaatgttgtgatgttaaatgttaaattaataaattaatttttttttattgtaatgttataattttaacaaataaaaaatttttaaaaatggaattggaccaggtaattgtaaaaaatgctgtttctacattataaagttgatgaatatactttttcaaatggaatttaataaaaataaattatttagaataaaaaaaagagcgaattgaacccgaacaaaaaaggtaaagcatcttttgccaaaccaacactttaccggttaggctaagcgcttcaccctatttttttttgtaaaaaatattggggatggttttggtaaattttgcattccttgcatcactatatccgcctcaccgggtgagatgtgtccatgtttttttaggaatcggaccacaataaaccagcatagtaaaaaagcggggaaagcaatcaaataatgggaaaataaaaagaggtgaaaaaaggtttcatttggtgttttaggagtaagcaaaacctgtgtttggcttgttgtgttattcatcttaaaataatggaaaataccttcaatatttgctatttataaattaccctaactttgaatctgaaacaatgtgacgattatagtccaccataatcatttggtcaaactcgcctagaacaaccatctctacgcctccttttgggattggtgaatcgaaggtggcccgaatggtggttgtgccgctccgtagcagttcgaagccacagctgtcatccagtgttgagctaagcggaatgataaagaatgtccaccccattttgaactgtttcattgtaatatcgcatgacctttccgaatttgccataccaagcgcctcgtacacatcaacaaaagcgcgagtgaagtggtgttgcggaaaagatagtttgtatggcacagacgggtagaccattccaccggcgtgtactgatatctcacgcaagtcaaaaggctcaaacttgaacggggttagcttatagtcaccattgaaagccgaatttgacaccatcgctatgataacgcgacggggaatggttgcactgaacacgttgtattcaaactcatagcgaccaacgctgatgaaggaagacttgatctccgttttacgaaccgcataagtggctggttgtttttcaagtgttttgtacaagctcatgttcagcgaaggttgtacctctaccatttttgcgtaaatttttacatcgtgaactgacaagcggtatttggtcgtgtcattgtcctttagcgtttgtataagaaatgaatcctttgccctgtaaattgtaaacagcaggtccaaattgtttataaggtaaagctcctgatttcccaaatcaaagtcgaggcgtgagaggaactgtgcctttcgcccatcttgaaatattttgcaacgttccttgaacccggtgtctgtggcatcatcatgtttagtgcttggttggtaaccggttgagccaaggaagtgttttttgacgtttccaggtaagctcaattcgttcgtgatgtatgctttgaagggatacaaatttccactatcatacacttccgtgttaccgaccgtgacttttaattgttgtacaaatgtcagtccaatggcttggattgccgatacattggtgtcttcggccttaattggtgtccaactgccgttagtttcaaacttttcaacagaaacttcaaggtgcagatagattcgtgacaaatcggtccacaggttgtcactgtagagacggaagaggtagggcgattcttgtgtgattgtcgccaagggaagcacttggcggaagaatgatcggacaacagagacgtttgttggaggcacagagaacagatttaatgcactgtttattgcaagtggactgtgttcactaattttttgcggacaagacattgtgtgttatcaataaggtcccaacgagtcaacacggacacgtttctttttaccaagcattggtggactaattgaggaatgcattttatttataggtttatgtctagctcttgcaatttttggcatttgctcacttttgtaccgtttgaagtcaaagccttgccctttttgggcttcaatgttgtttgccgccttttccagcaagttcttcagacctgacttactctcgttgacaagtgattctttaaggtctttaccgtccagtacatttgtcaacactcggtttccactctcaagtccttggcgtccaagtgccgtgccaatttgtttaccaattggcaacaagtatcgcatgaggcttctgaaaacggcgccaacacccgcgcctcgctgatagggaacgccacgaaaaatgttgaagccaccaaactgaactaattcagctgatgatggtgatagtgtagaccaatccacctggagaggatcaaaatcgacatgcattttttttttactgcaccttttaatcaggcaatgactattatttataatattattgttgtttgttgaaaattacctttctgacaaaggtgtttgcaattctgtcgggtgacattctggagaaatgtaaaaagtttataattttttcaaagggaaacccctggcagcgtgtgtatagaaagaaaattgcgtgtcgaccacacgcatttgagttgaaggactgaattggtattgggttgtagcgaatttgtttgtattgggccaaaaaaattttgatgtgcacacttagcggaggccaaatgcccaatgagtcatagtattcaatgtgcatgggggaaagacagtaaagtgacacccaatgtgaacctcgtgatgtgcttgggtcaacattcagtaccatacaatgtggatatactgcaatgtgattagttgggattttatctgccgcaaaacatccaacataggcgtggcgtgtgactgagttgttggccaaactgttgtcaatttcaaatgtattcatcattgttatgattaaaagtaggctaattttcgaaagtgcaaagttaaagtacatgtgccgtactggaatggcatcaagtttccactatttgtacgtatttcaatcaaaagttcagatatttcctttaccagtattctatggtattggattgctaaaaattgttcctcgacaatttcgtcgggttggccccgtatcgttactatgcgtagcactggtgcggtgacatcaccaatcatcattggctcaatgaggtcaggtgtgtaaacgtggaatgaagaaacgccgccactcatgtcgggcatgaagcgtgcctcgttttcgggcgccaccagctcggtgctgctaaacccaagaatgtaggcgagctgtgacgacattctgacgcgctgtacataacgtgggtcaagtctcagcgtgaaccggtttttgtgagtgtcaaaagtaaacttgcacgcaaatctcacctttttgtatgcctgtatccacgcctcaaggcccagttctttggtggcgtcaaggattgtgcgatcttcgtcaaacatgtttgcaatctcatcgttcaatttgtttcggccaagttcatcaagcagttccaaatcctcccccttgagggtggaaaaataattgtccagcttgttttggtatgtgtccttgtcatccatcttttctctcaacggaatttggcttgtctctgcacgtttctccctcgacacaatgccttgggctgctgcgtccatcaaatcaacagtgctgtcagtgccgccagtttggagtgcgtccaggagcacggttggctcgcttctctcgtgtttttcgtcgaatgtactcatccttggcccattggcgagcaaccgaggcggaattgttgaatgccaactgagcggtacgcgctttttttgccaacggttcgcttccctcgcccaacagcctgtacaaacttttactcagatcatcaggatttttaatatttgtagtggggacggcaatgtgcactgtgcttccggtctgccaatcaacctgcacaaattgttcttccaccgtcccaatggagggccatgaatgtggataaacaatgaccgccaaacccacttcccactcggaattgaattggattttgcgaggcagacgcacccggaaggagtttgttcggtttccatcaacacttgtgttggaaggaaggataacgtaaaatgaatttgaaggcatttttagttgctttcatttgtttgcagtttatatgtttttcgacgtgattgagttcagtggaatccagctgttgaagcgtgtgctgtacccacgccatttcacaaaaccatattccacaccgtcttttccctttttcctccgcaacaccctttcaatgtcatacatgcgctccttgttcttcagcgtcttgcacaaatcgttcgcgtaaaaccagccctttagtgtctcgttgtggtcatctcgtagacggtagacgatgggtgaccggtcggcgtgaacctccgccactgtgaacagttcgttggtgaaacggggcaagtaacctttttggaacacgtgtttgtacttttcaatacgcacacggtcccccaccttgaatttttgtactcctttgaccatttttttggccttatcatatagcatttgtctaaagctctctgcgttcttaaaatttacgtcaacaggtctcgcaccaaggcttgagttgtaagagtggttaatggcgcgcacaaagtcctgcactacatccacccatttataggtgtcgcgttcggtgaagtagcggtacagccgctccttgatgctccgatttgctcgttccgccatcccggcatggaattgtggggatgtgaacatgcaaaagtgttcaatagcttttgcccgaaagtactcttgtacggcccgggctgtaaattccctgccctggtcagtcaacagtttccacggtacatattttgcacgtttgagtaccgcgtcaaatgccttgatcatgctggcgctcgtctttgactttaccggctctacaaacagctgtctgctcagcgtgtcgatgcagacgagcaggtaacggaacccggcgttttgtttgccgagtctatcaaagatggccaagtcggcctgccactcggtgtgcaggccgggtgcgagcgttggcaaatggcggtagcgtcgcttcgcttgtcgatgaagggtgtaggtgcgctgggtggacaaaaaattttgaacatcttttcggctgatgttttgctggtgttttcgcgcttggcacaaaagcggctcaacgcttgtgaacgagacgggtgagtttgtgtccttgtacaaaaactccaacaaacgctgcttcttcttcaggctgccgaccatagctttggcttgaacttcaatgccgtactctttttatgttttttgcccttcccaaactgatgcttggtgaagaggtatttgctcagctgagcgttctgttgtgcccgttccgtgaactcgcggagcccaacgggtggatccttgtactcactccggctgtcccggtttaacaggtgggcaacaatacgctccacgttgctcgtttttaacggtcgtccgtccgcccttttgattttcccctccccggacacacccaatgcgtctgcgttgcgacggattaacgccatcacgccttgtttggtcagcgtgtagtttgcgtgcgattttgttgtggacgcagaggctgtctgttgggctgaacgtaacacacgtggactcgcgtcctcccaaaattcgtcatcatcatcatcatcatcatcatcaactcgcgttttgggctgctcatcgcccgccgactcgtcatcgtcatcacctccaccaccacgtttgtttacgatcaaccgacgacgctgtcgttgttgttgctgaagatgccgcccaaccattgtgcggcggaatgcgctggttggcttgcgtttggcttgttgttgtttttgctgttgttgttgttgttgttgtgtcatttgtaccactgggccggccaatgatgcagttgttgttggcagagcaggtgccgccgcatcggcgatctcgcgcaaattttgtagacgcacatcaactggccgttcttcctcgtcacgtttcagtttgttcagtcgcttaaactcctgctcatacctgatggacttttcctcctcatttattgtgtcgtcattttttagctggtccattcgcgcgcggaccaaccccattgggctgccgtcctgggaagcgccggaggtggcggtcaagctctgataaatttcctcggggacgagcacatagcgctttgtgtggtgcattatttcaaaaaaaaagagcaaataaaaatgaactattactatttataattttcaatgacattcccaattagcgggagcactatgctggccatcagcccagcgatggccgggaggccatcaccgtgctgtaacaacaccgttttggcagaccgtgcgctgcgtgtgcgcgctagtcgacgaagtgactgtgcgtttgttcgtaaacgctttagctgtttggctcgcaaagggacacggcccttcaaaatgttgacacaaatttccacgagacacaacagctgttcatcggaggcgtcttggatgagcgggccggcactctttgttgagcacatgttttgtaaaaagtgcacattttttgaaatcacctttgacactctcattttattggcacataaacaatcgtatgattttcatatatatgcgttctaaggcgtaaagcttccggactctcgggatgcatgtcgacgagcaggtatccaaaattttgtgcacaagcgtcccggtaggcctccatgaagtgggcggtccttgacgggaacaggtgggtggcgagtgtgcggacttgtagctcgcccgccgggttcctcatcaacaccaaataatgggagttgctacgcgcaacgcgcagttcccggttgaacaggtgctgggtcaccaatattacactaacgccccagttgtgtgagccacgggtgaagagtgtgtccaggtaatgttggcccattccaaccaccaaatcgtccaaaaccagcaatagccgctcctttttggcccgctctcggaccagctcttccgccgggacaccgttgtgtacggttaccggcacactgtcaacccgtccagctctctgcaagttgatcacattctcgttcagctccccgtaggcgtagagcactcgcccaacgcttacggacacctgtttgtccaggttgcgcaacagtcgcattatccactccgactttccactcccggtgctaccggacacgatcattgtgaatgggtgtcgaaattgcacatgcacatgttcaaattttttgtccatttaaaaaaaggcgctcattatataacgtttgtgtgtgtatatatatatatatatatatataatgtttaggtttgataaattttatttattgatagccatggatattattcgtgcaactgattggatctgctgcaacgccaacgccaacgccaccacgaccaccaacaccacagaaatgatcagcaggacgacaaca

SEQ ID NO: 656 - DNA, 2623 bp, Heterodera glycines
ctctctctctctctctctctctcgctcgctcacacacactctctcacactgtccctctctctctcactctctctcactctctctcagtttcacacagatatagagacctctacatacacgtacagacacctgtatatacagattgccccacactcgcactattctcccctccctttcactctccgcaccaccgctctccatcagtgtgtatctgtctcgcactcgctcacacacactctcactctctctctctctttcacacatacactctcatttttttatgtatgtgtatatatatatatatatatatatatatatatatatatatatatatatatatatatatatataatgtttaggtttgataaatttttatttattgatagccatggatattattcgtgcaactgattggatctgctgcaacgccaacgccaacgccaactccaccttggccacaaacaccacagaaatggatcagcaggacgacaacaataagccctcaactccaccaccagagacagctgcaatggcaacagcagtggtggtggacccgaaaggagatgaggaggaggaggaggaaatcaactggcttcgtctcatcgatgaggtagagcaacaggagcagcagcaggagccgaacaaggaggaggaggaggagcagcacaacggggaggagaaggcggcacaaagtacaggtggtggtggtgacggctattttttttaaatttttataaagacacagagaaatgtgcttgtggagtggtgagcggcagccgacagcaagtgtccctggtggaccacctgtgcaagcggttcaactgctccgcgcacgagctgaacgtgttgttcaaaagtttggagcaacggcgtgcgattgttgggcacttgcgcacagcacggttgcgcacctcccatcttcgcccctctgtccgcaactttcctgtgcgctgcaatgagctgtccgtcctggacgcacactcggcgcccgcctatcggggctaccttggaattactgtgagtcattgtttttttttttggtttatttttccattattaggttcgtatgcactactacataaagcacggcatccgtctgcgccatcccaattttccatgtgttgttgaatttggaggcggtgatcacaagaccttttttccgcttgaagttttgagtgttgttctcgcataggtgaaaaataaatagtaaatgttttctgttgtgaattgtactgttgctttcaaaataataaatgatgatgatcttcaacaaccaaaatcgctgacccgtcaacaatttttggccatcgcgcaacatggagtgaacacggaatattgcccgagccgcttccacgccatcatcatgcgcattcgtactcgcgccgggcggacggtggccgcgctggtgttccgctctgcgcgtgttgttctgaccggagtcacgcacccggacaaggcacagatgtttgcacaaagggtgctgcgccgcctccagcacactcaacagcacatatcaacaacaacaaccgagcaccaccaccaccaccctttcgtcatccatcaattgcgtgtggtcaacattgtgggcgtgcacacgttcgggcaacgcatcagtgtggagcgacttgaggcgcacatcagagctgcttttggcggcggtggcagcagctgcatttatgagccgagcatgtttccggcgctgcgctggcgactgccgtcaatcagtggtggcgcaactgccacttgcctcctatacatctcgggcaaagtggttgtgacgggcgtggcgaccatgtctgctctgcgcgccacctttgcatttgtgcaggacacagttgtgccaaactattttcgataaattttaaatttttttttatattcttcgccgtggataaagcggcggattctttccgtaagaaacccgtggataaagcggcggattctttccgtaaaaggcggctcgtcgtccggcggagccggacgaccccccccccccctcccccctgggcggcggcggcggcggcggggcaatgccaaacatacaaataataatactagcaaatttatcatcatcatcatcgaaaccacccagagtggccaggctgggttgggtcggggttctgtttgggtatcatcatcgtcatcatctccaattcctccatcatcatcattggttgtgcctgtgtttgttgttgttgtggtgcttgttgttgttgttgttgctgctgctcttcttggtagccaaaggggcgcgtctgcatcccaggccgcacacgtcccttggcgtagaagggccggtagtccttgtgcgcctcgtgcgtgtacagatccgcgtgcacactgcgaccaatttgcggaaatgtgacgcggatggcccgatgttcaccaccaccaccactcccgtacacgtacaggtcgtcattgtcgatcagatcatcactacaaaaaaaattaataccacaaatagcgcacctacatgggtccgtctatgttgtaggtggccaacgtcagctccttcatggcgtcaaagttgagcagctgctcgacggagtaggagaggcggaaactgcgcaccttcagattggatcgctcatcactgccgtcacggaaggtgtgccggatg

SEQ ID NO: 657 - DNA, 2474 bp, Heterodera glycines
tctttccgtagaggcggctcgtcgtccggcggagccggacgaccccccccccccccctcccccctgggcggcggcggcggcggcggcggcggcggcaatgccaaacatacaaataataatactagcaaatttatcatcatcatcatcgaaaccacccagagtggccaggctgggttgggtcggggttctgtctgggtatcatcatcgtcatcatctccaattcctccatcatcatcattggttgtgcctgtgtttgttgttgttgtggtgcttgttgttgttgttgttgctgctgctcttcttggtagccaaaggggcgcgtctgcatcccaggccgcacacgtcccttggcgtagaagggccggtagtccttgtgcgcctcgtgcgtgtacagatccgcgtgcacactgcgaccaatttgcggaaatgtgacgcggatggcccgatgttcaccaccaccaacactcccgtacacgtacaggtcgtcattgtcgatcagatcatcactacaaaaaaattaataccacaaatagtgcacctacatgggtccgtcaatgttgtaggtggccaacgtcagctccttcatggcgtcaaagttgagcagctgctcggcggagtaggagaggcggaaactgcgcaccttcagattggctcgctcatcactcccgtcacgggcggtgtgccggatgccgtagttctttgggcctccggcgacaaactccacaatgcgtcggtcggtgcgctcgcgcttcatctggcccagcgcctcgccctcccgcacacattggccgccgcccatccggttcacgtagtagattgagtcggtgtctgcaaaattttttttgtttgtaacgaaaacaaagaaacaaacaaacaaaccacagtagagcagctccgaaccgtccagcgccagcacctgttccatgtacccgtaaaggtgcagtcgcgcgtacgacgtgacgtagatggccacgggcagacagttggtgggcggcgccttggcaaactctggcctcttgcgcaccacacagcggtccatgcggtccgacacgtgcacaaagtccagcttgtccagcgacggatcctccagcagacggtggaactcggcgggcgtgcgcgtgtaccgcacctcggtcccgcccacacgctgggccaactttcccctgtgttgtgcagtgtgtgtgtgtgtgtgtgtgtgtgtgtgtgtgtgcgctgacatcaccaccaccatcataccaaagggagttggccagtgtcttggcgatgaggcgcaggcccgggtttggcgccattttgtccgggtccagccggattccctctgtgcgctggaagtcttgcacaaatgcctggcgctgctcctcgctgtcgcaaccttcaggccagccactcgcctgcactttgagccccacaaaggtgttcacgtaggagctgaacagcgttgtgtcccactcatcgtagtgccacaccttgggcgtgggtgagagtgagcattgagcacaatttggtcatgctcacttcaaagaggtcggtaaccatgtagccgagctgcaacgccctgttgagctccacctcagtgtatgcggtgacccatgagcgctggtcgtcgccgtgccggcacgggcgttgctgtctccgctcggcacacgtggcacacagagggaacgtgaagcgcccgtccctggtccggtagccgagcagtggcacacggacgtgccgtggggccagcactcggaccagcaaaagaccgcggaaggtgttgcattccggtctgctccacggcagaggggcggtcggtggacggagcagcacctcccgggtcagcacccgtgggttcccgacaggaaatgggttgaccttctgcagtgcaatttgtgtttgcgtataacaaaaaaaaaaaatgtaaacagaccatgacataagggtagaggctgaccacgtcaatgcacaaaatctcctccccttcggcacacacgtgatggagcttgaacggctccgtacgaccacccctcaacgcgtcgctgcgtgggtcaagcggacggggcacaaacacatgctcataccgccccctcagcgccgggtccctacgcagccgctccttccactcacaggcccacaccgtgtgcagctcacagccgtgttggtgctccagctcccacaaacgccgcaccgtccgctcgtacagatcctccgccgtccgaccggcggccaaccgttgttgccggttggggaagcactcaacacatcctagcaataaatttggatacaaaaaaaatgggggctcccaagtgcgcgaccgtgatagtaacagcccatccactcgatggccatcgggcgaaggggcggctcccgacgccaaaggccgtccacccgatacccgctgtcctcaatgtgcgcctctccaacggaccagctcgcacactgcacctgcgccacccggatgctctagctcaaagaaagcgaatgtagcgcctcga

SEQ ID NO: 658 - DNA, 2923 bp, Heterodera glycines
agaaacaaattgaacagatacgagatcggtatccaagcgtccgacatgcgtaaatgagtaaaaacacgccgaataatgttttggtcgttgggtttataaattagataattaaagcggacgtcacttgaattggttacaaaagttagcgcacgattcccttttgcatagtcgccaatgtgaaatttatagatgcgctggtctctgatcacaaacacatggttgtccaccaaagtaaagtcgcttttatctggtggaagaaaggcgacaaagttgctcttcaagatcgtatgtgcggaagattggttttttcgaagccaccaatgctccaggtattcaagctctatttcgctgatccgcctctgatgcttatcgatcagaaacaagcgacccgagaggtgatcaaacacaacccgtccatgtttggacagtcgttgcacaatcttctgctggtgaccacggaagatagccgtctcaccagattctctgtcttcaaaaaggttaaaactatacccattgtattcaaaacaggccaatggtgacattttcaccagtgatttcattttgaaaaacacactctgatagctgtgcaaagtgtacacattttgaagtgaaacggcccattcgctgtcacgctcacacttctctattcggcatgctgtattccaactataaccaaagtgttgtgctgtcgcatcctttgaaaaggtacgatattttccgctgtcgaaatagttttgattgtcaaccgtcaaatccacatttatcagctcagagtgcaacagtaacggcacatagctgaggactagacccacgtaaaaagcattcataaaatgaaccgtcatttttctcactgttcaggaaacgtgagcttttatagaccgttgaccaagtttctgacaaaccatttcaccaggtaatctgccatacttcgagtcttgcgcaaagtctcaatcacatggcagaaaggaacgccagaacatcggcttgccaaaaaatatatacaaaaatggccacacgtatcggatgtgggaagttgaatttggtctttagtgaccagtacctctttaaatgtgttgaggtaggcggctaaatcggggtttgggtgctcaccaagactgtcaaaatattccacccctcgatggcttgaagcatagcaagccacccaatgctcacctcgtgtcccttctttgcccgtattcacgaccatacaatgaggaaatttagaaacacgcttcggaattcgatcagatgggaaaacgccaatgaatttatttttggtagggcgcagccttttcagaattatttccaactgagctgaattcattgatgcttttcagtgtcagtcaattgcatttacacacttccgtctgtactcagaacccggtctgcgttaatggacaacacagaatcgaattcaccaaggacaagcatctcatatccatccgcttttataggctgctcaaattgcacctttatcgtgcacgtgccttgtctgatcagctcaaaaccaggtgtgtcctccagagtggaggtcaacggaatgacgaaaaaggcccaaccgttaagaaaacgctgcatcccaatcgagaccgttttggtgtcggagtcatccaaacccaggcctgcgtacatgtctacaaatgcacgaacaaaacggggctgtgcaccatcgaaggacagcaaatacggggtgctgggaaaggtctgtccgtttgcttcaacactaattgaacgtaaattggcgtgctcaaacttgtagggcgacatttttcggttaccggaatatgcgtcggttgaaacgaaagtgcaaattaggcgacgaggcaacgtagaagtgaacacgttgtgtgccagctcggtccggcctgtgccaagaaaaatggaccgcatctcaattttacgcaacggatattttgctgaagtggactccaattgtcggctaatggcaaggttaaggttcggtgtgacgtccacagtgcgcacatagagacgcatgtcatgcacacggatacggtactctttcttattttcctgtagtgtaccatctggttttttgtatgggggcgtaagcaggaggaatgaatcattgttgcggtgtatggtgaatattacatcctgattgttcaacatcaatgcattttgacgtgccaaatcaaaattaagttttaccattgtctcacattgtttaccgcctgaaaaccgtgccgcacgtgcggtaaatcctgggtttgttgcgctgttctggtcatcatcgtcggggtagtagcacgatgcctcgtggaaagccttacgaatttcctgtgaatagcccaactccttcattatgtagtcacggtagtgataataaattgaactgtcaaacacctcaatgcctgaaatgttgaccttcagcgagcggacaaagctgctaccaaagttttggatgaccccagcatgtttatcgtttgcgtccgtgtcactgagtgctacccattctcccgcatcattcttccgttcaattgagctgagcaggtacatgtaggttttgctcaagtcacaatattgactgtccgagaacaggcgaaataaatatggacctgtctgattaagagcagacagaggcagcaattcacgaacgtttgtcttgtttatggccacatttgttggcgatagagaaaattaagacagacttccttctagaccctcaacactgtctttgtcaatcttcttaattacgctcattttctactgttttttttttttatttatgtttctctcaaaaaattgaattttggaggagagaatgtatctaatagtgaaaaacacaaattatcatacctatttataggcttcgcgtgggtgccacactttaatgtgcaaatgtgagctgatcgatgatctgtcgtttccctctcaatttgccagttttggtattttttctatg

SEQ ID NO: 659 - DNA, 5432 bp, Heterodera glycines
  misc_feature (60)..(60): n is a, c, g, or t
agatcagggtggatattttgccgactgattgttgtaaatgcgtgttttgtgatcaaaccncaacacataggacagctgtttgctcaaatcaacgtgcattactcctggggcccattctaatgccgaatcgctgagttatttcattgtaagcaaattcagctgccattttggattcacgctgttgtaccattaactgcccatgctctccgtggagcacttcttcgatgagtttatatgttgaaatgcggtgttgactatcgttgtctttaccttcttcttgtaacatcttctgctgtgcatgtgttccatcgaccattcggtccacttgttcgtcaatcagcttttcaattattttctccttccttctctctgtcgctaccgttgattgcttaacaacaaattttgggttattggaagacaacgcggctgcttgaggtaaatttccaccatcttcagcttgagtcactgatgtagcagcatcaccggactgttctaatccacttaatggcggcgtaccgagttcatttttatcagcaatactattatcttgatctgctaaattttgttcagctggcgtctcggatgataaaatagcggtggcagtagtggtggtgttttggtggttatttttactattgatagcttcgtctgggtttgagggctcatctggtgaaaaggagtctgttcgagtggagctagtcctatttgacccctcagctacagcactgaggcctgagttagctttccctgtctgcgcatctctttttttagcctcgtattccaaagctgcaaaccgtttacgcctgtagtcaatcagccgttgaatgctctctatttgtcgctgcagcgaatccctttccgttgcgtcagtttcaaattcaagcttttccctcaattccctcttcttagtgtactcaagttgaagcgcttcataatttttctggattgcttgccagtaattaacaggattggcttggaagaattcttggacgaaggttaggttttgttcatggcttaaacgttcaaaatcctcttgagattttttctgatcacgttgcaatgctgcgttgtttaatatttccatctttcttccaaaaacgtgtatggaatttctcattcgttcagtttgtgaattgagctcttcaagctttttcaaatctttaactccttcatactctcccatctttgtctgtagatctagcacatctcggaggtaacttgacctccattcgtccagctgctctctataattgtcggggtatcgggcaaagaaacggtcaatgagtctttgttcattggcttcttgctgctcaccgtcccttctcttcgcctcttcttcaatcaaatgcaaatgttctttcagaaaagtttctcgcccctgaaagaccccaagctccgtcgaaagaagtgtttttcgttcgtcatccgctgttgaattgtactcctttgtcattttttcaaccctttctctgagctgatagtgtttttttctcagttctccaatctgttgccagtagtcaaagggatttcgagtgaagaaattctctacttcgataactccagcgcctgattctgacaattcggtttgtcgtttggctcttttagtgggtgtaccatcatttaaggatgagccgccaaactttttatcgtaagcattctggattatctgattcagtgttttttgtaaactttgtacactttggaattgtacatttggaattttcactgacaaattgataaacttttgcgattccacgtcagaatttccggcatcttctctgtagttaggattaaccagtttgacagagatagagtcatcctcgtccacactgatcgacgggaatgaatatggatagattattgctgataatgcgacggaccatttggagtcaagctctaaggtgtgcggaagtctaaccgtaaaatttgaagcagtatttcctggaccaggtgtgtttgaaggaattacaatgtaaaaatcatccattatttagctttgttcaaatgctcgtcgtttcactaagtctgaatcacggacccagctgttgtatctgtcagacaagccaacccaacggacgaaatgttctttgactccgtttcgtgtacgcgattttagcacttctgcgcggtaggtacccttttccgttgtctttacaagttcttgatcgtagaaaattccctttatgtcttctccgttcaaatcacgtattctgtacgagtgcgggtctgtattgtttacacgttggaccctaaaaagttcgtcagtaaaattgggatagtaaccttttgaaaaatgacctttctctttgctaattcttacaatatcgccaaatttgaattttgcgcttgctttgatttccttgtcaccggtgtgttctttatataggcgttttcttaacgccgaagcattcttaaaggttacagaagctggacttgtaccaatggtacggtttgtagtactgttcacattatttgcgattttatctatcacccctaaccaccttagagtattattttcactaaaatatttgtataagcgctctttcagtgttctattcgcccgttcaaccacacccgcatgcaggctaggactgtacattatgtgtttgattatgtccttttgcttccaatattcaatcatccgttttgcttggaactccaaacctgcatcactgtacagtttgttaggcagcacccctgcttttttgaacaccttttcaaatgcttcaatcatgtgttcgcttttcttcgactcagactctgcggtaaaaatttttctactaagcacatcgatacaaaccaaaatgtagcggtaaccatcattatgcacccttaacgtatccataatgcacaagtcacattgccaatctgtatgcagaccactcggcaccgttttgagcctaggaaatttgtttctccgtggcttaaacaatgtgtaagtgcgttggcgatgaagaaaatcatagacattgtgtaaggtaattcgaggatttcttctcttggcctcctgccaaacttttagcataccagcgtagctggccggtgagcgtaaatcgtaataaatttgttccaataatttatccacagtcggctgctgtgctattatagtcttgcccataattcaggtttaaatttgaattttggttccattctgtgtaaacctcgcgtttttatagacgatgaattcatcatattgacaaacactatttttttctttcccattttcttcacagtgctgtgccgccggcggccttcccccgtttgatgtattttttgaagcagtttcatcatttccgggtcttttgagatgcgctgaatgaagaagcgatggcctctgggcacatcttcgcgctgacctgtcaaatgctttaacgattcggtgaaatgagagcctgaaacgggtttattgaaattagtcaaaatttctccgctgctagcattgacaccgaattttttgagatccttcccgataatacccatcaattttgggaaatttttcggactggtccttaatgaaatggctggcgtcttttggtgtggcgttttcctcgacgatgtagtagcagcatcagcagcagcaggctcaaactgatcagaggcagttgaaaagtctgtgtcctcttctacatctgtgttgctcttacttacgccaccatacgattgaattgaagtcgaattgcggtgttgtgcgttcacattggacggtgtttgttgtttttgaatgcccatatacggcgcaacgtttggtgctgtaactgagccactctcaacaattactttttgaggtttgttctcaataatatcttttagctggtgtctacgcttgtacaaccatgagtgacgcttcatttttatttctgcgttcgtttttggatcagccagattattttgaatctgtacatcaagcagcgttttttcgccctgtaacgggtcggctagaggaggagatacgccgctgctccctttcagtagattaatgagggccaaatactcgctctctggcaccataaccatctttttagtatatttcattgactcgctattgtcaggccgtaattttttcgaccaagtgttgagctagtgcaccaagaataggtactaatattgcccctaatgcaataccacttccctgttgtagcctttttctcgcagtcttttcgctacgcgagcgtgcaattgcacgataatagtccgcgtattcggccaaccgtttcctctggcttctgtttaggctgaaattgaattttaatatgtttgcacaaatttcaacaagtcctaatatttgttcggctgtggcgtctcgcagaagaatgtttttctttttttcggatttcgtagaggcgatttttttaaaaaattctgcgttttcccttatatatggactgaattcatacatttgtagtgacaaaaacagattttctcaaccttttataccctttctctattcaattggtaggtacacctcacgctgttcatctgggaaaattttagttgttaaacgttcagactcgggcgcattaggatgcatatttataaccaaataactgaacggttcgctggttgcatcattgtatgcttccataaaataatttaacctcttcggaaagagttgagatcccaccgttctgacctgaagttggccagaaggattccgagttaaaaccaaataatggctattggctcttgcggtacgaatattgcgtccatagagactttgcgttacaaaaatcacacttacgtcccaattatgggagcctcgggtgaacaataaatccaaaaaatcgttgtttacgctcagcatcaggtcgtccaggattaaaagcaggggtttaggcatactttgaaccaacgtttgggtcggtaccccattatgtgtctcaattccttgtttcattaacccgatcacagaatcgttcatctcggaataacaatagagtatttttacaggaggcggtgcgatcagtatgctataatgttttaaaagtttcaataaccattgagtttttccacttcccgtagcgccggataaaattaatgtaaacggcgcgttgaacatttttataaaatttatttgtgcttttttttgcatacatatttccctttaaataggcataagggcacaaaggtcatctggaccccgtctccttcccattttgactcttgtgtcaccatttttcaccatatagctgataaataacctttttcggataactgtgccgctgaccgaatggtagtgtttttgattcgactctcgggttcgggtcctgttgcttgttggtgaattaattttaatttaatcatatatagatgacatttatcctttttcgggtaactgtaccgctgcccgaatggtagtgctttggattctacctcttggattcgaatccatctgcctgtgagtgattaattgaattaaatcctctcattggctt

SEQ ID NO: 660 - DNA, 2957 bp, Heterodera glycines
gtgtggtgatggaaaccacaaatataaattggtgcctctttcgtcgaaaatttgctgatttgaacgaagaaaagcgatgacggagtgatcgatgtaactgtgaaaatggaaggaatgcttttattgccataaagctttgatttttatttactaaatctcaaggctcttaaaaaggattttgctgggcaacggacggtcgggcaatggaaatggcacacatttgtaatcgaaccatacaaacagcttcggttcaggtcctttgtccttgctaatttcgattggtctccaaattgtcaattcgcttttgccattgaaatgtttgtccaccaacgcattgaaacgtggcgaaagaagtgccaatttgagaccaagttgaggacggtcaaaagaggggaaaatgtccatccaaacgtcgttgcaaatccaactgaaattatggaaaaacagtttagttaaataaatgacgaatttgtgtgacttttaaaatccttttaccgtcggttcatttttgaggcaattagcacaatttggccaaattctgaatgatgtcacacaatatatagcagaagaattaattgagttgggtaaagcttggatttttagggttttcctatttcttgacgtatattatcagggaacggatttatatgtttttactttttttttgcgcatatgctatcgcatgaaaatctcaaaaatagcatttttacctgttttcctttcaatcagagcgagtttttagcacatataaaaaacatattttggactttttaggaataaaaacatattttggggtttcggcagtttttgacacatattttggcgattttttggaaaaattaggttttttttacaaaaatgtcttttttggcactcaaattcgtggtcaaataaatgcccaataatttttcaaaattttcttttttttgtatttttttgacccttttcatgactttttcacttttaaagcaaaatttgatttttagcgaagaaattccgaaaaatgagtaaatctttgagagcgaaaaaaaatttacgccaaaaagcattacattaagctagcgaaattgataaaaaatgagacttttttgagaaattaacttattttttgagcagtttttttcaatttttggcacatattttggccttttttttgggttttagcacatattttgggggttttttggcacataacacaaattgcagagaattaattgcgttggaaactttatttttatggtactaccgtagagttgagcggaccgggaatgttgggcaaaaccgggaccgggacctgagaagccgggacgggaccttggttttccgggaatttttaaattcaaaaaaaaaatcaaattttaatttatttcaagtgaaaataacacaaaattaatttttattttgctatttattttataaaatctaaaagttaaagctaaattaaattaatgaaatttttaaacgaatttacttcagttatttcaaacaattaatcattttggactaaatgatcgaataatcttagaaatccagaattgcttttcacataatttttcggcgcgttttttccaaaaaactttttgggaagaaaggggtccggcggtgcagttaggcgccgccggggaaaaattttgaaaatttgagtgagatttgtttacgaatttcaacaaaaaggctggttttttggactactgggctcaatttgtatggattttctttaaaaaaattataaaatatgcgcaattaaaaaaaagtatgaggaagcatagcttgtcgatatgtaggaacccatgaacaaaaagaaaatcaaaatatttgaatttctgcagagtgattgaaccaagggaaagaagtagaaaatcaagaggattccatattcgtgatcattgatcagcgacctcggaaacccccggcggatacttgttttctgaactttttaaaccaaaaaaagaatttgaaaaaatgttgaccaaaaatgtggatacaaactcctgtagtaccatttttataattagagaacaaagcggaaaacaatgaaaacaaaatttgagaagctcgaaaaacagaaaaagggaacgcaacagaagaggagaggaggaccaccaaagagaatattttgcaaaatgatgaccatttgccgggcgttttaccttatccccccacccacaaatcaatcgatcaaataatcaattggacggatagagggaaaggatgaaaatagcagtggggaaggaggagagacggaagagaaagagaggaaaaggaaaaattcgacggaagaaggagggggagaaagaggaggaaaaggatgaaaatagcattggggaaggaggagagacggaagagaaagagaggaaaaggaaaaattcgacggaagaaggagggggagaaagaggaggaaaaggatgaaaatagcattggggaaggaggagagacggaagagaaagagaggaaaaggaaaaattcgacggaagaaggagggggagaaagaggaggaaaaggatgaaaatagcattggggaaggaggagagacggaagagaaagagaggaaaaggaaaaattcgaagcaagaaggaggggagaaagaggaggaaaaggatgaaaatagcattggggaaggaggagagacggaagagaaagagaggaaaaggaaaaattcgaagcaagaaggaggggagaaagaggaggaaaaggatgaaaatagcagtggggaaggaggagagacggaagagaaagagaggaaaaggaaaaattcgaagcaagaaggagggggagaaagaggaggaaaaggatgaaaatagcattggggaaggaggagagtcggaagagaaagagaggaaaaagaaaaattcgacggaagaaggagggggagaaagaggaggaaaaggatgaaaatagcattggggaaggagctaaatgggaagagaaagagaggaaaaggaaaaattcgacggaag

SEQ ID NO: 661 - DNA, 6681 bp, Heterodera glycines
  misc_feature (6652)..(6652): n is a, c, g, or t
aacaataaatcttaccttttttgtattttgttatattaattaaaaagttaaataaaaattttaattgaagcatttaaaactcaaacaaataatttaaaaagcagacgataaaatttaccaagaaaaaaaaacagaaaagcttttacataactcctaataatgggatttttcataaaataattataatcttaaaattaattcaaacaatacgacaaaaaactttttttattggttaaaaaaatattaaacataatgatatgataaaatggttatattaatatctattttctatttcataaataatatggccaaattattcatctaagaaattattattaaattaaaaaattaaaccaatttataaaattcatattgataaaaatttaagacctaattaattgaattctagtaataaaagaagcctccgaaatgatgcgagttttcgatcatgagcatttataatatggcatacattaatgacgaaattgaaaaactcacataaattgaaattcatcactatatgtatttattaaatgtaaataatgaaaatataatctatgtcttttaaaaatcaaaaataatttataaatttaaaattaatatacagagtgcataacaatctataaaattaattttaaagaaactagcgcaggcgcgctcgcttcgctcgcgcacttcgcgctagctaaaggttaaaaaaatatttgtcatccttatccaacttgcctcacgctctatttttttctctcatctctttgtcgactcttttctttctctcgtctcttcttaatttactatttttccatctaacctcttttctttctctctatcctctttctctcatctctttccactctctctctcctctctctctctctctcctcactcttctccccttttatctttttttttctctctctctctctgtttcatttcattctatctatctctttcctctctctctctctcctcttttctcttctcgttcctctctactctttcctctcttttctttctctatctctcttcagcacctcctattttctctctcttcttcctctctttatcctcttttcttttctctttcctctctctcctctttctctctcttatcttttctctatctcttcttttctctctctctctccagcacctctcttttctctctctctttattctctctctctctcactctttccttttctctctctccagcacctcctattttctctctcttcttcctatctatctctctttcctctctttctcctcttttcttttctctttcctctctctctcctcttttatctctcttatcttttctctatctctctctttctctctctccagcacatcctcttttctatctctcatttttctctctctctctctttctctttttttctttctctcatctctctctttccttttctctctctctccagcacctctaattttctctatctctctctctctcgtcttttctttttctctctgtttttatctatcctcttttctttctccctttcctctcttctctctatcgtctctttctctactctcacttttcccatctatctctcttttctatctctctctctatttcatatcattctatcgctttcctatatctttctcgtctttctctctctctctgtctccaggcctcctcgtttctctcttctctctcttctctcttccgctttaaattgggtggcttcaaaagaagccccaccaaaattcatggacggcggattaaagaaattcgtagcataacaaagtgtacatttcactttgttagaacagctgaaaatttggctacgaggggagctcacccatgtgaactctccattaattcgctatggtggcatggcccagagtggcttaagttgagccaagtatgttggccaaatgaactcttctttgaaataaaagagaggacattcttgaactcccaatagaggaagaaaaagtctttttaactcatactcgtatagagtcaaaaaagcaattatttgatgcaaagagacaccgttcttggaccaaattggtcaggacagttctctttgtaatacggtttctacatttaagattaataaatggaaaagacccacaagagcttacacataaacaccgtaaagaaatcgtaaagatttctaaaaacggtccattcacagcagaagatgttctgttagctgaatgtcttctaattcgtctgtatcaattaagtgatccagatgaattcactaaagttccctcacttatcgatagtgaagggatattgaggttgaaaacaagattgggcaggagtgatcaatcatttggattcacttctcccattctccttgggaaaaatacccaagtaagagacttaatcataatgaaatgccatgaatagcggcatcacctaggggtggatagcacccttacggagttcctaactattgggtacctcactcgcgaacagcggtgaaaagggtactcaaacagtgcctccgatgtcgaaggatgaatgcataccagtttgcattaccaaaaaagcctccactgccggaggaacgtgtctgccgacaaatggcttttaagtcaattggtattgactttttgagaccaatggagacacgattggcaggacataaagtcaaagcattgataattatactaacctgcctcacacgagagcggtttacttagaagccatgcttgacacaacagcggaatcttttttaaaagtcctccgacgattcatcagtcggaggggaaaaccagatttaatttggagtgacaatgccacttcatttaaactgtctcaaaagacaattgagcaattgacaactccgaaaggagttggacaatatcacgaggaattccttgcacataataaaatgaagtggaaattcatcgcccaaatcagtccttgggcaggcggcgtttacgaacggcttgtccaattgtgcaaaaattgctttaaacgtacattggggagaagaatcctcaagtacgatgaacttaataccttcgtggccgaagtggaggccacacttaaccatcgaccaattacggttgtgtctgatggggaagatggcattcagccacttcgccccattgatttgcttcaaccagatttgcagatcaattgggagataacagcagaagaagcccatcccaatgataagcaaatctcttcgtctgagagattcgctgctttatttaaagcaaccagagaagctcatgaaagcttctggcacaaatggcacaacgattaccttctccttctaagggagagggaaaaatgggatcacaaaggtcctcatcttcaggataagggagagccaaaaaaggggatgattgcggaccgcctcagttgtgccccggcacgtttgggccccggcggtttttggatataacttttttatttgtcaaccaaagccaacattcttggtatcattcgaaagccctaagtgtgctctattagcctgcacaattttgaaaaatttcgttaagaattccggttgtttatatcctaaattcgcaagttccctcaaaacaaaatgcgaatcataccgccctaaagaaatttttaaatccttgtaaattcatttattccttacccccaaaatgtgcatatgcatatgtatcatacttttcaagatttataatccatttaacaaaacaatttagggggtcaattccatccttactacaccagtttaaatgacgaggtcccgtcccacaaatttcgcaatccttaatttctcccaaacataatgaacagataaatcgggcactaataaaattgggcttatgaatagtctcttttcttaatgatttttcatcgaaaatcgtattcgtctaaattaaaaaatattgttttacacctaaaaaactaaataccgtgtattctaaatcgtaggcaactatcctataagatgccatttttttgttctcaatttttgcataaaacacattttttcggaacatgtattaagtgacattttctgcaatgtttttgatctaaaattttataaatattttaatttatgtttttaaatttacagcagctatgttctgtatctgtcctaaattcgcattgacattttgtacatttttgatacaaaaaacaaattttatttttgtgatgctcaaaacaatttttattaaaaaaaattctgttacatttttcgcagttaaatgtatttctttacggggggcatgggaaaccaaagcgttaaattttccagtagaagattacttttttattgttacctattctgcagcattttttgcacctctcttcatactccaaactatgtttttcttctctttgatagggtttttcacagcttatacaatatttatttttaatagaaaaaaattgtccaatacttttaattcctaaaaaatgttttattaccaaaaaaaatatataaacccaccatcccaatgatttttttcatgaaaaacgcacacattatattgaccggggccattccccttaaaaatcggacgaagtccaacatcccttgaaaaagcaacaattcaaatttccccggaaattttgagtcctaaaaatctattagtaatttatttaactattaatccttaaagtttgaagttttacctacccaaaaatcctgtacaatttgcaaatgcttaagaccataatttttcccatccatattaatttttgcgtccagcattaattttgttacttcatcaaatctaattcgcaattatttttcgaaattgattcattgaaattgtttcctcctcagttttattaattagttgataaaatctacttaaaaccaatgcataaaataagcctaaaaaattaaaaataccaaaaggaaaacaaatcgcagcgatagagagagagatatttatctagagagagtgatatttcatcacgagggagagatttgtggacatttaaaataatattggcaagcacatagctataaataaaacgattaattaatctgctgtcgtggagcaatataaaatctaatctgtggaagtttgtataaatttaatatcatgtttgcctaaattatttgaaatcaaaaattaaataaataaaatattaaaagatgctactcaatgtttaatattttcattaatatttgaaaacatgtaattttaccaatacctaaaaccaaactttgaccgatcacgtttaaataataatttttcaatgttaaatttatattaccagaaaattatcaaatattcagaaatatctaaaggattctcacattaaacctatagacctcccaatcgcactttatatattatcaaaagtatgaaaataattgaccaatctaattttaggggacttaaatttgaatagcaattgtcttaaatgggaaaagaacgagctcaatttgaattacaaaaatgtaaaatataaataatcaattcatattaaataaatccaatattaaagtaaaattggacatcaatcatattggatactatagattattattaaagaacaaataaataaatatgttctaaaatgatttttcgtaaattcatttttaaattaaaattttattataccaaaagttaaaaattttctttattttgataagcatgctcatatcactcaatttcgcgtcgcacgaatgtcgggagagagcgtatatttaaaaacaaaaaataagaataaaaataatttttaaagatttaataaataaataaaatttaattattggaaataccctatcagtgataatattaaggtaaaaaatgcaatttaaaaaaattaaaaacagcctattttgataacaaataataaatagtctatttcttcctagttctttaatttcacagtaatccagggggttaaatccttaaaaacctataatttttcattattttttaaatttttacctgcccctcgaggtgtactatatgtagttataatgcatgagatcggcgcatgcaataaatcatattcgctgaatgattggttaagaattttccaaccaattcttttttcaacatggttttttcaatcaaattttctaatatttttttaaagttttcggagctctcttttctgtttctttttttgggtttttaattataaatcttgctatgttttcataaatcccgtaatcgggcatatttttttcggctgacgaaagttcgacataattattttcatttaaatttatttcatcaatgctttttttgaaaaagttttttatatttctttcttttcttttttcagcgggcacggtcagaaaatttttttgggcctttaccataatttttttatttttcttaaataaaattattttctattagttaattattttttatagagagtattttttaatatgaaaaaattcagaatgtaattttttttcgcgattaaagtgaaatatttttgcgcaattgcgccttttatagcagctccggaagttcgttgtgacaggcggcggtcggcacgtgattgctgttttgcttctttttcatgcctcaattaggcgaaagtgaatattgattagtattttctacgctgtgcatcgaactgactggcccatgagtcacgtgcttattgcgaaataaggtcccgggcccaattttcgatgcgcaatttgagccatcaatcacttaagttgacaaatgtgccagcacngggctggattttccaaaataattaggtca

SEQ ID NO: 662 - DNA, 3099 bp, Heterodera glycines
  misc_feature (2917)..(2918): n is a, c, g, or t
  misc_feature (2923)..(2923): n is a, c, g, or t
  misc_feature (3009)..(3009): n is a, c, g, or t
ttttgattttatattgctattttctttttttcttcaaattttaaaaattttcgaatatatttttgtcattaattttgctttatttttcgctattttaggttacaaatatcagtttattttttgtattttaattcttattttttattttaacaatcaatttcttttgtcttcgattaaagggagcaattcataaaagaggatgtcagcgcgcaccgccatacccgcgcggattttattttagccatttataatcatatattatatcttcctttgcttcatcttttttataagctaaatcaaatagttatagtaatcaatgcgagtattaatcgattatttgcgggacccaaaaaaaacggctgaacactagcgcagtggcgcgaagcgtactcgagaatatcattaggctggggttttttgcaccaaaattagtggccgggagtccatttacaatttaatcgcttttcttgttttcatgcttttcacacaaaagtttatcgttctgctcctttttaatgtgtctaaatggcaaaaaagctattttgtagtaaaaaaagataaaaggaaatttattaaaaagagattaacaatagggaagaaactaaattagaagctgcagctattttcgaaggaaattttgtaagtttgaatatttcgccatcacaatggactctcagactcacaaattaaatctctgtgataaatcattaataattagaaatattatatctataaccaaaatatgaaataaatttataaaacattttatatttttaataaagtaacaaacatgaatctaaaataaatattaataaatccgctcatgtgaacagatacagtttaataggcattaaattacagataatatgaattaaattttgaaaattaatataattttaaaattaattttttatttgattattacggtaaacatagtatttaatctatcataaaataactaaaatcctaaaaactttaaacatttattacatttattacattaaagccaaaatttatttattctcacatcaaagagtatattaacaaataatttgaatataaatttcgaagtcgcaataagaatttgaaaaataatattttgggccaaataatcaaatggtcgcgccttctagacagcacgagcatttgttttggataaataaatattatagcaaaattattatttaaaaatttcattcatggcatctaagtgttaattccgttccagtcatgataaaataaatataaacaaaaactgaaaatattaatttattttacattgacgtgatgtttacatatttaaatcattgtttgtaaatcatttcaatgtgcattaaaacagactttatgaatattcatttatacaacacaaaagcataaattaaaatttataaaaattttctaacaaaataaaaaacgaaaacgatatacactaaaatcttaagaattttggaattaaaaagtaaaaaaagatttgcaaaaattaactgaatttatttcctatcacatcaatgtaaactaaactgcgccgagtcatgtccaatcagctgatcagctgttccttctcaataccaccgaactcaacccaaagtcttaaaatttataaggaataaaaaaatacaataaatgattttttaaaacatttttttataatataaacaatcctaaatcaaaatgattaaataaactttgtttagttcattgattcagcaatagtaatttagaaaaaatatattagaatagaaagcttaataatgaatttaacaaagtatattaaagcaaattaaaatagaaattaaataaaaaataaaaattgataaacactaagaggtaattaattctcttttatttgaaagtgtatcttatctcatatccataattttattatgatgaattgacactaaaatcagatatttgtacaataagtggggcatatttgttagttaatttaatataaaaattatttattataaatatttgctttattaaaatcgttaatctctacataaaataatttctctatcgaatttaaacataaaataacaccattaagacttagactcaaaagtgtcaatgtgaatctccttaacaatttgacttctttcacagagcgcgaaagatttgggataattacgaaacaataatatatttttagatataatttaaataaaataaaaattttagggaatttatgaacaaaatagctaattttcaaacaatttttaaaaaattatcataaatagttaatgaaaaataaatccaaatatttgggtttgggtttcattaattttgctaaatcaattaataatttaatgaaaatttttgaaaatacagcaaaaacagagctaaaagaaaaattcattaaaatagcatggaaataaaatattataatgcaattgataatattgtgactaaatttttaaaattgtctaaaatatttttttaaacaaaaatttaataaaatatggctataaatttttcataatagaattgctatttaaaaagcagctaatagcacataaagaaaaccataaaaagaattcaagttaaatatatataacattcataattttttaaatgatagaaaaaaattaaaaataccaaaaggaaaacaaatcgcagcgatagagagagagatattatttatctagagagagtgatatttcatcacgagggagagatttgtggacatttaaaataatactggcaagcacatagctataaataaaacgattaattaatctgctgtcgtggagcaatataaaatctaatctgtggaagtttgtataaatttaataattcatgtttgcctaaattatttgaaatcaaaaataaataaataaaatattaaaagatgctactcaatgtttaatattttcattaatatttgaaaacatgtaattttaccaatacctannaccanacttttaccgatcacgtttaaataataattttttcatgggttaattatattaccagaaaattatcaaatattcagaaatatctaanagggatgtcacattgaacctatagacctccccatcgcactttatatatttatcaaagtatgaaaataattgacccatctaattttagggg

SEQ ID NO: 663 - DNA, 8117 bp, Heterodera glycines
tttgttctttttcttatttttcaagcagttcaccaatcttcttgaaaatttcatttgttattgaggaacagaccgcacaaattcttcattaatgtcatcatttttatgatttaatatatattcgtaaaaattgttattaaatttaatgttttatacatttaatattcaatctttttattatagagtattctgatactccaatgacaattagttttttaattaaatattttttaatgttgttttttgctatttaaatttaatcattgaactttaataatttctaaccaaaattgtttttgttttacatctgttttcttttaatactctcgctctacatgcatgaataatgaacaattttggttttcttaggttattaatttttattaagttttatgttacaaattaatttttaaaattatgatcagccattgtgttcaatttagtcttggttttcaaataaatgcggaattcattttaaatttattcaaaatactattagcttaaatttctgttattaaaaatattattttttttttcaaacaaatcttttaattatacttgttaaatagcatgaaatgattggtcaatacaaaatctgggctatttcgacttttcttttgttaatatgactttgaactggatgctttaatgatttattattattctccgctgtttcattaaataaacgaatttttctattttaatttacctcaaattttgattttgattttcttgcataattgctttgatattttgaaaaattaatctttttacttttaaaattttaccgtatttcctcgattatacgcccccccccctcgaatggaagccccccctcgaatataagccccccttggaggggggttgaacaatagaagccccccctcgagtagaagcccccttcgaatataagcccccctcaaaaatttttttttttcaaaacttttgaagtcagaaacgtgcaaaaactattgaacaatttattttaataaaacattaacaaaaaaaatattaggaaacttctgcatcaatttcttcgtcgctttttatggataattttataatatttatttgttattttaaatacttttaataaaagcccccccccctcgattggaagccccccctcgaatataagccccctttggaggggggttgaacaatagaagccccggggcttataatcgaggaaatacggtaaattaaaattttattataccaaaaggtaaaaattttccttttttttgataagcatgctcatatcactcaatttcgcgtcgcgcgaatgttgggagagagcgtatatttaaaaacaaaaaataagaataaaaataatttttaaagatttaataaataaataaaatttaattattggaaataccctatcagtgataatattaaggtaaaaaatgcaatttaaaaaattaaaaacagcctattttgataacaaataataaatagtctaaataattcataattaaaaggattaaaagacaaaataaaaatgtataatcactagagaccgacttttgaggcatatgccttttttgattttatcagttgccgtaatttttatctctttctgctcatttatatgaaatattataaaaaaaatttttgaaggaacatttttgttattttttttttgaaaaaattgaataatttatttgtcggttttatttttttatagaatttgcacttcactcaaacattgcagattttgattaaattgtcttgcgtatattcatgtattccagaacatttggcacatttctagttctgttttaaacttagatgaataaaatcgtaaattaaaaattatttgaatttttaaaatttcgtaaattcaatatttttaaggtttctttcgttttttctagttgaagaaatatttgttgctttattagtttaaattctttggtttgtacctttctcaatatacatttttaaaataaatttttcggggaattaaatgaagtatattttaaacattaaattttaagccttcggaaatattttaaaaaattccttaaattagattaatatttaataggtaaattattaatatgaattttattttttatcccattagtttgatgtttattttatgaaaggaattccgtttgtttagttcttcttcaagtcgacaacttgaagttttttaatccaaaattattcattcgcccaaattatctttgatcttttgttttctattatcctgcaaaattacaaaaaattcactaagtttaaaaaaattatgacttgagaaactcaaaaaagcaagttttcttgaacatattttgtcataaatttcttgaaactttttgttatgattttgccaaaatgacagttttaagagaataaggatttttagggccgttggaaattttttacatacgttttacattattttaaagatactcaccaacaaatttcaaattttggattaatttttgacgataatcaatttttaatcgtagatttttgtatataaataattataaaacgatattgcattttttgaaaattattgtttattttttccgttataaattaaaaattttattatattaaaatattattgtggcaaaaaaattttttttcgagaaattgacttgcaaaaaataaactgtatctttaggggtgtactttttttcgctcttcagcccaaaaaacgaagggcgaaagcgaaaggcccaaaaatagcgaaaaagcgaaaagcgaaacttgcaacaacacccctgatacaaatgaatcttcaccttccaacatattaaggtaccaattctcgcatattttcataataattaattatacatgtttaaggacttatgaatcaaaaatttatttatggttatatatttctaaattactcaaatctgaagctctcgtttgaaggcagttcatgtgttgtcttaccccattgcagacctctgccatattccacttggtattttatataaatggaatctaaatgaaatagtaaattgttttttaaaacaatgttttagatgtaggcgttatcaatttaaaagatttaaataattttttggtgttaattttgtaatctaaaaatgtatgtatgaatttttgtgtctagctttttatagaatttttttatttggttctcagtactatgtttattttaaaaatatatttatcagcgtttttcttaatatatgttttatatatcactacgaaaaaaacgttaattcgtaaggttggtgaaaagaatggctttttatttttagaaaatttaatatgttgcagctgcattcgatggtgagatcgatcacaggttatccaagaaatgtaaggcagaaaccaataatttacttcatcaattataattaaggaaatcttgtacaaattttctcctgtaaagagtccaaacggatgtggcgtcggacgtcgtttcttaacactaagtaatggaacacaacgaactgaaatttataatcgaatgtaaactaattattaaatttatttgtgaattataaaaagccaaaccattcacttttttcccatgaaacgctgagagcatttctttaaagatgaattttccatttccgacgaaattgtgaatagctatgctttttagccttacattcattggtttttacagtatccttaaaatttttgacatttttattttaaatttttttaacaaattaaaaataatagaaatataactagatttaatttttcgatttatttttatttttaaatttattatgttctattttttgaatgcattaatttttattaatattattaacattcattgaatcatttattacatgcttatttttaatgtagtattttgttgtagttaatcgtaccttgatttttcggcatttaggtaatacgaaaatgataaaaatatgcgtataaatattatacaaatatgcacaaaaaacaaggcaaattaatttaaaaaaatatgcatttgcatatttttgaccgccctgattattatgattccaaataaaaaagtccgcatttgcgtcttgttgcacattaccaaatcgaattttgccagacattagtgattatgaggtaaattaaagaagagtgaattctaagttatatataattttattaaattgtctaaagatggtaaatttagtattatttaagttctgtgtttttgctctattatctttttctgatttacagatatttaagtaaattatggaggtaatagtagatttagaataatgttactatatttcttcatattcatcttgattgataacgtaggttcgtcttgttgatcatcgatggtcgcataattaaacgcttcaattctcctgttttttccatttattttataatttttctcaatttatatttttcttaattataagcagggatgcaaaaaacatgcaaatgcatttttttcctggcttctccatgctctaaatagcaggaaaaacactttcgtttttgtgtttgcgtataaaaatcgggacttttatttgcatatttatgcatatttcgccattttttggaaaatttgttaacaaaaatgcaataaaaacggaaaatacacccctaagaatcggcgctaaaaaattcagaaaaatacacccctaagaatcgaccgaaaatttttaaaaacacaccactaagaattggaaattttctcaaaaattcttcccccaaatttttttttcattggaaaatttttgatttaaaaaatgtcaatatttgctaaaaagaattttataaaagaaatgtagcagctcattggcaagtgcatagtaatttttttaaattgaatttgaacccctaattttcaattttttagtgcatatttgtgcagattttacgatttgtgtgcataccgtatatgctctaattatagcccatgggggattatttttaaacctcctaagaatacaggggataattagagaatgggggataaatagagactgggggattatttttcaacctcctcagaaaggtgggatttggacttcaattcctgatcattgtcccaaaaccccaaaaaatttttttaaaaaatccgagaacctcgagcataataatttatttgaattcccgaaaaaaagtctttatttaatgaatcgaattttctaataaatatacatatcacaaaaaatggatctcttcgcattgaggtattttatacaattatttgaatctttgaaaagaagcttaaaattttaaaaatgcaacaacagagcgctttaaaaataatgaatacaaagcaaaaaaaattattacagacataaattggttgaaaatattaaattaaaaaataaattaaaacagaaagtacaataaatttctttttccgttgtcaatcaattgtttgagtgttgcatttatagttttaataaaattattaaagaaagaacgaaaaagccttaaaaactttaaagatttcgttactttaataaaaacctatgtgaaccattcaaacaaattaaaaataaattgcaactaatgtttataagtcggtctacctcagttgggcgcgcacggttgggcgctcacggttgggcgctcacgtttgaacgcgcacggttgggcgccagcacgtttggacgccgacacatttgggcgccaatattccaacaatttttttaaatttgttttttttattaaaaaaatgttttaaagcgacaataaattccaatttttatgttttaaaatttattaaaaggatataagtaaatattattccgtacggatgcagcagcaaattgaccaaaagaaataggccaaagctagagcacgatggccatctctacacacttgacaagacaagtgccgatggaacgactaaattttggcgatgtgagttcaagaacagtggtgtgaacaagtgcaaaggacggatttggactcaggttgccatcagtttttaaattcaatgatctcaatttttttgattttaagcgttttaatacggagccaatttttgctgagtcagcaaaaatgctgatatcgattgcttttattcctattgccgatctgactgaagcagtcaatgtattggacgttgcgttccgaaattttccgcacatgcaaccgatgttggattttatgttaatcgaagtcataaacagccaacatttaccacgttcaggttgatgaacaattaaacgggtcgtacacttgaagatgggtcgcgaactgaaccgcgtttcaatcagaataattttcaattttgttattagaaaaaagtaaatgtaactggtaattagaaacaataacgaatcgtcgcccaactcaatgaataaaaacgatgaatgccaagaaagaaagaaatgcataattgttataaaagctttttaaaaaatatatttaacttttattttgatgaataaattgatacaaaatgtttagaattgtagttcatcaatttaagaaatataactaattaaattgttaatatatcaacaataaataaaaaatataccgaaatactttaattgatattaattgctaaaaattaatattgaaaaaaagattataaattttatttagctctataatgattgtatatattaatttgattgggaacgaaaagctgaatctcacaaacgcgcccacctcaaactggcacaagaaatcatttaataccaaaattcctataaatgcattatgaaaagttaacgctttcaaaattgtagcaatataaaaacaaataaattcataaaattaatatagttcataattgtttatattaagcaaatcataatattatcatacgttaattcactcgatagattttattatttatgttaaaaactctacaaaaaaaacaaattcgaaattatttgaaaaattttaccattaatggaaaggtaactagacgtacggcatcttatcctgactagtttaagtattttccattagtttttaattcaaacaaacatttttttttatcttttaattatttttttcctttctttaatttacctatataactgtaaccaatgtaatattgaaataagtattatataaactattatttattttaaaattatttaatctttattttcatgcatccccgctcttgtctcttttaacacaatgcaaattggattagattttatatagattttttcataaaactcatttgtttattaatatatcttatacacctatttgtcataaagacttagtattttaccaaaatgcatcattattcttgcaattaaattttataatttggattggatcacaaaattttttatatttcaaattaattttattgacatggaggcgagatgttgactaatacaataatttttaaaacttaaagagttaaattcaatattaaaaatttaaaataaaaataagtttataagtagtatagattaacgtttttatttgtactatgaggattctcgcaggattttcacatgcgtttatttgggattatgtaaattcagtgcaattaccttcaaatagaattaaaattcgcgaaaacttttttggcattttaaatgatttattaaattggtaaattcaaattttgtacaaggaattctgtgtttacctgttaacatttcatgaagtattttactaattttaatgcatttccatttgaactagattattgttttattttatattattcattgacccatgttaaatattaattttaaattttgatgtaaagaaaatttaaatgccattaaattaaattaatattggaccaatttatttttaatatttaaaattacacaattgttcatatttgtttcttataacttggaagtgttttattgaaggtttttttatatcattttcatatgactaattttataaatttgtacaatttattaattttattcatgtacatcgaaatcttttcattggtaaactctctagaattaataaattgtttgaattattttatttttacaaaataattcattgcttctatttcttttctgtgccagtagaatcaaatttttgatttcttcatatatttttctgaacaattaattattaaaagtttcattcaaggttttatttatatattttacagtacattttttaacaaatgaaaaaacttgctaagaaaattaacttttggcgtttaattttaaatttctaatttgtttcaa

SEQ ID NO: 664 - DNA, 2753 bp, Heterodera glycines
  misc_feature (757)..(757): n is a, c, g, or t
  misc_feature (2718)..(2718): n is a, c, g, or t
  misc_feature (2728)..(2728): n is a, c, g, or t
ttatttttttggcgttttatttctcccgtaaatttaatctttacaaaaaaagaaagaaatgggcaataaaacacatcaaatgatttgtgtatatgtattgtttacggcagcagattgattcatttaaattctctcctcttcttcctttttggtgtatgcattttattcctcaattaaatttgccatttaaaatcaaattggattttgtaagtaaatttattatgtttgcacgcatttgctgtattaggtaggggcttcattattacatatgtatttgtttttttgaaaataaaaattaatttataattttcttaattacaatttataatatcacgaaaaatatccaaattttttcgaatgggaaaaattgttggacaattttaaaaatcttacactatttttcttaaaatttgaatttttcgttacctttttctccattaaaagtggcggcactctttgctgaaccccttcaattagggcaccactgctcgatttgtgtcggcattgagtcgagaaaagtgtcggttttctctcttttgagggtcgactctcgggaatttttcgctctcgaccagctctctaatgaccatcatttccattcattcattcatttgtttttttttcttttctgttcattccttcggccattaattttttgtcgacggcggagagtcatttcgccataattacgggctttgaccgccaaaaatggcacatcgcccagaatgcccgccccgcccccattttttcggcattnttcggaataaatgcccaaatttcggcaccaaatgtgcccggaatgggcaacaaaaaagtgccaacattgctttgccaatcctaatgcaatttccaacgccggatgtgttcgccccattttttgcgcccaattaaatttgtcaaaaattatcaaaccatgccggaaaaaatacgaaaaaaatgccaaaaaatttgcattttatttaatggcattttgccttccggcgcttttaaataaaagtaaattatcgatgttttcacgggtaacaacaacaagcacatttagcacatttccttgtgtgtgtgccctttttcggcttttggattttttggcattttcctcccccaaaaatcgccgccacaaatcccccggggcgttgcgttcgtcgcccgggggccgggggaagccccgagggctcattttatgcgctataagcgttattgtgtcattatcatatatgggatatgtatgtatttaagtttgtaggtttaaatccccccggggcatttgcaaatgaagcaaaaattttcgccgtcgatttatccccgtgaaacattttttggtttcttttttttcaaattattcaccaccacgctcagtaaaatcaaaagcaaatttgaccgtagtcatgaaagtcggttagttaccgtattccctggaatgagcattttttgtagcagtaataaattgggttggaaatggactcgtcgaatatttggtgagagaggtgaaactttcgggatcgaccccgcccaaaaacgtggtgaccttgtcgcccgctgagcgtcaaccaacaattgggcactcgtcgagactgagtctcgagccctgctgatgcctctcaagacaaccccgagagtttgtgaggtttataaaaaaacttcttttgagagttaagccgggaattgatgaccgctgagaaacccgtgaccccccggggctcgtgattgaaatttggcacgaaaccccaaatgtgtcccaaaatctacatcattgtggaaaattcgattaaaaattcactgaattttctcagtttgccctcgacaaaaaaagatggcccctagccaacaacaccttcacaaaaatttgttcacggtttctgatttctttctcatttctgtctcggcacatggacattcattcatccccatcatgctttgttttgttttccgccaaaagcgcaggccaaaaggaatgccaccataacgccaaaccaatgaatggaaattggctaattttgaaaacataaaacaaattcccaaataattaaatttattttttaattaatttcaaaattctttttgtttcctgattaattttgccgtggttacttaaagaattgaaaacggtataatatatcttttttaaaaaatgacaaaattctaattaatttaagtttaaaaatataattatataaatatttcttttttaattttacaatttataactttggcatgccttctttccctgcataaatttggtgccaaattctgtttcccccccgtcccctgcaatatttgaagtgccgttttgcatggcatttttatgtttccattttggtcacaacacaaaaccgaaaaggtttccaaatttgtaatataatcaagaaccaaaaatcatttattatatttgcattaattatggcataagtaaattaaattttctatttaccgtcccaatttaattaatgtccttgaaaagtgtctttggcatggctaggaatttttttaagtgcgctaagccaaaaaacaataataaaaaaatatcgaatagactaaaaatattctgattaatatatatataccaattagagtagagcgggacccggaattttgggcttaaccgggaccgggaccttttcgggttgaaaacccgggaatttttggctgggaaaaccgggaaaaaccgggactggtcccggtcccggtcaaaaccgggacctcggtactcagttgtactcnagtgtccgtngtttggtcccggtcccgctctactc

SEQ ID NO: 665 - DNA, 4675 bp, Heterodera glycines
ggatgtccttaaaaatattccaatgacgcccaattcaattttcagattaaaattaaaaaaattgccaaaattaataaatgaatgaggtctttgccggcgtcgtcgttcttgttaaaaatttatttttgcttccttttattttttcaaatgtttgccaactgcgaacattttgacgcagacgatcgcccaactgatcgaaatcgtcgcaacgaagtgatttatgccgtgatcagaccaatttaaatgcggcattttgtcatttaatttttgcgctaagttcgggactgaaattctcggcactcgaatttgtgactgagacacaaaaagccaagagtatagaactcgagaccagcatatgtattggcccatgatggtcgttcatcgacccggagcttagtccatgccgttcaagagtggcaaaattatttgattttcggcacctttaggaatgtgccgtgtcgagaatcttgattctcgactcaaaaaatccctgggatttttttagggtcttggtctcgaggttttatgtgacttttgggtctcgcttctcgaaaataagcatttttgcacgatttaccacagattggtgccttccaaccctttgacaatgccatcccaaaacattggcacgtgccgtcgtcgtcgctgtctccccctctgtcccgcccgtcttcggcatcctttgaaaaggaaacggaggaacagtttgaccaaatgccatggcatttgttggcccatcacgcggcattgggctggtcccaatggagcgaatggagcgcatgcacgcgaaaggtgcaaagaattgggaatttgtttaaaatattttttaattttaaatttatttagggtaaaaatatttgtttaaattaaattaaatcgaatgattgttagatattttttaaaattattttaaagaatgtttaattttaaatttattttaggcaatttttaaatgaaatgaaataataaaaccaatcaaaattaattggttccattcttttaattaccatttttaattcattttcaaataaatataaaataatatattgtttgaaaatatttatagatttagtgaaattaaattaaattttacttatttttattatttatttatttatttttctaccaattgggatgtaaattatgtaagaaaaatccttaaatatgtaaaatgtatgttgtttaggtatttaaaaattgttttatgtacattttcaaaaaaaagttttatgaatttcttttaatttttttccattatttttttcaattccactttttttttggaatttacaaatttgtctttaaaattaatgccaaattagaattttagtgcggtggcgagggcatgcaattccaactgcgccgctgcctggacatgtactgctcgggaccgtcgtccaggcatcgaatttgtgccgaaaaagtgtgccttttgcataaaataaataaataataaattattttatgttaaattaaaatttattttaaaataattttttaattttattatttaatttatatttttaataaaaaaactattttcccctcccccttcaaaataatttaattcaaaattaattttccatttttaaaagctttgtcctccaaatggttccttttccactcattctgccgttgccattgaatgtgctcttcgttcatcgccagagaatgaattgttgcctgtgaccagcatacaaaatgtataaaaatatataattttacaatttaataattaatttcttttaattttacaaataaaatatttttattcaaaatcttttattttaatcgaaattattattcatttttcttttctttcattcttaattgttggttaattaattataaattattttcatattaaattaataattaaaattgtttttattcattttctacccaatttgtccaaaagtgttccgccctccattgtgtgtcccgtcggaatggcactgtgcacacttttggcatggcattacgtgatggcaccaaatgccatctgagccacggactcccaactgttgaggccgtttgtttgcatgggaagtgagttttttcaaatggcacggcaccattgtagatgattattaccgtataattataatagatcattacagtatataatttgtagggaatttttgaccgtataaaattgtagaagatcattaccgtataccaattgtagagggttatactgtatttcagtcgtcgagggttattaccgtatagcaattgtagaggcttataccgtacaccaattgtgggggattatactgtatttcagtcgtcgagggttattaccgtatagcaattgtagaggcttataccgtacaccaattgtgggggattatactgtgttccagtggtggaaaagtttttttcctttccccggcagatgccgctcagttggctgtgacggcattgtgggctcgtcggcacgggaggatcagtgcggcgtgtgcgccggtgatggctccagctgcgcggacgagctgttccagtggcgggacacgggccatttcagtccgtgcgacaaaagttgcggaccgaacagtacgccaaaaggggggaggggagggagggcaaattcaaaaaaatttaaattgcgcgtcccgaaaaaaggcattcgcgtgtcggtgtccgtgtgcgtcaacattcacacggaacgcgtggtgccggaacgcatgtgcgccgaccgggtgaggcccaggccgcaaatccggcgctgcgagcacatcgtttgtccagcaaagtgagcgcgggacggatcagtccccaaaaagtgggcaccgatcgatgatttgttgccattttggtcttatgccctgatccggtgcttaattcacttaacctggcctgatcagagctaccccattttgtctgatcagtgttggcctagtccaatcatggcttggacagatcattaatgcttgattcaatagtttgtcaccagaataaccatttttgtctaatcaatgcctgattggatgggctatgccggattttttggtttggcttaattatctctcaggaattctgtctaatcactgatacgtttgacagtgaccgttcaaatcagacatcatcaaattgatcagagtgcaaaccctcctcaatagacaaaaaaaaactggcattgatcacttgactaaggcaaacatttgtccacatttttaggggggtttaaaatttattttctagccattcgatgaagcccaaaattaggcatcagtaagtttgtttttaccctgaaatttttgccgaactgtgcgcattttgtgccgtttaaatttcgcttttcagtaccaggttcgttgttgttcgcatgtgtgttcagtgaatggttgtcgtcacgtcattttttgcaattcaaatgcttctcgctcatgccaagctgtttaagcagttcaaactgttgcttttgcgtgccaatttaattttcaattatttttgcttttttcgaaaatgccatccgtagtttttttttgtttgctaagaaaataattcatccaacttttttcaaagaaaatgccatcctcggattttgtcatgaaaatggcatatcctacatatataaaattgggaaaaatcaatcattattgaatttttcaacaaagcgaaaatgccgccattcctcaatatatttttttttctttctaaaaaatgtcaatatttaaaattggcgaacttttgccaaggcaaaatgccaccttcggttttttcccttaaccattgccattattttgtccaaaaatttcgtttttgtttaccaagaaatgccatttttaaaaacgctaaatgttatgcttattccgctagcctatgttttgcccctgttttcttattgccatttttctaaacaatttttgtgccattgtccccccccccctccctaaaagatggtttgccggcgaatgggccgactgttcggtcacctgcggcaccgggcaacagcgacgtgaggtgttctgtgttgaacgggttgatgctaatgttgaccggcgtgtgaacgtgcaacactgcttgccgagccaaaaaccggtgaattttttttttggattttttttaaattttcgaaaaatccaaaccaattttggcaccatttgtaacccccacttactgatcagttgtgatcagcttcacgattttgatcaatccttaacaaactctggtggtgctaattggccatcagcagtagtaatgctataaattgccgtcgttccttaattacattaccgtaacttaacattaatcacagtaccgtcctttccttaatcacactaccaccctttccttaactacactatcgtactttccttaattagtctaccgtattcattttctcccccccccccccccccctctcaaatggggaaggcgttataaatggaattttgtaattatatcagctctccaatgttagagcggcatttaaattttgaaggtggacgtgcgcaagtgcagcagtgaggcgtgcccggaatggtgggccggcgagtggggcgcgtgctccgccaactgtgggcgcggagtgcgacgccgaacggttggacgggcggggggggggcaaaatgccaaacaaaaatttaaattaataagtgtaaatcgaatgccaataaagcaattagaatgccaaaaatactgatttttggaggggtttatgggggcaaca

SEQ ID NO: 666 - DNA, 4526 bp, Heterodera glycines
aataatttgagatttaataaaataaattagtttaaaaatttttgttaacttagaaaatattaataaaaaaaatttaataaactaaaatatatttttttaactatcaaaataataaagatcaccaaatattttacgcagataatatttttataattattaacattttcaataaaacataaatttattatttaatattaattgcttatttgttttaatattattttttgcataattattttaaattaaataagaattttatttgtttatttaaatatttcattttcaaaccatttattttctattaaatttatttaatttaaaaatataagtttaaatttgtcgggtaactgataaaaatcccctgtttttatgttatcaaaaattctcaaaatcctctggcctatctcatttttatttaatcgtgccaaaatcgtacagcccgccaacttgcctcgggggatggcatttcgatgccacccaaaacgccgaagggcatgccgaaattcggagggtgggggaggggtgatttattggacctccgaccctcccaaaaatcccctgggggttcgttcctccattattttcagctgccaaaaaaaaacaaacaaaaataaagcaaaacattatgccattcacataaaacttcgaaaatattattatgctcttcatttttaagttttcgaattccaaaattggcaaaattgaaaattgcggggattttgaattttgcaaattcctttccttttcaaattctattttattaatcaatttaaatagtgcaaacacatcaattcatgcttcaaaaagggtcggagaatataattttcgcatttaaattacctaaaatatattttaataaaaaatataattaaaattctattttaaatccttttttgattttatgaaacttttaaattcttaatttcttcttttcctttacattttgattttattccagaaccaaaatgatatccactttaaaaaaacattatgaattttcactttggcacaattcttgcacaaagtccatctttttggcattgccattggcccccgggggcacaatggcaaaaatgttcaattaagcgccccttaagcatttgttatgcccagcagcagatgatgatggtggtgatggtcactcatcacatcatcaaacacacacagtacacaacgccaaacacttttggtccaaccaatttcctcccccgggcccattttggggacccttccatcccgaaaatggtggtggactccccctgaaaatgccccgaggggttttccccctcccctccttttgtgccgttgttttaccccccccccatttggccattcattcgcttggggccaagccaaccgtcgtccgtccgtccgtcccctcaagggtttttgttgtttcttgcccacttcctcccgcccacccatcaaaacacttactcatcacactacaactctggtgggagggtgaagcttgagccccaactctcgaccccttcccccactctcgtgccaccctttccggcgctgggattttacgcggacggcttttttacagggataggagggaggtattgcatatagtttctgttttcaatcattgtttggtttttgtaagacattttctggcaaattttttaggtttgcagacgtttttttctgagagatggggggaggggatactgtactttccaatatggtattcccggtcaatggaatctacctttgttccttttaattctggcatttttggcaattctcggtcaatgggattaagccaagccgtagccaacactagggttcttggcccaacgccattttgttcggtcctttcttggccattctccccttgattttcagccctttttggcataatgttgccatcgtcgccatactgtagcttacagttagcctcattattccttttactgtcctctgtttttgtgctgtcactttctgtggttgctgcggcaccgtataacgacgacaacagtgacgaggagacagaggaatggaaacggtgcaaattttgtgtggaaaatttcaaattttctggcattttgcccatttccaaattggctgcgaaaatccacccccaaaaatgcaaatttacgcgctaatcgcgctaatccgttgcgacggataatccgcccaattgtcagtgtctttctgtcgcgcaaacatcggacggacgcgaaaagtgtccaatttcttttgattttacttaaattggattattgtgtcaaattcggggcaaaggatgtaaaaataaattttatattatcaagggtaaaatttaaaaaaaggcgaaagaaattttcaaaaatttaaatattatttttaaattaaaaatatttttctaattaaatttaatgaataaatttaagtataatttttatattattttaatttgaatttattaattgttaattttttaattaaatttactaaaaattataatttatttaatttttactttattaactttgaaaattaattaatttgtggaaggaatattttaggaaataaatatttatgaataaatatattttttaaatttttttacaattaattttaataattattttaataaatttaaaaattatatttaaagttaattaattgttatgttaaaattcaggcccaaacaattgatgagctattcggagggtccttctgccgcgacccgacatgaactaccttcccattgcgctctctattggaattattttctctaccctccttgatcaaaaatgtttgtatgactggaattgaaattcagcactccctcatttttgcgttgtctctctccataaaattataagccgctcaaataaattttaaaaaattagcgcaaattttaaaaattaaattgatatttgcgttgatggcgtaatgttagttgatttaattaaatatcaacatttaaattgataccccgcaaaaactaataaaaaggttgatttgccattctctacttacaaggcactaattctcgaaggtcgacaaatcaatgagaacgaatcgatagtgatcaaaaatgaagaaaagattcgttttttatttcatgccattttgtccaatgttccccaattaggggagtagaattgtaattgggaaattttttcattcaaataaatatgtttatatctattttggtgattagtaaaagagtagaaaataaattaataattaggattttaattttgtagcaaaacaaagctttgataatattttttatcaattatttattttatattaaagttttgtagagccaaataaaaacgtcggattaaatcctgtaattatactcagagaccttcaggattaattattctgaatcttgattattatttattatattttgattttaatataattgaaaattcgtaattatgaaaatttttacaataattttaaatatatttttgttatttcatttgattatattaaataatgcaaaataaagaaaatattttaataaaagaaaaaaagcaattataacgctaatatttttaattaatattaaataattcaattataaatcattttttaaataaaaaattttgtaaaaaataattattcgtaaataaaacacagcaattttattcccttttagacaaattatcataacaaagaaatgaaaattgccaattcattcatttttggcttttcttattttatttgccaatattttttccattttttcttttgtcgttattctttcactgctaatgccaaattgtttaatccggtacttttcggttttgtgaccccccccccccctgaagttttcaaataaaaagtcatttctatggtaatttggggcgctgatcacgaatatgacatttatttttaaaaattccgaatcccgaacccgaattcgaacacaaattcgaaattaataaattacaaggaaatttttaaatcttttcgccataaaatcattaaggcatattatttcttttaaccacttttattaaatattaaaaaaatttatttatcaaatacaaatacaatctttttgaaaatttatataacaaatctattttttagagcgcagataattttttaaataaatttatccaaattttcgtaaatttttccgttttttcaatccttcaaaatttcttccccaaaatgtttcttccattctgaaattctcggttgatgaattttcaaaatttttccaatttccttgtttctgagtttattttattccattcttttgctgaatattttcttcctttttgctttattttttcttttattttataaaattttgcaattatttctctttttttgagttcatttcgcctttcttcttctttttcttcccaattttctccaaaaaattgggtaatcctgtattttactggccccataaaaaaagagattaaaaaggggtttttatgcaattcggagtagtattcgggggtcttcgggagcgctgatcacgaatatgacatcaattttgaccaatttcgaatcctgaacccgaattcgaacaaaagtcggaaattagtttt

SEQ ID NO: 667 - DNA, 1482 bp, Heterodera glycines
agagagagaagaaaacctagagaaaagtgtgaaggaagtgaagagggagatagagagaagaggaaagagaaaaaccagagaaataaaaataggacaaagaaaagttagagagatagaggagggaaagagggaaatagacagagagagagagaaaaaaggaagagagagtgaaaacctagagaaaatgagatggagtgagaaggggagtagagagagagatggaaagacagagggaaagagtcagagagggaggggaagataggaaaaaagaaacgagtgacaatcacttacaaaaaaagccttaatcatcgaggtgatctgatcagagaagaagccggcagaaaacccattttaataagctttagatcggtccttggagcgcgtgttcgcacgcctgcgggggcggcttgcgcactcgacgtgtggtgcgtcataactaattagaaactaattaattaattgcttaattaattatggacatttttttgcgccaattgtttagcgctgcgtgcgcaccgcaagcggctcaagcgcggccaccgccacccttctggtgttgccggatggccaatgtccggggtaataccttttttttgactttttatacaaatttcctcaccgatacgggtgtttcggcccttgagtcaacaaatttctcgatttttttttggttctcagtctcggctctcgagaatttcggctttcgagtcgagaaatttctcattttttagtcggggcttctaatttctcgagccaaaaattctcgtttttttttgggtctcagtctcgactctcgtcggtggtcaattcaaatcatcgaaattcttaactttcgagctttccttatcaaccatctctattaaactcccataataataattaatttgtgtctccctcccatattaaagtgttcggcccggtgacgaggagccctgcggggttgtcgactgtgcgcccgaatggctcgctggcaattgggtgggaaaaactcgaaaaaactgtgttgttgacggcattttgccgtgccaataatgttcagggccaatgctcggcaagttgcggcaccgacggcgagcagcggcgcgtgttgcgttgcgtccgacgcgacgcgctcggcgacgtgcgcccgctggacgacgcgcgttgcacggacgcgcaaaagccgcccagcgtacgcttatgcagcttgggtaagaagcggtggcgctgaattgggcccaggtcctggtgaccaactcggcgcgactgtttgtacgcggcggaaaattggaaaattggggggggggggagcgggggagggaggagaattctcaaattgggtacagtaagtgaagtgcgtctgcggtactgtatgtcagggatggcattccgaggcccaatcaattttattaaatagtaatacagtagtaagaaatgagcagccagtggagtacggtgtacacttcactagagaaacatacattataaatatgccatttcata

SEQ ID NO: 668 - DNA, 6103 bp, Heterodera glycines
tgagtttattttatcccattcttttgttgaatattttctccctttttgctttattttctcttttattttataaaattttccaattatttctctttttttgagttcatttcgtttttcttcttctttttcttgccatttttctccaaatatttcatcaaatgttttctgttgcaattttttatccactgattcaacataattaatattaattatgtcaatcaaaaataaaaattaaagaaaatatttagaaattgttcagaaattcattgaaatgacaaatgaatacaaacaaaaaagaaaatattcaaataaaaaatggaagaaaattgaaaaaatagcgaaaaaattgaggacaaatcgccaatatatttataaagaaaattggagtaagccatggaataattaaaagatgggagaaacaatttaacatccgccgtaaaaaaaataacgaagaaagaaaaaatggaaaaattgaaaatttattagaaaattaaaaaagaaaatccgaaaatgaacgaaaaggaaattgcaaaaattgtgaacacttcccaacagaatatgctcaaatgttgaaaattcatcaatcgagcatttcgcgatggaagaagcaattaggagaaggaatgttttggagaagaccagtaaagaagtgatttgactggagtgattcatttgaaaaatttttatcgtttcctttccatttttgtatttactaatttttatataaattttttttacatttcgagattttaaacaatttattataggaaaaaattattgaacacaaaattttcatcaattagcatcgatcaattaaataaaatttgatggttgtttaaaatgaaaagaataaacatattatatatttatttatttagatatgcatacaaatataaacaaaattttctaatacataattccccgatcaaaaaatatttataaaaatcctttctggtcgatcagtacaccactgatcagtcagcagagcattggtccaatcagtccactatccgaacccagtccggtctgtccatgcggccatactgtatgtcgttgattgtatcgtacatgcgttgcatcactgtcgctttggatgccattgtcggaatgtgcagctcgtcaatgcggcccgtgccacgctcaacataggcaatgcgtccgattggcgaaatgacacaagcggtgccgcagccgaacatttgcaggagctgcaacaaaacatataattaaaataaagaaatatcgattattttttttggcagatttttacattttttgttaaaaattgcgacagaaagatgtaaaaaaaaatttaatttaatttgatttgtttgtgccttacgctcatatttcggcatttttgggtaactttcagtatattttggcatttttgttaaactattttgagggaaatgcaggtttaactcttttttttactttaataaaacttagcaatttgagaaatttttatgcttatcgctttagaattttcttaaaaacatttcattaaattttaaaatttttatgcaaattaattaattcatcattttaaaattatttctaaattatttctaattttaatttaaaataattttgaaacgcactctccgctcgtgcaatgcccggcgcaattccgccattgttgggtagcgttccgtgaccctgaactcgccccactcacgtgctatgctcaacaccgagtcgcgcacaacgcccggcaaaatcagtccgtcattcagcggcggagtgaccagttccaattcttaaataataaaatatttaaacttaaaagattaaataaaaaatctttaatgtgtgactaagcctctgtataaaagttaaaattttaaagcgaatatcatttttttaattttcaaaaagttttcctttgtttttttcaataggccatataaatttaaaaactttggcacattaaatcggcaaaaagtctaaattaactccgtggatttcttttttttaaattatgattttaattttacctccgcattcatttctccagtagatgaatatgttcattgcaccaacttcagtgatcttctcatctggcccagtcaaccacaacacttgttggtatcccagatcatgtgcatgctttccgatcagaagagtgggagcataattgctaaaaataaatttaaatttttattactttttagagtgtttttcattttttagaaatttaaaagttcatccagccctttttggagttcccatattttgtctattttaattaattttcgatttattgtcactgaaaaatgccgaacctccaatgtgtgaattgtatatcattttggtgtttatttatttaccacactattatatgtacaattgtctcaattctatgttaattagtgtcgttgtcaaaatgcctactccaaaattatgtataattgtcaaagttttggtgaccattgtcattgacaaaatgtcttccttccttattgtagaatagcacagttttgttgatcatattccaatgacaaaagatcatccccaatgtattccattttgcccatttttggtgataatttgtcccattgacaaaatgcctaccatcccattttatatgcgcccacaccgccggggaatgcgcgggcatagcttggatcggcaaacagcgaaatggacttgaagccggttgggaaaaatgtgccaactgggccggtcagaatgaacattttggcggtgcgcgagtgtgcgacgccaagcgttggatcagtgccgatcaatgtgggacgaatgtacaaggaggaggaggccgagtagggcacccattcccgatcaagccggaccaactcggcgatgaccttcagcatttcttccgcatcaaaatcctgtttcgggtttgaggagtaaagcaatttgaaaaattaaatttgtttaaaaaggttttcagcataaataatgggcaaagtgcaaataaaaaaaaaatcggattccacctaagaaatttgaaaagatgccatctcaaaaggaactcagaaacagaaaatggcatttatctataaaagagtgcaaaaataatgccaagacattcaaaactgtggaaaatgccattaattagtggaaatgtcgcacccggggcggggggggggctggagaatggtgggtgagaatgccacggcactgtacaattaccggaagtgccgcacgtgccgcggtacgcttcatgcgtgcaatgttcatttctggacggaacaatcggattctgtcgtcaatgccacggtaagccttcatgccttcgaacagttcaatcgcataatgaagcacctttttgtgtgattaacaattagaaacaaatccccaaaatttataatttcatttgtttagaaatattcgaatatttttcattcaaattaatttaaattgtttaaataatgtgttgaaggattataatggaaaaaaaatttttatttatatataaattaagaatttttatttgaagaattccaatttttcagattgtatgctttttcgaaatttcaaatttcaaattttcattttaatatttaatttatttcgcaatttttatttatagttgtctgatttttaaagattttttaaaaatttacttttgcgcccggatgaagctgaacactgtgcaacgggctaatttcgggttgattccatcccgcggtgtccgaccaatcgacctccatcatgtgatcagaaaagtgatgtccaaatttgatctgatcaaccgttcccagcggcttgggctgcatttgtccagcagtggcacggacaatggacaaatctttatgcttaaaatgtgagaaaatattatgaaaacattataggaaatttttcaagtgccaaaaaaagagaaattaatccattgaacaaatatattaaatattctatgaaataaattttaatggaatatttattaattgacgctaaaaatataatttgagtattttttttacaaattttattgaaaaatttcggacaggcttcgccgaaatttggtaaaaaataaaaaataaccccctcccagccaaaaattgccaaatttttaaaaaattttacttatttatttgatagaaaatggtcaattaaaccaaacaattgtattttaatttaattgaattcaaaaatgccacaaaactcacgtagaatgtggatcgatctggctccaccgccggttgttgttcgacggatgcggcaatggcaccgccagcggcggacattgagctcattgcgcgagcaccgatgtgcaaaatgatgctgggtgctgtttgcagagttttcataattgttttgttaaataatttcgattttctacgataaaaaaagttgcagattaattaaaaaaacagaaaaattaaacaaaaatttccaaatttcatgtgaaacttttttaaataattaaagcattatttcagaacccatacacacttatttaattaacatataaaataaaatttttcaatagctcattgtgccaaaaaagcacgtagccattaaataacctaaaaattctgataaataattttaaaattaaaaaaatcgaaatttatttaaaaataacttaaaatttaatattttgaaaattaaaagattgtgaatccactgtttactatatcacacaatgacaactcaaaccaataaaattggcactgatttaaaaataattaaaaaacatcaaacgcataaaaccatctctcattaagtgaatcttattattaatagtaataattattataccccatttaaaacaaattatttattattcttatcacagaacccatcgccgccggcgccatgtgcacggcgatgaaaatgaacgaatgaatgaatgaaatggtgggaacacaaaatatgcacacatcgccacagcacccgggggggggggcgaacgaacggcaacgaaatgttcgcccatttcgtcgtcatgcgcttcggtccacgaggagtcgtcgaagtctgatcggaatgtgagaatgggttaagaataaaaaattgttatttaaaaaaacaaaatgtgatgctaatgatgatcatgctgatgagaatggtaatgaacgcgctccgatcatagcgatgagtgattggaagcggtggaaaatgggtttttcactgatcgggaccggtctgctggttgctgatcacacaccctcaccagcgactctggcgctggctggttgatcaaccaccctcactaccatcagaaagcggctggctgatcaaacgcactcaccaaggctttcacccccaccctcaccatcggctggttggaactgatgacacaccctgatcagcaacagaaagcgactggctgatcaaacgccctcataaaatttaattctctgaccaacacatcctcactagacaaagcagctggctgatcagtgatcaatcactcattacacacgcactcttttccaatgtcgttccggtcacaaaacagcagagtgcttgcttgctgcgaccacgtggtgctgctgctcttcgggggaaaaagagtttgtcactgctgctgatcgggaccggtcggctggctgatcacacaaacacacccacccactccacccaacgtcacattcagttaaacaattccggccaaaatgtgaacccacgtggtgctattattcacccgcctcttccctgtttaccacaagccccccccccaatccccccaattttgctgacacagcaggagagagtgatgatgatgtgatccgttatttaattgttaattgttgatcacaggcgaattggacggttatgttgatagggaaaagaagtacagagtagcaggtataccgtatacgatcaaacaactgtaagtaagactatgagataattgaacaaattttataaaagctcaaaaaatagaaaagaaaaaatttcaatgcacataatgacagatttgtttgtttaaactattcgtaaggatgtgctttcaataaatttataattttgttttgttaatatatttctggcgccgcccaatttcgcattgaataatacaacaacaaaaaagtcgtacaatagcgatcacacgatggcaaaccattgtgtgagatcacgagatcacagtttgaaaagtttttcatcataaatttgtgtattt

SEQ ID NO: 669 - DNA, 765 bp, Heterodera glycines
  misc_feature (701)..(701): n is a, c, g, or t
aaaagagggggggaaaaaaaagggggggggaggggagccaaggaagaaaactgggggggagagaaagagagggggagagatcagcaaaaagaggaggggagaaaaagggggggatgagagacaaggaagaaaactaaaggagagagaaagagatggtgagagataagcaaaagaggaggggagagaaaagggggaggatgagagacaaggaagaaaactaaaggagagagaaagagatggtgagagataagcaaaagaggaggggagagaaaagggggggatgagagacaaggaagaaaactaaaggagagagaaagagatggtgagagataagcaaaagaggaggggagagaaaagggggaggatgagagacaaggaagaaaactaaaggagagagaaagagatggtgagagataagcaaaagaggaggggagagaaaagggggaggatgagagacaaggaagaaaactaaaggagagagaaagagatggtgagagataagcaaaagaggaggggagagaaaagggggaggatgagagacaaggaagaaaactaagggagagagaaaaagatgacgaaagataaggaaaaaaaggagggggagaaaagggccgcgaaaaggaagggagaaacgaaaattaaaaaaataaactaaaatcacgtaaaaaaaaagggcattttcatttccggtccgcgtctcnctaaagaccaaaggagatttatgagtgtcccaagtgtaagaaaacaggactcgtgacctctaga

SEQ ID NO: 670 - DNA, 1365 bp, Heterodera glycines
cataaatcaaatacaaaatagccatgacacacattgaatgtgttttggtcagttcttcctctttgaaaccgacgaatgatgggccggagtttcgatcattttccgtttgagaattgacttgacactctaaaaattcaaattttatggatcaatggcatttcgccaacagcgtttcttccgaaagggacacctgctgatgctgctgcggttgttggagatgtgccgcgtcggcgtggccaaaaatgtgcagttccactcggtcttcgctggaaacggtgaagagtaattcgccggcgttcagtccgttgcccgtgcgatgcgccgcgcgacatttgaacagactgcggtcatcagtaatggtgctgcagcaaaaaggaaacatttcgatggaaaagcaattgattaacgaaacaggagagacggaatgaattgtgatcaaacagaggaactttgaacttcggaattccgggttcggaaaacacactcggatgcaggcaaaatcagacaggatccgggtccaaagtgtgagaaagcggcccagtgttatcgactttacctcgagtccggcccaatgtatggtgcgacacgaacgacttcgaggaattcacagtacacaatgtacaggtgaggagacgcatatactgtagtgggaaaagagatatactatactacaccagtttttctgctgaaaacgcccaccgaattccaacggcactttctcccattcgatgtttttgcttcgcgaccgtttcccctgcgaattaacgaacagtccaaagtctgaaatgagcattgattaggcgagcaaattcattgtcaatgagtttgctgttactgtgaaatgccaacaaaaattcgttgtccgaaatttcgacagcggcgacgggaaaatcgaagggacaattttccaccacaagaggagaaggcattgcgaaattgtcatcaaatcgcgcaaaatggaaattgtcggctccgaaaacgaaaccaaacgaagcggagcaaatgcaagtgcacggctcctccgttttgatttgagcgaccggagaaaagaagcccaatttggcgacgtattggagcacgacaatttcgtcgattgtggcaatgtaaacgaaactgaaatggaaacggacgatgaataaggagggaagagggagcgaaaggtggaggagggaaggaccgtttgtcgcggtgatgttccgagttgctgaccaccgcaatatggcattgttcgatgttggcaatgtttgtgcaggacaccgtcggctgttgtgcaactttgaatgcgcggaggatttgttggagatggatgacggccaattggcgggcggaaacacaaatggcgaggagcatgtcgaactcgggcaa

SEQ ID NO: 671 - DNA, 9530 bp, Heterodera glycines
cccccccccccccccccacctggtggccatttgcagggaatagacccagcgttgtttggcctgaacagtcggagccaacatgaacagaatgtagctgaacagaatattccattaaaaatgatcattttactgtattttgttactcgggcagtttaagttcgatcaacatggacatttcagtgccccgaatcccgtccagcggtttgtccgtcgtttggttgtaaatgcgccagtggtcccggtccaaatcgatgctcaaaaagggcagtgcgccttcactgactgccaactgatcgctgtcgtaaaaggacagtcggttgtcgtcgatcactgcccatgcgttgagccaatgggttgattgatcaggactgggcaaagcagcggaggcggaggaaaaaggccaaagtttaccccagcgggtcattggttggaaggagatcgaatgtgtgtccaggtagaaatggccaccattctttcggaagaccgcacgtgttgaccacgttgccacgacagtgcgggtgcaccgtaagggaacagtcgcggcatcggaggacgagtcgaaagtgggggagaccgtccatgcagacttggcatttattctggaaatagagggacttcaaaacttgacggaaagagaccgataggaccgttgccactgtgacaaagtgccgcttccaccggtggggaatgtcgtgccgcattctgcccggaaatcggggcgcactgtgcgcggagtcagtcgaactgttcctgcaaagcaaaaccaaatgatagaaaatcaaaagcaaaggcttgcttcagcttcgactgagagttgcgcgctggtgacaatgcgtcgtgaaaacgtacggtctcttcgcggagcattggccgtgtcggcgtcatttcgttttgcttttcatccaacactaaagccaaggcattaattaatgaaatgagaagtgccctgttaatcattttcgtaatttgtttatcaatgaaaggaatttcacctctgcgtcgattctcgagattatttttcagctgatttctctccttttccagctgaaggcactgtttgtactccatttcgatttcctaaattaatctctaaaaatccaaacagaactaattgtccgacggactgaaagatcagagccatcggagaggagagaggagcgatggcgcgggagcttttgcatttgcttcggctgaacgacgctttgcaaataggcgatcaatttctccttctgttcgaggtcggctcgcaattcgtacaactgatcactggtggaattctgatcaaaacaaaaggttttccataattctttattttggtgttttttgtcctcactttttctcgctcgttttctgatttcagctgatcattcgcttctttgaatgcgtccaattcggatttgaatgtttccgccttcttcagacagacgtcaaaattcttaaatgattcaatacattaatttataattggcattccttctttcgtcctcctctctctctctttacgatcccttttctctttcgtcgtcctcccctctcttcccatctctctctctgttcgccccttttctcctccgtctctctctttctctctgtctctgccacctgtctcaaaatgatgttctcctgctttgttttcgtcgcttcttctctcatcttctccatttcctctctttgtgaattattctccctttcgtattgttccactttccgttgtaatgagcgaagctccgcctcttgctgcctcaaccgtgcttccatcttcggcaccttcaattgccaattttggtgccgtttttaaacctttctcacctctccgctattttcactctcttttccctttgatgtccccgcagaagttgcgcccaattggtcagccaaatttgccaattccttaaacattttgcttattttatgtatgctaattcgcattggcaccgtccgatggtcagtgctcgtctctttaagctcactcttaaaatttaggaatgacatgactttacaagcattgaaatgcacctccaaaaagactattttgtccttcagccatttgctgcggtccttcagcgatgcgttttcattttccattttgatcttttccgtcagttggccgctcagtttttcgatttcccttttcagcaattcgttttcgttttgcgcctttcgtttctccgcgtccgttaagcgaagttgcgtctaaattgccaattaattaatatttcaattgaattcgctgtctttcaaaatcaaccatcagtttttcgcattgcatgtccaattcgcccattgaccgtttcattccgtcgcattttctcctctgaaggtccaactcggattggagtaacttcagccgcgaattctcacactcctcattctcacggcacagccgctgcattttatcaatctgaaagtggaaatactattagccaaatgaaagcagttttagaatatcgaatgacaccaacaaaaacaccgaatgaatttgacaaatctgattgaataattttaatcattctttttcgagctaaaagtgactaataaaaagcaaaggacaaaaggatgccaattcaattggtcctttgcactaaaaagccgcttaacaatgggccaatgccatgccttctctttcatttcggtttccatctttttttggcgttctttgagcagttcattttcattttcaatcgcttttttctcagcttcggccgattcgattttgctgcgcaattcaccgactgtcgaattcagcagtttcatttccttctgaatagaataataaaaaacgaatttaaaaattgcatttagattttggaaaggaccgcaagtccaccgaatttggcagtttccgtttccaactccgtgtatttccgcttaagctgaacatgctcacagcgcaactgcgccttctgttgcttcagccgttcaatctcatccatgaggcgtgacgaaacgatgtcggaagagctgaaagatgcttttgagggggaggcaaaaaatggggaaaataacccagatgaagcgctgatctgtttcaaaagtgagttaatttcctgttggagtgccgctttttcctcctcacattgtttgtagcgcttaaatggtcaattccgttcgaccccttccccccgctccgtgccaaaacctgctccatctctttgttccccttcttcaaagtgccgacttcgtcgcgaaggctttcgttctttgtgtccaaagagcccaacttttggttgagctggtccaggtactgaaacgtcaattaataacaagttcgaaaagcacaaccgattgactcaatttaagctaattaattaattacctctcgtttctgaccatttgcttcgttcgttcgcaatttttccctcatttctgcaatctccgcctctttgacccttttttcggcttttaattccaaaatttcgcggtggaatgattctgtttggcccttcatcgtctcttgcaacagttccatttcgacttttttctacaaattttaattaatccaaattttgggttcgcaaatgaatgcctttttaagtcgtgtctccaaaacagtgattctgttcttcaattcgccaatttctgcctccgatttcggtgccaattcactctcttccaattcccacagaacgccattggccgttttcctcgcaatttccaattcctcttggacccttcgtattgtgtttgtgctctcctccaattgattttggagccgttcaatttccaattgctaataaagtttaaatgagacaatttaaaggatgatgggcacttaaaaaaactcccaaatgcacattttggaagtaatttgaaaattgcgaagctggtcccccattaatgtttttgtttgttttaaaaatgcctaaaagtcggatttaattaaacatataactatgagtcagtcaaaaactttgctgctgatgtagttttagagaattaatttgctcgaaatggaattaacctcgaaaccaacaattgtttaaaagatagggatttcggaaccattccctcactaacaccatcgcgaatgatgaaaatcttaaatttattttacttatcatttaagtacaacacaattatttgtaattattttttaccgtagacggtggttttgaacggttcttcttaactttgtccaaaatccagctcattttgtatgacagcatagttggctccaaaacgtcctgcctaaattagtcacaattgcccaacaaatatcacaacggaaaacaaacgtgcaaggctggaagtaataatctccgcagaatttgtaagggtttttcagatagtttgcgcaaataccaactaaaatattattaataataatgcacacatgagaaaaacaaaccaatcagcggatcctcagaagtgagtccctcaactcctttcttgcgaagcatgaacttctcgaacggcgttgcctttggaggacgactggtatcaacgccaatcacaagcacatcacctccatccatgttgaatttgctcttactataagatagaatataagaaattttaatgcagaaaaacgaacgacgcttgcgggaacataggcatgtaattgaagccgaaaagcctgaaaacaaaataaagtcactgaatgttcgctaagcccacttcatgttcattttattcagcacattcgacagagtcatagcacgcgctttgctggccacttcgaatgtgacatgttgagtcagcagaccatacttcttctcgttgagtttcaaaattgctacagatttaagttaaacaaaaaaaaatatgggcattgccaccgtgtgatttgacgaattttttgtcgatgtagagcaaaaactgaattcggcggtccgagagttgctgcatacgttcagaaatgttctccaattcgatgcactcgtattgcgggtctggcaaatgcatgcccctctttcgacccataaccacaacttgttgaataaagttactaaaatttaaaaaaaacagtaaacaggcgaatgccctattccataattctaccggacatctccctctccaacttgacgcgtaaaaccaacgacccatgccttcatcaaagtgctcgtctcgagaaaacgaacacctgggttcacctataacgagcaaatagcaagtgatttaaataagattgctactctgtcttggaaatagcccatcacattccctccaaatttgatctaaaattggttaattaggtgaacaaaaaggtaagaatagattacctggggcatttcgtgcatgccaattttcacatcattctttccaccgataagcttcactccaaaatgactcataaatgcacttgacgtgccggtcccgatttttctcacttccgcttcaatgtcggcgtaccgtttgctcgaattagtcgtgtttgcctataatagtataagagaatgcgagggataaaaaaaaatattttacactaagaagctcgcgcgaaataaattcggacatcttgtcgatgggcactcgctgaccaggcaagatgataacacacgacattgggaacaatgtctacaaccgataatgtggttaaaaacagttctaattttgttaaaaaaagaaaacctctcggtcctgttgctggcgaacggctggcaattgtccatttatcggaatgttcttcttagtacggaaaaagtcgaccatagacataggacgaccatcaacgtcaaaactagaaccaagttttaattgatccacaaaactctcaaaacctaatctcggccatcttccgttgactgatcgcatcaatgacaatgacgcgcgacggtgcataggtcaggtagccgctaacgccgcgaaacaagtgattgaaatcggaccagaatcggtccatctgggaagcattgttgatgttgaaccgtcttttctgcaccatctccatgacgatttcctcaaggttacgacttgcgaagaatgcacaagtcttcactaaaaagaaaacttaagcactcaacaaacagaaaacaaagcaaaccgtcagcaaccaaagccgcctttggttcaccattgttgtcaataacgcgaactcccttagcaatgccctcgcgtgtgacaattccatcttcgagctctttgcagatctgacgcttaaaaagacgaccagcaccaatgatgtcatgggtcccactaagattaaacttgaaaaataattaaatactgctaattacgcattgagaaatggctgggaagtcagcatttcaaggaaagtgcgcaaagatctgtcagactgctcatcaggacggcgcgagatggaagaaaagacgtcgttgagatccagctcatgtttatcagtctgacaaggtttaatctcaattttgaccgaagacccacgcaagaaatcgcgaacgattccttggattttttccgtgtcaatttccaatgcctaaaattatataattacataatgttaaaagacaaaaaacaaacaaattgttcgattcgcttgttcgtgaataagattttacggttgtcgtaaacgaagtgtgcctaaaagtaaagtaaaataattgcatgcgatttaagaggaaattaccgcttgtccaaatccctgcgtcgagtcgtgcacgaacttgatcaaatcgaaacaaacggtgcgaagcaatccatttttcccatcgtcgccaccgcccgaagtcaaacttttgtttcggctgagctgcaccatttcaacgtcatagcggaacgcaaaagcaccgccatgtgaagatggtcgagtttcgaacctaaataacttcagtgtctcaaacgcattaatttaactgcaaacatacacataaacacttgaaaagccttcgacatatctgttacaagctgccggaggaggaatgttcttaaacaattagtaaaaatctactgaatacaaatacattgagtcttacagcagcctacttaactttcttgacctcctcagaaagagatgacatgtttaatatttggtttcaaacaatgctctgaatttcttcttaaattgttaagaaaaaaatctcaattgtaattaaaaaaaacaatattttcaacatttatgtgtaagtaaataccaaccaaacaaacaaataaaaatttatgtgagtggatcaaaaatgcaacacaaacaaagtgcgtcatggaaggcactatggggtcaagcccagtgtcactcactatatccccaacttccctccctttctttcttcctttagttctctttctttttttgtttatctttttctcaacactatctcctgtgtttttttgtttacataaatacctcattttttactttctttttttcaaaggttttcgcttcgataaataatccatttaaaatgtgacatacctacacatcaaattagtatagttaatgttttttattctgaagtgtaggaccaaaatgtggacccaaacccaatgagtactctaattccgaaccccgacaaattctaacaaaaattcaacttcttttaaatttcacattttcttcaacctttgtttacacacacggaaacgaactgaaagtcatgactgatactcatcagtgcttcaataaaatcgtttaaaccattttagactaaaaatcgaaaaaatccctaatttctacttaattcgagttcaggtcaggtgttataaataggttaaaatgaagccggattcgtgctcagcgcctcaaaatacccacagaaattgttagaattttcagaaaaaaaaattttaaaaaattttcaggaccaatggtcacatgattgccaaaaattttcccttttcatttacttaaaaaaccgtaatatatgcaccgccctgaagaaaacaatctatttgattggatagcaagcagatttatgcgcacaaaatcaaaataaaaggcaagcgccaagtggcaatcccaaaagttaaacaaaaattaagttcgaaagaataaataaaagttgtcgaaaggcatggatcaagattatgtcagatcaaatcaaaatacccgatattactctccgtgacgctcccgaagaacgccaatcgtccaaggcctcaaacgcccacggcacaccgggcaatgccttccgttgtgacggaaaacatagcgccacaaacaacgagaatggaagaaatggccgcatgttgtggagatgtgcacctggttcacgtaaatgcgctgaaggcaaattgtgcaaataagaggctgcccatgctccagaatgaccttaatgaaatttttgaaaacgtcactacaactaacaaaccctgcgatctcttgcgacagccgccctctggtgggcacgagaatttggcaaagccggagccagcgtaacaatttgccagctgcagcagagagcaagcaagaaactacaaaaaattagttgtgtataataccgcaactgattgccagttacccctgcaattcgttgttgttggccttgggatcattgacgggaaaaatgtattgtggcatttttgatgtcccctaaaacaaaatacatagataaatttgtcattccaaccgaaaccttgagcggaacatgtgactgcatccaaaactcgtggatgtcgacgcgtaccactttcgaatcaataaccgcccctacaaaaaacgatgaacaaaatgattttcgctgaataaaacctggagcagtattctcgacttgttgctgccccttaacgaagaaacgtttgttgtgattcttgtcgacgatgcaatagacgaatttgggctcccaagtcgggtcatatttcttacacgccttcacataggaaggaaattcgtcgtgaatgttctaaagcacacttttacaatccgtcgtgattcttccagcccaactaacgttcggaaccattccctcactaacaccatcgcgaatgatgaaaatcttaaatttattttacttatcatttaagtacaacacaattatttgtaattattttttaccgtagacggtggttttgaacggttcttcttaactttgtccaaaatccagctcattttgtatgacagcatagttggctccaaaacgtcctgcctaaattagtcacaattgcccaacaaatatcacaacggaaaacaaacgtgcaaggctggaagtaataatctccgcagaatttgtaagggtttttcagatagtttgcgcaaataccaactaaaatattattaataataatgcacacatgagaaaaacaaaccaatcagcggatcctcagaagtgagtccctcaactcctttcttgcgaagcatgaacttctcgaacggcgttgcctttggaggacgactggtatcaacgccaatcacaagcacatcacctccatccatgttgaatttgctcttactataagatagaatataagaaattttaatgcagaaaaacgaacgacgcttgcgggaacataggcatgtaattgaagccgaaaagcctgaaaacaaaataaagtcactgaatgttcgctaagcccacttcatgttcattttattcagcacattagacagagtcatagcacgcgctttgctggccacttcgaaggggagatgttgagtcagcagaccatacttcttctcgttgagt

SEQ ID NO: 672 - DNA, 1369 bp, Heterodera glycines
cgtttgctcggattagtcgtgtttgcctataatagtataagagaatgcgagggataaaaaaaaatattttacactaagaagctcgcgcgaaataaattcggacatcttgtcgatgggcactcgctgaccaggcaagatcaatacaagaaaatttattcaatgctttttagacttagctcgtcaagagctttcggatgataccaaatttatcaagattagatcgttttaaaaaagttagaagtgtcaaatctctcaatttttcgagttttgaaccctcctaaaaataggttctaaacccatttccgcaactcccggggaacccgaaaccggactcaaaatcccggagctttagggacttcggattcgtaaagtatgcgaaatcgataaatttgaattttcgactttttgttcgaattcgtgtcctcgttcgaaattggtcaaaatagatgtcatattcgtgctcagcgcatcaaataaccgctaaaatgtgtcttttcgggttttttttgtgggaccaataatcttaacaagctaaaaaccacaaaatgaggctaaagcctcagatctacgaaccctgtcaaaaacctagtatttcgaactttttttgctctgattttttttgtacattaataaaaaattttgaaaaatttgtaggttaatagagtttttcataagctttggaacaataccaagaatgcttaatatggttgagtaggaaaaaagttatggtccaaaaattcgcccggtgacgttttttcctggtccgctatatttttaccagccctaatcatcattatgtatgtgtaaaatagctacctaagtataaatgtttgttttttcagagattttgttgtcctcttaaatgtcatcataactcaatgaattcgcctttttcagtttcggtaaaacgaggtaaatatcggatttgcttaaaagtgactttttttaaatttgtgattttcgtagaagagttcgaggctggtgcttcttcccagcatttgcagaggatacatctcaacggcgttccgccaccggtccattcgctgctgctttcctctccttcccaccatccaccgtttgtgcccaccgttcgtccgttaggtgtcgccggcggcgtttcgtatggaaaaacaaatggcactactttttcgcgtccatcgcatttaactgaggcacaacagcggggatctattggtcctctacaacggtcagaatctataaaaaagatttccctaacgtaattttgaaatcttagtccatctagcggcgatgctaacagtacaatcaatcagtttctgatgaattacgttgtggtaaattcgctttttctctttcaacacattatcattttataaactattaccctcag

SEQ ID NO: 673 - DNA, 884 bp, Heterodera glycines
  misc_feature (872)..(872): n is a, c, g, or t
tttcccaggggttttattgtgacttgggtcattcttcttgtggttgtggtaccaaaactgtaagcaagagaaaaacaatttggccacggccttgggccacataacctgctttttactaccatgctaatttaggtatgagtccgttacatataattaatggacaaaaaatgcgcttttggtatgtaaaataatcggtaattacagacagagaattttttccggtcgattttatttgtgtgttaactttcattcgtgccgagagagctgcggtcatctgcgctggccattctccccgccgttgtgccccacggcggcgtttggccaaccgccgcaaaatgccatcggcaaatttcgtgccacaaacgaaaaacacgggcaaagtttccatagaaactttgctggatttagcaacgcgtaggaaaacaaaaagaaatgtgtggaaaaactacgtaatatatgtacacggacattgtggcaataatttgttaatccatcggccgataaatgaaaaaaaggggggggggaagaaatttgaataaattacacaaaagcaaagggaagcgaattcagaactgaaatgcgtgccaattttcaagtcgattttgcatatattaagcaataattgtgataaaaagcatttaatgaatttaatgggtctaaattttaattatttaattattgaaatttcgaatttccatattgtttatcttttagagtcgtaattttaatttccgaaatttttgaagcctcagaattcagattagggttgcgaccccgaccgtcggggttggaaaagtcggggttcggagttgtcggggtcagcaacgtcggggtcggggttcaaatcgttcggggtcgggatcggggtttgngggggggggggg

SEQ ID NO: 674 - DNA, 3064 bp, Heterodera glycines
atcgttgacatttggctgagttgacgaatcgtcgccttttggctgagttgacgaatcgtcgcattttggctgagttgacgaatcgtcgcattttggctgagttgacgaatcgtcgagttgacgaatcgttggcgcgccaactattttagtgacggaacgccaaaatagtgatttctagtactcagtaaacaattcacgagcatatttttcacagaacgtttgtcatttccccgtggattcgggcggaaatgctccgtctgaaaacgctttatccgacgccggcggaggaagaaaaaggaggaaaatgaaggtgctgtaacatttcgacagtggctgatttcgacagtgaccgatttcgacagtgaactattttcatttattttactgttttccgacatttccgacagtggctgatcacgacagtgaccgatttcgacaatgaacaaaattttaactttgccaattctaacatttgaaaacttcaaattgatatcgaaaataacgacaaaattgtgtaaaacgacaatgctaaaatcctataaatgtttaaaagtgcagatgataagcgcaagcgcgaagaaattggatcggatcacgattgaaaaaatcctgcacaagtgcttccaagttttggtcttgacgaatgtatttggcctttctcgtttcatgaggccctttaatgccgtcagccggtgcaatctgataatctgcaacccgaattctccacagttcatcttcctcgatcattttccgagcaaatgaactcggtcgttggttccccctaaggtgcacattccaagttgaatgccaaccctgaagaaaagacatgaaaaaatggtcacatcccaccacacttcaagcgaattgtttgttcttccaagcccttctgctactctgtccaccacattccacaattcaattggaaaaagagcgtcagtctgtgccaaattaagcgcctcaattctccctcgaatccaattatcagctactccgcctgcatcgtgaaccaaaacttcttcattttgctgattcggcgaggcccgatccacgtgttaatgaaatagatgatcagctcttgaagctcaggagtcggctcaagaattgacatggcaatgcaaaaatagttgtagacaaagtcgacggggacaaaagccagcgcttgtagagaccgcaaggatgttctgacaacttcatcgtcacgatatcgcgtgagcaaatttggcaatcgctgaattcttcgccaaattgcttgtccaaagtgaagtacgggaaccaattattgccaacagactgacgaattgtttcgaagaatcttgtgtatgtggcgagagttttgctgggcagtaaaccataaactgccggaactgcacaatgatcgatgacaactgccattgtgtagacttgagtaaatccccttgggcatgtctaagataaaaacaattttacttattttgtggtatattggtagcggcacattttatatgcctctcgccactatcagctaaaagtgccctttagttattcacctcaaaagtgccatcgattgccacttcattctgataattcgccaaaagatcaaggccaaaacgagaacaaaaaatgatcattttttctccattaacagtttgatcataaatcgtacgatcacgcaatctgtccggtatgatgatttgagatgcgggtaagacatccaatccaacatcgccgacctaaccatttatttttaaaattattttgcttattaaatttatatttttaattatctaattatcatttgcctcttcctgatgcttccgtttctgataattatatgttcgcctcatatcagctgcagagggtgcactgattgcccgaatctcatcactaaggttcgaccgaacttctctgatgatgttacggcttgtggtcgggaattcgctttgcgcctcttgtcggagacgttcagatgcttgtctcacctaattagctacttaacacccgttacattttaaatttctaccatatgaccccccaaaacgggtggatggttatgctgtccggtagtgcgtccaattttatatcgcgacccatcggcatcgacttcccaacggcactgtacacaagcacgccctgggcaataaggtggacggtttgggcaacgccaatactccattccgtcttcagttttcgaaacagccttagaatttttcgtttaacattttcacgaaattaaattagccttttaacctcgaaagtgtagtcatatccgctacgagatagaagaattttcccacgatttgttttggtctctgcgaatcggagtagagccattggtcaatgaattcggaaaaaaacgaatagagggaacagcaaatgatgaacaccagaaatgacaagtcgagaatgaccatcagcattcgggaacaccaaaacaattcctctcaaaattctcttatcaaattgacctccaagaaaattgacctcccaatataaagtgaacgaccggcccttccactatcaacggcctacggccaaagtacagtacaactgagttttacctcattgaaaataaaagaaaaatgctttattttactacatcatatataaatttcacccattaaatagtgacttttttaaataaaaatgactaatacacaaatataattttgttcattgtcgaaatcggtcactgtcgtaatcagccactgtcggaaatgtcggaaaacagtaaaataaatgaaaatagttcactgtcgaaatcggtcactgtcgaaatcagccactgtcgaaatcagccactgtcgaaatttcctggcaccttgtcatggcattgtgttgaacttttgttattttcgcaccgtaaattgatttttttttaattttaattttcgactttttgctcgaattcgagtccgggattcggaattcgtcgcaatggatgtcagattcgtgatcagcgaccccgaaaaccccctagaaatgtgttaaaaaaatttttttttttatggtctgtaaaccacataagtaccaaattatggctgttggaatcgtgtctagattacgccccggaaatttgcgtatttta

SEQ ID NO: 675 - DNA, 7008 bp, Heterodera glycines
tctctacaaaaaatatttgaagaaaatacaatgccaataaataattaaccaatgcgtaaattcaaatttaatttactttgtgaaaaaaaatcaggaaaaattattgtacataagattttgtgttggagatatgtaagatatgtaactgggcattcatttcaccgagactgatgctttaagctttaaattgatacaaagaatgcagaacctttgtatcaaacaaaagctaaaagtccctagaatcattaagacaagaaaatagcaaataatgacattaagaaaaaaacgacaacgagaaaacacgaaacgcatcctttttgagtatattcaagaatttttttttgtctattacttttagcccagtgtttgggactacaaaagattctatagactatgcttttatttgataccaagaatgtaggcattgaccaattaagaagaaatttatagccaaagaaactgatgattagacgcctacctagaagtccagtggacgtctgtctatatagcctatttttactatttttcatatatatttgtttagaaattgcaatattttcttttaggggcatctcttggtaatttttgtcgttgaaacacagcaccagtgacgcattgaccatggactacggcgtggaacgcaaacgccgcagactctccaactacggagcgacgtcgccgacaaagagtgtccaggaggtgaaacccgtggcattgtcttggcacggtctcaccgctgtccatgccaaatcgggacggaaaattcttggtaaaccccagtcggagttgcgttacctacgtcaaagactgtttcgatttttttagacgacgcgtccggcatggccgacgcgggccaactcgtggcactgacgggcgacggcggagtggacaaaacagcgcttttgaacacgttgctggaccacaacctgaagactttgagcgtggagggtcaagtgctgatcaacgcgcactccttgggccggttcatcacttacgtcatcggggtgagtcggaaaactgctaatcttctgttaaatgtcaaattttgaattctaaaacaaataaatggtaaacagaattacaataatgtacaatttttcctttgaaaacttgggttttcaagcgtactttaccaattaagtttttcaattcttcgcgccgttagttttaaattcaaaacttgaccgcataatataaagtgccggaatggcaaatccaaacatcgacgatatgtcggttgagaccgttaattgaaacgggattagtggttattaaactatagtgtgttttcccgttctcaatttcagtacgtgcaacaggacgacttgttcatgggcacgccaacggtgaaggagcatctgatggcgccggcacagctttggatggtcggacacacccaacggacgatgcgtagacgcgtcaatgaggtgggattttggatcagtacaaaatggaaatcactaatttgctaatggattagtttggttgctaaagtttcgtcgtgcggctattggaattggcgaacgagttttttaagaatgaatttctcattttcagttggaagaagccatttcggatggtgaggcgcgtcgtttgccgttcgccttcgaaccgcggcacaacccgcaaatcatttttgccctccaaccgactaaggttccaatttttttttgaattttccaaaattcctgattaggacctcgcctcgtcagtggtggacagcgtggtctcgcacattctgcgtaccctgaatttgttcggccggcgaatcgtcgtcacaattcaccgtccgtcagaaggaatgtgccagaaatttgagcgggtaaaatttgaccgattttccataaattgagttgggatgagtgccacccccaccctaaatcgccaaaatttacgcatttgtttttatttgtctgttgataaattatatttactattaaacgttactttttgaagttgccatctgaatgtacctttataataaaattgaacatgtcaaaatttatgccttttctcatcccattggcagccacaaagcacaaaatggaggtagggaaaagaatttttttttttgaaaacattctgttagcaatttttgtaatactaccgaggtatcacaaaaaatggtgtgataccatcggtagtattgccgaagttttttaaaatttctcatgggggaaacaagcttctcccagtgctgacttcttacaaagaagcagcaattgtttttagatttagcgcaaaaaataaattctctttggcgttttgaccaatttgtctaacactgaaaggaattcaaaaattttcttaggcatagtttttccaatcattttattttttgaatattatttagaaaaagtaatcctttataaaaaatgcacattccaaaaatagaattccccaaagaaattgttccaagtttggccaatttgtcgctaaatcgtcaaccaattgatgtggttttttcttcttttgactttctttttaatatattttttgagtcctcggaaagggtaaaatgatttgattttattgttagtctgattttgtgcccttagccctgggttcaaattaagtaatactttgaaataaaaaagaatttgattttaggaccgtcttttgaagttactcgaacggacgcaaaaggatgtccagcgcctgacgaccgccaaccaacagctcaccaccgccaaccaacagctcaccaccgccaaccaacagctcaccaccgccaaccaacaacttactacaacaaaccaacaacagcagaacacaatcaaccaccagcagcaaaacatccaacaactccaaaacttattgggtttgtgcaaaatttattggagatttaaatttcttttctcgagcaattgattgtaatgcctaatttttcaagccggtcagcaaccgcttgttccagcgtttgcccccggggtttttggtgaacaacagcagcatcatcatgcgccagcggactttctcggcgaccagcatgcgctcggcggccagaatccacacgcggcaccttttggccccgactttttcggtggtcagcccgaaaattttggtcagtgccttggttaagtcaggcactttctccattttctttcgtttaggtgttcagcagcagcacatgcaggagcagcagggtccccctcctccgccgccaccgcagtaagacgttgcaagtggaagtcgaatgatgagttgacgtttgaccttttaacctcttatgttttaacgttattttgtctgatgaagaataaatctaatgcctcgtttcagtgtaattgtttttttttgttcagaattgccagttagaaaagcaaaaacaatagtggtttttaaccaaacaataaagcgcagcaggtctaacaaaaaaaagcaattaacatttgtggtatgtcaccatagcttaataaatttcgagatttcaaaaatccatcaattctgacttgatcacgcaaattttaaccccgtcccgcaaaaaagacagccaatcccacagcgggaacaacaaatttctcagggttttattttgaccatcgtaatgccagcaatttttattgtcaaaattttcattcgttcagaaaagcgagattgaaaaagcaaaaacagcagtggtctgattcaaacaataaagcgcagagttcaacaaagaaaaagccattaacattttgtgatttattggtgttgctccttcatttccgttccgttcattttcactgtccccccttcaagtcgcgcatgccggcacgcatcacctcgtccacctccagcagattggaggcgatgttctgacaggcgttcagactcgcctgcttcacgcacacattgtcccaaacgctctaaacgggggaagagaatgaatgaaagtgttcattttttgtggcacgacacatttgtccccgcccatttctgatgacacacctgaggaacacacggctctccgctctccaggtccaatccgaccagctcaccagcagcactgaacgtctccaccagcttgacaatggcctggcaattgaaaggagtaaataaataatttttttaaaagccttttccctcacctcctgggcgtcgaatccggcattgaccgccaaagttttcggaataaccagcaaagcctcagcaaaagcctgggaatgagaatgatgacaataattgaaagggattaagaaagaaagaaagaattacggcaccaaaacaccgagtttggcacgccctttcacattgtcggcaagctaaaacagagattggttgtgaagtctagtgggaggactctacttgctacctttttcagtgcacaatatcccgcaatttcaaatgcaccggcgccgggcaaaacggcacctaaagaaaccatgaaaattaaatatgtgacgaccaaatgacagtcataagtaaagcccaaaactgggaaaagaggtgcaaaatcaaataacccaaagtgccaaggcattaattgcctaggtaattagtcattttcatccaaattgtcccatcccctcgtcgcaaaacccaccgtctttcaacgcattggcaaccgcccgctgtccgtcataaatggcgtccttcagctgcgtgatgctgtgcttgttgggccctttgagcagcaaagtgaccgacttgggacttttgcactcctccacaaaagtgtatttgtcctcgccctgaagcggtacggtaaccatgtgttacatacagtacaccaatggaaaactgtccccgcccaagaaataacggcactgctcccccttaactgaccagcacatgctcataaacactgcctgcccagccgagcacatcgggcgtcaggtcgtccaccgaattgaccgcctcgccaccgcaggccaactgcagccgttccatgttccgacgcttggcacgtcgcagggccaaaatgccgtgctgtgccaacaaatccaacgacggcggatcaatgcccttgggggaagcggggattagttatttttttaaattcgagagtcattcccgaataaaacaagcacacaccttttgattaatcaccacaaatccttgatctccaccggcacagaccgtctccttcagttccacaattttcagcacccgtcgtgtgatgtattcgcgctccgcctgcagcaaacgctcacgctcagcctattaaagcacaaaagcttcttcattctcgtcaaataaatattgaattttggtgttgaaactgtcgcctgcccaagagttttacagaatcaactgcacgtgccatcattgataacaagcacagtttcaatttttatcatcaaattttgaggaatttaattataaatcaaaaataatgtaaaatttagaaaaaaaagtaaaataaaattcataaattaaaaaacaaaagaatttgaatctgctttttgagatgtcggatacctaacaaataagcccagtcctgtccggctggtgctgtaacatttcgacagtggctgatttcgacagtgaccgatttcgacaatgactgatttcgacagtgaactattttcatttattttactgttttccgacattcccgacagtggctgatttcaacagtgacagatttcgacagagaataaaattattattttattattattatgtattcacatgaacaagccggaacccacggttttgcccgaagcaaactacctcacggtcaaactgacccgaaaagtcatttttattttaaaaaattcactatgtttaatgaaaattgatatatgtgtgtagtaaaaataaagcatttttctcttattttcaatgtgaatgaatttggaaaaaaacgaatagagggaaaaacagcaaatgatgaacaccagcaatgacaactcgagaatgaccatcagcattcgggaatgccaaaataattcctctccaaattatctaataaaatgacctcccaagaaaattgaccacccgagataaagtgaacgaccggccttatcactatccaacggtcaaagtaccactgaattttaccacattgaaaataagagaaaaatgatttatttttactacacacatatatcttgcaatgtgatacaaaaattcaaggaaatctgatatatggaccggacaaaatgcacttatgcttattgggtacactggaaaaatcattgccagacatttatgtgaatttgcgtttttttgctgcaaaatttacaaaaataaaaattctccaattttccagaaaaagtcggctagcaattggaattttgagactagaagtattatcagatatttttagcatgacatattaagcaaaaaatgttcaaaatgaataaagaaaattcaaatggaaagaacgatcaatttattattattatttcgtcaaataaaaaccattagaagattttggatcacaatttttttggaaaataatttttcaaacggttagacaaggccgaaacatccgtaggacactcattttatcgttaaatctgaaattttgcaaattttatttaatttcatttttttttacccttcaattgatcaatttttccaactcgcgaaaatcgaactcttccttggacatgttggcacccttctggccaatctgagcaaggcatggtgttattgttgaaagatgctctgctgacgagcacttgagggtcattttgctcttcacaagcccaaaaaacagtgatctgatcggtgccgaaagcggcaatgaaattaatttcattaattttaattaggtaattaatgagtggccgccccaccaatagcgcaaccgattgcaggacagaattggcgatcagcagcacattcttttgccacaatagcagcatggcccgacgtgtcatacaatccgactttgcaataaatccctttaaattgaattttataattaaaattattttggatttcgaaaaatttaaattacgtagcaaaggcagggaaaggcgaggcagcagaaaaaagaaaatgggagaacaaagttcattttccgcttaatggtttgatagacggaaaaaaaatcattagaaatttggtgacaga

SEQ ID NO: 676 - DNA, 1952 bp, Heterodera glycines
caaaacggcacattttttagtcaaaaagcaggcttaacacaaaactgatttaaacaatttaagtatctttctaatttatattattatttaatttgttttacactcactttttcccttcatcggcaaataaaatgggctgtcaaaattcaaattgcccatattttctcccttggcgccaaattggcattggcacttttggccaaatgccaggaatttgctgacctcctcacaatcgttgtccaaggaacaaccccaaaaggtgaacatttcagagactgtaaaaaaagggtgattgccaatcaatcagatcgccgcatcgatttatcgatcggtcaactaatcaatcaattgagcaatcagttttttatatttaatataaaaatcgattattgatcgattgattgatcaaaatatttgtgaaatggagattgataaatcacacataaaaatggacctatttcgcagctgaccgtgtaacagtactctccgcctcggcattctctggccgctgtagtaccgtatccgtttccacgaaaatagcccgccctgcaccggatgccttataatttaaatgtttttttttttaaattttcgacgatctatttaaagttcaattctccgtttctagcaattacggtctaatcgggtatataaattaattttcatgcatttccaattatggcataatattcgtggcattttatgcaatcttggcactatttctctgatttatccccccattcatacataaaattctttggcactattttcctcatttttatggcacaattctcgactcattaccatccatttttccctttggcattgttttccctcattatttgtgccacacagttcactgtcattttcatgcaaattttttttttttggcattttgcccccacttttctcaagtgcctctggcgaaagggtcggaatcgggccgggcttctccttttcgggcagtttcgcttgctcattggccatgtctttgccctcgtcaccaaattggcactcgcagcgctgcttcgtcgagtgcagcgcggagttggccgcgttcacaaagaattgttcgcagccttttttgtccgcgtccccgctgcacccccaggtgatcagtgctgtggaggtgtagttttctgaaatttttgaaaaacaaaaatttgccatttcagccggggcctaaccaggcgccaaaaatggcatgatcatatttgactagcaatcgccagaccaaaatgtttctttttaaaaaaatttcaattttctcttagaaaaacaggatccgaagcttaagcctaagccgaggctcaagcaggccttctgcgcgtcataaaattggggacaataaataaattacagtgattttaattatttaattttgttaatcttttattttgcacttacgctccatgcacatcacggaaaagcagtgatgggctttgctctcgcatatttcatttgtggcattttcacccgataaatgattggcatagcccgccttgcacgtcaatgcttaattaattaattcattaactaattaacaccactcattaattttaaattgttactcaagcatgggttgaacatggcgatcatcagcagcaatgcaattagcggcaaaagaacaaaggaagagatcattttcaatatgtccttaaaattttattggaatttaattggaatgattttattttttgtttgtgctaataaattgtaaaatgaatgcttttcacaatttttttcattttccatttgcctttttttatgagtcattcattcactttccatccaagcaaatgcttctttctgttctggcgctattctgatgattaatcaaaattgtcttcatcatcaacaaccatttcataaaataattattcactgagaaaattttaaaaaaattaaaaatgatttgtgttaattaaatgtgaaaattattatagtaatat

SEQ ID NO: 677 - DNA, 1415 bp, Heterodera glycines
  misc_feature (103)..(103): n is a, c, g, or t
cataaagtaggcaatttttgacttttatgaaattcactacgccaaaagtcgtacaaaactaataaacgggagatttatttgttccagattttcgtctttgccntattttagggtttgtattcaaaaaaagttgctcataataaaggcatttcttttgctttatgaaagtttatatttgcaattatacatgcacttttgctccataattttataacgattatataattttagagctctaaatttcaagaaaaccgcataaagtaggccaatttttgacttttatgaaattcactaacgcaaaagtcgtacaaaaactaataaaacggagatttaattttgttccagaattttcgttctttgccctatttttaaggtttgtatttcaaaaaagttgctcataataaaggccatttcttttgctttatgaaagtttatatttgcaattatacatgcacttttgctccataattttataacgattatataattttagagctctaaatttcaagaaaaccgcataaagtaggccaatttttgacttttatgaaattcactaacgcaaaagtcgtacaaaaactaataaaacggagatttaattttgttccagaattttcgttctttgccctatttttaaggtttgtatttcaaaaaagttgctcataataaaggccatttcttttgctttatgaaagtttatatttgcaattatacatgcacttttgctccataattttataacgattatataattttagagctctaaatttcaagaaaaccgcataaagtaggccaatttttgacttttatgaaattcactaacgcaaaagtcgtacaaaaactaataaaacggagatttaattttgttccagaattttcgttctttgccctatttttaaggtttgtatttcaaaaaagttgctcataataaaggccatttcttttgctttatgaaagtttatatttgcaattatacatgcacttttgctccataattttataacgattatataattttagagctctaaatttcaagaaaaccgcataaagtaggccaatttttgacttttatgaaattcactaacgcaaaagtcgtacaaaaactaataaaacggagatttaattttgttccagaattttcgttctttgccctatttttaaggtttgtatttcaaaaaagttgctcataataaaggccatttcttttgctttatgaaagtttatatttgcaattatacatgcacttttgctccataattttataacgattatataattttagagctctaaatttcaagaaaaccgcataaagtaggccaatttttgacttttatgaaattcactaacgcaaagtcgtacaaaaactaataaaacggagatttaattttgtttcagaattttcgttctttgccctattt

SEQ ID NO: 678 - DNA, 1069 bp, Heterodera glycines
tataacgattatataattttagagctctaaatttcaagaaaaccgcataaagtaggccaatttttgacttttatgaaattcactaacgcaaaagtcgtacaaaaactaataaaacggagatttgattttgttccagaattttcgttctttgccctatttttaaggtttgtatttcaaaaaagttgctcataataaaggcaatttcttttgctttatgaaagtttatatttgcaaattatacatgcacttttgctccataattttataacgattatataattttagagctctaaatttcaagaaaaccgcataaagtaggccaatttttgacttttatgaaattcactaacgcaaaagtcgtacaaagactaataaaacggagatttgattttgttccagaattttcgttctttgccctatttttaaggtttgtatttcaaaaaagttgctcataataaaggccatttcttttgctttatgaaagtttatatttgcaattatacatgcacttttgatccataattttataacgattatataattttagagctctaaatttcaagaaaaccgcataaagtaggccaatttttgacttttatgaaattcactaacgcaaaagtcgtacaaaaactaataaaacggagatttgattttgttccagaattttcgttctttgccctatttttaaggtttgtatttcaaaaaagttgctcataataaaggccatttcttttgctttatgaaagtttatatttgcaattatacatgcacttttgctccataattttataacgattatataattttagagctctaaatttcaagaaaaccgcataaagtaggccaatttttgacttttatgaaattcactcacgcaaaagtcgtacaaaaactaataaaacggagatttatttttgttccagaattttcgtactttgccctatttttaaggtttgtattttcaaaaaagttgctcataataaaggcatttcttttgctttatgaaagtttatttttgcaattattactggaccttttggtccataattttatacgaattatataattt

SEQ ID NO: 679 - DNA, 5370 bp, Heterodera glycines
  misc_feature (4239)..(4239): n is a, c, g, or t
gaaagctgggatactttttccacgtcctcgagcgttcgtcggaccgtccgcagatcaccaaggtgctccatcgcgatttgaagcagttcagctgggggcgggtgcgatcggagccccaaacatctcgttgcggccgggagtggctgggtgaacgcgtcgtacaggtagtcgtgcagctctggcgcttcgtccccgatcgtcgctaggccccgatcgaaatggcccttgaaaatgtcgaccaattcccgcagtcccctctccatggccgagagacagactgctgtctgtggcctgtctccgttgagatccggatcgagcaaatcccgtgcttccgcgatccgatcggcgagagggcccgatgccctttccaactggtcccgaatggcgcgtatggcaatgccattgctccgaaggtttcgcgtccctccgggctgagtgcccgaaccgcattgaattgccgatgcttccgttcctttctgtttgtcctttcccctttttgcactcttctgacctgctccgatttgcgttgtgggtgagccaccgattcgctcatttccgtcgttgccgtggtcctgctcgtcgtccgtaggctccattgcggctgttcgaagtccgaaatccgaatttggcgcggtcgtcgggtgaccggtcgatgagttgtgcagtccccctgctaacggcaccagtttgtcgaaaaagctggcgatcaatggaggggtgatcgccggtttcctttgccctccttctcggctttgtcgacccctttccgaattgaatgcccaaggggggccgagaaaggagaatggggagggccgacaaaaggggggtgatgtaacggcaccaccactcagttaaggagtgagtgaacctcccaattgcctgccgggatgagtcccgactccgatcgctgaggagggaagggcgatgggagggagtgggcaaggatcaggagtgatccaatcccgcacgacaattgctgatcgctccgaatgcgattaggggcgccgaatgccccaaccgaatgaccgaatttggtgattgcccaaagggaagggctattttcctctgtccaaaggaaaggacaaacacacaaatatttattgccaaagggaagggcacatatttggaggaaaaatgtgataagggggagaccaagtgaagggaaggacgaaagaaaagggaaagatgaccgaaggaaaaagagagtgaaccccggagagattaccggcggggggttaaataggccggacaatgagaaatgcaaatcacgtgaatgggcatttcggacggggacaaagttgggaagaacatttgcccgatgacattggggcccaaggtacaaaatgaattgaattgaatggtgagaagagacgggcaaaaaattgggacaaaagaagcgatttgagaacagatgccccgcggaggggcaacaaaggaaaacatttgaaatgaaagtgagcgggggcacaaaaatgcaaatgagaaatgctgagaagcaaaaggaagggaaatggtaaacaaattggataagacggaaaaagagggggggaaggcaaattgttgaagtgaaaggaagggaaaaggaggcaataatgggggatggtgatcataaattaatcactgtttggcatcgggccccctgcttccttcagtccgccgggaacaatcccggccatccaaagcccatcctttttctctcgtcgctttcgcgacattgggggcggcggcgaggcgggccaaggacgagccacagtcgaaatgccaccatcccattgaaggaagaggcacaggggaccaatcccctttggagtgatgccgttcactgagtccctgagttcaccgacttccgggccgatgatcatggccgcggatccggaacatttgaatcccgatggcgtgcttgcgcagtcctccgagcggagcatcaccgacatgggctccgatgaagaaaaaagggcgacaaaacaaagcagcggaagcagtgccatggcggccccgggcctggatgcccgtcctcgttctgcatttctccaagctctagcggctgcgcgggctcgtctggccaattgcactcgttcttgacttttgacctgatcggcggtcggctcgggaatgtccccacccgtcaaacgattaaaaactcgaattgggtgccgagtcacccatgtcatcaccttccacagcagagacgccccgagcaagcactggctgaggcctctttcgcacggttctgttgttccgtcttggtccgattccggtaactcacatttggtccgttgctgctccaccctacatcgcttctcgggctggacatgcggagggtccttccgatcgcgcgggttctttggcgttgggttgaggggaccaatccccagacgatcgttctcgtaaatggacggtttcgatttgtccgctgcttccactcccgatgaggctggcatgcggttccatctgttttcttctccgcttattgccatgaggatggtgtcgcggggcactgattgccccaagggcgccccgaaatgctctccgcaaagtacggtcccgaacactgtgtcgacaagaaaggccccctcggccgatattttgaatccgatcaccaagtcccaaaacttgcgaattccgatcacgatttgaggctgaaccgtcgcgtccgtcggcttgagcaggccggaatgggttctcggctcgaccacactttccactggtttcgacccaatgtgttcgcgggtttccggtcccgctggctcacgaattgcgattggtttccctggtccgacccaacagaccaaagagtgatggtcgttgcgcaggcaccaccggcatgcttttgggcggggacagcaactggcaatatgatcagaagaaaggcatcggatacaccgccgttgctcgaagaaacgttgtcgtcgttcttggaacgtgggataagtcgggcaattgcttggacggtggccccaattttggcatagagaacagccgttgtcagttggggccggcccacgagattgggcaagtcgattccggttccgatcagccactttccggtgtggcgcgtgagttccggtccgaagggcggatgccccaggtgttatgggtcgttgggatgaggggttgcttctgaccatgaacaccctcgggaactgatcccgattctgtgtcccttcggcgtgtcggctttgttccggtcttgattcggttcggcgctccggctcgcgcattgccgccaaagctgactctgccgcgcgcatgcacctgacttgggcgcccaccgccctccgaaattcccgaactgaccatttcgttccactcgtgctttcccggatcctcaattccgtcaggatccgaaccggcagcttggactcgagcagtggcatgaaggaagcgtcctccacattcgccccgagttgctccaattggcacactccgcgttcgaactcgtccacgacggtggtcaggctttgagcattgtctgtggccggtggaaggtggagaagctgggcccggattgcccgctgcagatcatccgtgtctccgaatcgttctttcagcaattgaatgaccacgggatagttaccgtccgaaggagggtagacctcgacagccctcctggctggggatccctcctttaagcagcgaaggagaagaagctgcttttcgaagcccgggatgggcttgtcgtcaactgcccgcttgaaatacgaccaaaatgtcgtccaatcctccggttgtcccgagaatgtcggtggctggaggcgcacggtttcgaatactgtcgtctcttcgtcacgtcgagtggttcgcagaactgaggggtctctgcccctgacctgttcgggtatccgaaaatgaccgcagggatttggattccccgcaattggaagttctggaatcagcgggcgcggttgattgcccgcttgtcggatgtgcggggagggagtccgttccctcctatcgctggcctgattgacccaagtgttggctccgtttcctcctgcgtttaagaccgggtactgggcgaccttggcgacgcttcgcatcacgggcgtcactgcccgtcgttcctcttggatgttcagctgctcgaaccgtcttgggaattgtccaaacagcaaatcgaccggctgatgattggtctgtggttcatgaacttgcggtggagggaacggcgtgcgatggacagcgggatcgtttcccgcaggttgacagtctacggttcccgatcgggtcccggatganagctgggataacttttcccgtcctcgagcgttcgtcggaccgtccgcagatcaccaaggtgctccatcgcgatttgaagcagttcagctgggggcgggtgcgatcggagccccaaacatctcgttgcggccgggagtggccgggtgaacgcgtcgtacaggtagtcgtgcagctctggcgcttcgtccccgatcgtcgctaggccccgatcgaaatggcccttgaaaatgtcgaccaattcccgcagtcccctctccatggccgagagacagactgctgtctgtggcctgtctccgttgagatccggatcgagcaaatcccgtgcttccgcgatccgatcggcgagagggcccgatgccctttccaactggtcccgaatggcgcgtatggcaatgccattgctccgaaggtttcgcgtccctccgggctgagtgcccgaacagctttgagttgtcgatgcttccactcctttctgtttgtcctttcccctttttgcactcttctgacctgctccgatttgtgttgtgggtgagccaccgattcgctcatttccgtcgttgccgtggtcctgctcgtcgtccgtaggctccattgcggctgttcgaagtccgaatttggcgcggtcgtcgggtgaccggtcgatgagttgtgcagccccttgctaacggcaccagtttgtcgaaaaaggtggcgatcaatggaggggtgatcgccggtttcctttgccctccttctcggctttgtcgacccctttccgaattgaatgcccaagggggccgagaaaggagaatggggagggccgacaaaatgggggtgatgtaacggcaccaccactcagttaaggagtgagtgaacctcccaattgcctgccgggatgagtcccgactccgatcgctgaggagggaagggcgatgggagggagtgggcaaggatcaggagtgatccaatcccgcacgacaattgctgatcgctccgaatgcgattaggggcgccgaatgccccaaccgcatgaccgaaatttggtgattgcccaaagggaagggctattttcctctgtccaaaggaaaggacaacacacaaatatttattgcaaagggaaagcacatatttggaggaaaatgtgataggggg

SEQ ID NO: 680 - DNA, 2194 bp, Heterodera glycines
ttaatttgcgctcaatttcgccgaggcgttccgcgatggcgctgaactgcgcagtcatttcggtcgccaatgtgttgttgttgtttgttgaaattaatttttcaattgcagataggcgattaataatagctttaatgtttttacaaatttattcaaaagtacaaaaaactaaattattctaaaaaagtttgcacaaaatagcaaaatttggtcatttatcgtgtaaatctttaacaaatcaacacaaattttcaaaatttgcccggcggtgcctaccgtcaccgccggacctcccttgtacctcaaacttttttgaaaaaatacgccgtaaaaaagggttttgaaaagcaaaaaagctcgatttgcaggcttgatataattctaagctaaaataaagattgtaaaatttttttcgaatttttaatcaaaattttaaaaattttgaagaaagtcccggtcccggcggggccccgggccctaaattggggccggggccgggagtcccggaaaaacgggagtctcggtcccgggggtcccgtacgggtccattttccaagtcccggtcccggccatctcaaaattcccgtctctacttaactttataaataggcaaaaattttgatgcttttcgagggcgtcaatgatggttttttttgaaatgttgatttgatgatttttgatgcttttttgagaaagtttgctgatttacgctgatttttgggaaaaatacctcaaaaatggccacgtaattttcttatttttcggccaatcacattgacaagaaataacaaataataaaaaaaatcgcaaaatcccctaatataataaataagtagggctataaattatatgcactaaaaaatggcaaatatgcgcataaaatatgcaataaaaatccctcaaatatgccctaaaaaaaccgaaaaatgcccaaatatgcactaaaatatgcatttggcgacaattgcaaaaaattttgaatttcaaaatttatatatgcatttttgaattttttttttcaaatttttattttatgctcaaacaaaattactttttttgtatcttttgcatcaaaattttttcaaaagtgcttacaagaagttctaaatttttcgattttcaagggtgtattttttaaattcccaaaaagtcgatccttatgggtgtatttttcgtttttattgcatttttcctataaaatttgccaaaaaatggccgaaatatgctctaaaaacggaaaaatggccaaatatgcatttattctcgaaaacacccaaaatatgcttttatatgtactaaaaaccttcaccaaaacaaaaaattttaatgcagaaatgctatttttgagcccctttcttcatagcatatgcgcaaaaagaaaatatgcaaaagcatataatttataaccctatttatataaccatagttcttagacataaacctttgtaaaaaaaatgattgactgatcaaaatgccaaaccataaaaactaacaaagcaaaattcgactccaaatcatccgaaaaattttacttgaaaaatttcaaccaataaagcaatttgacttagaaaaacaaataaaaaaacaacgcctattaattaaaaaaaaacattaaaaggtcgttttttaaatttcaaaacaatatatttcttggaaatttaggttgtttatatttatgccattttttcatagttccgccacttttttatcaacaacgatgtggtttttccgaattaaaggcaaccaacggcaatccgccactgtcggtgccggtaaattaatgataataatgggtgggtggggtaggtaatctatgcgcgaccgttgggatgtggcccgtgggaaaatcgtcatcccccaccccctcaccgccagggatgtgccggctttgccttatccgtcaccttccgccggcggggcaaataagattcaaaagggggaaggcatcggttggataatgcatgggctaaacggaggacgggtacactgtccttttgtgccgcgttgacaggtaaaatggcctttaagagaggagctggacatttccaaccggaaattagagggacaacaaaggacagacctttcatttaactaatatgtatcctatcaattcaattattctcttccccagagggtggaacagttccgattaatatgaatttgatagattttctgataaactccgaaggtttga

SEQ ID NO: 681 - DNA, 4210 bp, Heterodera glycines
tcagggggaagcaggaaacggtggcacacatattggcacgcgtgccaccttcgcggcaaaatgttatggcgagagatagaaagaagtgaaggagaagagagagatagaagagaggaagcgagaagaatgaggagcggaaagaagagaagaataaaagaggggaaaggagagagtaaggggagagaagagaggaagcgaaaggatgaggtgaggaagggagagagaaaatgaggaagggaaagagagagaaaggataaagagagaaattaatgaatagagaagtgaggaaaggataatgagagagagagagttagcaggagagagagagagagagagagtaaaagtgaggaggagaggagggaataaaggaaagaaaagaaagagaaatgagaaggttaagggaagagagtgaggatagaatagaagaaaggataaagtgagagtgtgagagagagaggagagaaaaaaagggataaagtgagagaggagagaagagaggaaagttagggaaggagagaagagcaaatagggaaggagggaatgagtgagagagagcaaagaagagaggaaaggagagagagagaggacaagagagaggaaaggagagagagagagaggacgagagagaggaaaggagggagaataacgaggagagcagagaagaaagaaaaggagggagagagagtgaggacaggagagaagagaggaaaggaggtagagagagtgaggagaagataaaaattatttataacaatttatatttctatattactactaatataaaaataaaataacattttcattattttaggttgataattactttcaaatcaataaaaatacaatatttatttacagtgtcataatttttcaaaaattttcttagggagatagttgggacaagcaatgccgaaattaatgtatttgaaaaatgtttacaaattctaatacaaaaaaacattcaaattcgaattggcccaaagttagccaataatgaaatatatgctgtaaaatccaccacatttcttttaacatgttgaaatgtcgatccgcttcattcatcaaatcattttctggcaaatgtctttcgtcaattcgaccaattgatgagtatttggcaatatcattaacacgattaaaacatggaatttgcatggaaaatttgttgaaaattttttgcaaaattttcacggcattttgccgcaagattggatgacgactaaatttaaatcaaataaaaaaaaagaaataatttagtttgaattaccttaacagtttgtatccaatcaaccaattgcaaattgataaaaataaacaatgaaattgaacaacaaaagctaatatattaggattgatttcatgattattcggatatgatcttaaaattattattattcaattgctgtttttctcaaactttaaaaatttaatttgaaaaatgttttgaaaatttcaccacatattgtaataattcacatattaaaatattatcaaatattaacatgttattttatgtaatattttatcttttaaaattaaatattcttaccaaaaattatttattcatcgatatcaatgtaaattattttattttaattcgttttctggctttttctttctacgtaaaattaaataattaatctgctaatttttcattcacttaactaatacctgcttgatttgatattatctaaaacatttccagaataacgccaaaatcgaagtttccagcagccaaaataggctgattttggctgtgtgttgaaaatttggggcgcctgatagttcatttactgcactggctgttgttgcacttgtacaccttgctcgttaattggccaggcataaggttggcgtggttgaaaatttgacgcttgtattggttgggcttgaggatggccaaaattttgttgaaccgcagctgggttttgctgaaccagcattcaaaacggaatgttattggctctacgcgcaaaaacaccaaaatgatgtatttgcttgtggatttcaacaccatgctgagtcagttgaggttttgcgggccaactccaacacagcgcttctcgttgacagatatcgaaatcgtctaaggtttggataaccgaaggagtcatcgtaaacggtactcactcggccgaaagcaaaaaaaaagtctcgtcatgttcaaaatgctatttataacagggctcggatctgtccttatttataagatttgtccttatttggagggtccaaatcttacaaaataaaaatgtccttatttgtaagatttgtccttatttcgggctattgttcttatttgtcgcttgtccgaaaaatcggcgcccccacaaagtgtcgctgacccacaaattgtccaagccacgaattgtccaagccacgttttgtcaaagccacgaattgtccaaaagagtaaaaacccacgaattgtccaaaagtctaaaaagctcataaaaacccggaaaacgggtctattttagggtttccggggtcgctgaatatgaatacgacatttatatagccccttgcctaatcctaaacccaaatataaccatgaaataggaaaataaatttttaatttctaatcgaatggcgaccataattcgaacaaatttttaatgctcttatgtgattcgaattctctctatagacacacacttagcttcacacattgaaaaaaataattttattaaacattcaataaaattcattacggaacatggacaattgaatggtcgtaaatttcaaaatctctcaattttcctgcatatccttcaacttggagaccgagcgccgacatcagatcactaatttcaccgttgctgttgtacgacgcgtccgccaaaattcgcataataaccgcgtcctgcaggatgtatcatttgtgtcgcttgtgaatgaaatggcgagcagatcaggcagcgtccgcctgtctgtcgatactttcattaaccccaccaatgaaatctgagaggtcggggtggtgacagaggccatgtggcgcccgaatgattttgtcctcccacgctggaactgaattttttattaaatttaaacggatgattgatgaaagaattctgcctggcgctgtcgaagtcgatagcgggctcaacgaatattgaacaagctgctcctgtggactcacagtggttggccatgtaagagttgatggtgccggtgagccgatgccgaactgtattagggtagccgcatagctgtgttccgaattgtggtcgaaattgttgtccagagtgcagctaaaaattaaatatttggaaaccaaatgcataaatttaaacaaacaatgattgccgatgggtgaaaaatcgagtgggttaccatctccaaatgcgttaacaccatccaacaacgggcgctgtgtcaagccgatgtatgttcgagagaagtaaaggaagaacactggcattccaagaggagaagacggccaagataattgagaaagctcttctgatattgcggacggcaaaagcggcaaagagagaaccgctctggaaaaataattatgatttacatctaaatcttattttttacctgaatatgttgcgaactgcctcaacatattctgtcttctcgccatataaatgctcgagaccaacactttctttgattttctgtcgccttgactccagcgattttctgagagatgtgtgaaacaagtcctgaatagattggaaattaaattttttgcattacttcaaacttaccgttcaaccatagacaatctcccccgaaattggtttttccgtgctcaaaggtcattgctgaaagttcagcctcgttcaaactctgttgttcaacattgtcggaagttatcacggcatgcggttcgtcaatctacactccaaaattcacggcatcctcagttgggtttgaaatgtctaacaaataaagcttcttccgacttttttgtagacattcaagtttattacgaatcatttgttcaattaatgaatagcaaaatctgaagacaaaaaaaagcacatattttaatcaaattttgagatttttcttattcgggtgggtctagggttaggcaaggggctatataaatgtcgtattcatattcagcgaccccggaaaccctaaaatagacccattttccgggtttttatgagctttttcgacttttggacaattcgtgggtttttactcttttggacaattcgtggcttggacaaaacgtggcttg

SEQ ID NO: 682 - DNA, 2081 bp, Heterodera glycines
gccgttgccttttgtcgtattgtttctgctgccgttactgcccacccgcgcaagttggtttggtcgtgtccggttgagaacatcgcgcactcctccccccatcgccgggcgccgactgtgttttggctgattgtgagtgcgctgtgttgtcatcattttctggtaacaaaaattgatgttaataataaaaaaaattaaaaattttacccggaagtaaattcagcaaacactgacaaaaaatcaggatggtcaatgaaatcgctaatcgatccaaatttcttttcaaagtttgaaaagaggttgtcgatggtttcttttctcttcgccctgatgaagcggttcttgttaaagagcttctttgccgcgtagcccatccagtacacatttgtttggggccagaatgaggaccaattttcgctaaaaaaagaatttttaatgtgacaaaaattagtttctctcgacctggccaccgtcttcatcatcctgtagacgtcgtattggtagtcgccaccatcgctaacaccattttgcgcgaaaaggcccgtatcttggctgagatcaacgaagaacggaacaccttctggttttgggaaacagaaattaatgagtaaactttaagcgcttgagaaaaatttgagcttactttttttcatacgcgaaattgaaaagtcgattatggaggcgcgcaccccatttgagacgacattgatttgttttccttggtagatgtatctttaacattaacattagtttccagtttttttcttgtgctgcttaccgaattttttcgttgtccgggcaccgctccacgagaatgtttccggcatgcagatcccggtgctcgaattcgagaacggcttcggcaattgccagggacaaggcgacctgatggaagatggagtaacattcggggccattttttatctgcgaaaaaaacaattttaatttttttctttttgaaggctaaccttaaacgcctccagatcttttcccccataggaaaggccaatgataacgaaatggagatcttcgtcggcataaatgtctggccgttcgttctccgacaattcgggctttgccttcttgaaggcatcccaagccttgagcaatttcggaggaaaacatcctaaacggaaagatgagttatgttttagcactacaaaacattttgatttagcataacaccccacaagccctaattaggaatgaaatttgaagggactctccattaaaaatacctttgacgatcttcctcatacgcaattgtgtgaatgatggcgtgacaaagtcactgccggtgtcctcggatagttctgtaagctgtttggtgatgaacagctcgttgaagatgaattttgctgtcttcaggtcgactccattgacgagcttcgaacactgctcctgcttgatcgcgaatggcatgaccttgaaaaatatttgataaaatatttgaaataatgcaaaaattatgagtaaaaccttcactgcgatggaatcaattttaaagacttctccaaatgccccctcgccaatttttgaccaattgtcgaaagaactaaaatgcgatgaacaatttttttacgcgatcatttttttggtcgtttgttaatttttcgaaatttctccataaatttgattttgtcattttttgtacatattttcacaacaattaccttgttgattgctccaaattggcccaagagacagctgctcgctggtcacagagtattaggagttcatcaaattctgaaaatttatggaatcattgcgcgaaaattttatattatgcattaaatttgcctcaaaatccagtctctatttataaaatgctattctataaattgttaaaaattagaattttttaacatttacctaaatttttaggttttttgcatttttgtgcctttttgaattttttcgtgattttggggatttcgttgaattttttaaattttgcggacttaaattcacagccttagtgattgccaaatctgagctaggacaaaaagacaaaactcaatgattaatttactacttgggaagttgctcaaatttatttttaatctaccttcttcacatga

SEQ ID NO: 683 - DNA, 2291 bp, Heterodera glycines
  misc_feature (2271)..(2271): n is a, c, g, or t
acaaaaatgacttacgcaactgtccgacgttgcgttcattgtgtccagcagcctcttgggcgttttcggctttcccttgaccaccaattcaaagagttgggccattgttttgtcgtctttggcggtgcacttgagaaaaaacaaaaatatatatatttgtaaaaaattttataaaatattcaaaaatatgcatcattttttaaaattatttttcggttcacgttaaaaattaaaaagtttcaatttctcaaaattcccaagaaataattttaaaacatccgaatttgctcaccgtgtttttggagcgtggcggtgtcaaattcttgctacaactaaaaaataaaatgaattaaacttttttttttgttaaaccaaccactgaatgtcagtggcatcctttctggcacttctgcgcggctggcgacgacgggcggtggaggacaatggttggtctgatgagtctgaaacaatgcattattttaaaataatatatttgaattaaaaataaattttaaaattaaattatcattaaattaaaaatgtccgtggaaaatgtttaactgttttttgaactaattaaaaattacaaaaaatgaaacggtttaaattaaaattgaaaaagagacaagcggataatcgtttttgaactaaatgccgaactggtaaagaaagttttttatctaagattttccatccaaactcatatcttacccaaggatggtccgatgccatgtacagacgaaggttgtgccgttttaggagttcggatttgcgtggcgtccttttccttttcgttggcacgctgcgatttcaacggcacaacactgggcttctgcacagacacttctttgctggaaatttttatgccatatttaaatgaaaattaattttaaaaaatagtaatattttgagggctcctggaaaatgcgtcagtggaaaaggtgccagtaatacagtatttttataataaagttactactgtagcattaagtattgcattacaaaaggtcgaaattgcactgattcactgacgcattttcctttcacgatttttatttaatcgaaaaaaattgaattgtcaataattttcttttgccatgtctttaaatttgtgtcaccatcaaaaaaagaagaggcactaatttttttttttgaaatttctctgctgactttatcacaatggtcgggcaagcgccagccgtctcctcgatgttgatgggcaacgtgtgcaacgacggtggactgcgtccgtgcgagttgagcgcaatgacacggaattcttcaaaaagaaatttttgaaaaaaatttttttttttacctactaacaaattaaataataaaaaaatttaatgattcatcataaaattttagaaaaatcgcatgaaaatttttgaaggggggggggacgacgcgggagaaagtgaagtacacatttaaaaacaattaccgtaggcctggaactcgcgcaacccgggcaccaaaaactcggtcaatggacactaaaattttaacgaaattgtaattaaaataaaaaaatctttttattgggacccattaaaatattctttgtgactattgtatatggaaataccgtaccatatccggtgttgccatctcccattgttcgtgaccccattctcgcttctgcacaaggtagccctccagtttgcagccaccgtcctcagctggcggttgccaagtgagcgtcacacaattaggacctgagtttttgtaaaaaatcaaaaatattatttttggcgttccgtctctaccaatggattgcgcgtggacttgaattggcattcccggcggaccatagcgttgtcgcaatttgattcggtcggattggggcgacggtttgctccaacccgccgcattctttgccgcaacgcggaacacgtactcgccccggtcgctcagattttgcactttgaaatttgttgaccaggtcgcggattttttgcatgtaacctaaagaaaaaaaaaaaaaaaaaattaaattttgaattttcacaaaaacggggcaatttttttaggatattcaacgcataatcctaatgctatgaaaattttctttgtattttttataaaaattttcgtttttttctaaatttttttttaaatttcgggtgtgggaagcgagctgctcacttcgagaaaaaaaactcaacaataattacaatacacaccaaatactccataaactcacccattcgttcgaatgttggtccttgtgctgtagttcgtagccacgaatttttgccccgccgntggatgccggcagctcccac

SEQ ID NO: 684 - DNA, 9377 bp, Heterodera glycines
cactaatttcgaaaaattttgactttcgattttttgttcgagttggggtccggggttcgcaattgaagaatgattttcttgtagaagtttacttctatattacaatactaatgccatagaattttattttaaaatatttgcatcactgacgcattttctactgacgcattttccactgacgcattttccactgaccgattttccggtcacggggattttggaagaatgccaaacaaaaaaacaaagcaatgagcggtaccagcgaagaacttctcccttcttacctggacgagtttcaatggcggcagctttatggaaagaaaacagtggaggccttcgataacatcctggcccaaattgcccatttttatcctgtggataattgatcaatctttttattgccatgcaaaaacgagttatgattcataaccaatttttttttttgaatgagctattgagtgcttggactttttcgtatatgatttttttaaatttaattattgatcgtatgaggcggggatctgaggttcgaatccgcttggctgcggattattttttatgacattgatgaaaaatcatagactaaatgaaggttcatgcataatctgaactcagatagtgcagtttgtccccccccctttttttcaaaattttttttttatgttttcaaaagtacataaaaacccttttctatggggatttcggcatcaatgattctgaattcggaccctgtaactataacgaaactgtaattaaaatagaaaaatctttttattgcgacccattaaaatattctttgtgactattgtatatggaaataccgtaccatatccggtgttgccatctcccattgttcgtgaccccattctcgcttctgcacaaggtagccctccagtttgcagccaccgtcctcagctggcggttgccaagtgagcgtcacacaattgggacctgagtttttgtaaaaaatcaaaaatattatttttggcgttccgcctctaccaatggattgcgcgtggacttgaattggcattcccggcggaccatagcgttgtcgcaatttgattcggtcggattggggtgacggtttgctccaacccgccgcattctttgccgcaacgcggaacacgtactcgccccggtcgctcagattttgcactttgaaatttgttgaccaggtcgcggattttttgcatgtaacctaaagaaaaaaaaaaaaaaattaaattttgaattttcacaaaaacggggcaatttttttaggatattcaacgcataatcctaatgatcagcagtgatacaatcaatatccaataataactggaattttctaatcgaattttcatatgttttgattaaaaggctatgaaaattttctttgtattttttataaaaattttcgtttttttctaaatttttttttttaatttcgggtgtgggaagcgagctgctcacttcgagaaaaaaaactcaacaataattacaatacacaccaaatactccataaactcacccattcgttcgaatgttggtccttgtgctgtagttcgtagccacgaatttttgccccgccgttggatgccggcagctcccactccaattcggcccatgttcggccaaagttgcgcaccacgggtttgtccggctggcttggcaccgagtacttgacaaccggctcaggcaacacctgtgttttaagcgagtaaattataattttttatttttaaaatgtctatttttggaaaatttataaatagggcggggattttttatttatttatttatgtttttccttaagaaaagcacgaaaaacataatttttagccgacaaatgtttcgtttaacaacttcaatataaatttggagctttcttaaataaaatatttagaacaatatttttaaccttattttaatcaattttttataaaaatattttgtaagaacaaaatacagtaaagacgaaaaatactccgttaaaattgctttctgaaaaaaattcaaagttcattcctaattgttttgcaaatatgtccctttctaattttaagtttaaaaatttaaaaaaaatttacggcgggggggggggagggaatgaaacgagggggagggggacgaacggctctgtttttccccaccttgaatcgtgtgtccggcacattgccaaatggggtcttctcccacggcgcgttgggcgctttggccagcagcggttcgtccacgtcgagcggctcgcccacgccaaactggttctcggcacgcacacggaatttgtagcgctcgccgctggtcagcctgcgcactcgcagcgacatgccagctggtgcaccgacgcgctcccagtcaccgccacgtgctgacttgcgctccaccacataattggtcagtggcgaaccgccgtcatccttgggctgactccagtgcagtgtgcacgcgtccgcggcaagctcggagaaccggatgggcccgcccggcttgccgggcacgtccagcacgttcacgttcagcttggcactgtctttgccgtgccgattctgtgccaccactttgtacggtccggcatcgctgtgttttgtgtcacgcatggtgaacacaattttgtcgtcctccacttcaatggtggtgcgttcatcaaaaattgtcttgccgttgttcaacacgtccacattcggcttcagccctcccgagctgtacggcaacgtgaaggtgatggtttcgtcggcacgcactgtaattttggcagattttttaaattgacaatttttaattttatataaaaaataaaatgacaaaaataaaggaatgtaaattaggaaccgaaatggtaattactaattagtccatgttttaatgcgttgcgctttttcaaaaattttgaaatgggatatttgcaaaaaaaaattctctaaatctaaaattaagcaaaaatcttagaagtaagcgaatttttaatttttaagaatcggagactcaaaagaaacaagtaagaaataagcattaagcacaattacaaacaccgaattggacaaattaccactttaaaaattcagttcaacttttaacactaattattaattataagcaatgcatgcgccacctgtgatgtctttcaggttggacaggtcgaacacgggacggcctggctggtcagtggtgaacacgaggtcggacgacttggacggttcgccctcgcccgccttgttgacggcacggacgcggaactcgaactgttccttctccggcagacattcgaccgtgcagtgtgtgtcgcgcactgttttggcacgcgggatgccgatgttggcacgagaccagtgattgtcgcccattttgcgttgttcaactacatagccatcaattcgcgcaccgccgtcatgcagcggacgaatccagctcaggtccaccgtgtgcttggtgacgttgccaacgcgcggcttctccggcgcgcccggcgggctgacaaacggacggcattgctgatgctggagaaaatgtttattaatattaaatgaattaatagtttattaattaaatgttatttaataaattttaaaacaaaaaaaaatccaaacattttaattataaaaattaaataaatttgaattaatccaataaaatgaatagcaaattgcactcaaattttcaaaatttccccaaggacgcctgcctattggcaccatcggacctcgcccccgtccccctcgtccaaaaaagtttttgaagaaaaacacaaaaatagacttaaaaagtaaattaaaaaagtcaataaacatggtcgaacccacccccccccattgcaaaattttcgtttgacccctccccccgctccccctcaaatttatacccaccacattcgccgctatttcgtcacgcagctgcttattctcctgctcctcctcactgctgtccacccattcgtcttcctccacgtccgatgcttcgagttcgaactgctccgcattggcgcgcagaagtgccttaattttatggatttattaaattagtgatattttgaccaaaatttatattttatttttttcgaaaaagtttgtttttctaatttaattagaaaaaatgtaatttatctgactcaagcccggtttgacttaaatttttttgtacaaatcaataaaacaattaaattataatgtgtttttatttaatttatgacaaatatattaaaaaatcattatttaaaaaatataaatataaaaatatttgcaatttaattctgcaatatatttattaataaaaaatattaatttaataattaaaaaagatttctcttgaattttgaagttaattaaagcattaaaaacataattcttttatttactagtaaaaaataacataaataaatattcgcatttaaattctgcgaaatttttttaattttgaattaattcataagtagcatattatttttaatcttgataagacattttttgttaaaaatttttttagaaaatttaacatggtcgaacccctccccccaaaattatcgtttgacccccccccccccttcaaatttattcctaccacatttgccgctatctcgtcacgcagctgctcatcatcttccacatcgatgtcattgtcgtccacttcgcattcagaagtggcattttcgttttcattggcactctgcgatttcaacgtctcaacaaagtcacggggctcctccaccacagacacttggcatttgctggaaaattttgtaccataatttaaatgaaaattaattttaaaaatttgtactatttttggctcgtggcaaatgcgtcagtggaaaaggtgtcagtaataaaataaagttactgtaacattaaagtattgtattacaaaaggtgaaaattgtctaataattttgttgtttttttcaattaagtttttaaatgtcaaaataattgaaactttccaaaatccctaaaaaataagtaatgatttcaagtaatattactaccgtatctcaatttaaagaaatactgattcactgacgcattttccactgccccaatttccgttcatgatttttatttaatcgaaaaattgaattgaaatttcagtcaaattaaaaagaaaattagtgaaatgcaaaatttggcaacgattttttggcaccattccaaaatttagtgcaaaattttcaaaaatatcttatatttttgaaaatttctcactttgttgtggccggataagtgatcgggccctctggggggccgggccggtccacgtcggtgttcaatgggtcggaacggccaaacgcattttcggcacacacgcggaactgtaaaataataaattaattaaaaatttcgaaattttaaggctttttcaggaaaacatagccgacattcggtttctagacaattttgaatttaaataaagccaaaactcggtagaattaaaaaaataatgcgccaaattaattttttgttttcgatggcatgccacattttagcaaatatttttctttcaaataatctgctccatggctttttctgaaatttctcataaataggaggagtgtcaagcatttggcgatgagcaatttttggccaaaaatgcaacaagtgcaaaaattgtataaattaaaaaaatattatttaaaaattaacattaaaaaaaattattttaccgctttgacacggaaattaaaaaaagcttaagaaaattttcaaaaaggtaaatataccatttattcaaacaatttatttaataataacaattgctttatttttctattaaaaaaaagttttgagactgcttttaagcataggcgcaaatatcagaggcgcaataaatattattatttaggtttgtcaattaattaaaaaactttaaaaaatattagaacacagaaattaccagttttttgtcggtaccgtttgaaaattttagtgtcggatattttttataaaaattaattccgaattcaattttattaaatttttgtgtttttttgtccattaaaaaattattcgtttatgcacgtatagtcatggtcatgggagccggtgataattccaaacaaccgataaggttttgcttaaaaagacgaacgacaatgttttcattactgaaaatcgttttattttgtgaaaatattcaaaaataaggacatttacaaaaaagataaaattttgtttattttttcgtttgatatttttcccttttgaaataagtacaaaacaaaacaaaatttgcgcctcgtttttcacccacctcgtctgggtccggcgagccagcaaacacctcgtcgtcaaagtcaattctgatcggcgtcacattgacatgacaggcactaaacaaataaagaatttgtttttaaaggaaacagccaaaaatgttaactgttcagatcactttaaacccttttttatcatgaagagcaattggatttgctattcctaaattttcagctatttttaatcttgacctcctaactgatcagaaataatcgatcaaatgagaatcttgcaaaaatacgttaattttatgagatttttcaactaatattttaatgcccattgtcattggtttggatcatctcaacagctaatgaattattttttatttttcctttattaatttggaatttttatgaatatggaatttaccactgaaatcaaattgctatacacagtaaaaagtgattttagaattaactgagcaaaacaaggaaaatttattaccggtgtttgtcaaatgtgtccttcaagtcacagccataattgcaatgttggctgaatatttatacaaataaaaaaagataaaaagaatcaaaatatttttaccatttgtatctcccattgtacccatgattgcgagaatggcttgccaggtacaaaggacgagcaaatgcatctgggcattctttgcacttgtatggctttaaataaataatagaaaagggtactttttcgttatgccataccccccccccataaaaatgtcataatcccgagaaagaaaacacatttgtatggtaattttaggtgttaatcaataatctgaagttaaagccgtacaaatctatgaatttgttgatgttattacaaaatccacaaaaagcactgatgagggtgagaataatttttttttaaatcatcaacaaaatcatatgaagaaaatcatagataacagtatagattttgcaattttgagttagactcctgatcagcacccaaaactaccattgaaaaagctttcctttgttcgtatcatgatatttttttcggggggggggcgggcgggtgaagcaaaaaaaggaagcagttatttgggaggacaccaatcggaaaatttggactccagtaaattggacaccaattcaaaaaagtgcaagaacctaaaattcaaaaataatggatatttctattacaaaaaataattttcattctaaaatctaaaaagttaaatgaaaaaatgcatcaataatcaattgtttaaagtcattgcttaaaattttgtgacaaaaattaattttattttctatttttgaaaataaaaaaagtaaaatcttttaatttttttaaatatctaatgattttttttttgttccacagcttaccaattcggccggcttgtccaattcggcctgcttctcctccttgagctgttgccttcttaggtaacgttgtgcactgctgtccgatgtgcctcttttgtgcccgcgctgctcaagcagctgaagaagcgtgtggtcttcatccttaatttattgtctaattattatatttatttttttggtgaatttttaattataattatttaatcaaaaaaacacctcaaagctacggaagcctgcctgatttaggctttttgttcgtcgccactcccgccttttctcctccgtctcctggtcaggggataagggatggataaataatattttaaatttaataatatactaaagatgaaagtctatacgatttatacccgatgaggtatgggcacttcgatttcagtgtctacaaaaagtactgtatttcttctgaagatatcgcattttatagtagaaattatcagcatcaaaactgaagtgcccatatccctgcaggtaaaagttgtagagttgttgtcttttgcatcttgtagagcattttgtgctcttttcaatgtaactacttaaaatgtctaaaaaatcccccccccccccgttgaaccaaaatcggctcctccggtggttttccgcctcgccgcatttcaccaccaccgccggaggttgtttcgaaacgataattgaatagaaaaggaacaagtgggccaagtgccgaatttgttggtgctgctgctcgaagccaaatttgggaaactctgtgatcagaaagccgagtccgctgagagtttgctccaacagttcgccaaagtattcaaaccttacagtaatggccaaaaggcgaattattgaaattgggaaacttaacagcaaaagcaaagcggcattttcaatcggctaagatgactccttgcatatttataattttttttcttaaattaattcaatgccgatcttttgctctgcggatcagtctctccctactgaaggtcgatggagctgagcagggcgtagttcatctgctgagtcctgaaattggccgaatgccttctttctcctccccccttttttttgccaaatttccaattcctttcgattgttaccaatgagttgccaccgacaatttctgttgttggactgcccagctgcacaacacttcgctcatctatggttatccgtctttcttttgtctgtccctcccattaaattcgtccttttaccaaatattgcttctccgcttccatcgcaatggccaaatgttctccggtggccaatatccgtgcgaccaattcgttctgtgccccggcaccaatttgtcccgaaaagagaatgtcgacgtcatctttgaacgattggtacacttcggcagtgacattgtgccgttgcacaaattcggcaggcaattgaaaagcgacagggcctaagcggtgaataagccattgaaaggaatgccaatgggaaaagacagtcggactttgcggcgtttgggcggacggagcgggcgaaactttggcatgggaaaaagcgaacgaatcgctggcggacgggggaccgccgccgatgtccatgggttggtgggcaaaataatcggccacagaagcgggcggatgaagctgatggacggaggaggacggattatgaaacatcggctggaaagggaacagacgaaaaatattttggaaagggaaacttcggtcggagagttttgcgtgaataattgccgggaataacccctggggcgaaagaatgcgaaaattggaaaagttgataaaattgattggagatgagtcgcgcgacggaaggcgagggcaggcgaaaa

SEQ ID NO: 685 - DNA, 1730 bp, Heterodera glycines
tgaaaagtttcattgaaaatggtaacaatttgaaaaaaacaaaattaataaaacagccataaatttgtatagatttgcaccaaaaatcagtttagttaaatttggattaaaaataatgactgaaggatatgcattataaatgttaaattaaacacaaaatctcaatatatccgcatttgatggatctatgcaaaaatttcgcgaattgctgcacccgcattaagaggtgtagtgatgatagtgacgaggccgggcattctgaaaactagggttgctcaccgtccccgagctccccggtccccgaccccgatccccgacatttttgggcctattccccgccccgacccccgacatgtcgctccccgaggtccccagcccccgactttttgccccccgactccccgacactaattcggggaattggggactccgagctttgcaaaaatttaaaaagttaattcaaaacgaaggggggaaaggttgaaaatttatgaaattttgaagaatctccttaatattaattaattaaaaattccgaaaaacttttcggcgaagcttatggcaccgccggcccccaaaaactcaaatttttttttgcaaagaattgtcccaaaattgcaaaaattggtattttttaggaaatgtaacaaattgcaaattttcaaaaaaaaatttcctcgcggctcctaacaccaccgccgctcatcccctctttgttccccaaattttttatttgaaaaagagcgccgcaaaaaatggtggtcaaattccgtgctgggacatttcgtaaaattcgccaccttgggcgtttcgtaaaattcgacatttttgcaatttttacaattaaaaaatctaatctgttcacatttattccgattgatttattcaattaataaaattattttcactttaaaaataacaagaaatatcttattaaaaatgttgccaagaagatcaatcccgattcggtcgtcaattacttatgtagtaatttgagttaattttgttaattttatagatatgaactatggccctgaacaccaaaatttaatatattaatttgattttttagttattgattaaaaaattctctacttttttaaaaacttatttaattctggtcagcactttggaacaaaagaataaatatctaaatccgccatcaaaggtatattaaaattaaaagatgattaaaattataaatttttttaatttgagcaaatatgttagtcgagatttctctagttgtttgtcaagaaaattaattgggcgtttcgtaaaatccgccattttagcgaatttattttacattcttggtaccattcgatagccaagctttttctctattagcctgccaaattcaaactcatgtaattggagtcgttcgctgccgcaacaattttgaaaatggcattcattttggaaaaatgcgcatcgattctttgctgtgcagttttgctcgctgttatcatttgtttttccaacaaaaatttgtacaacatttgtataaatgcgatgattttaccgtataaacacagtaatttttcgtgtgaagatattaaaattaaataaaaaattattatattatttatgaatgaatttttgtaacatgatgttcatttactattttaggactaaagcacagtttggagatgtgcccaataaaataggagtcgaaagatcgccatattaccgaatggtaggccggttttcgggatcgggctatgggg

SEQ ID NO: 686 - DNA, 1449 bp, Heterodera glycines
tgatggacgtggacaatggacccggacgcagcaataccggacgtgggctcaagagtaccggacgtggccaatgacccggacgtggaacgagataatggacacgcagcgggtacgaaccatcaagaaccaaatgatcttgatagttcttttgattatttttctgattgattattttttaatttgttttactgatttttgctttttggcttttctattaataaatttttgtctgaaaaattttatgtgtaattcttagtttactttagttttaagtgcggcacctttttaacaattcgttccttgctcatccattaatttaacgtgatagaaaattgccaaataattagttgatagatatttatctaaaagttttgaagttaattgcattacctcggcgccgccggggggaattttgaaaattttagtgtaatttgctaacagattttcaaaaaaaaaggctggtttttgggattactaggctcaatttgtacggattttctttaaaaaaatgataaaatacaattaaaaaaattaagaatcatattctgtcgataggaaagccatgagtatacaaaaagaaaattcaaaataatttaattcctgcagaggattgaaccaggggaaagaagaagggaaagacaaggcgactagccgctaagccatccgcacaattgcctgaatttttaaagaatatattaatatatttttaaaattttttccttttaactccaattttcttcactaatttttcactcagacccccattcttaccagtgcttgtttttcccggttcccggttgccctaccgggaccgggacctgagcttttcaaattccgggaacctggaccgggacctcgaatgaccgggaattcccggcccggtcccggtcccggtcccgtggcactctaataaaaagtgaaaaatatgcacataaaattttccaaattaagcgtaaaatctctcaaaagttcttccaattcgttaaatttaagctaaaatagctaaatatggtataaaaaatcatttttaagaaaaaatacaaaataaagcatttatttattaattttggcgaaaattgaataaaaatcgaaaatttccgttttttaacttatttttgaaataaattaacaaattttaagaaaatttaaatttaatcattatttcgacaaaattttgctaaaaaatgtctttttcggaaattttttcggtctttaggagtcaaaaaggctaatttacctcatgggggccgttttaataggggttttttggaaaaatgcccaaatatgcacataaaatatgcatgaaatgccaaaatatgcacaaatatgcaaataaatcgcgaaatatgcacaaatatgcaaaatatgcatatggaaatacgtcctagacgcttcaaaccaagctaaaaagatgtttttcgtccgtttcaggcctgccgcagtccagga

SEQ ID NO: 687 - DNA, 1475 bp, Heterodera glycines
agtgaccgatgttttttcaagttttcaaaaacagattaaataaatttaaaaacacattattattatttattagatatttttagatgcttctacgcaaataattaattttttcaaacatttttttgatttttaaaataaatttcaaaaaatccaggtccaggcctggatccaggtctcgatgagcctggatttttcctggacctggattttcctggatttttgtccaggaaatccaggtccaacatggaatccaggtccagatccaggtccaggcttttttcaaaatgtcgatctctaatagtaacgtttatttaccgccgcccattttccgagaattttttatcttccaagtcatgaaaacatgtttccagtggttttcggggtcgctgacctcgacgtcacccatttcgaccaattccgaatcccggacccgaattggaataaaaagttaaaaaacaaagttttcgctgatttttgcgtatttttcacttctttgtatccaaaagcaccactttcatacccaactcaatccttcccatggctggctctacgcctttgaagcttagaattttgaaacttacaacaggaagacttccaattcgtgcccaatcgtccaccccggacagttgcttaacaaatgcctcataacgggcaattcttggattgtcaaaccatccgttccagtttatgcgaaagtaacgcgggtatttttcgagccaaacgatattttcagcgtgcatttttatctaaaaaagaactaggaaatacttagcacgaatgataagccagaaatgcgaccagtatttggtgtttggggctttgcgggtacccttcaatgggttttttgtttttaattatgtacattatttcctaagaaaggggtatgtatccataggtgctgggtcgatatcaaaatcatcaaaaaggggttacacaaaaatcattaaatgggaaatttaaaaaaaaaaagtttcataatctgcctctttagaaaaaaaactattttcaccttttttggcgttttgctaatattattacaaaatgcaataaaacgaaaaaacaaccctaacaaacaaaaattgaccaaaatctttttcaaaaatacatccccctaataaatgaaaatttttaaatttttcttttcaaaaagtcgttaaaacatatttatgggggttttctgggccgctgatcacgaatatgacattaattttcactaatttcgaatcccggacccgaattcgaacaaagtcgaaattcaaaattctcacaacaaaaattggttttgatttttcgacattttgtccgaattcgggtccgagattcggaactgaccaacactaaggtcatattcgtggttagcaaccctgaaaactcaaaaaaacatgttttcaagttatccttatatgaaaatttttttattaaaaattatgttacatgatgaaaaatcatagacaaaatcaatgattttgtaaaat

SEQ ID NO: 688 - DNA, 6372 bp, Heterodera glycines
ggttcaaccgggatactcccataaaaaattttcaagaatttaatcattcacttcctacaaatccaaatttattgttctaactctgttgaaagctaaaatcgcaaaatctggccattttttggacaaaatctgtttacaaatcgaatttaaatttttaaaaatttttcccacggcgcctttcggaaaataccaccataggtcatagactaagaattgtataaaacactcttataagttttcttaaacaattttgaaaaacaggtcatcgtcaaattcggtgttaaggtacttcaaaaatcggagctgatccccccccccccccgttaccaaaaatttcggttgaccccacccctttccatgtatgttgtaaaggacaacttggatgcactcttactggcgctaatgaacgagtttgaattagttgactaaagcgaaaaaagaaaatttacgagcatttaaaagaagaattagggctttcgttaaaaaatttgttgatcactacccgatcggaatccccgacccccgacattttgccccccggggggtcggggagcaacccttagtccctctcccgcccccccccccccacatttctcaatcgtccgtcgatggcccttggcctgagacacctcttatgcagtatgctttataaaaaaatcaaaaatttaattattgaaattgtttattccaaaaatactatctgattgctatcgaaaccaccgaaaaatattttatttataattaaaactttttcatgaaatttctttataacttccctttattcctctttccctcccgttcctctgcttttacttgattttttaaaattgaattttttttttcaaataaggggataaactaaagcattaccctattccttatatcaaaaatcaaagtttcacttgggaaagataagtttcttttagcttatttttatagaggattggttaggtccaatggcgccgacccgggcaaaatgagccaatagatccaaggtactactgtacttgttgtcttactgacagtatgaccggcttacaaaaagtgccacattgttgcactttcctttttatcaactggcagagttagggcccatagaatgagtaaattgggtggctgacgttacaaaagtgcatttcaagcccaattccttggcccaaaaatggcacggcatacctcttgccattttaagacacgtggcagcaaaagtttgtgcagcagccaacaggacgagagcgcattcggtgtggcattttcggcagggatgagaggcacaatttcgaacaaaagttcgagcggaaggcatttgggggccattgttgggagaagcatagttttgttatttggggtaattagtgagcaattagctgattagcattgaacaaaaaccgccgtcgtcacattggcactttgaacttggtttggcccgtttcgtctcgccagtaacagtagcagcagcagaaggaatggccgtttcttctctcctttccgtttgctttatctcttctgcgttgtctgccttttcctcttcactctctatctctatctctcaccttctctctctctctctcctttttattttctctatgccttgcgttgcgttcgtcctttcacaatgattcggtcgcttttcgtcgtaccccgaggggttttgcgtagaactgtctcgtttttctgcttccacttctaacgtgcacacttttgtctttgcttctctgttctcgctttttctctcctgtggcaacactctctgcgttctctcgcctttccttgcgttgcctgtctctgcgttctctatctctctcgctctctttcacttcttcgttttgaataggacagagaaatgaatccaacttttgtttttatatgtatttgtatagtttggcttttcctaaaattaatttgtgaacgattctcaaaaatacaaaattttattggtaatttaaggcagttagggtctcctcatttacaaggagttcagaacagttaagcaccagcagcagcagaggaaaaatgaacaatcatcgatttgcaattgtacaaatgataaaatggcattttgtgagagaattatataatgtcaaaatggcatttcatccatatcattagcgtacaatataattttggtcgccattttcatatttgtacactccgccgatggacaattaatcctccccatttttgctcactgatcaactgctgctgcagatcaattagcgcaaacaataaatattaattatatttattaatttaattcaacttcttccgctgattaatgtccaagcactttcacattcactaattatgtgcatttttacatagaaaaccttttttaccttttatatttttaacttttcatttttctaaaatttcaataatattgaaaaatttgattaaaattttctgggaatttaattaaaaaaaagaggaggatcctataaattttatcaattctcatctttatttcgggttggcaactcttatgcagtttaatcctcccccagaaatttgttgcccaaatttttcgtttgatttaaatccataatgcccatgttttcagttcgccgatcatgaatccatcatccacttaggcctatttcgaacctgggacccgaattcggacaaaaattcagatttttaaacccaattcatggtaactgtgctgtgtatttctaggccgaaaccaaaagcaccaacataatttttttataagtaagggtttggaacttaagttgtgaaagccattaaaaaagtcaattgataatgattaaaaagtcacgaaaaagtcaaataggcatattagaaagttcaaaccaagggcgtagccagtagagaatggcaaatcaacctttttattagtttttgcggggtatcaatttaaatgttgatatttaattatatcaactaacattatgccatcaacgcaaatatcaacgtaatttttaaaatttgcgaaaattttttaaaatttatatgagcggtttataattttagtgcgagagataacgcaaaaatgagagagtgctggatctcagtcccagtcatacaaaacatttttaatgaaggaggtagagaaaacaatttcaatagagagcgcaatgggaagggagttcatgtctcttcttcgctgattcttttggtaagagacgcagattcctcgctatgttctctattctctctctgtcttaaatctcttcccataacactctctttttaattaatttttctttattcttctttaccaaaaatgcttttgtatgactggggcctgggtcttaaattacgaaaatccgtaattacggtggtcaaaaaacccgtagtttccgcaatccgtaattacgcccagccccctggatttgtgagagaacaaaaaatgcaaaatttcttttcatttttttgttcatttccaattctcttccttctcctcctcttcttctccttccttccgcttcttcttcttcttcctcctcctcctccgactgttcgattctctcctcctttttcgtcccatttcttctcctttgttctgttggcacaaaaaaggcttttaaaaaatgtttataatttggatttacgcagcgacaaatcaatttaatttgtatcccaaatttttctctacggcgcttttcggcgcctaacccttttaataagcatgccaaagcaatccaaacacagctcgttcacacctaccggcccttactaccttttccagcgcttttgcggccattggcgccgtttcggcaccgtcgccacttttttccgcctcgccgctgcacacaaattccaccagtcgtggcatttgtttctgctcgtggtacttcttgatgtgctccaggcctgtgatgtgaatgagggatttttgatctcgacaatttggttgtactgcttcgagagggccacaaaaagcccgtccaattaatttcataagggagcagcagcaacaggggttttcttgaaatcactgtccaaaaaattctaaattcaaaaccctgatcggtctcccgaccagggttttcaattatggaaagccgtaatacgtgattacgcgagtttttaaacctccgtaattacggaaacccgtaattgcatgcagccctgggtccgaccgatctaattcggctccttctgatcacaaaatccatttcgctcgggttccgatcaatcttgcctaggggacttaggcaccggacattttgctgacttatctctaaccatgactcagaaacacagcggccaaatcttttgttttggccacgtcattgacattaccgaagttaatattcggatggcgtaaaaaatcggacggcgtttgattttctttaaatatttcattttgattcaccgggagggaaattcactacctcgttgtcccatgttttgcccacaaaaagtactgcttgctgtctgtttcctgttactgacttccaatgaacgttccgcagatgaacaggaatggcatttcccgatgggcggtcagtttggccaaatttgcctccaccgcggccaaccgaccgattttgtcggcataaaaagtgaccagcgggaggccgtagccgtcgcggagcagcacctccagctggcgagagtcggatttgcgcgagtcagcgtagaggacggccggcagacggcggatcttcgcaaaatgcaaaattagccggattggggagagaaagagaggagagagagagaaaagagagagagagaagagagagagagaacaagattttgacataattgagattgatttgaactcgagactgatcgagaaaaagtgagagcaaagaaataaggagagaatgagagtgagagagaaacaagagagagagaagaggaaagatgagagcgagagagaaagagggaaaatggagagagagatatagagcgagaaagaaatggctttacatgaataaactgatagagaaaaaggggaagtgtgcttccacaaattaatcccgtacgcactgccaatcaatcgtcataccgtatggtacagtacctgctgtgacaatgcttggagggatgttgtacttttctggatgggcggcgtcttctcctccagcatttcaccgtgggttgttgccgttgtcggcgtcgtcatttttggcatttccattgtcgctatcgtcattattggcatttcaattgtttccgtcgtcatcattggcattggctgtgttggcattctgttgatgggtgtcgccgccgtcgtttgttgctgagtggctaatagcgcgagaagcagcgactgctccagcaactgctgctgcaggttgttgttgtccatccttctgaacaggttttttgccaaaattgaaggatttttgaactattaaaaggattttcctgaattttcattaaaaaatccgaaatcctggccaaaactagggtccccgctgctcgtccgtcacccacccgtcactgttcgccgccgcttctcctcccctccatttgttgtcggcatttgccaatgatcagcattgccctgctgctgcactacggcattttgttgtgccaccattagtggtggtgttggcttttgatgttgccgccatggtcgaccaccgtcagctgcagcagaagtgccaccaccgacagaaaagggaccaccgtcataaccggagacggcaccattgaagcttaagtgaaatgcgatggaggggcaggggtcattaaggtggattaaggctcaaagcgcaaggctaattggtttaatgcactaaatccatgcctcagcgcagggcagcgatgcggacggaaaagtgccgaaagacgcggaaaaaggggagggcggtatggcaaaaagtgatggcacgaaaggacactcgcgaacacaattacaatcagctggtgaaaatggaccgcagagaaatgagacgcgacgcgccatttttggttaacgaattttttgaaataggataacagagaatatttagacctattgaatgagaaattttgggaatgattgactcggattcgaaaaggatcaaaatggatgccagaatcggattctccgaccctgaaaccccataaaaataaaaaaaatttcgaaaagggtggctaccatcagaatattaccaaaaaatgaaatcgaaaataataagcccattcgttttttgttttgttcaagtatttcaggagtttagcggtttatgcgaacggagggcgtagccaaaccttggcttcgggggcggcggttgactaacccaccccagaagagcgacgaattgaccgtttgcccttcgtccacttatgtttcgccacaattttaagtaatttttgaatggtagggggtgaattttggccgcgttcaacaattttcttttcataaaaatagagcgaacatgagcaaaaaaaaatttttttttttttttg

SEQ ID NO: 689 - DNA, 1699 bp, Heterodera glycines
tccaagaaagttacaaacgaaaataatcagcaattacttaattaatcaactcttttttggtaattgcctgaacgctgcgattttatatattttagcttcgttagactttgtgctttcgaatgataccaaaaagatagggtttgttcgaacataacaaagttattgtataaaaacccgggattgtcaattgattggactcataaagtgcattagagccaccaaaggggggaaataaaaaaactttcagaaaaaaatgatcaacaatttgaccctaaattttccccggcagggtcccaattttcttatgtttttgccaatatctgatctaaaatggccaaaatttggggaaattacactggaagaaatgttttgggccggaagagcaaacaaaagaaaaagctcttgggtgcccctcccccgaaggttacgggcctgaaagggggcgggagacagaccacgtcaaagaatagcaccaagtcgggccggatcagtccgacctcagaatggcacgcccattccatggacattcctttggccaatgagtaggcaatgcccgaatagctgtacctgaacagacagcagatttttgaaaaatttacgttgagttttggcacaaaatgttttttttttgcaatttcataaagttttcccgtctttaccattgcttctccgattttttggccgaatattttaagaaattgacccctcccttgtccacctatggcccccctcccctgaagccatgggtctggctattttaaattatggctggaatttgttcgaactatctcctgtcgttctccccctcccccctccgaatttcgttccaaatttctctcctccgccgctgcctcggctcacctgtccacgatcaaattccatccttcggccaattcctcgaccatttggtgtatcattagccaacgattggccgcgaataacaaatggatggcttctcggctttcctccgcacttatgacgattctatatggctgtgctacctgcgggaagaacttttgcaaaatttggctggttggtttagagccgtcttcttttctggaatggatcgaaaaagaattgccattttttgatttgacaattaaaagagcttatttaaaattcaatcagacgacgaatgaaaagagtgagaaaaggccactaaatttgactggaattgaagaaacttttgaacaattaaaattcgaattagtttcactcattttgagtgcccaaaaattgcgggaattgactaatgaaatggcagaaaaaatcaattaacagaaacaacaaatggcttattgaaaatagaaatttgatttgatgctttttcataaagaaaatcaataaatttgtatattaaaaaagaaaaaaatttgaaaaataaaaaaatattcaaaaattttatcagaaataacaatttagcggaccagtttttattaatgctttttttacattaacaatttttgcacttatttaaaaagcatatgggtccatccctgatctgcatatacatatacatacataaaagaagcgattatatatttatgggaaaaatgaacgtaagagcaaataaaagcgtggcggtgctgtataagaaaaggattggccaacattagtagtgacccctgtacgcgtgttacaatttttggcgctaaattcaaatttgaattttcgcgtcgatacactgtggggagggacg

SEQ ID NO: 690 - DNA, 1655 bp, Heterodera glycines
ggatttccatttccacgtcttcaacaagtaaactacaataggctttaataacagcacagaaaatatggagacattgcctaacaataattcggacggtgtttctgctctatcgctctgtttcctttttctctcatcggccctctttgtccgtccgtctaccaatggtacaaagcgtgtcggaaacgcgtgtccgcgccggtcacaactcggagggtcaagaaaaagccgacgatgaaaatgacgagatagcgccaaatcattgtcaaagggttgccgaactcgggccccgagaagtagaagtactgaagcttgtagaagttgcgcataaattcgcgccaaatggcacgcggagatttgtcacgacgggcgatgtacgcggccaagtcattgactttgacttccattagcggaatgtcatctgaatggaatggtaatactgctaatattttcgagtcaattaatccacggggtaaagttgacgattattggaaggaaaagtaaattaacaatgaactagaggaaatgattagcacaatgttcttaacgaaataaaggtttcaaactcactgtttgttccgtagtaacgataatgaacatatgggccgtggacacgcgggttccattctcgcgggtaaagaccaaaagtggttcgggcgatgaaattgttgtaagtgtatacgcccaaacgctgaaatgctcgaccaattggctttagaattctaaaatggaagaaggtaaaaagttatttaaaattgaattgaaaaacatacaaagcatagggaaaccaaggctcaataaaagtgtcatgaggcggcggcttcagccaaactttggtcacattcttttgaaaaaaatttttaacaggcttcacaatcatatggatgaacagaagcaaatgatgatgctgaactaaaaagaacgattgagagcaaataaattaaggcaaattttcaaaaagaaaccgaaaaaagggaaaataatcgctaaaaagtttcaaatttaggggtgtaaaattacaaaagttgttcaaaaaaattaaccaaatcagtatgagataaataatttttaaaatcaaagtttatcgtcaagaaagtaaataggtaggtaaataatttttggagatgaatttttgataaatttttcatttcgtaggggtgtttttgaaaattttcgggtcgattcttatgagtagggagtccatatttttttctggcctgtgggaggcctgaaacgcacgaaaaacatgtttttagcgtgttttgaagcttctaggatgactttccatatgcatgttttgcatatttgtgcatatttcgcgatttatgtgcatatttgtgcatattttggcatttcgtgcatattttatgtgcatattttttatgtgcatattttgccatttttggtgcatattttatgcgcatattttgcgattttatgtgcatatttttggactccctacttatgagtgtatttttcgtttttattgcatttttattaacaaattttggaaaaaggccaaaataattatagctttttcaaaatcttttagtttttaggtgctaaaaataaaaaaaatagaaaatagttgccaataactcgaaaagtagcttaacaaccatgaaaaaaaaacatgtttttcctgcgtttcaggccac

SEQ ID NO: 691 - DNA, 1742 bp, Heterodera glycines
  misc_feature (1722)..(1722): n is a, c, g, or t
aaaaaatttttaaaatttttaaaaaattgaaatttaatttttttttttttaaagtgaaaataatataaaattatttttttattttatttttattttataaaacccaaaagttaaagctaattaaattaatgaaaattttgaaatcaaattttcttcaattatttcaaacaattaatcatttttggactaaatgatcgaatattgtatgaaattcagatttatttttcacatcacttttttcggcgcgctttttccaaaaaacttatggggaagaagggggtccggcggtgccgataggcgccgccgggggaaattttgaaatttgggtgtaatttgttaacagattttcaacaaaaaaaggttggtttttgggatttaggctcaatttgtatggattttcttcaagaaatgataaaatatgtgtcaattaaaaaaaaactatgagcaatcttattttgtcgataggaaacccaaaattataaatcgtggccctacttataattcgaagctttttttattttgcaaacctatgcattagaattttttcattttattagtttttaaaagttttgggtacttaggtatacatttacgccacattcaaaaaatgtttttgttgtttttaatgataaaacatgttccagaatccctattcaacggagaagcggaagtttttcgaaaaatgggctaaaatatcggggtcggaatttcagtcaataagacgaatgccaaatactgattaccaactccgtggggaggatttaaaggcaaaaacaggtaggtcatctcgatgaaacacggaattaaactatacaatttatgcacaaccgatatgccattttattaatatatcaaatgtgtatacaaatacaatgacgatgaatatgaatgagatttcacaaatatcgaacaagcgaagcacaatatattaatgggtatacaatatatacatattcaggtcacataaggaaggatcactgttcacaaggggaacatttaggaagcattggaacagacaaaacacagcaatcggatgggaagggaatggtcgaaagcaagggacgggtgtgttggtgtcgcgagacgtcgtcgtcgaacactgtcatttgcacgcagcagggcctggctattcctctgcttggctcgtctccgctgtgctctgttctcccagcgcttcgtccacggtggatgcatcggcggtgtccttcttcttgcccttcttgtccttcttcccgtgcttgtccttcttgcccgctttgctgtcgtcgctcttccccgcctccttcgatcggtgtttgtccttgcgcttctcctcctttttgtccgccgctggtgctgctgctgcgccttcgcccttcttgtccttcttcttgtgcttgtcgcccttgctgccagccttcttctcctccttgtcgccggcggtcgtcgcttcttcgcctccttccggcttgggcttctcctcgtcgtcgctcttcggttggtcgagcatcgggccgaggtacgccttccaacagtactgaaaagacaaaaatgttatgaaatgcaaattgaaaaaatgaagaaagcgcagcattacaattcctgctccgaaggcagcagcagcgatgaataggtaagtggccattgcgttgcgttgcgcactgaagcggttcgttggttggagtgtggtgaagaagaagaagagaagaatgtaaagtcgagggaagacgacccctttatacngatctattctgctggaagga

SEQ ID NO: 692 - DNA, 2842 bp, Heterodera glycines
  misc_feature (2800)..(2800): n is a, c, g, or t
aaaattgatataaaagggcggaaaatgcccaaaattctcacttattccatttccttcaattcacgcctattattttcgacacgcctcgcgcctaattactgaggtgttcaccatctcccgttttcccctcaccccctccatttgcacatcactaattttttttccccttttacagtgatcaacaacgctctgccgcgcatttcaacctcaacgcacacagcaaacgcggatgtccggcgctggaagtggacgccaaaagaggggcaagacggaagcaccgcgacgcccaacccgccggtcaacgcagcagactcgtcaggccgacactcagcagcagcaaaggcgtgcaccagcaacgcaggaacagagtgtgctcgcgccgcagccaactcttcgcagatgggaggacacggcagaattcttcttcgccctggaacgcttcgtcaacgacacaacgccgcgctccgtgcaggacctggtcagcgaattcaccgaactcaacgcagcgccacgaccggagccatcgcctgagtttacacggtgggttttggcgtcgttttcaatttgtgcatgtctaattttcccaattttcaattgcaggaacttggaatgcaaccgcgaccgagatgtgatctgcacggaaatcaaccgggtgcgactccacagcggacgctacatccacgccaactggatcagcacgttcggcgagaaccgcttcatctgcactcaaggcccgctcgagacgacctgcgacgacttctggacaatgatcgtgcaggagaacatcgaaggcattgtgatgctctgcgacaccatcgaacaaaatcggatcaagtgtcatcagtactggccgaccgcggacaacaaggtgggttttgaaattttacccaatttaacaattaatcgtttccccttccctcctagctcatgcgcttcgccaacaaccagatcattgtcaaattcgggcgcgaataccacgtggaaggcgcgctctacaggacggacctcatcgttggagcaccgcagatgcgacagggccacttgcgcgttcaacacttccactggcgacaatggcccgaccgcggagtgccccacagcgacctggccccgctgcgcctgctgtaccatgtgatcggcgtcccccgagcggttgtgcactgttcagctggtgagttaacggaaacaaaaacactgaaaaattaatcatttttcccattgcaggcatcggacgcactggaacgctcgtggcggtgtacttggccaaccaaacgctgcacctcggccagcctctcaacatcttcgctctcatccgtgacctccggcgccaacgatcgcaaagcatacagacgctcgaccagtacctctacatttacttcgtgattcttcggtgggttttcaaattttcatcaacaaaaatgaaattttaattttttcagttatgcacaaaacaaggcgtcaaagctgaacatcaacgtgaacgcgctcaacgccctcgtgcaggcactgaactccaccatgcgacggggctgagctgctgctgctgctgacgtcgccgggccggccgatgacggagggatcgtcaggatggaatatgatcatttgcgaatgtattgcgttgtcaccgtgtccataaactgtcataatgccccatattgtaattgtcaatacacccgatcatttgaattgtatgtatatgtattattgttgatgtgtgcgcatatataaactaatcaaaatgagaaattttcactttgtcactttttgggtgtttcggcacttctgacttatatagaggggggatttttaaaaggatcgaaaaatgactaatttggtatcatttgaaagctctagatgagatataacggacagattttcccacagccgtcaattcggagcataaccaagactggcttcggggggggggggggtgctaaagacaaaaattcgatttttaaggggtgtatttttctttttcagccgatttttaggggtgtatttttgcaccctaaaaattgactactttacgtttcttaagcatttagaaaatttctttatatatttaaatgcctaaagcagccaaatcaaacgctgtgttaaatcgtcactggatttcaaagttcccggaaggaacttattcaactgatggaaaaattaatccgggactttacaaattgattgatatcgccaaaattttcattggaggtcgggcgaaaattgataaagactgatattaaatatgatttttttttgcgtaaatacacttggtttttccaatttttagcacatatttttgcattttttaacacatatttaggccttttttttggtttttagcacatattttgggtttttttagcacatattttattacatatttcaggatttttagcacataaaaatcccagccctaattataacagatattgtaccaaaaatagtcaattttcatttttgaagcatatttttgaaatatatttcatagaatttcattaaaaatcgaatttaagaataaaaagaattcgccaataattttataaattgtctgtttttgtttgccaaaattgaaaattttaattcctttttcctttttaaaatctttgaattaatttaattgatcaatgtttatgcctatcattcgcttccgggcgaaaatttgccaatttttcccacaaaattgcgcgttcgaagcaactgcaaagcctaactttagtgatcgaagtcactttagacgatgacgagtgatcgatgggacacggattatttgtcttcagtaaatcgcatttttttggacgaaaattgnggctctatttgaaaaatacatatttaaaacatgttttttaaa

SEQ ID NO: 693 - DNA, 6404 bp, Heterodera glycines
  misc_feature (70)..(70): n is a, c, g, or t
ggatgaaatgattgcccagccatgttacaaccctctcaatcacaatgtcgacaatccgctttactttccncctgattatgaagaatcggaagaaatggaagaaggcgcggaggacgaaaacattgcgaaaattgaaaggcgttggatcaaaaggaaaaagcgcatggcaattacccattgattgaactgtttgttttgttttgtcagattaaaatgtttgttgctcttctgtactttgtgttaattgcttttcgtttttcgacacattacaatatttttctatgaattcaatcggtattaaatttaaagtttttttcgtcctctgcttctgcttgtcagataatgattgtgaacccaattagaaatatattcgtgaggaattttgcctgtcaattcggaccttctgaactcggttaggagattttaaaaatggctggactcgggagtctacacaaatgagtctttaattatgattttcagctcgttcctatgtcaccgatggcccactgacagtgagcggacgcagtgcgcctgtcaaaaagcgcacaaatgccgcagacgaaattgcgcggacaaagttcgagcttttggaacctatcgctgttactgacttgccacgggcacaacaacgttttgctcgtcaaatccacagatccaatcggactcgggtgcaaaaaatatttgccaagaatatcaaaatgatcaaaaacggcctggccggcattgcattggtggtcgccatttatttgtacacatttttcgtgatgcgaaaggaaacattcttggaagaaattgacgaagaaatggcaattgaacggggcgaaatgaaactcgatgaccaagggagactggtggcagtgaaatgagcacttttgttaatttgattttagcacttcatttgtctaatttgttttgttttattttttgaagagaaattaaattgttttgtttatccaccatctttctgatttttatgtacttacagcgttaggaaaataacttcctataccaaaaaattttttccattagcttttaaataaaccaactttataaaatttgcctatttcgggaaagtttggcccgaaaaatttggcttaaattgaatcatacgaaactccatcgtacgaatcgcctattgtacgaactgcctttgttcgaatagcccattgtacgaaacgccatgatcccattttttaaatccatacttcaagaatcccaactttaaccaaccgaactatccaagctcctttaattttgaatctttgctttcttcgtgtaaacattagattaaacattaaacggcatcttaaaatctatttgcataactattacatacgtacattaagcaggaactcatggaatagaaatctactatctgtcaactaatattcatttttagtcatacaataatatgaattatcgtgactttgctgagtatcagggcatctcaacaagcggtgcagcggcctgggaccggcttggagaccatgcttttctgagcccataccaagatttttcatcgatgtcccgtgttcctggcgaggcctttcgcttggagcgtccctatagtaaaaacaaggcaaaaggtggcggacgctttactggtcagtaagagaaaaagtaaattgccaagtaaaattgagcaatgttttagaaatgcgcagcggtcgtccgaatacgatgaaagcagtgggcattcgccgtcagcagaataattattctgtaaattcacaaataaattctttccttgggtattgaaattaagtttttagtacactccaattcccgactcgattgagcacaaagaatttgccttgtcttcaaatggcgttttcaatttccatggctatcagagtctttttactctccaacatcgcgtaattcattccaccagccattgttctttttagattttgtcatttcagttcgattttattgtcgacggcgtcacttacaaaagtgtcgaccagttctaccaaatgaacaaagtcaaggatttgactgggatcgaatcggccaaattcacggacggatcgacgcggaattacagcgcattggccaaggaattgttgcgacaagcaaacgtgataatttaaatgctcaaaatatataaaataaacaattgttaaggtcaaacggcaggaaattgacaaatggcgcaccgggaggggcgttgaggtcattcaggtgactgacattgggcaaaaatggcaaattgcccattttgtgtcgttttccttttcagaaggctcttctcgagaaggtccgccagtgctacgacttgcgcaattcgatcaccagcacagcggacaaactgattgtgcacagttacaacggcgacgactttttcggggcgggcgttccggcgaaatatgtgaacgattggtgcggggggatggagcagaacaaagtctcgctgaaggtggacttatactgatttgcagtattttatataattattttgatagtacccaatggaatttcccctcactgcggacaatgtgaaatatgtgccgctaattgcgaaggtaacaatcattttcagtatttagtaatgatttaatttgtgcttcaggggaagaatgttctcggtgccatttacatgattttgcgcgaaaaggttttcgttgtgaaataaagcatttcgacttattactccattgcttttcagatcaacaaaggccaattggactctttggacgtgcaattgaagccgattccgatcagcagcagcagcacaagtaccgacacaattatggtcgattccaactcttaaatggcacgcaaattctttttgatctgagaaaagttatggatgatgcctttgtattgtttgggcgctttttctctcgtttcatcattattgttttatcactttttgttgttctcaaactttcaactttttgtgctgacgaatacttttcccaccaattttcacatgattaaagagcttatcgataaaaatgattttcaatttaattgatcgtcaaccttcattgtttattttgatttgtgaattcggtttttcatgttaaaaatggtatttagcaaaagaaaattgcaacggatagattagcaccatttgttaacattgtcaatttgctgtttctgaataaagcggtggacaattggcatttagtgcccatgacagcagcagcatcggagaattttggccctctgtcagcacattacgaggaagacgatgaactgcttacaccgacaaagcgacttcggttatagtgtactttgtaccccccctttttttgaaaaagaaaaaattcaaaaattttttttcgaaataaagttgttttatggattgtctgggtcgtagaattcgatttctttttcataaaaggggggggggggggagtacaaagtaaacgattaccgcgacttcatttaagcgaattgcggctgaattctgacgaaaaatgtgcgatgtccgattcaatcccacgggctgttgagctgtttatggagaagaaacgagcaaggatttcaaaattcctgtacacgtacaacggcaacttgcaattgaatttgccacaattgcacgcatttgcatgctcaacgggcggactgattgatgacgaatttagagaaaggtgggaggaacaaacctcgtaattctcccatagagatctcagtttacaattgccatttttgttctggcttttttaaaaaaatgcactcaaattggttcggcggataagtttttaattatttggccatcatttttctttttactcgaatgaattgtcaagcgcttttaaatagattttttatggcttaaaaatagaagttgtggtcaaaaaattcttacgttgtgttgttcttttgtatttttaaaaccaaaaatcaaaacagaagataaatctaaattgatggaaaatttattgttttagaatttggccaattctcgcaaaaaatctcccacaagcaaaacgatgtaaagatacgcaatgggacgccctccgctcggaggaatacaatgaccaaacaaatcattcgagcgacgaattgcaacaacaacagcaaacccttttcctatcagattccgactttgaatctgcactttccacgttcaccccgtccatttcgggctgtgatgatcaattgatggatgcggaggacgacgccgagggggtcgacgaccaaagaatggccccccaaaacgcaacggtactccgctcatttgggttgataaacacaaaactataaaaattgaaaagaaccgatgacattcgagtgagtcaaggtcttcgacttctctcctgaccagctgcgtgcccacaaggaatggaatcaggtcgaattggacgtggcacggacattggcacggtttccaccgaacattgacgaggacgaaagggcatgtctgcagaacgagttgaccccacttattgtgaggatattgtgcgaaaatgaagacttccgttactatcaaggtgagtgtttgttgtcgatcaactaatccttgaaaaaaccctggcgaaatttgcgttcacaatttaacccatttggcaaaatccgtcctcctttccccaggctttcacgacgtgtgtctgacttttctgttggttctcggcgctgattcggccctccaagttacgcgggacatttgtgcccgaggcgccttccacaattatttgtgctgttcgctcgaagagagtgcaatgcgcgagttgcaggacctgtacgtgttgctgttcctgcatgaccaagaagtggagaagcggctgagaagcgccgagttgggcactctgtttgcgctcagttggcccctcacttggttttcacatgcactccaaaattactcccaggtgaattttatttctgcatttccttttcataattaatttggttctaataactgttgcaggtggtcctgttcttcgaccttttcctctcttctcatccgctgatgccaatttatgtcagtgccgcgttggtcagcgaacgacgggaagaagtgttgggttgtgaagtcgacatgccatcactacaccaactgctgaaccatgtttgtctgttgttgtgtttggctgcgttatttttgacttttaccaaatgccttctccttttaagattccttccaccattaattgccatcgcgttgctgacgctgctcgtgcgctaatggaccgttacccgccgactgtcatttgcgagtttcgagaagagtaccttcgcatctgcgacaggcataagcggctaattgcggtagaacggctgcaaaaacggatggagttatgtgaaactaaaaaatagcattgtttaaaaagcagggacatttttcttgtagcagtccttccttcccccaccaatttttttttgactctaatttattattttctaggaataattatatgaatttttcaaaaggattgcttatagaaattattttcaaaaaaaaaaaaaattttttttttatattctagatcaaaaacctacgattagtagaaaacaaagttttctttttttaatcgatacggggtggatgaacctaatgcacctttttctctgaaatggatgttaaattaattatttaaatttcgttcgaatttaatttatttcaaaacgatccataacaaaagtctgtttagatggaacccatcagaagcggtggtgcccgtcgttcttctgcctttctcctccctttgctccaaagggacaacatttacgctttggctggtgcgggtgccgtcgctttgctcagcgcagcaattgtccattattggacctactgattttgggacggtggagactcaacaacatacaaaacaacacatgcacacatacattccacacagaatatattacccatcacatatatataaatacatatttatttctcattttctcaattggaatgatttatgtaaaattaacaacaccatttaatgtaatatgtgaatgaacaataatgtgctttttccctccattattatctaccatttgccgcccttcttctttttccccttcttcgcctgttgcccggccggccgttgctggcgcggtccttcgggtttgggcgacgggtggggggacggagtgccaccgctggggcccggcttggccgaactgctgctgtagtcccttaacaaaaaatcccaccaatctaaggcaataatgccaaaatgtgctcacatattcgccacggcactggccgaggtgccctgtgtgcctcgtccaatgtctctgtctttgtattttttgtgcagcttctttcggtacgctgttcgttcctgcctgggcagccatcgctcggggtcaagcggcacttgtgggtcgaaatttgccggcaaacggcgctttcgcttgcgcgtctttctgcggctttttgtcactgcgtcggctgctcaccgtgcctgggaagagaagaggggagggacctttattat

SEQ ID NO: 694 - DNA, 1789 bp, Heterodera glycines
ttacgggcgttcgaatggactttcgtcggtcttttccctcgtcctttatttaccccgtcctcctccatcggctcctcctcgtcgccatgtgcacttttcatcggtcgccatttcttcccaaattttacgtaatccgcttccaaattctcgacaatcgccgctttcaatttccaatttaaggctctaaaaacagattttatttattagaatggaatgacaataatttacttggttttcagcacattttgatataattttagtgcctctttcttttggtccaatttttgtaatgtgaacgctttctgtgccaaaattggtgccatttcctgctgaatttcctctttgccaaggccgtccgcgttcaatgaccgttcacattcaactgtatttagtgacacatttttgaatagaaaagcatttttggaagaaattgtaaatgctactacctttaatgattcttttcacttaccggccgtcttttcgagcagtcggagggcgtcgtcaaacttttgacatgcgatcatatggcacgacgtattgtacatagtctcgaaggactccaagttggccaagtccaattcttgcgagtcgccttgggactgaagtcgcgctttgactgcgatgagattcgctcgtcgaatgtcgtcaaattcgtcgctgtgagttcggattaacttcctgaaaaatgaaatacagaaaaagaattcgtaatgtggtggctaacttgaacaattcaagagcttcttggtattgttccattcggtacagaatttgcgccttcaattccatcacacgcggcacggaaccatccaattttctgatcactccaagagcggccgtgtcattctttttacggtaaaaagcataggctttttcaaaagacatttaataaagcggcaatgataaaactaagaaaaagtgcttaaacagattttttattaaaaaatattaaaaagttattttgcagtttttaagaggcattgtgttgagtaaaattcaaatattgactatgtccagagaatctgtttttttcgttattaaaaaaattagttaaatcatttcctttagcctaaatgttttccaatttatcttttttttaatgacggaagcaacaaaaatttacaacagactcagtgcttttcaaaagtttcgcatcaatttgaactgccatttgcgtcgcgtccggtcgaattggttgtatcagctttcgacggcgctggtcttcgttaccgccttaaaccatgccagcatttacctcacttacgggcccgaccacccgcgatgcatgcaacagtaaattgaccaattttttgcatcggaattctgtcttatggcatcgttatgcttttctttgcaaatgatgcttttaagcaactacgatgagattaaaaaatggatgtcctgttaaaattctacaaatttttgaaaaagaatgagcattttaattggtttaattcgaaaatgatttttagagaatcagtttgttcaaacccggtgcatattcatggtaggcccgacaccagaaaaaaagcgggaaactcgatgattttttttaaacttttctggccaacaattccaaaagctttttgttttgctatttcaaaatttgccctgctccagtgccctccctgatcaaatatttcccttcagatggaaggaacggaaacagcgcggattgttaacggacgaattgctttggaaggagcggctgctgtacgcccgcaggtgagacccttttttatgcgcccgtcacgaataaaaatgtcagaggggggcgggggggggggcg

SEQ ID NO: 695 - DNA, 3175 bp, Heterodera glycines
  misc_feature (3112)..(3112): n is a, c, g, or t
  misc_feature (3151)..(3151): n is a, c, g, or t
aatgcccaccttagagcgtaaaagaaaaccgtcggctcattcaagttattatttctcaccatctgttggctatcaaactgaggcttctgatgcgcatcaaacggtcgacacgatgttccaatttgacacagaaattttcctgtcggtgaaaggcgcggatggttggcgcgccttgaagcgactcgctgaagtgggaatagatgggcgagcgacggttggactccatacgtttcaactgacgagaaatgggcacgtaaagaagctaaatgatatattttgtacatcctttcccgtgagaaagaacggaccaaaaggtacagatagcagagaaaaagtgggacgatgagcacaacaaataaccacgtgcttatgcagatggtcaccagcgttgccatgaccattgagatgcattggacaaaatagcgaatgttcatcgggagaatgctaaattcgaatgaatgaatgaattctctccgactctcctccacctgtccgccacttcgatgtctcgcccgaatcgatttaataaccgtccaattggagtcgtgtcgaagaatgccatcggcgcacggattacgcgacggagcagcggagaatacaaattgcgcgaagcgttcagtccagcgaagagaagcatccaaaggccaagaaggaagaataaagctgacaaaatgacgaaaacattaatataagtgtgtatgtttaacgtttaaattgggaacaaaaccataaaaatgaccgcttcaacacatttcccaattcaacaaaaagacaaactgaccttcggcggtgccaaaagccgcgtaaacgataaggcgttcactgagtccatatgaagaaacattataagtagttgaggaatttaagtcctgttggttgtggtccgccctggacgagaaaatggggtaaaggaagaacaaaaaaaaattttaccaatcggatagccaaaagtttcgactcatttgcatgcactgattcagtacgaaaagcatcaaaaatagcaacgaagatgagcagccagcgacacgaaagtattgcagatagaccatgagtttgacctaatagtgcgttcattttagaaattgaaaagtcaatggtttattaaataattggcataaatgctttaatcatcgatcagtcagtctctcatttttctgcctcagtgttcgtttacccttcccgtttccacgcgttccttctgaatcagtcgctttggcaaaggagtgtttccatttgggagcgtcagttcaccagtggcatttgatggagttgcggttgtaacacggccgctcaaaggttcagcatccggatcattgttcgatactcccggttcaatgtcataattcacagcagtgcgctgaccatttgtgccgttccctattttttctccatttttcttactttcggcaacaaattgtgcaaattttcccccaagcagcgaagacagctcgtcaaaagttccccgttcaacgatacgaccatctgaatttagttagtaaaagtgaatcgaggagcgaacttgggggaggaccttggataagaagaattaggtccacatgatgaaggaagtggagaccatgggtgacaaaaacgcgactttttccatccaaaatactgccggggccaatcacctgaagaaaagaatgaaatggtagcagataaatggcgtccgataaaacgacaaaatctcaatttacatagaaaaaacaattatgagttgtcgactatacgataataaaacactgcgctttggacagatgtcaaattactttttcaaaaatccacttgcccacgtgactgtcgaccgctgacaaaggatcgtccaacaaatacaattcgctgttccgttgataaacagcccgtgccttgaaaatgaggacaaataaaacttacctgaattaaagttacgcaaaaatccaacacttaccaaggaaacccgtgccttttggccacccgacaaattaatgccctgcaagtgagtgagttaaattactcaagtgatttttcgtccgaccttttccccgatttctgtggcgtccccttgcggtagcatcgccaaatcggcacgcaacgcacacgcgtcgagcacacgttcataccattctccttcaaaaggctgcccaaaaagaatgttattccgaagagataaattttgaatccaaggcaattggggaacctgaggaaaggaaaaatggggaaaatcagcggactttgggaaaagttacagaagcaatcgccaactccatcccttccagcattttgagttcgcctttggtccgtttcatctctcccaacagagcggcgagtaacgatgactttcctgccccgactttgccaacaacggcgatcaacttttcgcgtcgtatttccatgccaatgtcggtgagtgtcggccgttcagttgccttctgttggttccagacggaggacgtacgacgatgcacattctgtcgatggccctccttcgactttccattctttccgttgttgtcccaacagaaatcggcatttattactcgaatcagcggagaggtgactgaatattttggtaaaataaaattcgacttcaatatgacaaaatgcaccattcggtgttttcctttgttcgattgtgtttttttccaattcgtcctccaacaaaaactcgcgaattcgtttgttgctcaccgtcgtttgtacgaccaaattgatcagcatcccaattattgtcattggacttcgaatttggttaaacagtgtaagagaaacgaaggctatttgcggcgtcaatgaccgtccaccggcggggtcgagcaaaataaaagtggtgaaagagccaacggcaaccagaaagggtgaagtgaagttgagcatgtcgactaggctgaaaggatgaaaaacggtacaaatttccatattatagacaaactcacctccgaatgactccacttttgaacatacaatgcaactcgagtcttcgaatactgccgaccgctttgagcatcggaatttcccaggcgtacagtttgatcactttgattccgttgaaaatttcgcagagcaattttgcccgctcgtcgcgcaagttcatttgtgtggtcagccaagtgcgagtaaaaaaggaagagatganagagagcggaaaaatgactgccattatcaaaaagcctgnaagagccgcgatgccaagcaattt

SEQ ID NO: 696 - DNA, 4270 bp, Heterodera glycines
aaaaaaaaaattcaattaaatattttttaattttcctaacttgatagcctggattttttcatggacttggatttttgtccaggaaacccaggtccaacatggagcccagactttttttaaatgtcaaattctaaagagaaatatttaattaaggtaaaattttattagaagagatgaaatttccattggctttcttttctctgtgtttatttgcatttgctgaagtggcagccgaccgggtcctccttcttatagacaatcccacaattcgggaatcgcactccgtcttcatcaaatccctcgaagagcgtggccactccgttattattgccatggctgatgacccaaacctttcgcttatcaaatttggcaaatttctctacgaccatttgatcattttcgcaccttcggtggatggtaactaattttttgcaatatttttttcagtttttcttttagactttggtgggaatataaatgttgacgagatcaccaaattcattgacggtggcgggaatgttctcgtcgctgcagacaaaaatttgggcgatgcgattcgcgaccttgcagcggaagtgggctttgagttcggggaggaccaatcgatggtcattgaccaccacaactacgacactgttttggttcgaattctgccccttttcactaaataatgcaacggtcaaattgaggacgatgggtcgcacacgaccattgccgtgcccaacgcacaactgatcaaagcgccccttatcactggcgaaagtgcgcttttggctcccgtcctttaccgcggcattgcgctggtcgcggatgaactgggccctttgcaaatgattttgatgaccgcttcatccaccgcgtactcacataaccccaacaaaacggttgaagaggtgtgttgggacaaatcagtttgatcccattatttatgccttaaattcattaaaaatttgttttctttatgacagagttttcttcacttttcagcgtccttcggctgttggcaagtcgacaattcttttgggagctttgcaggcccggaacaatgcccgtgtcattttgtccgggtctttggactttttttcgaacaaattttttactgcgacggtgaaccaagcggggggccacactgccaagtgcccaactttttttcttatattatttatttggacattttattttatttagtgccgtaaaaagtgggaatcagcaattggctgcgtccgtcctcaaatggttgctcaaagagtccggagttttgcgcataaaatcagtgaaacatcacactgttggccaaaagtccccgcccgccgagtacacaattatggactatgtggtgagaagagcgagcatttttaattattattttttatttatttatttccactcagcgatatgaaattggcattgaggaattgcagaacggaaaatgggtgcccttccaaggcaaagatgttcagttggaatttgttcgaattgacccatttgtgcgcgtcactctgaaaaacaacagtaagtcgaggaggcgggggattataatcattacatctcattggtaattaaaaaattacgtttttcatcagatggcaaattctcagctgaattcaaaatccccgacgtttacggcgtgtacaaatttttggtggattaccaccgaatcggatacactcatttgactgacgttcagcaggtcgttcacgccttccccattcgtcaattgtttctttgttcaattcattcattcatttcaggtctctgtccgaccattgaaacacacgcaatacgaacggttcagtcgctgcgcttacccttattatgtgtccgcattttcaatgatggttggggtgagcaaatttgttaaattatttttcaaaattcaaatgcgtaatttcgggttcatttttgggaatatttgggctacatatatgggttttattgtatttttttgcagttcatagtcagtcattttttggacgcatgccaaattagctaattacctttgccctttggtcaggtggtgctcttctccttcgtcttcctctacttcaaagagtcgcccccgcaaagttcgtcctccgccgccccttccgccaaaggcctccaaaaggcaaaggcttcgtaaaaggcgcatttccatcttgagaaaggcttaatgtgaatgttgttacatattattatactttcctttaacttttgctctgcttaatttatttcattgtttttgtttaagggtctttcgttaataaaattttattttttttcttcaattgtttaaataaattttttcaaattcaaaaattacctaagattttttgccttttatgtgaaaataaaatttgctaagaatgtcacggcataagaagacgcacaaacgcaacagcaggaagggctcgaagaagttcagttgtttaatttctgcactttattttaacttttttcaaaagcgtaaaaatttccatttttccgtttattttccccccaataaagcgctaatcttaaccaaattttgcatcaaggaaaaggggccgagggagcgcttcttccaatgggtcaaccgattcggacggtgccgttggcacttcgtccacccgccgggcaaagagttcgaatagggcaaatggacggcattctccgccgtcctcctacgactcgaccctttccgaatgttccacctcctcaacggcgcattgtcagcattttccggaccgggcaaagaatggaaacaattttggtcaaattcgcattcgaaaaacacgatggggaccaatgttagaggagaaaagcgaagcaaagaaaaggcgaagggaaaagccaacggcgagggaaagcggcggaaggcatcgccggagggggaaaagtgccgaatcaatcgacagaggaaaagacaaagcgacacaaaaaacacgcgaattgcgacaacttttggattttgtggacgaccgaaagcaattggcagacgaagttttggacagtttggacgtgaggactcggaacagaatattcccggaattaaaagtacaaaaaaacagacgcaaaagtgattggcaaatcattttttcaaatttagacaatgtcggagacggaaatgcgaaggattgtctacggatttatcaacggaatatcaaaaaagcgaattgtggcattgctccaacgtccgttgtgccaattttcaattaaatactcgtcatttgcaggaatagacttcgccgacagttcgtcaacctccgattcggaggaatgtccaaattccattccgtcgacttcgtccgattgtcgaaatcgctcaatttcgaacgaaccgaaaaaccctaccaaaacaaagagtaattcattgaaagaaaagcacaacagaaacaaaagggagaaggagttggaggagggcgaattgatttcggaggaggaaatggaaaaaggagaggagaagggaggggaagacggatcagaaccaccaccagcagcagaaagggcgacattcgaagacgacacggggagccaatcggacgacgacgaggaggacggccgattggcacgacgacaaaagaccgaaccgcaattcgtcatttcgcgtaataaacaattagtgttttaattgcactaattgacctttccctccgttcttttcactctcattgaattgtcagttggattttctccgcctcatcagcacaattccgaaagtgtcatcaatttttgtgagagtgacgaaagcggcgacgatgacaaatttggacaaccgcagcagagggtacaaaacattctccgccgggggtttatcaattggcttttcatccccccccccccccccctcatttatcagatcgtttgcattttgccctctccgtctccaacagcgacaattgtcgtcggaattccctctgctgatgagagtcagccaggcgacgaggaggaggaggaggacaaccgcagcaaactgagaactcctcctccgactgatcattacgaatttgaagagcaatcagtgaaagttcaaataacagtaactgacgatggggaggaggacgaaaatgaattggacgaggaagagagagggaggaggcagcggaaggggagtgccgaaccgacagacggagcggaagaagctcccgccgcaagggaaaatggtcggaacttccagaaaccaaaacggataatttcgctattttagttaaaggtgacaaaacgccaacagaggaacaatgaagatgatgatgatgacttgctgatcgaactggttgatgaatgaatcctccaattcattttgtccaaatta

SEQ ID NO: 697 - DNA, 6624 bp, Heterodera glycines
cctgattggtaagatcaccgcccggtagccggcttgttcccccccccacgggggccaacgacgttcccaaaaagtgccaagattggaaagtgatgctaaaaagacagttgcccaaatggtgtgtcaatgactttttgttttggcattcggttgtcagtgccctttggccgttacatttcgaagtgttcggtccctctcctccaaattgtcccacagagacgtcgcattggcattgttccgctgggaaatgcgtcggtggttcccctcccattttttgcctcctcttttctcaaaaacacattcatcccaaagacggagccatagcagcacttggaaaggaggggggaatttcaggaatttatttgtatattttaggatcattttgttgttcgaaaaggccctgaatctatggggtattatgttttcgtttcctcccgattaattcattgtcagaaaaaaattcgaatgaattagaaacaagaactcgtatttttatatagttcgatttcactaataatttttatttttttaattctcatttaaattctcaccgattcgatttgtctcctaaaagtgctaaattttaataaattaacattttgctcaaattgcctcacatctttggtcaacaaatccagaaaggtgctcggcgcgtatttgtcgacccaaagtgtgaatttgtgccatcatttctcgtcgggaacgttcaaagtccgccaaaacgcccttcggccccgtccgcggtgccgttcgtctcgatctaattgcaagctgaacaaaaaaattgggatggtcgtgcaaaaccccctctattctacctctgactgcggaagaacatggcattgcgcctcttgaaaccgcaaactcctcttcatcttcctcagatgaggaacagtaaccagccggaggaccgtccaacaaattttcttcgatggtggtcattatttgaaataacaaacactaaaacacaattataaggcaggaaatttttacaaaataaaagcaaagatgcaatgcaataaaaattaaagggacagaaaattgtccttctttttttaaaatacactcagactgaaagactgggaattccaattcgtacagatcactctttcttcgcgttcttcctcaaaccaaaataaaatgccaaggcgaagagaatgccggggatccacagaaaggcactgaaatgagttagaaattaatttttgtaccgagttcctgttttcgcaccagaaatttgtcgcggcgagtgcggacagaacagttaccggaaatgagagcccattgttacgcgcggtggctaatattgacagcggcttaatcttttcaattacacttattcattatacgaattaacataccgggataaagaaggcgaaacaaagaatctaaaattttgcaaaaattattaaactcttctgtcatggttttaaattttagcaatactcacccaatagtggaaatcgtcaagctgtcgctgaagaattcgttcatgctcggtgcgaagagtgttgtgatcgacaagaattcgttcatgttcggtgcgaagagtgttgtgatcgacaagaattcggttgtgctgtaattgtaattttttttgttatttccccatctgttaaacctctcgagttaaagaagacactctttcggacaattcgtgattgtccgtttgtatttgttgcgcttgtttccaaaattcctccatgtcttcaatttcacatccgttccgaaacacctaaaaagttcatttttgcgttttcaattttatttctgggtattttctcggtttaaagaatccccatctgcgtgtagtactacggtttcattttaccaaattaaaggcgtttcgccaaaaatatgtctatttataaatttctacacctacggtaactaccgatgtaaacatggaccaatgaaaatagatatctggttccaggttaacaggtcaaaattggaaatcaaaaagcaatattcgtccaaggattccataaacacctcgggaggttgtccctgaacttcatcttcaacttctggcgaaatggaattggacgaattggcttgagcattgttaagagaagacctattcgagccattttgtgactgcccattgcccagctgctgctgttcgttggacgaattggacatgaaaagttatttggtacaacaatcaagggctgaaaattggaactttttaaattcaaattgtttgttgatgcatatcaaatggttctataaacgagcttaaggtggatgagattgtctttggatgagttagttggcataaataatagtaaccctaaatttgcataaaatttggtgcttttgacccagcttaaacgactgtattttcatacatttttatataaaaaactaagtaactcccaaatattaaatctcacaagagaaattgaaaaatgtttgggatttactgaattggtagtggaagtgaaaaatgtcggaatgagacagagagaggaatgaaatgaagcatagtagtggatgactatcatctcgcacaaaatctaccgtacactaaatattcaaattgaaaaataataaaaattccaattttaaatttccgcgtaaattgtcttttgtatttttattagagtgccacgggacctggaagcggacaactgagtaccaaggtcccggttttgaccgggactagtccaggttttttcccggttttcccagctaaaaattcccggtttttcaaaccgaaaaggtcccggtcccgggtttgcccaaaattcccggtcccgtggcactctaatttttatgcaataaatctgaattttactgaagaatgaccctcctttagatcaagaagatatatgcacaaacctttttgtttttttaggagattttaacgaaaaatactttatttaaaattagctgatttcaccacaatttcagtggccttttcccctactaaattttaatttgttgagtaccttaaatttcaagaatacctaaagatgtacaaaaattatatctattattcgtcataatgaaggaaaaaaacaatgcgagttaaatacaaattccattaacagaaaaaaacagattgtatcattatttttgatcaaaagtggagaaaagtgtgccaatgcgaatgtctcgtcgtacggcctgggaactgccaacggaatgccgaaaagtgaacagcggcccctgcacagacaatgaggatgagacggaggaagatgaaatcggacggcgttcggtcatccaattctgctggtgaattagcgtcaccgccgccaccggaccacaactagagagcgcatcacttgctgattctcgcgttgctgctccacaaatggctaaataattggcaaaaaatgaaattaataactaaaaatgccaatgccaaaattcggctgtgtgtggcaccgacctgaacattcaagttgaattggagtcggcgggacacgtgcagggcacagtgtaagtgaacaaaagcgggcgcaaagggaatgtaacgggtgcgaacacaaagtgttgggcacgttggagcagtgtttggagtgcgtccaattgggtgaacagagcggagacgaaacggcactgaaaatggagggtgaattcattcccgaccgtcgtttccaccgcccgaaattaaaaaaaattaaaatttaaagcgcttttttgaaattcgaaaaaaaatcgtcggttgacctgcgccatgttaagtttgaggacggcggcaaagttgttgaacaccaactgctcgagacggacaaactcttcggaggacatttggccaaacagtacctggagcgtacgcgagcgaacgggcaacggacggacgatgacacggctgaacaacgtgacggaatcggtggaagcacgacggcacacagacaacagcacacgcagtgcctgattttgtgaccaatttgtcggcgtggaagtccagcgtgaaaatggcggacaaagtgtcgaacagtgacacggcgacggccgtgttcagtggtgacggcacagcatttgaggaggacactttttggtcgactgacgaaccgttcacaaaggcctaattaaggaaaattagtcggtataaaaaaggttttctaccggacgaaagcaaaaatagtctcacaaaattggcatttgtcgtcgttgtcgtcccggtggtcgtcctgttggcttggattcggtcggaagtgtgcgttttcagcgtgctgaattggagggtgttcagacagaggcgaatgtcactgccgtgggaaaggaacagttcgtccagctgatcacggccaattcgcacgccttcgtaatggcaaatctgacaattcaaaattaggggagtaatttcaattctggacagttttagttctgcctttcgtagtctgtttttatgaaaatgaaacaaaacaaccaaaaacgaaattcgtatacctctggtccattcaaaatgcaagcgtttgtccccacctactcaagccgtcgctgcatccgctggcgattgcaccgctgcacgcgcacgggcaagcagttggcgcgcaactcgcgcagcgcgggcgcacgccaaagggaggcgcaagtgcaaatgacgggacaccgacagacgacggaggaagcgcgggaacgacggacccatgaacaaaggaattgaacctgtacatggggtgaggagggaatcaatgctcgaattcatggcactgtccggcccgtccaccaaccatttccggcgacgcttgttccaccgcgtccacaatgaaacagcacggccgagtgccgacgtgtggtggcggtgcttcacctgtcgaagcggcggagacggacaaattgtggaaggcgcgtcaatggacgtgcaatcggtggcattttcaagacgcgacttcagctccgccatgttttgcagttcactgacaaatgttcgatttgtgtattaataaaacagaaatttcatggttagcatatttttaaaagtggaaatgcgtagattgacgttacaaaactattatttcgacgaaggaaaaacaaagaattgcactcctaacaaaattaaatttttcatgaaaaaatgtctatggaattttcttttaattttgcggggggaaacaaccgggggataaagtacagcttgaaaaactgcgttgaatgtgaaaatgcgcttttgtgccactcacgacactgtgccgttcgttctgtccccgcgtgtttacctgatcggtatgatcaccggccggtagccggcctgctccgccgccacgcgggccaacgacgttcccaaaaagtgccaagatctgaaagtgatgctaaaatgacagtcgaccaaatggtgtgttcaatgactttttgttttggcattcggttgtcagtgccctttggccgttacatttcgaagtgttcggtccctctcctccaaattgtcccacagagacgtcgcattggcattgttccgctgggaaatgcgtcggtggttcccctcccattttttgcctcctcttttctcaaaaacacattcatcccaaagacggagccatagcagcacttggaaaggaggggggaatttcaggaatttatttgtatattttaggatcattttgttgttcgaaaaggccctgaatctatggggtattatgttttcgtttcctcccgacctcgaaagggcataaaaattattttaaaaattttgaattatacaattgatttgacttaaattcgaagattttgaaaaccagaaagtgtttaagcaacattttcgtcctcactttggctgttcctcaaccgttgttcctgctcccgctcgtgaacgcgctcttccgcctgcattaaattggcaaatgctaagtcggcgctctccaattgtgcagtgtcctgttttctggtagtggcactttctgcaaggaattaattgaagacaaatgcgattttcgagaacggaaaagtttccgggaattccttattgtcgatttcccaattaaaaagaattccctggggttcttggagtccatgacctcgagttagatgtcaaattcgtgatcagcaacctctaaaaccccggataaaaaattttcatagtttttattacaaaaaaattttgcacaacaaaagggttcccccttttgtttttgataaaattcaaaagacttcttttaagtataaatacccaaaaccggactggcgtccattttcccttttcaaaacgaagctgaccctaaccattttttgagccaaaaacgaaatgaatccgcttttgtcacctttaccttgtccaaaatagcatctgtcaacttttcttgccggaaatgctcataacccgctgtttgactgactgctgactttcggccgcagattaacgttggactatagctccaacaacctcaaacacagcaatgcccctcatattgctcatcagagtatgaacaatatccaactgagggaccgtccaacagttttgtccacacttccgtttgacctcggcttgaatttgagtgaggaggagcgcaaagcgaaggctcgcgtgcctttgccttatttggacgcgcaaacagagaaaggtcaatactttggaagtttttcatttgtttggacagctaacaaaatgcccaaatcgaccctttaaagggtttgattggtctccacatttcacacaaccggcccaatttt

SEQ ID NO: 698 - DNA, 4602 bp, Heterodera glycines
  misc_feature (3119)..(3119): n is a, c, g, or t
tttgctgacgctgcgagtccttttgaccaacgccaaaattattcattttctgaaacaaaacaaaaaaagacatattaaatgtaaatgtcggataaatagaaaaactgacaaaacaatttgtttttcttttccattaaaaaaaaaaataaattttatgtgttgaaaataaaattcaatgcataaaaatttagtgccattattttttcgctaaaaaataaaactgtaataaaaaaaattttccccctttttagttaatttggtaaaataaacatcttattaatatatttgttttgtataaaacattatggacatttctcgacttcgaaggatttgtgccatttacgcttccgatgggattaacggatatccattcagtttggcggtgattaagaaggcattggagtcaaaattaaatgtgtgctcattattgttccttcatctccggagggatctgcccgatactctcaaaaataacccaaagtaaggcaataaaaattgtaggaaatactgccgagtgacccccagtcataaaatttgttttactagtagagggttttcggagtctcagattacagatctgacattgattgtcacaaattccggacccggattcaaacagaaagttgaagtttcaaattttgcgagtttccgacttaggttctaaaattgaataaaataatggaaaatcaatcaggcaaataaactatgcctttggaatgtccaataattgacttgtttaaacagcaaaatttgattgttcattgtgttatttccccaccatctttaaagtgcagattcgtcgcgttggaatgttttggtttcgattcattagaggcaattcgcaaaagattggcaaaggaagacatttcgcgcgaatctttggtgttcatcgactcgcttcccgttctgatcgagcagttctcgctgccctccacctcgtggttcctcacccaaattgccgaactgtccgcctgcgttttggcattggttcacagctcagaatccgaagatgaccaaaacagcgaagattggcgacgaattgaatcaattgcatcgactgttttcgagcttagggcgagggataaacacacattgtgccgaacgaagaccaaaaaaaggaatggcaccgcagaagagaaggcaatggcaattgaaaaatgcacaattaaaaacagacatttggaagttactcgtttattttactttcagcttgaacaattctccatcgaagaagactattccatcactttttctccatttgattattcttctgatcggactgacgacaaattcgtcgagaattccatttcggcaggcggaaccgtcggcaatggcaccgccactcatttgtccacacttccgtttgacctcggcttgaatttgagtgaggaggagcgcaaagcgaaggctcgcgtgcctttgccttatttggacgcgcaaacagagaaaggtcgactctttgggagttctttgccttctcatccaaacaaatttgcccttttccatttgtttggacagctaacaaaaggccataaatcgactcttttaaggtttggttggtctcaacatttcattcaacaaaaaagtgagggtcggcggtcgcattttgtacgtaccggacaaagaggacgacttcgacgagagcgacccggacgacgatttgacaatctgagaacacggaggagcgacgctgccttaagagccaaacatttcaaattctattggacgaacactaatttcggttttgcagaaatcattgattctatcattgattttgaaatcataaatttttggaattttgtcaaatgttgcaccctttttcgaatgaagcaaccatttatgagcagcactttttactagccaatgagatgatctcattgtacaatcacacaaaacattagcaaaacacttatgtactaccctgccaataatcaatttatgaacatttgaccatattgacaaaatttcgaaaatttatgattctaaaaaatcaatgataaaatcaataatttttacaaatctgatattatattcgtgatcagaacccccgaaaacccccgggttatctttttataacagaaacaaaaaaaattttgtttgtgggtggagcccagattctccagtattaccgaaaaaaccaagcgaagctttgggtcataaatagattaccaaaaggggggcgtcggtgggcggggggggggcgggcgactgccggcgttttggccatttttgtctgtgtgaattaagcgaaacgtaaataaaacaattcacataaattaattggatgacttaattaacacatacattttaccacatttctcctaaaaatgaaactgaatacttagcttcattcattttccttcaaaatttaatttatttgttttcagcgttaagaatattccatcaattcagaagtggaccacagaatgaatgccaaacgtcagtgggagtgtttgtcatgcccaattgaccaacaggtgatggagcattacagaatgacctcacaataaataattatgctaatttgttcagttccaaatcagtgatttggtccacggctccatcgatattttccacccaattaatttgatcatcgacacgccggaattccaacgtcttagacgcgtcacacagcttggtgggttagcacgcgtttttttccaatttcgcttatagactttaacttttgctcaaaatatgcttttgtgataaggtgtttccaatttggtctatccatcgggcgaccacagccgtttttcgcattctttggggtaagtttaaatggctcacattttaccttttcaattgcaagtttgcttttagcaataagatgacaaatattttattgggatgaacgattaacaaaatgaaatagaaatcgctattttttgaattaaaaaagtcgacaacagaaacaatttgaatcaaatgagctaattgttgagagactcttttggaatggtgcacttaacggcctttttcttccaccaaatcttttgtccgttctctttttcttcattttccattctctttcttacatctttccttccctctccttcattcagtgtctatcatctcgctcgtcttatggttgcgcatctttccggcattcaaccggncccttggcattacgccgaatgatcaactttgtgtttccattgccgctctcatccacgaccttggtggctacggatacacacgttcttcccccccccccccaccacaaattttttagactgttaaaaaaccgcctaaacttggcgtttgccttttcatttttccattttaagtttgccactttttaggccatgggcccttctctcatatgtttgagtcgaagttcctccgggaaatgggcgtcaaagattttgaggtgtcgtcaaatatgaaaagggaaatgaaaaatggataatttagcatgaggaaatgtcacgcaaagtgttcaaatttatgttggagaaaaacgacggatggttgaaaaagaaattggacgaatatttggaggagaacgactacgaattcatcgacgaactgatcaatccgccaaaagacatggtgaacttctccacgacaacactttcgatgcaaaataatttggtgttttttctattttcagatgagcaacgaccattggaccctcaggggacgaacgcgtgaaaagtccgtcctttaccaaattgtgtccgagccgaccgccggattggacgtgggtgagtgatgcgttcattcaccgacaacaatgaatgatccgctgaaaatgggcctttttatgaagataaaatcgactatttgcttcgtgattctctgctgaccgatgtttcgatcaatttgagttcggtagggttttgaaaattgcaagagacagtggcaattaatagtgaaattaaattaagaacgaatggcaccgcattttgggcgctgtcggtgtcaccgtcgacagcaaagggttcaatcgcatttgccacccacacaaaatcgtattacaatttttaccatcggaattcattatactaaatccatttccttaacattttcgaaacttggccgcgtttttgattcccgcaaattgatgcacgaatgtgtttatggacacaaaacggtgatcgccgcagaaatcatgtgcgttgccttcgcatcctttttaccatttttttgaatgtttctaaggtacgtccgagcacttagggcagccgacccgcacctcgaatttgtcggacagaacgggacaaagtataaaatgtccaccggtgatcactttaaagggcaacaccttaatttacctaattcaaaattgcagcacacaaagacccgcaggcattttgtcgcctcgacaataatgtcatttccctggtagaaaatcgtccatttttcaaattccaacagacaaattgttaacagatccgctattcgaacgatgtgcgattggacgcagcaaaaaaagtgatcgatgcgattgacatgcgaatgttgccaaaatgtgtgatgaaaatgcaactgaacgcgatgggctcaaattgtgaagaaatgcaaaagaaaattgaggccgctttggccgcgtactctgaaggattgccaattatcgtgaaagtgattagttttcca

SEQ ID NO: 699 - DNA, 582 bp, Heterodera glycines
gtctcccctccaatgggctcatgctttgcgcaagcgcaacagccgccgaatcgaacgtctgctgctgtgggtgagcctcacaattgcgatgagtagcgccggtggcggtgttcgactgttgctgtcgcagcacatggcgaccaccgccattcgtcgtcgacgtggtcggctggccgttgtggttggtcaacggctgtttccccccccccccccaccgaaggcgaaattaaaaaaaatgattggaaatttggggaagcaaatttaaataaactgaccaatttgaccgggggatggaaaacaaatgaaagtttctttaaatggattattgttaaatacttcgagtttaatgaaaataaaattgattaattttaattttttctttttggtttatttaaaatttattatttgaatttattaattaaaatccaattaaaattagcaaagaatgggaaaatgcccaagtgaccggccacccaaagcgccgtcttatttttttttgtgacacggatttttttttctaatacctcgcacaacaggaaaagaatgagaaccaaatcaaatgaatagataaaataaacttat

SEQ ID NO: 700 - DNA, 2237 bp, Heterodera glycines
  misc_feature (96)..(96): n is a, c, g, or t
taattgtctttcgatgttttattccgattcttcttctgtctctcctttcattttcacatgtgtagaatctttcaaattgtctaaatgcttctttcncagattccaagccgattttgataattaattttacaaaataactcgtatttttgctattccatgggaaccagtcaaagaaagaacatttgggggagcggagggcgaaatgacgagtgagtaattaatggagttattgggcagggcgcggaaaggataaattgggaggggtgagagcatccgtagaaggcggagattccctgtgattagtcgaccgattcccgtgtttttgcgaaagaaaataacttgctgcgccttgtgattgaacttgacatttcttcgttttccacaatgtgtggcattttgagtgggggattaattaacggaaaggacacggcttttccctttttctaagccgctccataaaaaacacccaaatacaaaaattgttcccaattccgcctgtctccgattagttttctttttctgtcaccgccctttttcagcggatgtttaaaagtgcccgcggcaaaggccttcgtcgagtcaatccgacaacacttttgtattccacaaaaagggatgggaacgagcgttgggaggaagaggtcgcaatttgggaaggaataggcgacgaaaacgaaaatgccaacggaggcgaaatgcttttgacgcccattttcgctatgccaccgaatcaaagcgacggagcggcacaaatggacgaacatttgcaccaattggttcgcatttgtacgattgtccaccgccaagcgtacgctgtgacacaaaaattgggaagggcggtggacgcggtcaatgcgacggacggcgaaagtccgcgaaaagcatgcgaattgttgcgcatttacgaagtgagcagttacagaaaaaaaccaaaatcacaaaaacctatgtatttttaaattgaccctcccaaaatttgcagcgcataatttggcggtccatcatagaaattgaccagaacatcaaaacactttcgagttccgtccgcggtgaattgcaaagaaatgctatgaacctaatttttttcttgtcaccacagaaagcattgactcgtgcaaaatcaatgaaccgcgactcgaatggctgctgagcatcagcaaatttcgggtcaccgtttttgaccaaattaaaatttaaaaaataattttaatcccattttccgttggcaggtggaaatggaaaatgccattgacagcgaaattggcatttgtaaagaaattgagcgcattctccgaattcgtgcgaggggcgaagttcgcggactccggattaaaggggaaacagtcgcaaaagtcaacgcgataacaaacgaaatcgccaacaaaacaatgaaaatcattgaaaaatgaaatgctatttaatttaatctttgtttttattgagcataatatctaaattaagaaattgaggtattcctaatcaccggatcgttctccttctgcttttgttgtccatcacctgaaaacagcgctttacattcggccattttttccgggtccaatttgttgatcaaagcgaatggcttaacgagggaaataaaatgttaagagagaaagcacaaaaattaaatgtcagaacatggcatacctgtgcaagggggggggggctcaggggggggggtctattagtcgaccgtaagggttcgagacagtcgatcttacgaggtggggggaaggaaaattgggagggaggaaaaaaagagagagagagaaaagtcagcgaaaatgtcgatcgtaactatgaaaaaagaaattctataaagaaaaagtgccttattttttaacaaatttcattaaaaattccgttttacgatcgactaatcccgatttgtgaggaaaattgtcgatcgtaagaggtgaaagagtagaaaaatcaaaaaattttgccgttttttaaaaaaaattccaaatttttacgatcgactaaaatcaactttttcccactcgtatataattttctttaaaatttggcttaaaagcataaaattggtaattttttggtgaaaatttgccaaaaatataaaaatttagtcatttttggacaaaattcgttaacaaatcgcattaaaaattcaaaaattttcccggtggggcctatcggcaccgccaaaccccctttttctcagttttttttgttgaaaaaagcgccgccaaaaaagttgttgcccgggtgggaac

SEQ ID NO: 701 - DNA, 1668 bp, Heterodera glycines
  misc_feature (817)..(818): n is a, c, g, or t
  misc_feature (942)..(942): n is a, c, g, or t
ttgagtcggtccaagtccaagaaaatgtgtcgagattgctcaagtgttggtttgccaccgcaaatgcgacacttcggttcgaccaaatcgacaccatccaacaaatggccacaccctaaaccattgcagattttaaaataaaaataaaaaagcacgatggaccgtcgcattggtcgccccgtgcgtcggcgaactgacaatggggacaaatgccattgacaaaacggtcggcaagaaaccttttgggtttattttttgttatttaaggaacaatgttcgttgtttttttgttctacttgttgcaattcgcacaatgcaattgcatttgcgcgtcaattgaagtgaatccgttagcaaacaatttgttgaaaatgtcctgcgcaattctaaaccattaatttaaacaccttgtcgctaattaaaccactcaattaattaattactctgtctgatttgggttcgatgtccgtccgaaaaagtcaaaatcaatggaaaaccaatcgtacgttttcttgtgcaactcgtaaaatttgtcacaaagttgtcgcggtgtaagtccctctgaaaaggaagaaaatgaaacattctgaggacgactgcaaaaaaagacccgaaagtgccttcatttccgtggccgtcccatattcgtcggtgccgcaaatgaaaagactttggtactctctcatgcgacagtaactgaaaatgaaagttatacagggaaaagtgccacaaaataagggaaaaatatcgaaagcaaattaaaaataagaattgttgggacgaccgtggaaaaaaacgtcagcacacttacacggannccaaatgatattccccaaatgcggcacattattaacgtaaggcaacgcggaggcaatcaaaaccatttcttcgtccgtccaaaggaagtctgaaatgggtgagtaaatcttgcaaaaaaaattnatgtcatataaaatgaactgaattcacacaaaaatgaaaaacaaccatcaaaatggggaagttcaatttcccaggaattaaatttttctcattaggttctgatatttttatcatgaaatttctaaaaaaacaaatttttaaaaattggcatgaattgtgtggccctggtcactgtcagtcggacttgcgtctgtcaatggcaaagactgtcggctgtctctctctgttgcttcggttggtctccgtttccctctgctctctctcccaacgttccatcagttctttctccaattctctcagtgttttccccgccgcaatctgtcgcacttcgtcctgatcctcctccgccaactttcgaagttccgtttcctccgccatttgtcgttcgaactgtgcccaatttgaccaattctcttccaacaacggcagcatcggtttccgtgcaaaaatcagctgaatttccctcgcattgctttcaccgttcggatttccttttttgtcgattttttcgtagaccacctgtaacaatttgtcagaatccgacccaattcccgcggtccgttcgtccttcacttgaatgtccacgaatccgaccctctccaaacattcgatgtatcgcatcggattgaagtcgtcctcttgcaaaatgccatattcgctcaatttgcgcagtctttccaattccaaggcgcagacgagcgaacgcaacggtcgaagaacacggaa

SEQ ID NO: 702 - DNA, 1271 bp, Heterodera glycines
tttacagaatttctagaataacttttttcatatttatgctacaaaagccaaataaaacccataaaattctcctgatttttctctatttttagagctttatttaatcaaaattggtcaaaccttaggccagatatgaattttcaaatattaacccaaaatcccaagggtcaaaaaattgaaaaatattttcgaatttttaaaaaattctaaaatttccaaaactgaaaacaaacatcagattcgtgctcagcacctcaaaatagcccagaaaaatatttttcacaccctttttcgaccccaaaaaaatttttgaaaatttctagggggcctagctcgaaaatttttgaaaatttccgaacagattgtataccattagatagagtttaaaaagttctacaattttgctctaagacaatttttcgctaaaatcaacccctgacgagttatgggcccaggactcaaatgtcccgctgaggccaaaaattttttctatttctggaaaaaaatcgaaaattttccaaaaaaattaccaatcgatagagctcgaaaaactatgttttggaagtggtcttcgtttttctgggaaaattcgttaaaaaatcctaaaattcaaaaacccgaaaaccgttttttaggcctagctcgaaaaattttcaaaattttcgaaattttaaaatttggaaaaatcgagctttctaagctctacaatagtgccgctggcacccctgcgctcaggtcaaagcctaatgagttattcaacggggactgaactggacaaatttggtactgaaaagttctagaagcacccagcccagggggttagagatagaggcctggaattttttttaatttttagccaacatttcaacttagggccctcacagcgggaattttttgatccgagttttagaaaaaaagttacgggccctaaactgcaagaaaaagtgagaaatcggtccccgggactcagttgggcgtcgagaatttttttctatagttttcccggattctcctcaaaaagttgtaagacccttccactactttcagggcgctcccggccttcggccgggagattttgttttttgaaacgaaactccttgtcaatataacgtatatactagcgggtgcgtgaaccgtcggctatttagctgggaaaaagcgcttcgcgctttcggagcttcgctacctagactgtgaagcgattcaaattgatcgaattggttggagatttttttttgaatttttaaaaaattattatgggtttttagtcc

SEQ ID NO: 703 - DNA, 5091 bp, Heterodera glycines
  misc_feature (37)..(37): n is a, c, g, or t
atgagaagaggtacaactgtgataggaggaggtacancagtgattagaagaggtacaacagtgattagaagaggtccaacagtgattagatgagtccagcagtgattagaagaggtgcaacagtgatgagaagaggtacaactgtgattagaagaggtacaacagtgattagaagaggtccaacagtgattagatgagtccagcagtgattagaagaggtacaacagtgattagaagaggtacaacagtaattagaagaggtacaactgtgattagaagaggtacaacagtgattagaagaggtacaactgtggttagaagaggtacaactgtgattagaagaggtacaacagtgattagaagaggtgtaacagtgattagaagaggtacaacagtaattagaagaggtacaactgtgattagaagaggtacaccagtgattagaagaggtacaactgtgattagaagaggtacaccagtgattagaagaggtacaagtgattaaaatttgaacaaaagtgattagaagaggtacaatcatggtttaaaatgaaataaataagaaaattgtattattggatgtattataaatttatcaaattaaaaaaatccttttacttattaaaaataaagttagaaatttataatatattgtagaatatttattgaaattgaaaggaattaatttctcgaaaattcaaattaaataaaacatttattcatcagaaataatttaaaataattaataaaacaatattaaattaaataaaaaattaaataatttaaattaaaacatttgttcaccaaaataatttaatttaaattaaaatttaaattaaaaatttttatttattattaataatacaaaacaaattaattaaaaaatgtaaaagtaagcaaaaaatgcacagaaaaaaatggtttatgaaaaaatataattaaaaaaatgtattaataatttttaaaaaattattaaaaaatgctttcttttattaattaaaaataaactttaaatttacaatgattgagtattattgtattgaaaataaatttttgacaaattataattaaaaaaacaaataaattctttaatttaaaaataaaaaataattaattttaaattaatacatttatttaccaaaattatttacttcaaattaaaaatttttatttattattaataaaagaaatctattttttattaataaaaacattgaaaataatgaaaaaatgcacagaaaaataatgttacaccgcccggattcgaacttccccccccccccctcaaaatgatgcctcagaatccccaatcacacagggattctgaggtcttaacgatgtcaaaagtaaaatgtgatcacgtattcgtgatcagcgtcataaactacccctaaagacatgtttttggaagatttttgtcgaaaaaattttttcactcaaaaatcctggtcacccccctgtggtcccgaacaccaaaatcacttttatttttataacaattcgcaaaaaagagataaaaatgtaaaataaaatttatattatagagaaaataattgcggatttttgtagtatattacttttacagaatgacttttcagaagggagttatgaatttttttctgaaaaatcgaaaattttcagaaattctggaataactttttttctttttaagatagaaatcccaaataaatctcataaaattctcccgattttttgctatttttaaagctttattgtatgaaaaattaccctctctgaggtgagttatgaattttccaatattcgcccaaaatcccgagggccaaaaaattgaaaaatatttttgaatttttaaaaaattctaaaatttcctaaactgaaaatgatcatcagattcgtgctcagcaccttaaaaatacccagaaaaaaattttcaccctctttttcaacccaaaaaaaaattccgaaaatttctagggggcctagctcgaaaatttttgaaaatttcccgccatatggcacaccattcgatagagcttcaaaagctctacaattttgccctaaggcgttttttcgataaaaccaacccctaacgagttatggacccgggactcaaatgtcccgctcaggccaaaaattttttctatttccgggaaaaaatcgaaattttttcaaaaatatcaccaatcgatagagctcgaaaaacggttgcttgaaagtggtctccgtttttctgggaaaattcgttaaaaattcctaaaattcaaaaacctgaaaaccgttttttaggcctagctcgaaaaattttgaaaattttcgaaattttaaaaactggaaaaatccagctcattgaactctacaataagtctgctggcaccccctcgctcagttcaaaccctggcgagttattcgcctgggactgaagtggacaaagttggtactgaatttctccatttttctgcagcccttcctattataggtagaggcctggaattttttttgttttttagaaaacacttcaacttagccccctcacagcgaacattttttgattcgagttttagaaaaaaagttatgggccatcaaacgcaagaaaaagtgagaaatcggtcgccgggactcagtcgtccgcgctgaatttttttctatagttttcccagatgcgcctcaaaaagttgtaagacccttccactactttcagggcgctcccggccttcggccgggagattttgtttttgcaaacgaaactccttgtcaatataacgtatatagtaactagcgggtgcgtgaaccgtcggctatttagctgggaaaaagcgcttcgcgctttgggagcttcgctacctagataagctatggttgtggagattttgaatttttaaaaaattatctgggacttttaggccgcttcgcggcctcgaacgggcgcttcgcgcccgtttttttaattttgttgggcttatacgggcgcttcgcgcccgtttctaaatttgttgggctattaaggcagcttagagacctcagacgggcgcttcgcgcccgtttataaatttgttgggctattaaggccgcttcgcggcctcagacgggcgctttgcgccggtttttcaatttttgttggccttgaacgggcgcttcgcgcccgttttttaaatccgttgaactcatacgggcgcttcgcgcccgttttttagcttgttaggccgcttcgcggcctcagtcgggcgctttgcgccggtttttcaatttttgttggccttgaacgggcgcttcgcgcccgttttttaaattcgttgaactcatacgggcgtttcgcgcccgttttttaaattttgaggtacaacagcgattagaagagtgattagaagaggtacaacagcgattagaagaggtacaacagtgattagaagaggtacaacagtgattagaagaggtacaacagtcatagaagaggtacaaaattgttagaagaggtacaaaagtgattagaagaggtacaacagtgattagaagaggtacaacagtgattagaagaggtacaacagtcatagaagaggtacaaaattgttagaagaggtacaaaagtgattagaagaggtacaacagtgattagaagaggtacaactgtgattagaagaggtacaactgtgattagaagaggtacaacagtgattagaagaggtacaaaagtgattagaagaggtacaaaattgttatcagaggtacaaaagtgattagaagaggtacaaaattgttagaagaggtacaaaagtgattagaagaggtacaacagtgattagaagaggtacaactgtgattagaagaggtacaactgtgattagaagaggtacaacagtgattagaagaggtacaaaagtgattagaagaggtacaacagtgatcagaagaggtgcaaactgtgattagaagaggaacaattttcaatagacgtaaaagttgagtaaatcaataacgcacaccatctcaaacatgagaatgtaataaacagatggcatataaaaaaatacaaattatggacaataaaattaattaatttgaaacaaaaaatttattcatcaaaaataatttaatttaaatttaaaattatttattaatttttaataaaacaaaaaggttcaaattaagtaaaagcattgaaaatgacgaaaaaaataaataatgaaaagtttttataaaaatttaattcaaataaaaaaatgtaatttattattaataaaataaaaaatattttaaatgaataaaacaacgaaaacacgaaaaaaatggtagttattaattaaaaacaacgttggaaattattaattgaatatttatttaatttgaaattaaattttttacaaattcaaaaaaaaataatgaaattctttaatttaaaaaaaataaatttaaataatttaaaagaaatcttctaattaattaaaaacagtcaaaataacccaaaaatgcacagaaaaataatgttacaccgtccggattcgaactttgcacccccccccccaaaaatgatgtctcagaatctccaatcacacagggattctgaggtcttgactatgtcaaaagtaaaaactgattacgtattcatgatcagcggcccaaataacccctaaattcttaaaaaagtgataaaaatgccaaataaaatttatataatagagcaaaaaactgcggatttttgtagtattttatttttccagaatatcttttcagaaccgagttatgaatttttttctgaaaattcgaatttttccagaaattctggaataacttttttccttttttagatagaaattccaaataaagtccataaaattctcctgatttttctctatttttaaggcttaattcctgtaaaattgatcaacccttcgatttgttatgaattttcaaatattaggccaaaatcccgagggccaaaaaattgccaaaaaataaagaatttttaaaatattccaaaaaatctgaaacttaaaataaacatcatatttgtgctcaggaccctaatttaccccagaaaatatttttcaccctctttttcacccaaaaaaaatttttgaaatttctagggggctagctcgaaatttttgaaaattt

SEQ ID NO: 704 - DNA, 3548 bp, Heterodera glycines
  misc_feature (27)..(27): n is a, c, g, or t
  misc_feature (3538)..(3538): n is a, c, g, or t
ccccccccagaagatgactcagaatcncccaatcacacaggattttctgaggtgttgactatgtcaaaagtaaaatctgatcacgtattcgtgatcagcggcccaaataacccctaaagacatattttttgaagattttgggtggaaaaatttttccactcaaaaatcctggtcacccccctttggtcccgaatcccaaaatcacttttatttttgtatctttttttaaaaatgtgataaaaatgtaaaataaaatttatattataaagaaaaaaattgcggatttttgtagtattttaattttcaaaaatttcttttcagaagggggttatgaatttttatctgaaaaatcgaaaattttcagaaattctggaataacttgttttctttttaagatagaaattccaaataaagtccataaaattctcctgatttttctctatttttaaggctttattcctgtaaaattgatcaacccttcgatttgttatgaattttcaaatattaggccaaaatcccaagggccaaaaaattgccaaaaaataaagaatttttaaaatattccaaaaaatctgaaacttaaaataaacatcatatttgtgctcaggaccctaatttaccccagaaaaatatttttcaccctctttttcaacccaaaaaaaatttttgaaaatttctagggggcctagctcgaaaatttttgaaaatttccctacatatagtataccattagatagagcttaaaaagctctacaattttgccctaaggagttttttcgataaaaccaacccctaacgagttatggacccgggactcaaatgtcccgctgaggccaaaaattttttctatttccggaaaaaaatcgaaatttttccgaaaaaaataccagtcgatagagcttgaaaaactatgttttggaagtggtctccgtttctctgggaaaaatcgttaaaaaatcctaaaattcaaaaacccgaaaaccgttttttaggcctaactcgaaaaattttgaaaattttcgaaatttttaaatttcaaaaaatcgagctttcaaagctctacaataagttcgctggccaccccccgctcagatcaaaccctggcgcggtattcacctggtactgaagtgtactttttgagcacgcttcagttgccattttttgcaggccaggggtttgctcaaaaaaaattttaaaaaataccagcatttagaggacactttggcggagtgccctcacagcgggcactttttgattcgagttttacaaaaaaagttaggggccttcaaatgcaaacaaaagtgagaattcagtccctggtactcagttggctctcgaaccggaaaacctatatttttcccggatgctcctcaaaaagttgtaagacccttccaccactttcagggcgctcccggccttcggccgggagaaaatggttttagcaacgaaactccttgtcaatataacatatatactagcgggtgtgtgcttacatgtttctttagtgcttaaagcgcttcgcgctttgggagcttcgctacctaggccttgtgttagggtctttgcgtcagccgacatgcacttggtttcactcacgtgatgagctgacacattgcatttatcagtgcaatggaaaccggaagtgccctaactcgcacgtcatccctcctccctcccttagtccaggtggcagcactttttgtatgtgtatccgtttaaagtgcagatgagaacggggcgacatcagtaaagtgccacacacgctggactataactcgtttgctttattgcaatttgagcatgtttttggccacaatgttcaacactttggtttgaccttgtgcatcggtctcccttctgggagcgtacactcggacgttgttaccgtccgttgcccttgaaaaggcagtgtataattgaccatgggaaaatacatccctttcaaggtcaattccgaccgtgttgattgtttggccttgacctttgagaatggtcatggcgaatgcaggttttatggggaactgcaaacgctcatattttaagccgccaggcgttttgtcttcatacacattacgtgttctttcaatgaagaacttaacttggccaccaacagcgttgctgttgattactcgaccgaccaggcgatcgtcaccaagttcttcaagaacgatgcgcgtgccgttgatcagtccttctttatcacttttgttgataaggagaacaacgacgcttccgactttgagtcgcagacggtggggaggcatcccagagtctgtgcgccggttcaacgctgccacttcggactcgatttcatcgatgtccagtggacgctcgtcaagcggcttatccgaggacaaatattcgcgcacttgaccaggcacattcgccatcatgatttcgttgatctcatcacacgtgtcaatgtgaggtgcgaggatcagacgattgagcagctccttgtcattgccaaggagtttttggaagtcgggatagacaaagtctatcaactcttccctgctctttaccaggaactgcggaggaatccagaagtgttctccggtctctccgagcccaatttgacgacacatttgtaagtatgcttgttgcccttgacccaacctctggttgatagtcaatttcattgtggtgaattcaccaaacaatggggatgtttgaaagcaagctgttacttgcgcagtcaggccctcgtgaggaacgaccggcagcgactgtttaaagtcaccgctgactatgaccgtttttcctccgaaggggaggttcttgtactgtgagattgccatctctttgcacacgcggttaatgacctcaatcaccgtattgtgcagcatggtgatctcatcaattatgatgagctgagcctcacgtatccgtcgagcaaagaagctctcaagcggaatgctgggaagcttgtccaatgagacatctctaccgagacggaacgtggaatgggccgttttcccatatggcagcaaaatagctgcacaccctgtggatgccgtagcaagcactttgtaggtgtatgggggcttgcgcaagcgccttatgatttggccaaacaggaatgtttttcctgtacctccatcgccgaaaatgaagaaacggcgcggcacagtctgatctcttggatcagacttaattgccttaacaacagcatcaaagaccgtttgttggtcgctgttgagtggaggtggagcgttttgctgctgcctaggattttgctggccaggcgacatattcagatcatcatcaccaaagaaagcttcttcaactgccaaattgatatttttggcttttgaatttggtggatctgggaggccacagtgcacgcagcttgagttaaagaagtgcaatcgccaatcaatgtcggctagcgcttcctgctcccgtgcttggcgtatagcgcactggtgtgccctgtggatgtacatttggtcttgtacttgttcacagttctagggcattgctcggctgcccaaagacgaggatgctcacgaagagccatctcatctggtccggncagcgatgca

SEQ ID NO: 705 - DNA, 4494 bp, Heterodera glycines
  misc_feature (36)..(36): n is a, c, g, or t
  misc_feature (4352)..(4352): n is a, c, g, or t
  misc_feature (4380)..(4381): n is a, c, g, or t
  misc_feature (4415)..(4416): n is a, c, g, or t
  misc_feature (4424)..(4424): n is a, c, g, or t
ttgcacactcggtcgatgacctctatcaccgtgtgntgcagcatggtgatctcatcaatgatgatgagttgggcctcacgtatcgtcggggcaaagaagctttcaagcggaatgcttggaagcttgtctagcgagacttctctgcctagacggaacgtggaatgggctgttttcccatatggcagcaagatagccgcacacccagtggatgccgtagcaagcactttgtaggtgtatgggaccttccgcaatcgccttataatttggccaaacagaaatgttttcccggtccctccgtcgccgaatataaagaaacggcgaggtacagtcgcatcccttgggtccgactgaattgccttaacaacagcatcaaagaccgtttgttggtcgctgttgagtggaagtggagcgttttgctgctgcctaggattttgctggccaggcgacatattcagatcatcatcaccaaagaaagcttcttcaactgccaaattgatatttttggcttttgaatttggtggatctgggaggccacagtgcacgcagcttgagttaaagaagtgcaatcgccaatcaatgtcggctagcgcttcctgctcccgtgcttggcgtatagccgcactggtgatgccctgtggattgtacatttggtctttgtacttgttccacagttctagggcattgctcggctgcccaaagacgaggatgctcacgaagagccatctcatctggtccggccagcgatgcaaggctgcctcgccgagcgttttgtgccaaatttggtcatcttcaagaagcccatgctgtaaagcggcctctgtgaaggtgttgtactgctgcccattgaccagttttaagtggtccggatcaccgggaaagtgacgcattaacgcatagagcgcaaatctttcccggtccgttggagggacaggtacaacacgaccgattgggggccttttgctaggcttctttttatataagacccatcggtcctttgcccagcgaaattgctctgggactttttcaaaaagcatgtccttaagcgaaggaacatgctgccattcattttgccattgcttccaataggcagagcatggcgtctctgggagttcgcctcgctgaatttcctcagctttgctcaccagttggaatgccctgtatacaacgggctgctggtttggcaaatgaattgacaaatgaacaacgtgatgcgagagttttgcaaatggcattgaatgcacaactgcaaaagcttccgtagcaccacggaagttcattttggcatattgagccggctcatcgataccgattttgctgccggactcctctttgcactcgacataacaatgtcctggccctttgaaagggtatttgagtgcatatttgatgttcgctttgttaccgtatgcgaataacacgttgtggtgtactcggtaacgcagcaaaatgtatgggttgtacggcacgacttgcgagttgtcgtatattaagccgttcacctcaatttgggcaccaccgtcggttgggctaggccggtaatacaatgcgggcctgtccgggtgtagtatcgtacatttcgagtacggggctgggaagccctttttacaccgcccaaagttggggtcacgtggaccacaccaactatcgctgcatctgtgcagttgcatatgcattagttcgcggacttcgcgatgcatttgcgctatgggtgagtcatcgtctttgcacggcaaagatggaatatgagcccatatgtattcctggatgacttctggaactgcgtccaggtcagtctgggctacaatgtgtgcgtgtgggccaccacgcccctggaactccatggactctcctgagccaaggatagtcccaaagaaacccttctcgtagagctcttggtggaagacagcaattttgccgcaccacactcgcatccacatgtcaaaacggtcagtgaacatttgaccatttttgtaaatgttttgcttgaactctggccactcacggttgttcgtgaatgtgatgaagagccgcgccttttttgcgtcgtggcaacgagcaaaaatggtgttgcagtcttcatacctttttttccaatactgaagagaattaatattcttttcagaaaggcgaacaacactaccaatgtcatcgacagtcttttgtcgtgcattggggttttgccgagcttgctgcttattgtattggtttaccaaataatgcaacaaattttttggagtacttatgcgcaggtccatgtctggacggcgcaaaaaactggcaatttgccaatcaattttggccgcttggtctaagacccagcgctggccaagaccaccgccacatgacagaatgtggtgatattgccactccaaattttcatcccttattgcgagatggtacttgcagtaatctcgcagagaaatgaattttctcgtcttatcaatgcgatcaatcaatgattcggtcgattcgaccgactcagcatctgatgcagcaattgactcagtctcgcatgagccatcgtcggacattgcatcagtgtcaaacatttgatcgacacattgatcgcttctccgctttttttgtgcgggtttggcatatggaataccaatttgatatccatcatcgcccttaggcttaattaatggataagtcaagctatcagtccatggactgaacggggctatttcgtttaactgcccttgcttgttttcgacccatatcccttttggtgccggggcacctgtgggatccgcgtgtattgcgaacataccttcacccgttgagggggtgattatctggtggggatgcaatttagggtctttcataccacccggagcagagcgctcattcaacaaagtcattctgaagaaccgcagctcttcagtcctttgttgtcttaacaactcttgtagctgctcacgagcctgcttgtaagcagatgcagccgggtgattttcttggatcatttgttccaaaatttcaagggtctcttcattaagctgatgaccctgcacaaactcttcctcgtttgtgattttctctcccgtaaaggtgggattttttcgtcgctgctccatggcttcaactggatccagaatgtacaactgaccgaagccaggtatctgtgttgtacccgcctgcatgctgctaatgcggcgatggaattctccgttgagaattactgccatcggtccgcctgcaggacttggcttatggccagccgaaacacttgcaaattggagcaaattattgtaccgcgacatttgtcgtacaaattcttttcctttacgggattgtttttcctccacaattagctcttcaagctcttttgggtgagggttgagctttggcaaaacaacccttccctgacgacagcaaatgctgctgtcctcgtgtgggaaatgtaatgctccacagtgagaacacttcttgtcaccaagcttaccagaatctgagtattctggataatgctttgccgctgctgcagcacagcaccaacccttgtggacaaggtagcaacgccgcgtaaatgctgtgacttgctcagcggcatttgtcgatgaccgacgtctcggcgcgggtgaaggagaacggctaatcgaagctgattgccgtctcccaatgcgcgatgaacgccttggaggcgtctttggtctgacaaatattgaatcgtcagtctgcgcaattggctcttgcgggacgcaagtttccgacaccaatccaagcgtgtcagcttggttttcacctgccacttgggcttgtgttggaatggcaacaactgcttgtccactcgtctgtggttcgatgatcattatatcatcatgatcatcaacttcaactggctcagcggccttggatgtcgatggagcctcatccgcatgtcgatagacaattgggcacggagtaggtaccccttcccttggatgatatggaacattatcagagttatacagctcgttaatgtgccacaatatgcgccgcttttcataattgatggacaaatctggcagaacaaacgtgcgattgttcatgagccatgattcagcatataggcacacgaagtacccgcagctgttaccatcgtgttgtaccgtaagatttacggcattaaaaatcccggtcaacactgttgacggcaaaatgtcagaaatgatctttccaattttttccgtcagttgccaatccaacctgccataaggggtaggcaaagaatcggcaaaatgtgtaccgcactgaacatcatggataattagagtccaatgtccagggaaatgtactggcaaaagaatgacttctgcctgaacatttgggtcataccccaaatgtcatatttttatattgcatgacancgtccaagccattttcccataccattgnngtcacacgaccacttttcgttgtgatatgcttgnncagtatgncaaatatgtggcagcaaagccgtcattgagaaactgggtcagatcattccagcacgttttcatgaatctt

SEQ ID NO: 706 - DNA, 5348 bp, Heterodera glycines
  misc_feature (647)..(647): n is a, c, g, or t
  misc_feature (5245)..(5245): n is a, c, g, or t
  misc_feature (5264)..(5264): n is a, c, g, or t
  misc_feature (5285)..(5285): n is a, c, g, or t
  misc_feature (5294)..(5294): n is a, c, g, or t
atttcttggaaattttcatttattttttgatacttttcgtcgatcaattttcccattcgctcgctccttttttatgactcagctctttttctcttcatttttcactatgagtcaccatttttaatggatttttgtccatctgtttgtgcacatttttcacgtgcctggccccgcccccatcgattgtgagggtataaaagcacgccccattctccattttcttcactgatcactttttgattaagtcagtcgggacagttttctgtccaagcatttgcattaaattgtaattgtgcaattgaattgaataaagattaagaaagagtcttagtcttttctctatctgtaaaagggacgctcaggagccctttcatacagatcattaagccattgacccccgttgggtcaaagaaaaggcttacaaaaggaaaggagaagcattttcctcctttcaaattgtcccttcagtaaaggagaggaatttcctcctttaatttatccctttggactctgtgagtttctgtcttttggacagaaattcgctttgcttaaaagactccccccttctgccgggagagtctgcttccccttctgccgggaagtgcaaatttttgtggccctttgcccacaaaattgagcccccgtanggggtcggcttccagttgtaagcctaccctccaacccttaagccaaaagcaaatccaaagcgcagccgtagcgcttggatcaaacgcaacccaaaggggtatattgcgttttcctcaaacgtaagagcaatgagtgagctcctacgtatttccattgcaccaatggtggtgcgtctcaaaatgtatattgagacagcccaagaaaacttgggcaaagagctgacggaccaaagtgtccgtgcagacttaattgcagagagacaaaatctctgcaaaaccatttctcttttggagaaatacaatggaaaatgggaagccattttcttgagaataaagggaccagctcttcaggaggaagagcaaaactatagggactttaagccagaaggcaaagccttcatgcattgggtcgaccaagcccgagggcttgtcgacaccattgaaggggccttaggcctctcagagctgggggatgcaattccccagccaaaccagccagcacaagttgtgcagcagcaacaacttgtgcatcagcgtcatgatgtgacgcttccgccaataacattgcccaagttctcgggggaaccccgagagtggcctttgttttggaagctctttgagacttccgttgaaagtcttcagattgaagactttaaaaagcatatttatttgctgggatgcctcccagagaagtcaattgctcggagagcaattgacttgtatccaccatcagatgaaaattatccaagggtagttgaaattctgaaaaagcggtttggggatgaaaaaacgatggtggagtccctccaagcggagttactccaccttcccaaaccagcagaatccgttcagtctctgagacaattctcagagtccattgaacggatttgccatcagttgttggactatggagaaaatgaacaaaataagttcatggcctccactattaagtccaaactgccttatcaccttctcacccaagtggtggagagggaaatgagggcaggaggtgcctttaattgcacagagctccgaagagctatcacttcaatcgttgaagtgaaagaagaagtacagagatgtactcaggtttttcgaggtgaggaaaaaccccggaattttcccccacattcaaatgggggaagagctaaccaagggagaggaacaccgttccgtttctcccagccgttccggcaagaacggcagtggaggccaatggaacgaaacgaaccggtgaggaggatgtctcctcaaccgaatcgttccttctcggccattaacaaatctcaaacccctatttcagatagggggtcaaatcgcttatgctctctttgtgaagcaaaggggcatgcaccgagtcggtgcacgaaatacaccactccgggggctcgaaggaagcgccttacggaccaagaccggtgtataaactgtcttattacgggacataattcccaaaattgtacgtccttaagtaggtgcggtaaatgtggggaaagacaccactttatggtgtgttacggggaaaggtctcgagagggaacctctcggggcccatcaaataatcagataaaaaaagaggtgacaaaatcctctcatagtcatttgactatgtgtgagcaaacacatgaaaatgtgccggattcagaagtttttccagatatggaaggcttatccatcactactaatgtgatggcaagcgtagtggcgaaaaagcctcacgcatatctaatgaccagaaaaatactggtcagaaccaaaaacaatagaagagtttggatgaaagttccatttctctttgacccagcgagtcaagctacctatatttccgaccctctcatcgagaagcttaagccacccaaagtatcttctgaagaattggaagtttatggctttggtggagagagaactggaccaataaggttccattctcccgtatactccatccaaatcaaaaggacggatggaaagtgggaagatatccttctcaataggacggaaagaatttccacaccatttaaaatggcagagtggaattctgaagaattcccattggtaggcaaggacgcggcacacgctttgagcttttctcgggaagagcccgaaatacttataggtgccagacatttctggcaattcttccaagcgaaggaagaagtttctcccgggttatttgtaattcaaacaaccttgggccctttggtaaacggagagtccgactttgggccggaaattccgaacccggaactatcaatgatggtcattgatgagtccaatcaagggcaaatgcctaccgttaaagaaattgaatatttctttaatttggagtctttgggaatcaaagacgatccaaatgaaaatgatgaccaaacagcaatgggtctatttaacaagtccatccgtcgagaaaaagacggaaggtactctgttaagtggccatggaaggaggaggtgcctgacctcccttccaattaccgcatggccttttcaaagctaatgtctacttttggtaagcttcgtaattctccagacttaatggagcaatacgatgctaccattagagaccaattgcaaaaggggataatcgaagaggccaggaaagcccctggcactcttgagcattatatccctcatcagggagtccttgccaaaggcaagaaattgcgcgtcgtttacgacgccagtgctcacaccagaggaacaaacagtctcaatgcctgtttgtatagaggcccggtaatactgccggacctggtcggaatgcttatgcgtttccgatgcccaaaattccctctcctctccgacatccaagctgcatttttgcaaattgctttggaaccggaggacagggaagtcaccaaattcctctgggtgaaggacgccagtaaaccactggcaccaacaaatttgagcacttacagattttgtcgtgtggcattcggagtgatcagttcccccttcattttggctgcgactttgcagcaccatttgaaggggtatgaatctccagtggccaaagaattggcccaatccttatatgtggataacacactccttgagtgtgaatccgcagaagaggctttgcataaatatgcagagtccaaagcaatccttaaagaaggattttttaatttaagggaatttgttacaaattccccggaggtaatgaaggcgattcctgaggaggatcgcctgaacaagcctaaggtaaaagtcctagggctcatttgggacacagacaaagacgaaattgtctttgagttcccaactaatggcttagaaaaggtggcaacacgccgtcttgttctaagcttccttgcctcattatttgaccctctcggtctaatggggccgtgcattcagcccctgaagcttttcttccaaactctttgggaagaaaagaagggctgggatgatgttctttctgagaaagaacaaactcaatgggaatccttccaagaaaattggaaggatcagaccattagaatcccacggagatcaatgctacaagggaacccatcccttcaattacatgcttttgtggatgcttcgatccacacatttgcagccgcaatttatctaagagcggcagaaggtaaccaaatttcagtttggcttattttctccaaaaatagactcaagcctaaaaatgcctcaaaagcattaacaattcctagaatggaactcatggccattctaatagggataaggggtcttaaatttatcgccgatcaaattcggcgaccaatttctaatctccatctttggggcgattcacaaatcgctctaaattgggttgcttcaaaagaagcacaaccgaaattcattgagagacgagttaaggaaattcgtactctcaatgaatgtgcctttcactttgtccgaacagccgagaatccggcggatatagcaacccgaggcgcaaaaccaggagagcttagggataagtctctctggtggaatgggccttcctggcttaaagaaggccataaccaatggcctaaagaaatagaatttaaaataaaagatcctccagaaaatctggaggaagtgtctctggataacgaagagaaagttttcttcgttaataccagaacaaaggaactgattgagagtcctctgattgaccccaaaagattcagctcttggacaaaaattgtccaagtgacactctatgtcttaaggtttctccgtctgaaacttattcagaggggaaatcctcatcagcttttcgagagtcatagaaaagaaatcgtgaaagtgtccgaaaagggaccattttcagcagaagatgttcacctagcagagaaccttctgatccgcatagaccaaataaaaaatgctgaagatttcctcagctatccttctcttaaggatagtgaagggattttgaggctaaaaaccaggttgggacggtgtgaccaaccttttggttttagccatccaattattctcggaggacaatcctccatccgagacttaattatcttaaaatgccaccagaaaaggcatcattttgtggggtggaaggcaccctcactgagttcttactcggggtattggacacctcgagcaagaactaaggtcaaaaaagcactganaggatgccttcggtgcaanaggatgcaggcataccagttngcattgccnaaaatgcctcctttacctgacgagcgagtatgccgtcaggctcctttcaaaaca

SEQ ID NO: 707 - DNA, 7684 bp, Heterodera glycines
  misc_feature (7650)..(7650): n is a, c, g, or t
cagaggaacaaacagtctcaatgcctgttgtatagaggcccggtaatactgccggacctggtcggaatgcttatgcgtttccgatgcccaaaattccctctcctctctgacatccaagcagcatttttgcaaattgctttggaaccggaggatagggaagtcaccaaattcctctgggtgaaggatgtcagtaaaccactgacaccagcaaatctgatcacttaccgattttgccgagtggcattcggagtgatcagttcccccttcattttggctgcgactttgcagcaccatttgaaggggtatgaatctccagtggccaaagaattggcccaatccttatatgtggataacacactccttgagtgtgaatccgcagaagaggctttgcataaatatgcagagtccaaagcaatccttaaagaaggattttttaatttaagggaatttgttacaaattccccggaggtaatgaaggcgattcctgaggaggatcgcctgaacaagcctaaggtaaaagtcctagggctcatttgggacacagacaaagacgaaattgtctttgagttcccaactaatggcttagaaaaggtggcaacacgccgtcttgttctaagcttccttgcctcattatttgaccctctcggtctaatggggccgtgcattcagcccctgaagcttttcttccaaactctttgggaagaaaagaagggctgggatgatgttctttctgagaaagaacaaactcaatgggaatccttccaagaaaattggaaggatcagaccattataatcccacggagatcaatgctacaagggaacccatcccttcaattacatgcttttgtggatgcttcgatccacacatttgcagccgcaatttatctaagagcggcagaaggtaaccaaatttcagtttggcttattttctccaaaaatagactcaagcctaaaaatacctcaaaagcattaacaattcctagaatggaactcatggccattctaatagggataaggggtcttaaatttatcgccgatcaaattcggcgaccaatttctaatctccatctttggggcgattcacaaatcgctctaaattgggttgcttcaaaagaagcacaaccgaaattcattgagagacgagttcaatggcctaaagaaatggaatttaaaataaaagatcctccagaaaatctggaggaagtgtctctggataacgaagagaaagttttcttcgttaataccagaacaaaggaactgattgagagtcctctgattgaccccaaaagattcagctcttggacaaaaattgtccaagtgacactctatgtcttaaggtttctccgtctgaaacttattcagaggggaaatcctcatcagcttttcgagagtcatagaaaagaaatcgtgaaagtgtccgaaaagggaccattttcagcagaagatgttcacctagcagagaaccttctgatccgcatagaccaaataaaaaatgctgaagatttcctcagctatccttctcttaaggatagtgaagggattttgaggctaaaaaccaggttgggacggtgtgaccaaccttttggttttagccatccaattattctcggaggacaatcctccatccgagacttaattatcttaaaatgccaccagaaaaggcatcattttggggtggaaggcaccctcactgagttcttactcgggtattggacacctcgagcaagaactaaggtcaaaaaagcactgaaaggatgccttcggtgcaaaaggatgcaggcataccagtttgcattgccaaaaatgcctcctttacctgacgagcgagtatgccgtcaggctcctttcaaaacaatcggcattgactttctcggtccaaccgaaacacggttggccggagagaaagtcaaggcatggatacttcttatgacttgcctcgtaacacgagcagttcatttggaggccatgcttgacacaactgccgagtcattcctcaatgttctccgacgtttcataagtcggagaggtaagcccgatttaatttggagtgacaatgccacttcatttaaattggctcaaaaaaccattgagcatttgaccactccaggagtggatcaaaacacgcaggaatttttcgcacttaataaaattaagtggcgattcattccacaaatcagcccgtgggcaggtggcgtttatgaacgccttgtccaattgtgcaaaaattgcttcaaaaggactttggggagaaaagtcctcagttatgatcaactcataacttttgtggctgaagttgaagccacattaaaccatcgccctattacttctgtgtcagaagggatggatgagttcctgccccttcgtccagtggacttccttcaaccggaagtccgaattcactgggacacgaatggtgaagaattcgatccatcggatcgaaatctttcatcccaccaaaaattagttgccctttttcaggcaactaaagaatcccatgaatttttctgggaaatgtggcaaaaagaatacctcctccttctgcgggagagaggtaaatgggaccacaagagtccccgtcttcaggacagaacagaaccaaaggagggaatgatcgtcctcattcatgaggagttcactccccgaaaccaatggtctttgggaaagatcattgagcttaatggccgaccaggggccattagaagcgttcagttggaactcccaattcatgggataaaatcaaagaggtatggaaccatgcctcggaaaatcattatcacccgtccggtgaataagattttcccattggaagtaggattagataatcctacagaaaatgaagaaaaatttgaagagagttcaaatggaactcctcaaataacaaatgagaaagaaatctctcatttggaagctccaatggatgaaaaggagactgaaactcttcaattggttgatcaaccaattgaccaaaaccggcatggcatgatcactcgcagcaaagcaaagatggggacagttttgaactgtctttccatcctttttgctatgtttgcgttggttggagcttatccaaccaatcattgcaatgaatgcaaacttctttgctttaacaaaggcgttaaagcaaagattccaaaagaaatcaacaaagttgagctctgctgtgcagagaactgttacattcatgcgaatgtaaagaagctcacttacgagctgcccaaggagatcctcctaaatgacttcaaatgcgaaggtcatttctggatggattcgaaacacatgttcaaaaaagacattttatgtccagcagttgatgagtgtgaactcatcgaatgctatttttgcattgaacagttagcgaatccaacctgttatccattgatttcatcaatgttagcagggggactttgcttatcattcataagcataagctttgtggctttttccatattaaaagtcctgttttcaggactttatatggtcatttggctgataattcaatttatcaggccaataatttatttagctggcccaaatcggcctccgaaagataggaggccaagggcaacagcttctcaaaattggacatcacgccgtgtttacagaacaatggcgtttgttgtccttatggctaactctctccagaatttgactggagcagagaccatagcagtcatggccaaatcggaaaaatgcattaaaaatgcgacaagcatgagatgcattgttgaaaactcagcaatgctgacgttgctgccagttggccaaacaaacactcttcttctgaaaacagaggaaggtgttctccttggctcaattaacgttgtgctgaaggctttagctttggaatgccaaagcttcactaaagcctggcaacgttcatacgcaattaatgtgttggccggtaaaaggtgccctaagatgggctcctgtgaaggaaagtattgtagcgaggttcgccacaatacttccattcctgagctaaaagatgccaacgatttaccaggcaattcattttgcctggacagcacagccttttggggcaacaaatgcctcttaggcggtagtgcgtgccttttttatcgttggtatgctcaggaaaagtccaagacagtctatgaaatcatgggctgtaattcctgggaatttattgtttatacaataattcgcctggaaactttgggcgaaaaacccaagtccactcaggtgttcctttatccaggaagaaccctgaaatggaacaacatcagtattactccgatcggagtaacttttccgcccgctcccgtcttaaactcagattttgtttttgacgggagcaatatggctctgacccgagagccattggcaattgacttcaactgtaaaaatcggcaagaagcaattgatttcaattgcagtcttggagttcaggcatgcactgattgcatacctgaccattcatcaggtttagtgaactgcaattgccgttcacataaccttgaaaagttaatggaaagtccagagaggagacttccattaaacatcaaaaattaccaactcagaaatactgggagaaaagtaattgccttgacaggattcagtcctgtccaattaaaccttcaaatcgaaggtcttcaaatggctttggaacttcaccaaagcctttgcaccattttgccgttgaacatatctggctgttacagatgttcaacgggagcacaattccgttatgtgtgctcgactaattttggcaattctcttgccgaaattaaatgcgatgatggaacacatttttcgacaaaatgtgattccaacgcatcaatttaccagacaattttggcttttgataaagccagaattgacacaaaatgccaaacaaaatgtttggctggaaatacttcttttgttctaaaagggacattacactatgtccagcccgaacaaatagaagattacagtccaaatcactccgaaagagtgataaacagccaatccagttggccgaactggaattttgattggaaggcgaccctttggtctttgattggcatccaatcatcacttgccttcataatgattatttgtgtaggcattgtttgcctaacagttttcattaaactttctcctttctatagactttggaaattaatttcctggtctttaacgagaaagggttatggtaatgtgcctacagtattggcaatactgtacttggccgggggaggatccttcggatgtggtgttgaatcacgtcctatcccctcggcattcaaaaaattttgtgagtcacccctcgttcaggggaatgattcatctcttccattggatgatggtataaaagggtggcggatttgccacccaaccacactcttcaaatcatccttccacggaatgcctattcctattcgagaaggaccttatttctcggctcgccgggtggtcatacccgaaaatgccgaggtcttcaatgatcgcctttacggacttggcgatccacgatttgaagaggaggagagagttcctcgctggcaggaacctcctattcctcgccaaattgagtcattgagctcatggattgagcagtcttatggaccgcattggtatgaaacagcacgggagcgccgtgctgtcgaagtccgcctacgcggagaacttagcgaaggagccacgctacttggcgaacattttggcagaattgccgagatccattttgatggattcacctgttatggtccggagggtctcttcatctctccgggcataacacttttcgatcattttgtacggttgggtcttcaagtagacccagtaaaaccgtgcatacaagaatatgtagggtttagccctcgcgagcaagggatgcttgtcgacatttatccgatcgaactggtcaacatccgaaccagaatcggagttgcttggagagcgccagcagttttggaggaacctcaccctcctccacgtgaccaagcacagctaccagatggacgtttggagaatcgtcctcctagggtggctcgtcgacttccaaaccgacgatgaaaagaattttggcgaagagacggcaacagatgccgccatccttgaggcccggagtatgtcgccaaagcgacacaaatttctttgaaatttcttttatttttgatccttttcgtcgatcaattttctcccttcgctcgctcctttaattatgactcatcttttcttttctccatattttcgctatgagtcatcatttttgagggaattttttccctttgcttgtgcacatttcttcacgtgcctggccccgcccccatcgattgtgagggtataaaagcccggcccattctccattttcttcactctgatcactttttgattaagtcagtcgggacagttttctgtccaagcatttgcattaaattgtaattgtgcaattgaattgaataaagattaagaaagagtcttagtcttttctctatctgtaaaagggacgctcaggagccctttcatacagatcattaagccattgacccccgttgggtcaaagaaaaggcttacaaaaggaaaggagaagcattttcctcctttcaaattgtcccttcagtaaaggagaggaatttcctcctttaatttgtccctttggacattcagtgaatttctgtcttttggacagaaattcgctttgcttaaaagactccccccttctgccgggagagtctgcttccccttctgccgggaagtgcaaattttagtggccttttgcccacacgtgtcttggtgacgagcccgggtcttgaaaaggccgggtgtccaggtctggacccggtcgggtaggtgatgccgtctaacactaatttcttattcgaattttaatgttgacagttaatttgattccattaaataataataaaaaaaatttttttttaatctattgttaaaaaagtaaaggctattttctgctgaacactttctgatgaaagtgcgaattttaaatataattacagataaatactttagtttatttctaaatactcacgaatatatgattagtgcggaattccttgatccatcggcttaagctcattctgtcgatacccaatttttcggcaatttttctctcactcatcattggatttcgttctgccatttcttcacttcttttcactccgagtaaattttggacgttccttaaaataaaagaaaattaattttttttaacttaatttaataattaaaattattactagccatttttatttaattttctttgtcgtttccaaattgtttttttttaattcttctttcactttttcaaattgtttaattttttttccttttattataaacattttcttttcgcaattctatatattcattaaattaaatttatccaacatttccatttccatttcgtttattgtttcttcctcctaaataaatatagaatttataataattaaaaatcatacgttcgaattttattttaaaaattatttttctgttagctttattattcattaccatatttttataattataatttttttctacctcgtaaacggtcgaatgaattttttcgttagtgctcaatcatttttaacttttaattttcccataaagttttctgataaaatttctaagtttcttcgtgtagaaataaattaataatttttaattagacagaanagtatccaagctaattacaaagataaaagttcct

SEQ ID NO: 708 - DNA, 2453 bp, Heterodera glycines
aatgtgggatttttcgtcgctgctccatgctttcgactggatccagaatgtataactgaccgaatccaggaatctgggtcgtaccagcctgcatactgcttatgcggcgatggaattctccgttgagaattactgccatcggtccgcctgcagggcatggcttatttccagccgaaacactcgcaaactggagcaaattgttgtaacgcgacatattccgaacaaactccttcccttcgcggggttgtttgtcgcagacgatgagctcttcaagctcttttgggtgcgggttaagctttggcaaaacaacccttccctgtcgacaacaatggctgctgtcctcatgcggaaagagcagtgccccacaatgagcgcattttttttcgccaagtttaccagaatcggagtattccggaaaatgttttgctgctgcggcagcacagcaccaacccttgtgcacaagatgacaccgtttagtgaaccgtgtaacttgtccaggtacattttccgatgtgcgacgcttcggtgcaggtgaaggagaacggctaatcgaagcagactgccgtctacctatgcgcactgatcgccttgtaggcgtcttaggtctgacaaatattacatcgtcagcctgcgcaataggctcttgcggtgcgcaagactccgacaccaacccaagcgagtcaacttggttttcaccagccacttgggcttgggtgagaatggcattagcagcctgtccacttgtctgtggttcgatgatcattatgtcatcattgtcatcaacttccattgactcaacggccttggatgtcgactgcgcttcatccgcatgtcggtagacaattgggcaaggagttggcaccccttcccttggatgatatggcacattatcagagccatacagctcattgatgtgccacaaaatgcgctttttttcataattgatggataaatctggcagaacaaatgtgcggttgttcataagccatgattcagcatacaggcacacaaagtacccgcagctatttccatcgtgttgggccgtaagattttggacatcaacaatcccggtcaacattgtggacggcaaaatgtcagaaatgatctttataattttgtccgtcagttgcacatccaatctgccatatggggtaggcaaagagtcggcaaaatgagtaccacattgaacatcatggacaattagagtccaatgtccagggaaatgtactggcaaaagtatgacttctgccggaacattagcgtcatacccaaatgtcatatttttatattgaatgacacggtcaatgcccatttgccatacaactggatcaacaacgaccacttttcgttgtgatatacttgccaagtatgccaaatactcgacaacaaaggcatcatttagaaactgtgtcagatcattccaacaggtctcaatgaatcttgggccagagcgtgggccttgtgatgtttcgccatcacgctcgtaaaggccaacatcggcccatctccgaattttgcaggccatatttcgcgatgtggcgaaattaattggcactgtgctgaaatttatcttttcaggcacagttggcaaaacggccactgatgttgtagcttcagagctctggtccattgacgagctctcgctcatggagtcattagctttgctcctgcctgagcctgcatggccacctctttttttggctggtcgtcctccacgatttctttgcgtggtagtgggcgtcgaagcaattgcttcgttaactgccaaggctcggccaacatcagtgatcttcacttttttgctggccggcgaaaaatcggccttttgagaggacgattcaattggaatgtcaattgttgacacactattttgcgaagccgtgataggctccgctctggctttcgggggtctaccccttcttttacttccaatggaagaagccggcgtgctcaattgtagagcacttatgtttggggtattgaagcccctgggcgatgccgccccattcccatctgcactcccgtcagggacgggtgagcaacctggactgacagatttctccgccggtcttcggtcctctttcatcttctttctcaaatttttcgctttattaggcattctgaaacaaaaaaaaaataagaaagatatgaaaagtggcaaaaaatatgaggcgaatgaaccgttaaatgcacacaatacaaatatttattcatataaaatatgcataataaagatcaatcgacataattcttcgccgcaatgtgtagtcgtcctgctgaatccatcagccaggttcacacatcccattcaagaatgcagatattaaacaaccacaatccccacaggtaaagtctttgtcagactacaatccttcgaaggggcaggtccttttacaggaatgcagaaaataaggtaggtccagatacccatttctggtacgaatcccacgacg

SEQ ID NO: 709 - DNA, 1464 bp, Heterodera glycines
tttgagggtctgccccttcttttacttccaatggaagaagccggggtgcttaattgcaaagcactaatattgggcgtggtgatgcccgggggtgatgccaccccattctcatctgcactcccgtctgggacgggtgagcgatccgggctgaaagattgctccatctgccctcggtaccgctcttgttccttctttctttttattttttgttttgaaggcatctgaaaacaaaaatgaaacattgatgtgttcatgcggtaaagtatttaggaaaagcaaccattaaaccacattaaatcaaacatttatcgaaaaaattgaaaatgtgataaatgaatgcatattccttgaatgccatcatgatgccgctgcgaatccataagcagggctcgcatgtccaattttcgcacagtgtgttgcgaagaaagagaccggctcacacatcccgttaagaatgcagatgaaaactaagcattgattggcgaattcaatcagcttattaagaaccacaatccccgaggggcaggtaatcggaccaaaatccttaaagggcaggtccacattttggttgactccaatatcctacgttacctctcaccagtccactggtcttggtaaagtgcgggaccagcttcgcaccggatgttggccggtaacgataaggaattcattgtaaacctttcggaccacaatcacccgacggggcaggccctcgaaccacaatcctcaaggggcaggtccgtatttatttaggttaccgggtaatcctacgttacttctcaccagtccactggtcttggcaaagtgcgggaccagcttcgcaccggatgttggccagtaacgataaggaaacctttgtaaaccttttggaccacaatcacccgacggggcaagtccttttcagaaccacaatccccgaggggcaggtcctaagctgaaccacatccctagagggcaggtccacgtttgcgttagggtcttagcgtcggccgacatgcacttggtttcacttctttccaagaagctgacacattgcattatgctgcaatggaaaccggaagtgccctaatatgcacatcattaaaaaattatactgttaagcattaacatcatattgtgcataacacttttgttaaatggacacatgatcccccgctggggcaggtccttggccggtgaacacaatcccccgctggggcaggttcttggcaagttaaccacaatcccccgctggggcaggtccttggcccgtgaaagggatgggtaccatccctatagccgttggtatagggatgggtaccttccctatagccgttggtatagggatgggtaccatccctatacccgttggtatagggatgggtaccatccctatagccgttggtatacggatgggtaccatccctatagccgttggcatacggatgggtaccatccctatagccgttagcatagggatgggta

SEQ ID NO: 710 - DNA, 5278 bp, Heterodera glycines
taataaatttagcgtagattcaatagaaccaagcattcttggtttcattagctcactcgcatcaatatgcgtttaaagaaaccaagaacgtttgggtctgttgattttacgctaaatggtaagaaaaaatagtggtaaacaatttctaaatttggtgaccacctatttagcacatttttaaataaaaaaatttgtcaaaacccaccaaaaatccacctccttgacgatttcgtacacaagagggcaattttggatgatcacttcaactccaaaggacgatttggtacaaaaaagcgaaattgttggctgatcaccgcaacaccaaagcctttgaaaatcgaacaccgccagccaacagtagaaacttacaaaataaaataatattaaaatctttaaaataataatcatggacaaaaagcgaaagatatcgacataaaactggtggacataaattttacaattaattttttattagtaaaaacatttaaaaagactgatacttttaagaacgttttataagaaaaaactaaataactaaaatgtttcttagtaaacccaaccaaaatcgtcattatacgcagggattctgagcccttaccggtgtcctaaattaatgctaaccttttcggtattttgtccgtcagctttcacgttaactgcagtcttatttttggatgcgagccatccccataagagtgtttaaggggatgggaccatccccataagagtgtttaaggggatggtatctatccccataagagtgtttaaggggatgggaccatccccataagagtgtttaaggggatgggaccatccccataagagtgtttaaggggatgggattcatcactactatacgcagggattctgaggctttaccgaaatccaaacggaaatctgattacagattcgtgatcagcgtcctaaaatacctgggaccatccccatatgagtgtttaaggggatgggaccatccccataagagtgtttaaggggatggagccatccccataagagtgtttaaggggatcggaccatccccataagagtgtttaaggggatgggagccatccccataagagtgtttaaggggatgggaccatccccataagagtgtgtctagataaatactggatcattaaaattttaacagcaaataaatagcaaaacaaatttcaattaaatatttgattttcgcatcttttgcgtattgcaatcttgagcagtttcttggtttttacgtttcttcgcttctgcagtcttcattgtttcctcgtaaagtacgtgcgcgaccaaacgattaacagttgcgcgcacaatttgttcatcactgagctttgatttagctgcattgatttcctatagtgggagggatcatcctcttaaaactgattagcgggatagtaaccatctccatgagagcgtttagggtgatgggatccgtccctatgagagtgtttatggggatagaatttttcccttaagattctttagggggatggtaatcttcctcttaaaactgtttagaggtatagtaaccatcccatgagagcgtttagggtaacggaatccattagcatattgaggaaccttttttaaacagcctgcagtctcgtttctttcctgcaacacgaccaatgcaacggttcggctcaatgtagcacgaataatttgctcatcggttaagttttccatgtgttttgctttaaagttaatgtatatcaaaataatttcaaaataaaatttccgaatcagctcaaattcaaattaaacacatatttagccgaacatggagcattcatgttctcattaggaacgccgtgaggctgcagtcttccaccacgctgccactgacgccctcggctctgaatctggctatcgtgagattcttgctgcagcctttttccacgattttcttgcgacaaaattttttgctgtcggcgttccttattgaatcgtcgtcgacgctgattgttgtatttctaagtatttaataaatttaatgccaacgtttagggggatgggatccatccccataagagtgtttagggggatggatccccatcccccataagagtgtttagggggatggtatccattccccccaataaatcttaggaggatggattcatccccataatagtgcttagtgggatgggattcgtcattatacgcagagattctgaagccttatcggtttcttgagttaatgctaaccttttggttattttgtccgtcagttttcacgttaactgcagtcttattttttccaaatcctgaagtttgctggctgcgttcctgatttccttggcgctggttcgtctttttctaataattttaattaaaaaatacaacattttcgactcaaaccttttggatattttttccatccgctttcataactgcgagtctttttcttttcgaattcagtggatgtaccaaggttttcttcaggcacggcattaggtgttttttctgttgttgctctaagcttcttggtttgactccgatttgcaatcttttgttctctcttttttcctttcttcgcctttgtgatgataattctcgcatctgcttcaatcgctgctgcagtctgtgaagacaacggctccatggttgctgcatccaacacttcaagaacaacattttcgtcaacatttttctcggcattcttgtttcgtctgcttgcttgatccttaatttaaatttattgaaggaagtgtacatataagtacaccttttctgcagtaactgcaatctttttgctggaaacgccgaatttgccagaatgtttttttgtttttgtcatctcctcgcttaatgcattctcattcgggatctttacgtttgacttgcccccatcattcaatgttctgcgctcatggcaccattcctatattttataatttaaatatatatctactgaatgattaaataacctcaaaactcgcagattttgacatttttttaggaattttgtctgtaagtaaaaatgtataaactacaaaaatgaataagcttacatgtcttatcaaaatttttaataattttatcaaaaataggtgtcatgaaaatctaaagatttgtttgattaattaaataatattcgaagtagtttgtcaacgctattgattaactaactaaaagtaacagaaaaaagcatatcccaatttgacacaaaaaatatctgagatttatattacataatcttattgtttgcataaaaaataaattggcattctgaaactttttttttaaatgtttaaggggatgggactatccccataatagttagaagagatacaactgtgattagaagaggtgcaatagtgattaaaagaggtacaacagtgattagaagaggtacaacagtgattagaagaggtacaaaattgttagaagaggtacaaaagtgattagaagaggtacaacagtcattagaagaggtacaacagtcattagaagaggtacaacagtgattaaaagaggtacaacagtgattagaagaggtacaatggtgattagtgtgcataacacttttgttgaatggacacatgatcccccgctggggcaggtccttggcccgtgaaagggatgggtaccatccctatagccgttggtatagggatgggtaccatccctatagccgttggcatacggatgggtaccatccctatagccgttggcatacggatgggtaccatccctatagccgttggcatacggatgggtaccatccctatagccgttggcatacggatgggtaccatccctatagccgttagcatagggatgggtaccatcactatagccgttggcatagggatgggtaccatcactggcgtgttattcgcctggtactgaagtgtactttttgagcacgcttcagttttgtggggatgttgtccattttcctagcaaacggtatggggatggtggccatccctctagcaaacggtatggggatggtagccatccccatagcaaacggtatggggatggtgtccatcataggattcatcactatacgcagggattctgaggctttcccgatacgtcttttttttccatttttcatatagggatggaccatccctttagtcaatgttaaagggatggatcaatcactttaacattaactaaagggatggctacatccctttaatattgactaaagggatggcttctatccctttaacattgactaaagggatggctactatccctatccctttagtatggggatgttgtccatcctcctagcaaacggtatggggatggtggccatccctctagcaaacggtatgcggatggtagccatccccatagcaaacggtatggggatggtggccatccccctagcaaacggtatggggatgttgtccatcctcctagcaaacggtatgggatggtggccatccctctagcaaacggtatggggatggtagccatccccatagcaaacggtatggggatggtgtccatcataggattcatcactatacgcagggattctgaggctttcccgaagagctaaacgaaatttgcggatttttgggctatttttattttacaaaatatcttttcagaaccgagtagtgaatttttttctgaaaattcgaaaatttccagaatttctggaataactttttttatattcttgatagaaataccaaataaagggcaaaaatttctccgattggggatggtggccatccccatagcaaacggtatggggatggtgtccatcataggattcatcactatacgcagggattctgaggctttcccgaagagctaaacgaaatctgatttcagattcttgatcagcgtcctaaataacctttaaagtttttactaaaaaatgataaaaacatgaaataaaatttatcaaatagagcaaaaaattgcggatttttgggctatttttattttacaaaatatcttttcataaccgagtagtgaatttttttctaaaaattcgaaaatttccagaatttctggaataacttttttcatattattgatagaaaactcatataaaatgcataaaattctccgatttttactccattttttgagcctctaaacactaaataaaatagacctgatctaaactgagttatgaattttcaaactttaacccaaaatcctgagggcaaaaaaagtgaccgattttcaaaaaattttaaaaaattccaaaatttccctaacaaaaaacaaacatcatattcgtgctcagcacctcaaaataaagccagaaaaaattttttcaccc

SEQ ID NO: 711 - DNA, 1093 bp, Heterodera glycines
accatccctacatactttggtaaagggatgggtaccatccctatagccgttggcatacggatgggtaccatccctatagccgttggcatacggatgggtaccatccctatagccgttggcatacggatgggtaccatccctatagccgttagcatacggatgggtaccatccctatagccgttagcatagggatgggtaccatcactatagccgttggcgtagggatgggtaccatcactggcgtgttattcgcctggtactgaagtgtactttttgagcacacttcagttttgcggatttttgggctatttttattttattaaatatcttttcagaactgagtagtgaatttttttctgaaaattcgaaaatttccagaatttctggaataactttttttatattcttcatagaaataccaaataaagggcaaaaatttctccgcttggggatgttgtccatccccctagcaaacggtatggggatggtggccatccccctagcaaacggtatggggatggtggccatccccctagcaaacggtatggggatggtggccatccctctagcaaacggtatggggatggtggccatccccctagcaaacggtatggggatggtggccatccccctagcaaacggtatggggatggtggccatccccctagcaaacggtatggggatggtggccatccccctagcaaacggtatggggatggtggccatccctctaacaaacggtatgtggatggtgtccatcataggattcatcactatacgcagggattctgaggctttcccgaagagctaaacgaaatctgatttcagatccgtgatcagcgtcctaaataacctctaaagacatttataactttttactaaaaaatgataaaaacatgaaataaaatttatcaaatagagcaaaaaattgcggatttttgggctatttttattttacaaaatatcttttcagaaccaagtagtgaatttttttctgaaaattcgaaaatttccagaatatctggaataactttttttatattcaagatagaaataccaaataaagcgcaaaaatttctccgatttttactc

SEQ ID NO: 712 - DNA, 1433 bp, Heterodera glycines
atcctcctagcaaacggtatggggatggtggccatccccttagcaaacggtatggggatggtggccatcctcctagcaaacggtatggggatggtggccatccctctagcaaacggtatggggatggtggccatccccctagcaaacggtatggggatgttgtccatcctcctagcaaacggtatggggatggtggtcatccccctagcaaacggtatggggatggtggccatccctatagcaaacggtatggggatggtagccatcccaatagcaaacggtatggggatggtgtccatcataggattcatcaatatacgcagggattctgaggctttcccgaaaagctaaacgaaatctgatttcagatccgtgatcagcgtcctaaataacctctaaagactaaaaaatgataaaaacatgaaataaaatttatcaaatagagcaaaaaattgcggatttttgggctatttttattttacaaaatatcttttcagaaccgagtagtgaatttttttctgaaaattcgaaaattttcagaatatctggaataactttttttatattcaagatagaaataccaaataaagcgcaaaaatttctccgatttttactccattttttaagcctctatacattaaaatagacctgatctaaactgagttatgaattttcaaactttaacccaaaatcccgagggcaaaaaaagtgaccgattttcaaaaaaatttaaaaaattccaaaatttcccaaacaaaaaacaaacatcatattcgtgctcagcaccttattttaccccagaaaaatatttttcaccccacttctcgccctaaaaaaattttttgaaaatttctagggggcctagctcgaaaatttttgaaaattttccgacacatggcacaccattcgatagagcttaaaaagctctacaattttgctctaaggcaattttttgctaaaaccgacccctgacgagttatgggcccgggactcaaatgtcccgcttaggccaaaaaaattttctatttccggaaaaaaaccgaaatttttccaaaaatcccaccaatcgatagagctcgaaaaacggttgcttgaaagtggtctccgttttccccggaaaaatcggcaaaaaatcataaaattcaaaaaccccaaaacctcttagggggcctagctcgagaaattttgaaaattttcgaattttttaaatttggaaaaatcgagctcattgagctctataataagttcgctggccaccccccgctcagatcaaaccctggcgagttattcgcctggtactgaactggacaatgttggtactgaatttctccgcgcacctacaggcttttctattataggtagaggcctggaattttttttgacttttagacaacacttcaacttaggttcctaccagcggaaactttttgact

SEQ ID NO: 713 - DNA, 8721 bp, Heterodera glycines
tcacttctttggctgctgataatgctcaaagacttgtgcacattaagaagcatgaattggcattgaaaaggaaaagcgaattcgatcagaaattgattttctgctgaagagaacgacgctttttgtcaacgcatgacaattcatctaatgggataaacttataaagctaacaccgctgatcagatcagatcacaatgcgtatttgtggagtccatccacgcacaaatgaacaaaaacccgatcacataaaaaggtcaaagccaagccatcaatcagtcgtcagtctctgtcattagccaaactatggccattcctcataaatttgtcactgtctttttgtcctcgccaaatcccatcaaattattcgttgcccctccccccttcttttgctacttttactcaactctctcttccgcgcactgtattgactctcttttcagatagtcaataagaattaatttaaatatttattttatttaaattaaattaattttattggatttcccaatacttcaattatatttcacactttattagtgaattttgatcgaacaaatatatttattaatgaacgatttcaacgattgaacgataaaaaaatggtgattttacaatggtttaaatacggcaattttacataggcgggctgacagaaatttaaatgtaaacaatgctgactaataaaaaggcttaaaatcacaaaggttatgaatttggcgtaaaattattttaaacagatgaatcataaaattttaaattttcgtcgctaaggatgaaattagagacacactgcctccctcttccctatccccaaaacgagttaacaattaataattaattaaatttatttattgtgaattttctcatcaaatttttctatcaggtcaaattaattccaatacccataaaaagggctaaacaaacaatcaattatgaaaggaaaagagtgtgggaagggtgccccataaagaaaacaattaatggaatttttctaattaattaaaaatatttatcaaattgttattttctcaaacaataataataataaattttatttgaaattcacaaataaaaaattataaataaataattaattattataaaattaatttaaaaaattccatggaagggtgcccaataaaaaaagcaattaacgaaattttccttgattatttaattattaagcaacaacaataataatttttatttgaaattcacaaataaataaataaaatttatttttctcattaaaatttattattttttgtaacaattaattacctacatccttacttttgaataatattaaaacaataataatttttgttttaaattcataaataaataaataaataatttatttaagctcaaattaactccggtaccctttaagggggctaaataaaatcaattatcaaaggaaaagagtgcgggaagggcgtcaaataaacaaatcaattaacattatttttgactaattttcgcttttgaatggaacgaattgggggactgtaaaataaaaattaataaactaaatttaatttaaaattgattaattaattattattctaaaattaataataaaatattcatttactcttataaataattaaaaaatatttttttcttaataaaatttatttttaatacataatttagtttactgcctcctgtttaacttttgattttaaataaattatcaaaagggaagggagcccaataaacaaataattaacggaattttccaaactttaaagttaaaggaaatggtggaccaaataattaaaataatatttataaattaaattaagtaattaaaaagatttatcaaattattgttatttctgaaataataattatattttttattttaaatttacaaataaattatttatttttctcataaaatcttttttttataacagttttatttatctacatgattacttttgtacgattttattatatatatatattttgaaaaaatttctcattgtttattcgatttttccttgttttcattggcggtccgtcgttctcatctaacaaccttattcatttccctatttttttcaaatcaataaggttctttattctttgccattttcggatgatcatcaacacttaacccaccaaaacaaatgaaccgaattcgaaaagcattgacagtacacagcagaaatgaatcaaaaattccggtgttgaaccctaaagccgatgtttgtaaaagaatttgaaaaatatgatttttagaatattaatgataaaagagcaaattaaaatgagtcatttcccagtcttataacctcaacagcaaaacattgagaagccggtgtactctttgaaattcgttggtggcacaacattgttccccactgaatacgccaacgacgttgacctctacttgcgacaactcgaaagacgcagcccgctggactccgactttttgtccaggcacaaaaccgtagatggacgaatgcgacaaattcttgtcgcttggcttgtttatgtccattttaaaaatgttgaaaactcggtgaaacggtattaattcaggtacaagttcgcttaaagctgacatcgaaaaaactcgaggagttggtgaagccaaatgttgacgactttgtctatgtagcagcaaacatgttcaagggggagtacatcatgcgcatggaaccgcgggtgaataggaaacataattttgaattaccggatttttatgtgtacaccccaaatctcaccggcgaatttttttaaataattaaacttatattataaaattttttcaaaaaataaagttgaaatgtttttcacgatttttcttgaaaattcaaaaaattagtcataactttgtgtgcgcattataaaggtgttgtccgggctcaagttcaacctcagcatgccgtacgctgtgcagtttcggcatcgatatcgcttctacacttcgccgtcaaagagtgtgtgggcatttgcgaattcgtcagcgaagttgtcatggtctgctacgcgctggcccacatcccaccttccgttgttgccgccgtatccctccatttggctgcgtttgcgtacgcatgttcgctgcggttgcccgagctgtttgtggacacgttccgaatgcccgaggcggtcatggatcgcatttcacgctcattcgtcgaccatgttgttttacttctaaaataatcagcccgggccggccttttttttaaaaatttcgtccttaacaggcactacaaaaaaattttgctttccgttgcgcgtttttgcttccggcctaaaaaggctgaatcttcccacccacacaaaatttttttttcacctaacagtgaataataatgcatgtaaaattgggtaagctgttccggtttgttgtccaacaaaccccacggtttgactatatttcatttattcgtacccttgctatttaattatattttcctcaaattttccagggcgtccactttcttgaccccatcgcgtagcttggggccctgcgcgagaagaaccgacaccactttgtcaacaccaacgaggccttggggacaaccatcgttagacagaaaaatgacggactgctcgctgattttttacttcattctaaccttcgctgagttttttcgcccacatttgagaaactgtccaaacccttttcgagccgtttttcgtcattaagtttggggaaaaacaaataaatgaaaatgtgtcacattaattgtactttttcatctgcctttgccactctctactcttcaacctttgccattctcgcaaccgcaggctttttccccaaggcttctttctcacttccttcttttcctagccaatttctcatcccctgccttcttttccctagccaatttctcatcccctgccttcttttccctagcctcatcccctgccgtcttttgccttgccaacttcttatcccatgccttcttttgccttgcatttttttcttttgccttcaatgtcctattctgccatgcgccacttctcatattcctcgagcgtttacgttcattttctcttagttttctctgctgctcttcattttgccttcactcttcttgtgtctgtttgcccctctcatgcaattgtggcgacagaaagcttaccttttggtacacggaaacggtatttcctgctgctgtataggtgaactattacatattgtgggttccatgtacccaacttaacacaaaaaggaccccaaagccatgtttttccccagcctgtttgggcaaattatgcctgacggtccaaccatccacccggccccatcgaacaccaacttctttgtcaagtgtactttgaatttgtttgttttatttccaacaaagcctggcgtattgctcggcagaattacaaagaaaaagtttgtcatttgaccaacaaatataatttttcaaaaaaaagtccttatatggggtgtgccaagtcggttcatttttcttcatccttggtccagcggaaactctttgccatcgtcgtcgtcgtcgttgccggttcatccttctttaggtgcttcatgatcagatcggtgcaatcaaagttcagctttgcacagtcttggcaaaacgattgggtgaactcaaggcgttgctgctcgccattctgattgatgagtttgaatcggctgttcccctgccggaaattgtcatcacgacactctttgcacatgaacgtgaacactccgtacttaagaaatttttctatttttttcaaattaaatattagccaaaacctttgggcgggccaatttccaaaatatggtcgggtactcaaacacattggtcggttgttttttgggcgattcatccactaaaatttggctaatttaaagaaatttgcagaaaaagccaaaccttcagcttcatggcttttgctttcttcattgcggaagcaatttccttatggattttgtccaaacgaggcttgcgtcccctttttgagggccccggttgcaggtcaagcagtgtttgagtgttgttgttgtctccaattgtgatgacgtcatcatcattttgaggggaaaaattttcccgtttcgactcatccatttctttaaatttaaaaaaatttaaaattattataaaaaacccaaaaaatgattacttttgttctcaaacaccaattgatcattgatttttctcggggccattacgattaagaaatagtttatgattataattgttaaaagcataaaatgaacctgcgaaaaaaaacacgtaattattgattgataatgagaggggtgttagcgcgcagcgacctccagacgggctgtcccttcttaatcgataggccacgccatccacaaacacatagacgagagagtagtggttagagaaagatacaaaagggcgccaattcaaacacacagtgaatccccaagccgatttatttattttttacagactatggtactccctctgactgccgccctatccaaattgctaagctgtaaacccgaaaatttatcagaatatttgaacaaccccgaggcggtgaacaaagcgaacgcctacctgtgtggcaaaaaactcaaaacaacctatcagggtcctgattgcaagaccaaagatgtcaaatttggcacattttcgctgaaacctgccgctgaaacctacgcctttgagggatttcttggcaagtttccgaaaattctgtttcggtccaacaccatgcgttcagatgtcaaagtccaacagtatttctacataaaacaccggattcgcctactgtaccctcagctcaagtgcattgttgagtaccacaacaagggccattgcaaatactacccattgggtacaaatttgtatccgaaaaaaataaaataaataaaccccattaagagttgttggccattgaggagggctgtgagagtgcacccatcgaaaaacctgccgctgaaacggactatctggactacttgaactttcgcagtgggtggcaatcagcactctactgatcaatgaagcgtgcgagacaatcggaaaagttgggcgccttccctgagattgagttcgccgtcaacacaatgggcgtcacggtgtattgcccacggcacctgcaaacgcctcggtttgtgccatgggaccagcccgggcggtgcccgagctgcagaagcggaactgttgagctggactacatcatccagcccgagggggtgaccatcttttcgaatcggctaaagacggacggcgagaactttgtgccatttgacgcaattggtaagcttctgcatctgtttgccaaaaacctaacccttttcttaagtggattttgccgatcgtgctaaattccgcataagggcacggaataaggtgttcactttgccgctgcgacacccggaggtccacgccgcaggcccgagcttggaagaagccgtaaaagaacagaaggaaatgacgcagatgccataagcacttgtccatttttccattatttttgttcttgttctgatggattacccaagaataatcgaaagtgaactcgcttttctcatcccttcggggattattgtcagcgggccttcctcatcaggcaagacccagctggtccttcgcctgttacggcacgccaacgtattgtttgatccaccgccaaaggcaataggcgtgtgtaaaagggttttatgtgcagtgggctgttgctatttagtatgggcatacggtgagtactcgacgcagattcccgatctggagcggcagggagttgtcccccacgcaggtgccccgtctgacgagatgctgaaaaagctgccaaagccttgtctgattgtttacgacgatttgatgggtgacattgaggccaagaagttggccgatctgtacaccaaaaagtcccaccataacaatttttccgtgattttcctcacgcaaaacctgttcgataaatcaatgcgggtgccaaggtccaacgcccagtacatcttcctgatgcgggctcccaacgacatgcttagcattcgtaatttggccagccagatgttccctcgcgagcagggattcctgatggatgcctaccgacagacatgtgccctaccgtacggctacctgttggtgactctccacgcgaacaacattatacgcctaaggacaaacattttcccagacgacgaggagagaatcatttttgcccccaaaaatggttaagcgggaacagaagatcggtgagcgggttgtgcacaactacgactatttgaagaagttgggaaagacaacgtcggagaagaagcgccgtcatttgttgaacagtgccggttgtgaggaactgttaacgcttgtcgagatttgtctcaacgttttgaacgggagtttctgtctgagcaggaaacaaaagcagagacttgcgccatttgcaaaagacatcagacagttggcacgtgtgcgaagcgaaaggggtgcgcgaaaactagtgcagcagtcaggcggatcactttttgcccctttgttggcccccattctgattgaggctgcccgatacctgctttcgcgcagcaataatggccaataaacttattctgctgccgtacgagcactaaaaggggctggttggagcgagggagacaaagaatgacgacgacgacattgctgagcggacaaacttgggctttgtcaaacgacaagtgaccgctgcagtacagaagcggaagggaaacgtcagcgaacggaacgcaatgtacaaccagcacctgcgccggtacctgaagatgcgcaaggaacataaggagcggcccgtcctggtacagctcagcaacggcgctcaactgctaaataaaacagtggagacgggtgtgcaggtacggcctggtccggacgaaccgaaggacaagtccgtgatggttaccgacgaagatgaagatgaagaaattgaagtgccaaagtttttaaccccaacaagccagacgcagggaagcaatcgatcacccaggaccaataagaaagcagcaaaacagcaaaaattgatcgagaagaaggaccacctgttggccatcattatgtctgatccgcagagattcggcgcaaatgaaaatgtgtcacattaattgtactttttcatctgcctttgccactctctactcttcaacctttgccattctcgcaaccgcaggctttttccccaaggcttctttctcacttccttcttttcctagccaatttctcatcccctgccttcttttccctagccaatttctcatcccctgccttcttttccctagccaatttctcatcccctgccttcttttccctagcctcatcccctgccgtcttttgccttgccaacttcttatcccatgccttcttttgccttgcatttttttcttttgccttcaatgtcctattctgccatgcgccacttctcatattcctcgagcgtttacgttcattttctcttagttttctctgctgctcttcattttgccttcactcttcttgtgtctgtttgcccctctcatgcaattgtggcgacagaaagcttaccttttggtacacggaaacggtatttcctgctgctgtataggtgaactattacatattgtgggttccatgtacccaacttaacacaaaaaggaccccaaagccgatgtttttccccgagcctgtttgggcaaattatgcctgacggtccaaccatccacccggccccatcgaacaccaacttcttggggcagagtgtactttgaatttgtttgttttatttcctaacaaagcc

SEQ ID NO: 714 - DNA, 1333 bp, Heterodera glycines
  misc_feature (132)..(132): n is a, c, g, or t
tcaagcagtgtttgagtgttgttgttgtctccaattgtgatgacgtcatcatcattttgaggggaaaaattttcccgtttcgactcatccatttctttaaattaaaaaaatttaaaattattataaaaaacncaaaaaatgattacttttgttctcaaacaccaattgatcattgatttttctcggggccattacgattaagaaatagtttatgattataattgttaaaagcataaaatgaacctgcgaaaaaaaacacgtaattattgattgataatgagaggggtgttagcgcgcagcgacctccagacgggctgtcccttcttaatcgataggccacgccatccacaaacacatagacgagagagtagtggttagagaaagatacaaaagggcgccaattcaaacacacagtgaatccccaagccgatttatttattttttacagactatggtactccctctgactgccgccctatccaaattgctaagctgtaaacccgaaaatttatcagaatatttgaacaaccccgaggcggtgaacaaagcgaacgcctacctgtgtggcaaaaaactcaaaacaacctatcagggtcctgattgcaagaccaaagatgtcaaatttggcacattttcgctgaaacctgccgcggaaacctacgcctttgagggatttcttggcaagtttccgaaaattctgtttcggtccaacaccatgcgttcagatgtcaaagtccaacagtatttctacataaaacaccggattcgcctactgtaccctcagctcaagtgcattgttgagtaccacaacaagggccattgcaaatactacccattgggtacaaatttgtatccgaaaaaaataaaataaataaaccccattaagagttgttggccattgaggagggctgttagagtgcacccatcgaaaaacctgccgctgaaacggactatctggactacttgaactttcgcagtgggtggcaatcagcactctactgatcaatgaagcgtgcgagacaatcggaaaagttgggcgccttccctgagattgagttcgccgtcaacacaatgggcgtcacggtgtattgcccacggcacctgcaaacgcctcggtttgtaccatgggaccagcccgggcggtgcccgagctgcagaagcggaactgttgagctggactacatcatccagcccgagggggtgaccatcttttcgaatcggctaaagacggacggcgagaactttgtgccatttgacgcaattggtaagcttctgcatctgtttgccaaaaacctaacccttttcttaagtggattttgccgactcgtgctaa

SEQ ID NO: 715 - DNA, 12102 bp, Heterodera glycines
  misc_feature (12070)..(12070): n is a, c, g, or t
acttcagctgctatgtttgttacgtagggcttcgccttagcgatcatagggcggagataacgccaaaggttccgcactacggctcccacccccgctcccttctgccgtggaattccaaggaagtagccatagccacgctgaaaggttggggctccctcaaagtacgaaatgcttccaccctgctgatgataattctccaaccgcaagttcgacgcgttgaatataactcggaccattgtatcagaaagttacgacttttttaaactgaagagtcagcacaacttggccaaattcaaatcgttcctcctccgccttctccttggcgagtcgttcttcttcctccgttgccaaccgctccttttctgtcttcttctctttggctaatcgttcagcctcagatttctttgccttctcttgctctttttctcgctgcttttgctgctgttcttctcgttgctttctctgctgctcttctctctgctttctctgctgctcttctctctgctttctctgctgctcttctctctgctttctctgctcttctctctgctttctctgctgctcttctctctgctttctctgctcttcctgctgctttctctgctgctgctcttctcgctgctgtcgccgtttatcctcctcctccctctcttttttgtctcgctcatgcttcaagcgaagttgatcaagttttgtgcgatttttcaacggatttaatggtgcttcttcaggctcttcctcctcaacgacttccatgtcaacaatctccccctcatccgggtactgtattgacctttttcgggtcaggtgtcgttccatttccgctatcatgccgtggtgcattccccgttcaagctgctgaggcgaaaggaagctgccccttggcactctgaaccggaacttgcgaccatcgcgcaggtgcaccactacgtattgcctctccagggttcctacagtcgcccagctaaactgtacaagggcaatgagaactgtgcaaacccactcacctgttgggatatattatgccagacatgcccaccatccatcccggcccatcaaacactaatttctttggcaagtgtgctttgaatttattcgttttattgccgacaaatcccggcgtattgctgggcaaaattacaaagaaagagttactcattttaacgaaaaatcaatgaatgaatggtcaaagatcacttttccgtcttgaaaaaggtgctccgtcctccgttcttctgtggtccatcatcctttttttggtgtttcatgatcaggtcggtgcagtcaaagttcaacttggcacagtcttggcaaaacgtttgggtaactccagtttctcttggccactgccagtgttgaggatgaagcgcttgtcgcctcgcttgaagttttcgttacggcattcgttgcacataaaggtgaacaccccatactgcaacggaagaagaagaacattgtagggctgccaccagagcaaacattacctttgggcgtgcgagcttccagaaaattgttgggtagtcgaagacgttggctgctttgcgttcgtcgacatctgtgacttcaacctctgcggggttggacttctttgcgttgttcacgtcctccagcagtttttcccagcgagactttcggcccctcttcttgagcgcaggacgttcctctgcgtgagatgactgcgagtcaaccaatatgacgtcatcatcaatatctgaaaaatgagaaaaaatccaaaatttttgtaaaatttgtgaaaaattttacccattttatgttttctttgattgttttgtgcttcttccacgtggttcgcttctataaaatgcttatattttgtgttttattttaaaatttactctggatttcgtccaaaaactgctcattctgcttacgaggagccatttcgaggaatatttttgtgtgttaagatgaaaatgagaagggaaaagtgtgggggtactgtatgtgacgtagcggagaggggggtgtcacgtgggaataggccacgcccactcaagtgagagcacgcagggacctccagacgggaggatttcgaaatccatccacagtatgccctcctatgccacgccccttatcattcacttccctgtcagtcatttagatgcccccactgacaacagccttatccaagctgctgaactgtaaagctgagaatttggcagagtacctgaataacccggaagctgtgaacaaggcgagtgcatacctgcgaggaaagaagctcaagacaacctactcgaacaagggcggcactacaaaggaggtcgagtttggcaacttctcgctaaagtctgcttcggagacgtacgccttcgagggattccttggcaagtgtcctttctgcaagcattccctcactttggaaagttcagaggtcaaagttcaccagtacttctacataaagcaccggatccgcctgttgtaccctcagctgaagtgcatcgttgagtaccacagcaaaggtcattgcaagtactatccgttgggtaagctttaggctgcgatgaaagcccataatctcgcacggtttcagagttgttggccatagaggaaagtgcagagataacaggcgaaaagccaacagacaccaactacttggactacctcggcttccgaagtgtttggcagccaacccccgtctattgacccgcacagagatgaagcgttcgagaccgtcgcaggagttccccgagattgagttcaacgtgaacacgatgggtgtcacggtgtacagccctcgccatctgaagacccctcggtttgtgccatgggatcagcccggtcggtgtacacgctgcaagagtgggaacgtggagctggactacatcattcagccagagggagtgaccatcttctcttcccggctcaaggatgacggagagaactttctgccatttgatgagatcggtaagggtttggactactgctcaaaagtaatcagcagcttaagtggactttggcgacaatgccaagtttcgcgtccggtcacgtaacaaaatgttcacactgccactgagacacccggaagtttaccaggctgcacaagtcgcagcggaagcgaatgaactgctggcagaagttccaccaatggctgagaacaatgatgatgatgataatgttgacccaaagtgataactcagtttgttgataagccattttgttatcattcgtgatggattacccgagaataaatgagcgtgaactcaaatttcccattccctccgggattgttgtcagcgggccctcctcttcgggtaagacgcagttggtccttcgcctgttggcacacgccaacgagatgtttgatcccccgccgaaggtgataggtaagtccccaatgccacgagtaatgagcagtccccttgggtttagtttgggcttacggtgagtactcctcgcagatacccgagctcgagaggcagggggtagtcccgcacgcaggcccaccctccgaagaaatgatgaaaaagttgccaaaaccctttcttattgtctacgatgacctcatgggcgacattgacgcgaagaagttggccgatctgtacaccaagaaatcacaccacaacaacttttcggtgatattcctcacccaaaacctgttcgacaaggcgatgagagtgccaaggtccaatgcgcagtacatctttctgatgcgtgcgcccagcgatatgttgagtattcgtaatttggccagccaaatgtttcctcgcgagcaagggtttctgatggacgcgtacaagcaggcgtgtgccgatccgtacgggtatctgttggtgacactacacgcaaacacagacaacctcttacgactgaggacaaacattttcccagacgacgaagaaaagattgtctttgtacccaaaaatggttaagaagcaaatggttggacagcgggtgttggacaactacgagtatctgaagtcccttgggaggacgacatctcacaagaagaggcgtcatttgttgagcagtgcaggttgtgaagagctgttgaccctggtggagatttgcttaaacctacttaacggatccttctgtttgacgcggaaacagaaacaaaaattgttgccttttgctgacaccattcgacggttggcacgcgtgagaagtgagcagagtgcgagaaagctgatcttacaacaacaacaaccacagcaggagggaggttcactgtttgcccctttgttggcacccatactgttagaggaagcacgttatctgctgcgcaaagatggccaataagctcattcttctgccttttgagcattaccgaggattagttgcagcgagagagggtgtcggcgttgcgaaaggagacgacgatgtggcagggcagacaaatttgggattcgtcaaacgacagctggagaccgcgaagaggaaacggacagcgaatgtcagcgaacgaaatgtattgtacaaccagcagctgaggagatatttgaagctgagaaaggaggtcaaggacaggcccctcaaggtccagctcagcaacggtgcgcaactgctgaataagacggtggaaacgggcgtacaggtacggcctggccccgacgagccgaaggacaactccgtattgattactggcgaagatgaagagattgaagtgcctacgccaataagtaagacgccgggaaacagccgatcgcccaggaccaacaagaaagcgatcaagcagaaagaaatgaacgaaaagaaggaccacctcttggccatcattatgtctgacccgcagagattcggcgctacggaccgtgggaaaatattaaatccaaagacggggcgggagttcatcaactcggacctggcctggtcaattgaacgcctagtggaccctcgcccggagaatgccccttcaccaagcggaaccaaagagttgatgaggaagctcgcacagaatccgctcgccagtagcctacttaatcgactattcgttgggtctggacaagtcaaacaaacgggaggatttgttccctctaaatggacgaaaaaataaacaaaatatacaccgacccggccaatcccggtgggtttgcgggtgcgagtgcactctatgcagcggtcaagaagaagcacccaaaactgaagaggaccgactttgatgactttttgcagcggaacaccacctacacgctgtttaagccaaagagggagaagttccgacgccttcgcacagtccccggagggttcatgaccggtgagtttgtccacgttattttcacgtgatcggctcagacgttcaggcggacttggcagacttccaagccctttcgcgaaagaacagcggctatcggtacctgctgttggcggtggatgtgttgtcgcggcgtatgttcggctcacccgtaaagagtaagaggccggcggacgttaaaagggcatttgaggaggtgtttggccaaatgccaaagcttccggaaacactgtacacggaccgtgggctggagtttgtggccaagcccatgaaggagttcttcgctgagaatggcattaagaagtatgagaccagctcaaagaagaaggctgccgtcgcagagagagccatccgtacggtgaagactcggctgtacaaatatttctctgccaaaaacacctctgcgtgggtggatgtgttgcccaagtttttgtctgcaattaacaattctgtgtgccgcgcaacgggacttaggccaaacgaaatcagtgacgtcaatgcgagagaggtgtggaagagggtctatggtgaaggacttgtaccagcggagaagagaccaaagatcaaagcgggagaaactgtcagaatcccagagcccaaacacatattcgagaagggtacagtgactccttcatttttttttctgtatttttttttgtgcttaaggctatattccctactattctgaccatgtgtacaccgttgatgcggctcgcgcaaccaaaccccagcactttttctcaaggactattatggcacaaaaatgaatagaaagttttatttgccagagctaacaaaagtacaagtggacgaaaacacaatgtataggatcgagaaaaaatacaaagaacgaatgagggatggaaaaaaggaaatattggtgaaatttatcggatttccagagaaatattgggtctcaaacgaagattttgaaaaataaaagtacaaaataaacaaattattccttcttacagagacaatcataggggttatgggctttgcaatactcatatgagctgtaaccaaagggcacaattttcagtccacggtcccggagcaccccgttattcacggtggggttgaactgcttggtgatgggcaccgtcagaatgtcgccctgcttcgtgatgcggaagttcttcgtagggtagtcgaaccgcacatggttgccgggcgtgccccacttctccagcaccatttctttcatcttctcaaagttgatgtgcgtgcaggcgttcgagtccaaggtgatgcctcgcagcttcagcttgtactcgtcctcgccggttgcgttgttccgaagccaaagagcgtaggccttgggtccagctgaaaatcgatgaaatttattcaaattattttggccaaagtccttaccacagatgaactcgtcgatggtatggctggggtactcgtccgcgagctccccaagttggttgcctcccttcagcgggtcccccagtgcagtcttgaagtcatagaagatactgtcggtgtcctgaaaaaagaatattttattatgaatattttattgtcacactcttaccatgtataaaatgcgcgtgtcgtagcgctcttcttcaggctcttcctcctcaacgacttccatgtcaacaatctccccctcatccgggtattgtattgacctttttcgggtcaggtgtcgttccatttccgctatcatgccgtggtgcattccccgttcaagctgctgaggcgaaaggaagctgccccttggcactctgaaccggaacttgcgaccaccgcgcaggtgcaccactacgtattgcctctccagggtccctacagtcgcccagctaaactgtacaagggcaatgagaactgtacaaacccacccacctgttgggatatattatgccagacatgcccaccatccatcccggcccatcaaacactaatttctttggcaagtgtactttgaatttattcgttttattgccgacaaatcccggcgtattgctgggcaaaattacaaagaaagagttactcattttaacgaaaaatcaatgaatgaatggtcaaagatcacttttccgtcttgaaaaaggtgttccgtcctccgttcttctgtggtccatcatccttttttggtgtttcatgatcaggtcggtgcagtcaaagttcaacttggcacagtcttggcagaatgtttgggtaaactccagcttctcttggccactgccagtgttgaggatgaagcgcttgtcgcctcgcttgaagttttcgttacggcattcgttgcacataaaggtgaacaccccatactgcaacggaagaagaacattgtagggctgccaccagagcaaacattacctttgggcgtgcgagcttccagaaaattgttgggtagtcgaagacgttggctgctttgcgttcgtcgacatctgtgacttcaacctctgcggggttggacttctttgcgttgttcacgtcctccagcagtttttcccagcgagactttcggcccctcttcttgagcgcaggacgttcctctgcgtgagatgactgcgagtcaaccaatatgacgtcataatcaatatctgaaaaatgagaaaaaatccaaaatttttgtaaaatttgtgaaaaattttacccattttatgttttctttgattgttttgtgcttcttccacgtggttcgcttctataaaatgcttatattttgtgttttattttaaaatttactctggatttcgtccaaaaactgctcattctgcttacgaggagccagttcgaggaatatttttgtgtgttaagatgaaaatgagaagggaaaagtgtgggggtactgtatgtgacgtgacggagaggggggggggagggggtgtcatgtgggaataggccacgcccactcaagtgagagcacgcagggacctccagacgggaggatttcgaaatccatccacagtatgccctcctatgccacgccccttatcattcacttccctgtcagtcatttagatgcccccactgacaacagccttatccaagctgctgaactgtaaagctgagaatttggcagagtacctgaataacccggaagctgtgaacaaggcgagtgcatacctgcgaggaaagaagctcaagacaacctactcgaacaagggcggcactacaaaggaggtcgagtttggcaacttctcgctaaagtctgcttcggagacgtacgccttcgagggattccttggcaagtgtcttttctgcaagaattccctcactttggaaagttcagaggtcaaagttcaccagtacttctacataaagcaccggatccgcctgttgtaccctcagctgaagtgcatcgttgagtaccacagcaaaggtcattgcaagtactatccgttgggtaagctttaggctgcgatgaaagcccataatctcgcacggtttcagagttgttggccatagaggacagtgcagagataacaggcgaaaagccaacagacaccaactacttggactacctcggcttccgaagtgtttggcagccaacccccgtctattgacccgcacagagatgaagcgttcgagaccgtcgcaggagttccccgagattgagttcagagtgggaacgtggagctggactacatcattcagccagagggagtgaccatcttctcttcccggctcaaggatgacggagagaactttctgccatttgatgagatcggtaagggtttggactactgcgaaaaagtaatcagcagcttaagtggactttggcgacaatgccaagtttcgcgtccggtcacgtaacaaaatgttcaccctgccactgagacacccggaagtttaccaagctgcacaagttgcagcggaagcgaatgaactgctggcagaagttccaccaatggctgagaacaatgatgatgatgataatgttgacccaaagtgataactcagtttgttgataagccattgtgttatcattcgtaatggactccccgagaataaatgagcgtgaactcaaatttcccattccctccgggattgttgtcagcgggccctcctcttcgggtaagacgcagttggtccttcgcctgttggggcatgcccgcgagatgtttgatcccccgccgaaagtgataggtaagtccccaatgccatgagtaatgagcagtccccttgggtttagtttgggcttacggtgagtactcctcgcagatccccgagctcgagaggcagggcgtagtcccgcacgctggtcctccctccgaagaaatgctgaaaaagttgccaaaacccttccttattgtctacgatgacctcatgggcgacattgacgcgaagaagttggctgatctgtacaccaagaagtcccaccacaacaacttttcggtgatattcctcacccaaaacctgtttgacaaggcaatgagagtgccaaggtccaatgcgcagtacatctctctgatgcgtgcgcccagcgatatgctgagcattcgtaatttggccagccaaatgtttcctcgcgagcaagggtttctgatggacgcgtacaagcaggcttgtgccgatccgtacgggtatctgttggtgacactacacgcaaacacagacaacctcttacgactgaggacaaacattttcccagacgacggagaaaagattgtctttgtacccaaaaatggttaagaagcaaatggtcggacagcgggtgttggacaactacgtgtatctgaagtcccttgggaggacgacatctcacaagaagaggcgtcatttgttgagcagtgcaggttgtgaggagctgctgactctggtggagatttgcttaaacctacttaacggatccttctggttgacgcggaaacagaaacaaaaattgttgccttttgctaacaccattcgacggttggcacgcgtgagaagtgagcagagtgcaagaaagctgatcttacaacaacaacaaccacagcaggagggaggttcactctttgtccctttgttggcacccatactgttagaggcggctcgttatctgctgcacaaagatggccaataagctcattttcctgccttttgagcattaccgaggattagttgcagcgagagagggtgtcggcgttgcgaaaggagacgacgatgtggcagagcagacaaatttgggattcgtcaaacgacagctggagaccgtgaagaggaaacggacagcgaatgtcagcgaacgaaatgtactgtacaaccagcagctgaggagatatttgaagctgagaaaggaggtcaaggacaggcccctcaaggtacagctaagcaacggtgcgcaactgctgaataagacggtggaaacgggcgtacaggtacggcctggccccgacgagccgaaggacaactccgtattgattactagcgaagatgaagagattgaagtgcctacgccaataagtcagacgccgggaaacagccgatcgcccaggaccaacaagaaagcgatcaagcagaaagaaatgaacgaaaagaaggaccacctcttggccatcattatgtctgatccgcagagatttggcgctacggaccgtgggaaaatattaaatccaaagacggggcgggagttcatcgactcggacctggcctggtcaattgaacgcctagtggaccctcgcccggagaatgccccttcaccaagcggaaccaaagagttgatgaggaagctcgcacagaatccgctcgccagtagcctacttaatcgactattcgttgggtctggacaagtcaaacaaacgggaggatgtgttccctctaaatggacgaaaaaataaacaaaatatacaccgacccggccaatcccggtggatttgcgggtgcgagtgcactctatgcagcggtcaagaagaagcacccaaaactgaagaggaccgactttgatgactttttgcagcggaacaccacctacacgctgtttaagccaaagagggagaagttccgacgccttcgcacagtccccggagggttcatgaccggtgagtttgtccacgttattttcacgtgatcggctcagacgttcaggcggacttggcagacttccaagccctttcgcgaaagaatagcggctatcggtacctgctgttggcggtggatgtgttgtcgcggcgtatgttcggctcacctgtaaagagtaagaggccggcggacgttaaaagggcatttgaggaggtgtttggccaaatgccaaagcttccggaaacactgtacacggaccgtgggctggagtttgtggccaagcccatgaaggagttcttcgctgagaatggcattaagaagtatgagaccagctcaaagaagaagactgccgtcgcagagagagccatccgtacggtgaagactcggctgtacaaatatttctctgccaaaaacacctctgcgtgggtggatgtgttgcccaagtttttgtctgcaattaacaattctgtgtgccgcgcaacgggacttaggccaaacgaaatcagtgacgtcaatgcgagagaggtgtggaagagggtctatggcgaaggacttgtaccagcggagaagagaccaaagatcaaagcggaagaaactgtcagaatcccagagcccaaacacatattcgagaagggtacagtgactccttcattttttttctgtatttttttttgtgcttaaggctatattcccaactattctgaccatgtgtacaccgttgatgcggctcgcgcaaccaaaccccagcactatttgctcaaggactattatggcacaaaaatgaatagaaagttttatttgccagagttaacaaaagtacaagtggacgaaaacacaatgtataggatcgagaaaaaatacaaagaacgaatgagggatggaaggagaggaaantattggtgaaatttatcggatttccagagaaa

SEQ ID NO: 716 - DNA, 1957 bp, Heterodera glycines
cccttccattttcctttccttttttttcacttccatttccctttccttttcctttccctttcctttccttttcttttttttcacttctatttccctttccttttcctttcctttttccttcccttttccatttccctttcctttttccttcggtttcctttttcttttcctgttcttttctttttccttttcttttctttttgatttttaggggcggttttgtcgggaccgatttcccgctctcgggatttcgatcccgaactgctctccacgaagcggcccaaaaaatcccaaaatttattttattactataataatcatgctctatttgtttgcactatttttggatttttagggccggttttgtcgggaccgatttcccgatctcgggatttcgatcccgagctgctctccacgaatcggcccaaaaaatgccaaaatttattttattactatatttaatatgctctatttgtttgcactatttttggattaaagctccggttttgtcgggaccgagtctctcgatctcggaattgtaaatctgatcaatcccgagctccggtagcacgaatcggcccaaaaaatcatagcgacgagcgagtacgccgagcacgcgccagccgctgctgctgcacgaacatccagacacgcatctgcgcctgagctgctactgcactaacaacctgacgcatctacgccgttactggctacaactcgacgggctagggcaagcaagtgcacgctccccacgcatgcccttggagccggctagttatctatatatataaaaacggggggggcccaacctaaatggtccatgtgctaatggatgccgttgagttagcgggtcgcttttttttttaaaagatagctgagctcaagctcttcaaaactgaccgtaggcttttaaattgctcttgcactttttttcgagaaaaactaacttttttgaatttacttttttttttttgccactttttcgatttttgcacatgttcaagttatccgcagggtttgaatgttgcttatgaaaagatgctcctaacgatgccgcgtcttttaaaaaaaaaattggcgcgccagcactaagttgaagggccggaccccctttagcccctggggtgggtcggggtctaaaaaagttagaaccgggggaagtgtgtggttaatgaatcgggaggcccggcgctattggctattattgtagagctcgccgaggcgaacattttaaaaaaaaatttggacccctagccccaggttgagtaggtcatttgtccggaaaactggtcaaaatgggcaaatttggctgggagtgcggggttttgggggtaaatgagtgcgggaagtgcgaataacggggttttaagtgttttagacttttttttgacaggtcaaacaatgttcggggagggtgggacaaagtgtcgacaggtttgacaaaatgtcgaaaattttttgtgtggaaatatgaatttttttgcttttttatggttcggagcataggaaagaggggttttaaacggtttagactttttttgacaggtctaacaatgtttggggagggtgggacaaagtgtcgacaagtgcgacaaaatgtcgaaaatttttttgttggaaaatatgaatttttttggtttttctgtgtttttgaggcatttttgggctggggagggacctaaaaaagaaaccaaaggcctaccacgagccccgtgtgggcggcgcatccaggggggggggcgggggggggggaaattccctccctccgtcaatcaatcattcattccctttctttatttatttcattatctgcttgaggcactgcaacgacaaacataaataatcgagagaaaaatgggcaaaaaaatatcctgcaaaaagagggtgggggggcacttgggagcaaaagggggagaaatgggtccaaatgggggatggacgatgagcgggggggggg

SEQ ID NO: 717 - DNA, 2421 bp, Heterodera glycines
  misc_feature (93)..(93): n is a, c, g, or t
  misc_feature (99)..(99): n is a, c, g, or t
  misc_feature (485)..(485): n is a, c, g, or t
ctttccctttccctttcctttttccttttttttcacttccatttcacctttaccttttctttccccttttcctttcccttttcctttcccatntccttntcctttcctttcctttccttttcttttttttcacttctatttacctttccttttcctttcctttttccttcccttttccatttccctttcctttttccttcggtttcctttttcttttcctgttcttttctttttccttttcttttctttttgatttttagggccggttttgtcgggaccgatttcccgctctcgggatttcgatcccgaactgctctccacgaagcggcccaaaaaatcccaaaatttattttattactataataaccatgctctatcgaatgccactatttttggatttttagggccggtttcgtcgggaccgatttcccgatctcgggagttcgatcccgagctgctctccacgaaccggccccaaaaaatcnccaaaatttattttattactataataaccatgctctatcgaatgccactatttttggatttttagggccggtttcatcgggaccgatttcccggtctcgggagttcgatcccgaaccgcaaccctttatctttgtcacaaaaatccaaaaatttattttcttgctatatttaatatgctctatttgtttgcactatttttggatttttagggccggttttgtcgggaccgatttcccgatctcgggatttcgatcccgagctgctctccacgaatcggcccaaaaaatgccaaaatttattttattactataataatcatgctctatttgtttgcactatttttggatttttagggccggttttgtcgggaccgatttcccgatctcgggatttcgatcccgagctgctctccacgaaccggcccaaaaaatgccaaaatttattttattactataataatcatgctctatcgaatgccactatttttggatttttagggccggtttcgtcgggaccgatttcccgatctcgggatttcgatcccgagctgctctccacgaaccggcccaaaagatcccaaaatttattttattactataataaccatgctctatcgaatgccactatttttggatttttagggccggtttcatcgggaccgatttcccggtctcgggatttcgatcccgaaccgcaaccctttatctttgtcacaaaaatccaaaaatttattttgctactaaattcgctatgccctatttaatggcagcaattttagattttaatttgttttttcaatatttcgtttatttccatttgactcttataaatcaatccatacccccccccaacttcgcttcgcttctttctttttcgttgacacctcatcccccccccagcgatgctttcgctgctcctatgcgttgtaggggcgggatggggggtcggcgaaagtgagcagaaatttcctattgattgctctttcattcataggaaaaagtaaaaaaggttttagctgagcggtttatgtgccgccaaaaccttttttttataagtattttataaatttttttaaagtgatactgtagaaaagaaaaaaaaagtgaaatttgaaaattgaaaatttgaaaaaaatttttgaagaaaatccgaaatttaaatggtgttttgaatttttttattagcggttataaattttttcaaaaaatgaaaaaatttaagaaacttttcggattaattccgaaagctggcactgacaaaaaaatttgttaatccagcaccctgcctggctgtgaacctttgtgttaacgccgggcagggacgcgcgcgcggggctggatggtccttctgcagagcacctttgtgtgatcgctaaagggccagatcagtcagtcctcccccagcgtagcccctggataggatttaaaaaatgagtttttaggcaaaaatttagtacaattaatggaaaatagcaaaaaattaagactgtgtttttagaaatttgtacaattttaatgatgctctatcgaacggcatcattttctgaattttaggttcgtttttggcgggctcaagatcattttaagacctcgggatcaggaaattcgacccatcaaaaccggccctaaaattctgaaactgatgccgttcgatagagcatccttaatttagtgccaatacgatttttcagaattttagggccggtttggctggttccattttcccgatcccgactcttttaaacggtcttggatccaaccaaaccggtcctaaaattctaaaaaattatattggcactaaattaaggatgctctatcgaacggcatcagtttcagaattttagggccggttttgatgggtcgaatttcctgatcccgaggtcttaaaatgatctaaaggccgccaaaaacgaacctaaaattcagaaaatgatgc

SEQ ID NO: 718 - DNA, 701 bp, Heterodera glycines
cgatgccgactcttttatccggtctttgcatccatccagaccggtcctaaaattctaaaaaattatatgggcactaaattaacgatgctctatcgaatggcattaatttcagaattttatggctcttttcgatcgcccgaatttcccgatcccgaggattgcaaacgctctgcagccctccccaaatgctcctaaaattctgaaactaacaccattcgatagagcatccttaatttagtgccaatataattttttagaattttaggcccggtttggttggatccaagaccgtttaaaagagtcgggatcgggaaaatggaaccagccaaaccggccctaaaattctgaaaaatcgtattggcactaaattaaggatgctctatcgaatggcgttagtttcagaattttaggatcatttggggagggctcaagaccttttgaaatcctcgggatcgggaaattcggccgatcgaaaagagccataaaattctgaaattaatgccattcgatagagcatctttaatttagtgcccatataattttttagaattttaggaccggtttggttggatccaagaccggttaaaagagtcgggatcgggaaaatggaaccagccaaaccggccctaaaattctgaaaaatcgtattggcactaaattaaggatgctctatcgaatggcgttagtttcagaattttagg

SEQ ID NO: 719 - DNA, 5909 bp, Heterodera glycines
  misc_feature (5767)..(5767): n is a, c, g, or t
  misc_feature (5777)..(5777): n is a, c, g, or t
  misc_feature (5833)..(5833): n is a, c, g, or t
gactatgactccttcatttgatgcattagcaagagatgaccaatgcaatgatcattactggccaatccctgacaatgagactttgtgatttatacatcgcaccgcaattggggcgaggcctgctcgaacaccgcctgatccactgaatcaatctttgtgcacgagctacagaatccctcttaaatagatcaccgacaccaaaatgaacgttgattctacataaccaatatctattgtaatataagtatttgacaacggttaacacaatattttaaggccttcccaagcatttcaaccggggcttttcgctttccccgaaaggaagcaacacaaatcgccatttcctccatcttgaattggctttctgcgcgtcctcagggctctcctgacattgacgaaattcgtctggtcgcttttcaagaggctgacttcaaattgtacaagttgatgcttgaacaagtacgtgccgttgggttgaggatttgtgttattattatttcttttattaggtgaagcgccagctgagcgctgcaagaaggtcaacgccgttaagcacggacccttcccagctttcttcggtgctacaattctttataaatttttattatgagtcattttacagagtgtggcagtgactccagtaactggattgtcccacaaaattggccggttgctgtttgacaggacgacccatgccaccagtccacctgccaccaagaaaagggcaacacaagcgacaacaccaacacaggacactgatttggagataatggatgtggtggaagcggttcctggcccatcacacatgcgaacagcccaagtctcatcgcagcagtcccgtcaagtgcaaattcagaacgttattggggatggctcttgcttcttccggttttaataagatttaggggcttttttgactaaatcttttcagtgccatcgttaatgcacttgtcggcgaggacagcgaagagtttgctgccaatttacgcaaacatctgttcacgacattgggccgcatggttggagacccgaattgttatccgaaagggttcacaagccgagaagagttcatggatttcgcgcaggcatttttcttggaacaacgtgacactttcgagcaatacatcgcaaggcgtctgcgtcccaatgactgggctgcgagtgctgatgcatttttggcagcaattttactgcaacagacaattgtcgtggttgtgcctttgtaccacacacgacttttgcctgggcaggagcgagaatcggtcaattactttgactcccgataccggcataggctcgagatctattttgccgacggccagcgaatggtagtgtattttaagattttctaaaattgataatttttataacaaacacagatggtgcaccaagacttcccggatgatcagtttggcaattttacggcgactcaaggcccaggtcaacaaagacaggtcattgaccccgttgtcatctggtacaatgggacaaatcactttcaaaccgttgtattggtaagttactgaccgtttaattcaaaacacataaaaattctatgtccacgtttacagccgtccaggccgtctgcctctcgctttgcagtcgaaatagtcacttcgccgcagtttcctccttcgattcacctttttggtgaagaagttgaagctatggaaattgcagcgcctgccgctgccccttctgcgccaattccatcgacgtccagtgggattgaggagaagcgttcgaccaccgtcacagctccatcaatagtgactgaagaagaagatgtgttcctggaagaatcgttgccgaagatggagtcctgcaaatgctgtaatagcgctgttgtgccaccggcattagaagacgccaatgtccatctaaaacaacagtttgcctattacggctacattagcactccctgttgtggcgacttccatctgagatgcttcgaaaaatggtcgcatttgtttttcgaagtctgtgcaaattacttctatctttaggaaccaaagtccgccctcttatgcgctgaagcgccttcacaactacgatggtgttgatgacaactgtccaaattgtcacaggcgtattgtttcgacattgtctgatgacgtggccactgaacatgccaaagaggagcgcgcagattcatctgagcattctgatgtgaataattaaaacaaaaaaatagctaagggattactaattttaggaaccgactgagccagaaagccagcagctaactgaagcagttgatcttgctctgaacatcaacgaggagctttatacgccgatcaaagttgagtatgacaacaccagcattgcttacttcgcagtttacaatgcaatgatccgtgcgaagaacaactgctacagaaacaggccgacaccaccgcctgagatgctggctgaattgagggcgtgctccgaaaaggagaaaagcctttactgggacttcagtgcgtcaactaaacgccatcaatatgcaacggagcagatgcttaagatgcaggactacttgaaggctacagcgcagcccaaacatcggcaatgtgtgaaggagcaactttgcgactctttgaaggaggcaacaaacaacaaggccccaataatacgggagcagcattgtttgctcatccaagcgctcgaagaacagctttacgacatcatcaagcagtttctcatgctctggcactccatgcaacagatcagtcccagcactgcgtcgttggaatcaatgcaggaatggctcctttcttcggaggacaacggtatggaactggcgcgtttggccgacagttgggtcgaacatctggccctcatcaacgaaaacatcaaaagttgtgtgaagaagtgcaataaggcgaagaggaggacgagcttcatgtcggttggccaacttacaggcctcctccaagcaaagctaaagtagatattaatgtgtagcaaaaaaataacttaacaattaaggattgtgcgtaagaggtcaaaaaagaaggctgtaagggttgaacgccatccgctgctcgaccatgtttttgaagacctgcgtcaaaaacatttccagctggaagcagccatacgaaagcaggaagaagctcaaaacacaacagacggaggacaaagaccgcgggccaattccatcggcaaaaaacggcgaattgatgacaaatcggtgactcgtgaatcgcccgtaaagcgacgggaaaaggccgcagatgcagcagaacatcgtatgcagcgaccggttctgatgacagctgaacaagcaaagacattggaggcggagcgaatcgaggcccagaagcgcatggctgcagaccgccgagcgcaagagagattgcgccaggctgaccaattcctcaagcaacatcttgctcagcagaagcggcttaagcagcggaatctggtctggggcaggcaagccgcatacgagcgatacatcaatgagcggttggagaagctcaaggccgaggtcaacgctctacggaaatctgcacgcgagtcgatgaacttcacagaaattgacatatgtcagctgaaaataattattttatcaaatagcgtcaaatatttagttctgccaactcgccaagctgttgaagcatattgcgctgacatcattcgctatgccaatcatcatgctgaggaggatgttcaaaaggcaattaaggaacatcagcagattctcgagcgacgacagcgtgccttggatgaggagcggcagcgacaaaaattgcttagcacatggcggggttaacaaattaaatggaattgcttttaaaaaacaactttagacgaagatagacaatgggcatatcgagaagacccagtgcttgctgccgagctcgaaaagataagacagcagaaggagcaaattgatgttgagtatgcggaagagcaggccaggcttcgtaacatcagaagagccgaggaagatgcacggtcgcgagcccgcaatgagttgcttggcctctacgattcaccagaatctggtaaaagcaaaatttgtagtttcgttcgagaccaaaatttcagagggttggtcggacgaagacctgttctacaacgtccgtcaagccgacagaatgcccatcatgcaagaagtgggagtggcgcagatgccgcgggaggcaattcgcgcaagagaggtcatagatcggcgcttgaacttccaagaggccgactatgttggtgagatgacgccagctaacaaaggcgacgacaacagaggtagccgaaagtaaaaaattttgtaagatttgtttttataaggacccggttcgcatccgcactttacatctgtgaacatgcgcattctgggaagaagagacgaagaaaggcatcgaagagcggacagcgtgtgcctcatctgccacatgcagcttcttcgtgggcagctgatcagcgttctgccttgtcaaccgtcagttagccacatcttccactcgatgtgcatcaggaggtggctggcgacaaatcgcacgtgcccagtctgcagacgggatgttcgaatccgtcctttgatgtatgagtcgactcataaactgtcacaaatcaaggaattaagggaccaaacggatgatcatctgcgggcattcaacgagtacgctgagggcttgtccaaccagccgatctcgacacaacggcaggacgacgactttgtggccagggcttggtatgaagtcgttagaacaaataggacttatcgggtttctaggcggcactacgagcagcttctccggcctgaacacgacagaaacggagcagtcatccgtcgaccgatgcggccacggctcgcctacagacaggtcatgcaacacataaacagaggaaacttcgacagatttggtggccaacatctcacctgggacatcaccgacccgaggaacgacgaagaagtcgcataccagatgtgccagacacttcttcaggaacgagccaaagaagatgataaaaattggggatgaatttggaaattttttttgataatttttatttaaacatcatttaaccattaattttcctttttatcttttcttcctgtattttatgtttcacaacgcacaattatatatttatctttctgtcttatctttcggcccaatgatcctgagccattgccttttaaattagcaaaaacacattacttctaaaacaatggctcaggggagggttgccttgcgcaaagagaccaccttcccgctggtgtgaggcgtcagtacttatttgggcaaagctcaagtaaggaagccaagagtctctccattcgaatttgtaaatctgatcaatcgcacgcaccggtagcaagagtctctccttgaaatcattgtctctcacaagtcttgcacacaccggcagctgctgctgcacgaacatccagacacgcatgtgcgcctgagctgctactgcactaacaaccgcgacggtgcacacgttacgcatctacacctcgacgggctagggacagcaatgggtactttgcgcagccctctaccgcgcccggctagttatctatatataaaaaaatggggggggctctttgcaaatgtggcccgcacattgcgaattctgcacctatcgacccaattctttttgcgttagccaactgatctccccttactccaacttcaccgtgcaaaaaaatttgggaggccctcggcgctgagcaacgctaacctgttttcgctaagtgttgcgcagcgcccggcggcgcacagctagcggctgggcgccgcttggcgaaatgcgtgccatgccgtgnggagcatttnaaaaaaaaattggcccgatcccgacacttggcgccgagatatgctaacttttattnggctgtttgcgccatgtgcagccaccttttgcgccccgtatgctagagagtcagaattttttccccgcgcgtcccc

SEQ ID NO: 720 - DNA, 195 bp, Heterodera glycines
gggggcggcagcccccccccaggagaacacccatactaaaaaaaattatttatattatttcctttttcctttcctttttttttcacttccatttccctttccttttttttcactccccttccatttccctttccttttttttcacttccatttccctttccctttcctttcccttccctttcctttttccttctc

SEQ ID NO: 721 - DNA, 4235 bp, Heterodera glycines
ttatatactgtaattatggaggagggggattaatagagatccacagggtgtctccagttaaaattctcgacgcattcagacagcttaaagtcatccggcttaatcccagacccaggaaagtctgttctcgtgcgcagaattgcctggatcagatggcgcataacgcgttcatcagcccgaactccaagcagtgatggcgcatacaaggaaggggtcaaaatgccctcgatcagagagcacatcatctgcaaaacggacggcattcccataataaatttggatcggaatttactgtttatggttttcgacatttttggtggccggaattccgattaccggttttggacatagttgggaattccgattttatacatatttggatgtcggaaatccgcttttcgacttttgtggccccccggaatgtcccatccctggtgtagagaatattttgaattttcggcttttttggctccggcgccaaaagtgatcagaaaaaaatcgatcaaagtttcgacaaaattacttaataaccccgaaaaattggcccacccaaaatgtgttctcctcacagcacaccaacagcagcgaggcgacaacaaatgccatgccttggcaatagccaatctcggggaacagaaatgccagggcacggagcacacggcgcagtggcgcaatgccaacggaatggggccggccgaagcagaaatgggcgggcaaagtgcgcagcaggtccctagtcccggaaattatatttaaaaaaaagtcggaatcggcactcggattggaaccaggccgggatgggatttccgggattgaaattctgactttgtcgggatagtcctggtcccggaattgaaatcccgattttgccgggatcccgaaccgatccggttttctcgtgattttaatcccgaccctgggacccaaatctcgattttgtcgggatcccgatcccgtcccttttcaaaaaaaaagccaggatctggacccaaggaaaatcccggcaggatcccgatcccgcccgggcattccaagattctcgagcccgctaagtgccaaaaacatttttctgcaatttcataaatttgttagcttgacggagtttttggcacttcaaaattttagactgtggtcgagactctcgaactcgttgagtgtaaaactcacttttcaatttggacattgatgcacgccggcacactgtccttggtgcacttccggacaattttcgcgtaatcacatggggctgaaaaaagcaaaatgcttaattaatatatgaataacgacccaagatttgactaatctctgagataattgcgcgaaaaattcgcggaaaattccacaaagtttgaagtgccaaaatcgctatggcacttacggtgcccatgaaaatgccaaaaacggtgccaacaaaaatgccaaaatgacaaaaacggtgtccaaaaaatgccaaaaacagtgccgaaaaatgccaaaaaacagtgcccacaagaacgccaaaaaacagtgtccaaaaaatgccaaaaaacagtgcccacaagaacgccaaaaaacagtgtccaaaaaatgccaaaaaacagtgcccgcaaaatgccaaaaaacgacgcccagaaaatgaaaaaaaaacagtgaaacaaatgcgcaatgcgcacgcacattttttgcgcttttccgcggcactgcacagccgtggccataggaacggcctcaacgagtgcggaatgccaccgtcgttgaccatcggcatgaatttgggcgtgtgccgcaaccgttgcatgtccaccttggcccagcacagttcgtcctccacttgggaatgcgcactttcgatcagtgccaaccaacgcattctgattaattttattttgccatgcatgattaattgccaaaaaaatgtgccatcattagcaaaattttaaatttgatttttagcggtgtatttttcttttttagaaatcccgaaccagaagtatgtttttaaagtaattaatagggttataagttgtatgcactaaaaatccctcaaatatgccctaaaaacccgaaaaatgcctaaatatgcactaaaatatgccttaaaaactgccaaaaatggtttttaaccctcaaaaaaatgccaaaaattgtgtaaaaattcagagactttaaaacaccaaaacaatgactaaggagcgttttcagacaattacaaaacattttaattttaaaactttatatatgaaatttagaatttataaaatttttattttgtgctaaaacaaaattacattttttatattaagaaatttttttcaaaaattttcacaaaaagttcaaaatttttcgatttttaaaggtatttttttataaaaattctcaaaaagtccatccttagggggtgtatttttcgctttttccatttttttacgaaaatttccaaaaaatgagccgaaatatgctctaaaaacccaaaaatggcgaaatatggatttattcccgaaaacccccaaaatatgcttttatatgcactaaaaacattaaccaaatcaaaaaattttaacgtagaaatgctatttttaagcccctttcttcatagcatatgcgtagaaaaaatatgcaaaatcatacaacttataaccctagtaattaacaatatttctttttattataattttttttttgtggtgcgttttttcaaaaactttggaatttttgaaagatttaacaaatttcaccaaaaaataaatttatttgttgtatcaacccttcctttctttaaaaaagcaaaattatttttcgttgaatttttttttttaattttttttttggatttcggaacttttggcaacaaagccgagaaaaaattctggcctcggcatttttatgaaggtaaattgggttctgtggtgccgaaaatttggaaaaattcttgattccaattcaaaaatcaaattgcgcaggacagtgccaattcttttggcattttgtccggtttgaaatcattgattggcactttttttgtgccacctgtgcgacgagctttcaagcggcggcttctccagcgttgggtccaccgtctgctgctgatgatcgttctccgtttcttgcgcgagccgaaaaccaaactcgtcgaacctttggcatttaaattccaaaatttatttcggtttttggcatttaaaaaatgccaaattttgaaatttttacaattccaacggctcctcaaagtattgcggcaccagctgaggatggagtgccgtgaaaggtcgtccgccgagcgggaaaatgctttgaataatttccaacgcgtcctcctctttggcaccgcttttgccaaaactgtcaaatttgtcgagactctcgaccacctcgtcgacatcgtcgtcatggtcagctttcaccaaattggcggcgggaatgccttcgaattaaacaaaattttgtcagtagtgcctaattagggcaaatcggctcagcccatgggaattatttggaattttttttagttttaaacagctcaattttttttttaaaataatgacaaaatgtttcaaattaacgcttttatcccaaaaaatattccaaaaaaaaattattatttttttttacataaaaaattgaagaaattatacaaataatgaaattataaataaattaaaatcatatttttacattgtcaaaatattttcataaaaaaattcaaaactaagacagtcttagaatttttcccaaaaataagcacaaaattcacttgcaaattttgttttaaaatgatggcaaaattcagaaaatagggaagaaaaaaaaaatttatctttttagatttaaatacagaaaaatttttggcgattccgataaaaatgctgtttttccttgattcttttttgaaaattaaattttaattttaaaaagtttggtggagaggggaaggggctgtccccgaaaatcaaagcccccgccgaaaagtgtgccaatgccaacctttttgatattttgccatccgccgacgaaccgattttgtgggtgatggtggttgattcaaaatttgaacaaacaaatacgaaataataatgtccagccgcagaagaagctgggaaagaatggcacacacagcgctaaaaataatgccctgagggcattatcgacggcattttgtcctccctcccctggcaagaggaagagagtgcagagaaagaacacaggggggagacgacacgcaagagacagtgcagtgcgcagagaaagagagtgacgag

SEQ ID NO: 722 - DNA, 3149 bp, Heterodera glycines
  misc_feature (3121)..(3121): n is a, c, g, or t
ttcctaacttgattacattttctatgcttttaaattagatggttgcaattcatagccaattaaaaatatttttattttttaactctttaagttggtgcccaaacttcccggtgcccaaatttctggtgcccaaacttcccggtgcctccgccccccaattaatgagggggaagggagtgataaacaaagtgctgccgacaggtcaaaaaaaaacggaaccaaaatttcttgaaatttttgcgaatttttaaaaggaatttaaatacaattttattataaaaataggtaatagaaataaaaaatattttggcgctactgtaaaggttaccgattttgaaacaaaaggggggacccttttgttttgcaaaattttttaagataaaaaaccacggactgggacagtttagtctggccggtttagtctgaaccaagtttagagcatcataactcttttctttgttgaccaaatccaacaatattggtatcattcgacagctcttaacaagctctatcggcttcccaaaaaccacaaggatataccgacatatgcaaaaattctgactttttggtagtattcatcttgcaacttttttataggtttttcaatcgcttagaaatagcttatcaaaagcttctaaacatatagggctttagaatgatgccaaatttataaaatttggccagctgagaaaaaagttatgatactttaaacttggctcagactataactgccagacttggtgtcccccacccttctttttcacctcctccccccccccccgttcagttgaacttttgtctgtgaatgacgaactcaacaccaccttcgaaaagtacgaccgatgcatggccaattacaacgcaaaaggcgtcgacctttcgatggtggccagcggaagtgggacaaagcgacaaaaggagggggaggacgaactgttgatagacttgggaggagcagcggatggcatcgggacgaagggaattgcggacaaaatggcacaaatcggtgggggagagagggggggggggagaacggactttaatcgtggcacacactccggcacagacattcaccgcgacagaaaccaacgcgaagggaaaggcgccgggatgaggtgaacagccaacgaaactgagtttatgggattgcctgaattgggaaaggacgaggcaaaagtcaaaagttttggttggaaaaaaggcaaccggataaaaaaacgaacaaaatatttcacagagaccggaattttgaaatggccgggacccgggccggtggaaaatgaccaggacgggatcccgggcccgagactcccggtcccaatttttgggccgggggacgggaccccggtccctaataccttatttattgtgccgtcatttctccttttcccattgtcagcaacgaggcgtacgtccacgaccaggccgagttgcccatgcgtacggttgtctacaacaaaacggaaatggcggacgaaaagaacggcgaggaaggtcacacaattaatacacaacaaaggagttcagtgttccccgtttttagcgccggaattgccaaagaaaaagccattggtcgacgacggactctgacgattttagttcaaccaaagccccggaggcaatttgttggcgacatttttatactctttggacagagttccccccccccccccccccctctccgtcccataattttccaattttaactttaaattcactctcctcctttatattgctgcagctttgtgataactaaatattgacacgatattttactgtactgcttgtgtagcgattcgaatgcatcaaatccaccgtatctctgttctatttgttttgcagctaactttggaaatttcaataaatgtttgattatcattacacacagcgtttcaactttggcctttcatttagagacacagctgtgcagggggacggaaagtcgagaaaaagaaggaaaaaattaaaccttttccctttaaaattgagagaagggaacctaaaatgagatggtgctgaaattcagtactgctggtctgatttggccgattggcgagcccggggctgcgccgaggggcctcgaactcataataaagaatactgttagcgttgaagcactaaccaaaaaataaaagcaaaatttactttattgcgtaaaatttgtcaaaatggtttaaaaaaattcaaaattatacaaattatttgcatatgtacatgaaataaaaaaaagtggggggggggggtcagtggccaattttgcgaagggtccgtctggccatgtaaatcgacattttttccctttccaaaccatttttttttggttcgcctgaccctggaacaatgcctggaaaaaaatttcccaaacaaaaagcattcgctttccatgactaattttcttaaaattttggagaaaatcaagtgtttgatgaaaaaccttagacaaaatcagtgattttgcaaaacccgagctcagattcgtgatcaggcttttctgtttcgacaaaactcggcactttttatccgtttttatggtgccatttcaaacagagacccggaaatctccgaaaatatctgcctttaaaaaaattggttgttcaaattaaaataattagtatttatgcatatttatgtaatctgcaagaagtcggaatacacattggaaatcatcagcattttccgtcacttttactctgccgcctgaatgcgtggtgcgactatcagtcccccgcggcgacgttccaagtaacgctgcttcgcttcttcgattgcgttttcgtcgctgcgcttggccagcacttgtctgattcgtgccattctctgtgcctcctcgtcctgcttctgctccgccttctctctgctgcccccgctttcgtcgcccttccgcgctctcttccttccgtcgtctgtcgtcctaccggtctctctctcttccttttcttctgtcctctcccttcttcgacgatgtctctcttcttcgggtcgttgttgtacttcttcccctccttttcccccttcttccgctggtggcgttggctgtcgtctctgtctttttccatctgtcttcttctctttctctccctcctgccgttttctctcgtcccttccttctttctcatgccgntcctcttcctctgttcttcctttttcct

SEQ ID NO: 723 - DNA, 3142 bp, Heterodera glycines
  misc_feature (2920)..(2920): n is a, c, g, or t
  misc_feature (3104)..(3104): n is a, c, g, or t
ttttccgttttaatccgtttttcttccgctccgtcgtcttcttccattttcccctcttcggtcaatggaccgcgggaaatattctcaagcattgttcgattgaatgcttgctgccacattttctggtcccgcacgtctcgcatctctgacagtgagtttggtcggttaaatcattttataatcatcttccccaattgtgccccccccactcttcccgggcacactttcgagtgcctcctcccgctccatctccgttttgtgccgttccctctcctcaatttgctgtcggtacgcccccgtgacgaacacttcttcgtcctcaaattggcccgcctccttttcgcgttcctttttgtaagtgttctcctccaccaacagtttgctcagctcgcgctgtttgtgcgctttggccaacaaatgggcgtatttgggctgaaattgtgccatgaatttcttccaactcaacaagttcaatccgcccattttgtccacctttttctctttgtccgcctccttttgcgccgccactttttggtctctctgctgctgtatttcctcataatgcgtgtcgtagtcgaaaatgtccgggttttttgccaattccttctcaacaattcgctgttctcggcttaaacaattgtttttcccattgtcccccattccattttgtttttccctacgcttttgtcccggccgatgcggcgtatttccgctcgaatttctccgccgcattttgttgttcgtcgtcgtccgattcgtctccaaaaatattggccgtctttttcggccctaccgccgtctcaacgcttttgcgcacattcaatcccatccgaaatttgccattggcactcattttgaagaaaactttggaaaaaagtatataaaatggtaaaggaaatggaatcagtaaaaaaaatttgaaaaaaacaaatgcataataaaacaaacaaaaaaaaagttgaaaatttaatcaacaaatgaatggacccgtaaaaattaacaaaatatatgaaagaaaagaggaaaatagcgacacaaaagttatggagggaaatgccgaagtcaaatggcgtttgaccaatttcaaaaatgtctcttcatgagagttcggcccgttatctgaagggaatcggtttaatacttccatttaaaatcctctctcgtttaaagcattcactaaggcaattattgctaattaatcatattcgttcgatccaacccgtgtccgcattttctgctcccgcttttgcaaaatgcgttgtctcagctcctcctcctcgggcagtccacggtcgcgcgcgtattccgatgccaattcatggattgactgtttggactcgaccgcgtgttgttgctgcgccttaaaacttttaaataaaagaaaaatgccaacaaaacaattaaggcaaaggaggcttctgtgaattctccaatcataagggtcaaccaaaatgttggtctgtcggccactgttcagtccgctcaccctgtacagttcggcaatgtatcgcagcagtgccttcgcctgccgtcggcgctctctccacgacgactccaaccgatggtccaatttccgcttgagttttctgcgcagaatctgctcgaagttgcgctgttctcgctgcaatttgttaattaaaattcaaaggaaaggaccaaaagaattgacaaatttcaaaaattaacaaaattcgtcaagatttaaacaattttccggcccattcgttcctttggggttactactcatttttttaatttaaaatttagttttgtagtcgtgggtttggcgtttctctccgcaccaatcgctgccgtcgctccgctcgcaaaaggcgtcgcatcactctttcgcgttcctcgtgctctctgcgcgccctctcctcgctgatcatttcctccagtcgccgctcctccgcctgcgctcgctgctccgttttgtcgcgttcgtattcgatgcaaatgcgtcgcaggcggcgctgagtgattttgcggatgctcaaatgggcacttcggtcgaagtccacctgaaaatagtgaacaacgctttggccaatgcctttgtgtccgtctcactttgattttcgcctcccgaagtgacccgctagcgcacttttgcaccaacattttgccgcccaaaaaggccatgacattcacaaaggcgccgtactcgcggaattggacgtacacttcgaaaaaagggtcctaaaaagaggcgaaaagggacagaaatggattaaaagttaagcgatgcctttgaaaacaaattcactcattacaccaaaattgctgtccctctgacctgtcccaacagccacgaggagatctgaatgccggagatttcgggctccatttgcttccgcaacgggtcgcactgggggatgtccacgcaggcgacctcgccaaagtcgctgaaaatacgcaaaaatgtccgttccattgtttcatcgacggacgactaaaagagggaaggggaggggataagcattgggaacaattatttatttatttatgcaaaaaagaaaaaagtccacaaaagggagtaatccacttactctgcggacgtgtcatagattaaattgtcctcgagtaatatggattaaacattaaacaaaaaagaaatcacaacaaaattacatataagaatgaggtcaatgattaataaaaccaaatcactatatcactataaaaaccaaatcactatataaaatatataatatctttaattaaagagataattcacttttccggtcattttatacgttaaggagtttaattttagttttaaattgatttaaagaaatttattttaatgattttctttatccagctgattcccacatttttgtagcccctccccgcaagggaataaatttttttcctaatttatatttttgtgttaaacctataaaggggacattanagcgtttagaagggttgaaaatttttaatatatctagatctgttcggccataaacaattttatgcgccatgaacagatcaaacagctttcgccttttctcaagtgttggcagttgcaggtattctaatcgattttggtatggaattggcggaaggctgcatttaaaaaatactcttttggtganatatttttgacacttttcgatttttttaatattttttt

SEQ ID NO: 724 - DNA, 2540 bp, Heterodera glycines
  misc_feature (4)..(4): n is a, c, g, or t
  misc_feature (42)..(42): n is a, c, g, or t
agtntagaaaccaaaaatcaaaagcttacaaaaagcaaaatntaatgaggccacaactgtattaaaggcttgtatcgatagttaaatagagtttccgcttcctttatcgattattaagttattttattcaaatgcaaagaagtagacaaatatttgaattatatttgaatttgttgttgactcactcgaaacgtatgaaaaaactatttgcaaaaggatcaagcaattgctccattttcttgatcactcaaactgacctttttttgcctatttacgtgcaattgctaccaattaatttgacccgaatgtatttttaatatttatttatttatgcaaaaaagaaaaaagtccacaaaagggagtaatccacttactctgcggacgtgtcatagattaaattgtcctcgagtaatatggattaaacattaaacaaaaaaagaaatcacaacaaaattacatataagaatgaggtcaatgattaataaaaccaaatcactatatcactataaaaaccaaatcactatataaaatatataatatctttaattaaagagataattcacttttccggtcattttatacgttaaggagtttaattttagttttaaattgatttaaagaatttattttaatgatttctttatccagctgattccacaattttgtagccctccccgcaaagggaataaattttttgcctaatttatattttgtgttaaacctataaaaggggacattaaagcgtttagaaggtttgaaaatttttaatatatctagatctgttcggccataaacaattttatgcgccatgaacagatcaaacagctttcgccttttctcaagtgttggcagttgcaggtattctaatcgattttggtatggaattggcggaaggctgcatttaaaaaatactcttttggtgaaatatttttgacacttttcgatttttttaatatttttttgaagagacggattccaaacctctggagcgtattccaataaaggcctaatataagttttatataacgtaatccaaatcttagatgatttggatttaattattcggaacaaggaacgcatacgtaaatacgcattccttgttatttggttaatatgatcggaaaattgtaatttgttatcaatgtttactcctaaatccctaattgtatccacagcatttattgtattcccataaaatttataagtttcttttgggttttttgaacccaaataaagtacaaaagttttttgaattgaaacttttatttgccattcgcaccgacttggaaccagtcgaacggcagtccccccacgtagacggtgtccggcctttctcccggctccctttcgtccattgggcatttgccggcggctgaagtgaagaattggtcccaatccacgcgggtgggaaagtccaatttggcctcgtccgctttgactgtcaaagggtcggcgaaaccaatggcacggaaagaagggccattcagcagcgaaatgacctgcaaagggaaggaaattgggtcaaaatgaacgagcaaaggcgaaaaaagccatggtgcataattaacagcactattttaatacttgtgaccaattaagtcccaatcttaaactatttttagcaaattgttttgctatttggcattggtcttcccatttttgtactgctccaattttatgcatgaaattgaaagagtacaacttaaagacgaattctgactttccaaatgtttacaagggcgtagtcagaaaactcttggcttcggggggggggggtgaattcaaaaattcgatttttaggggtgtcgggtgtattttattttttcagatatcccgaattaaatggattttgcagggatttgtaccgttttcaccgcccaaaaagctacgttttgccattttcaaaaatatggtaaattagaggcccctaatgtcagccccctggctacgcgttgttgttcattaaattgtgttttttcggcttttccttcgtgcccgttttctgttcgtcccactcacttttttcatgtctctgtccgtgcccaccgtggcgatgaaatgcacttcctccagcgtactttcgtgcactttgaaatcggtcaactgtgtatttctttcttttttatattcacctcccccccccccccttttccacctcaattgggtgcaacattttcttaagccgttcacggatctcccaattggacctaaagacaatacaattgtttttaatttttgatgccattccgtcgtttgctcacacggactgtcccatttggcgcagtttgggcagtgccacttcgatcatcactttgtaaacgggacgaaggtacaggtcattgtgtgtgaaaaagggtagcaattcggtggaagaagccgaagccatggccaaaaggaaaaattgacaaataatggaaaaaatggaaaaggattaataaatattgagagaatttgtaactaaaccaaataagagtcactaataaagttttatttgaattataagtattatctaattgagaaacaaaaaataacaaaatcaa

SEQ ID NO: 725 - DNA, 6411 bp, Heterodera glycines
aaaaaattccccggtttttcggccactatggaaccccaagaaatcccacccttcatgggaatatttcaggtcgcgaattatttttgccttcattattaacacttggttaggtatttgctcggggttatgaggaaggaatgacataataacagaagagaacagtgcatttgttgtggaggcttcgtggcgatctcataagttttgatttggggcgatctaaaagatgggacggtcttagagttggttcccattttgagcgtttttccgatttagcattttcaggttattcctcgaacgtaaaaatgttttatcaccatcccccccccacagaacgcccttccaaaatggaggtccacggcaaagtaatgtaagtgagcagtgcattcagttgctcgccgccctcttcctcgacaccgtcctctcttcggtcacgcaaaagttgcaaagccttgccaatgccgcgcatcgaccaattgccgggcgtacgaaggcccccagccaaagtatggacatctaacaaaaataacacgaaatatattatcgaaaattccaaaaatttcaaaatggaagacattttagcaaagaatcgagtggacagttcgtctgtttctttgctttccttcccattttcccacccgttgcgctcgccccttccgccgtttcgcttccgtccgttgattctccgctgaaccatcgcgtcgccgtccgttggccgccataaaatgccgtcggcgtcaccgacggcggcggtccgccgggcgttgccgcaccgcgcgagtgccgcgctccaccgttaagcaaacgcgagaagagacgcctaccgccgaacgaagcggcgccaacatcagacacacgacgggagagattgaactgaagggaaagggaacagaaatgaaagggcaaaggacgaaacgaactcccccgactcgtactgttcatgtgtaaattgtatgaattgtctaacagtacggaccgacttagtacgaattgcatttctccaaataaaaatgagtgaattgagtaataattgtttcgactgtaagcattatttaaaaaagcatacgtcaaaacgaccgccgacattcatttctaatccgttttcgctcatcggagtctcaaatccgcagttggccacccgagtgaccgccatttcggcgaaccctctcccgcgagggccgcgcattttcacaaattcaagccgtttcggtgtcattgacgagccgataaagcgttgggcccaattccaagcgccggaagaggaagtttgctgtaaaaaaatgaaaaaattacactaacaaataaaaaaaatacccgcgaatcatagagctttttgagcacatcgaaacgaatggagccaaggaaaatgacggcctctgcgtttcggtaacggtcccggacgaccaactcaacgcagacgcattcgccctcggacacgaccatgtcggtgaacaccttggaagcggcggttgttggtcacactccaaaaatcttattagccagggggcgtgtaccccgaaacgaaaaaagttttaaaatcgcacgccatctgtcgaatttgtaggctaccaaattttactttactgtcaaaaatgaaaaaaacgtaaatataatcatacggtttttttaaacccgccaattttctcccattttttattttgtggctgtttgcttggcctttttattcggcaaaatacctcgtcaaaactgtcgatggggaaaaaaatcttcgggtaagtgacctcctcacattcgccttttgcgtccattcgacgacgactcggcgaagggtaaaccctctgaaaatgggagcatttgaaaagagaaacggcttatgtgcaaagttgcgacaaacttgacaagttttgcgatggatttgcaaatttgtcggcgaattttttgtacacaccgcaacagtgacaaaataatccaactaaataaatgtaaaaattgaaaattacgaatttggggaagaagcacctgctgaaggatcaaatttagacaaacggtctcctgccaattcacattttggtctccgggcatcggtttgtttttgctctgtcgacggaacacttgcaaatgactgatctgacaatgaaatggatcgaagatactcaacaagtaagtacgaggaaaagtctttttcatactcaatacatatgatcccaaaaattttccccggcctgcctattggtatcaccgaacactcctcctcccaaaccccaaaaatttactttaagttcattacaggaagacaattaactgttttttcagtaagttaaacatgaattatttaaacaaaggctcattctcgatttattcagcaagaaaaaactaaaaaaagtctataaaaactgtcttttgcccacctccgagccgacggcacaagcaccgccgttggccattcgcacaatcggcacataccaaagcatgtcgtcgctgtgcgccacacatttttcccatgaacaattggccgggtcgagaacgaactcgcggaacagcgtggaccaacgctgctcaaacggaccgacgacactaacggagggcaaatcatcatctgtaaaagacaaaaacaatcaaatggaaatggcattttaaaacggcacccaatgcattcggtcggtgctttatcagtgcacaaatttgctgcaacagtctcgaaatgcacgcgcattttccgccgccaccgctcggagtgccgccggtcagtgccaacggtgccatcacatttctctttgtttggctttcgtttccttttgtttcattgcttttcagctgatcattagtgttggtggcatttgctgctgaggatgaagccgctgccatctcattttccatgaccaaacgaagcggggagggacaaagagcccatctcaatggcaagcaattaaattaatcgacatggaaataagtataattcggcattaaatgctttcaaattccgagacttaacatgaagcatttaaaaatcagatgtataggcctttcgttctttaaaaaaaaaccaagatgtttgaatttttaatttttgaattgaaaatttaaatttcttgacggatttttaaatatgaaatgggtactgtccaaatttcaagaaatattttctccagtttgaattattattttttattttttttataattttggaggggtttgaatttactttattcacttcatttttattattttttattctccccatttctcttttttcttatgtgttcgctgttttaacaatgagactcgcaataacaacattcttgattttttattctcttctaattaatggtcatgaaaaatcgaatttaattacttgtgtcttttctctttataaaaagggatggattcattcggcagggaaacactgccgccgaaggtagcacccctttaaaaaaattaactttcaaatcactgaaaggatattactagggatttcgggggcgttgaacacgaatttgtcatttattttagccattttcgaaccccattttgaatctacataaaatgacacatttttaatgttgcaatgttttgggattgaatttttactattttaatcaaaatatgaattgtgccggtcccagaatcccctcttgctcagtccgggcgccgtagcccgccggcagaacactcccaaattgaagaagggggatgaatcaatggatttgaatatattttttaaaatgggatctatcatcgacagattaccgggcagtcttaggtaaatgactactgaaaaagaatcatcgagtggctccgacgatgtgattaatgccagcgaatttgccagtgaggaaaccttttactcgcctcctgcccaaaaatcggtgaaggaaatcatcgaagctgaccataacgacgaaagcctgaaaaagtcggaacatagaaaaaacaattaaattgcctcactaaatcttcgagatttaagatataaagagcaacttctgggcgagaatgcttcaggcccggtgttggtggagcccgacaaccccaaaaatgtgcttgtaagacgcatttcgctggtttcggacgaccaagtcaagcacagcatggacctccccggttggttttcacgcattacaatatacaatacactttattttgaaaatgagttactaataatttgttggctctattgcagttcacacgaccataaaattttaatgcatcacaactttttctagaaacatccaaattaaaattattggtatctttcggttagcccaacgagtcctctgttcgtttactaaatttcaaaaaattcattatgtttcaaaaaagctatggccaagaatgtttagaaaaccaaattttcgaaattttctggccataattttttttaaacacaatcaattttttgaaattttgcaggataatagaatgtttaatttggatgcttctagaaaaaatgttgtgcattaaagttgcaaaaaattttatggtcagatgaactggaataaagccaatatgttccccataattttcgaaaaagtttctgaattagaggcccggaatcgaacgaaaagtaaaattcactggtcccgatagcccatttgtggtaatgaatgtatttttaattttttctcaaaaagtggacttaacattactgttacctaaaagtttgttttttctaaatccatgtttatgggtcaaggttaaaatggttattaccatttcgaaaaatggcctcaaaaattcagcaaagggtgacttcgtcttctgcgtgaaagaaagctgcacctatcggatacgcttcgaattcgttgttcagcgtgaaattatatgcggactcaaatacgcacacaaagtgagtcggcttggcgtcggaggttggtgaatttcgccaacccttttataatatgtctttttttgaagtgccaaaagagttgtacatgctcggctcctacggtccccggcacgaaccgtacacttacgaaacatcaccggaggaggcgccttcgggtttttgttttttgaattagaaatttaccactcaaatatattgcgcttgcgggacaaagcgtcacctcaactttattcatgaacaacgccctaaaaaaacccacagaaatatttttaaaaaagttacaggcatatggatttgaacccaggccccaaaagcctatttttaaccaaccgagcaatccgttccccttttttttcgctccgtcgagaatgggtccgaggcagcaaaatttcaagtttttgaggccctgtagcttatgaactaaggtgtatgcaccgctaaaataaaaattctaagagaataaatttaagaaattatttaggaatattaagccggggaaaatatcgagtacattccctcatcaccgacgacgacaaaaacatttggttggattggtcgtggcacatcgaaatcgcaaagagttggtaaattgttaagcgtcgatagattttgtggctcctttttgaatactcaattcattatcaaaatttcaaaaatcaaaaaagggccataatttgttaaatttgttccacctttgcccttcacttattccttttattcatgtgacattcttgtgtacttcatccgttaattgcccaaaccaaaagttgttagagcacgaaattttgcaagtgacccctttacctactatatgttgacctcccgcattatgtcttgttctgtttcgctgccatttcatttattcatttgaaaattcaatcaatcatttacaaatgtttgtttttggttgaagcgggtgttaaggataagaacctggattgagagagaaatgaaaacatagaaaatgtaggggaggggaaaaacggacgaagaagaagttgaggatcatcaacggaggtggggaggagtgcacgcaaatacaaacaaaaagcaatacggattggaaaagtacaactgcgcacagaaagcaaactgggagacatttagaataagaggaggctcaataaaagaattcgatgcaacaatatcggatgaggaggtggtgaagggaagaagggcattttacatgacaaggctttgacccaaaatgcatattttttgtctgctgaaatataaatcatcgaaaagccgaagaatctttggaccaaagcattgacagtctacacaaacaaataaaagtgtctaaatgtaaatacaatattttcaacatgttaagaagaatgctctttactggagggattgagtatgaaaaactataaaagggaaaagaaaaagactagaaagaggggagatttaggtggttaagaactgtgaaccgtgatcgaggcaatgcatttaatattgattttgtatgttttatttatatcattgggatggctagccaaataagcctattaagaaaaaggaatatgaaagcacgcgttttctcgatcctccgattacttataatgtcaacttttcttcggttgtgcgacatttctcccctc

SEQ ID NO: 726 - DNA, 3755 bp, Heterodera glycines
aattaaacaaagctggcacacttttgtcgtaaatgtgattgcaaaaatgaaaataaccaatgaacggatttatatgtgctaaaagacaacccaaatatgtgctaaaactcaaaaaaagtccaaaataagtgccaaaaacgaagaaaaactgttcagtaatacgtgaatttctcaaaaaaaagtctaattttttatccatttcgctagcacaatgctgctaatcaaaagcaatttaatgctttttgacgtaaaattttttctttctctcaaagatttatttatttttcggaagtttcatcgctcaaattcaaatttagcattaaaagtagagagcggtattttgggcaaatacggatcaggaccaaggagtacggactaggcacccatacggactacggactaaaaacccgtaaagtccgtactccgtataaatccgtatcggcccaaaaaaatacggactacggagtacggacccgtaaaaacccgtatacgggtccgacccgtactcgctctctaattaaaagttaaaaaagttttgaaaaatgtaaaagctagagccctggcgggatcgtaaagacaagaaaatatacaaagatcgatttgactcaaacgaaatacttcccaaatatgtggcagacacaaatagtgaattctttaactttgtcgtgttcaaagaatttgagaaaattaaagtttcaagttcaaatatttgggtatattttttgtcaattatcgatttggtagtggtcatcatctgtatttcagttctcagaattttaaaaataaagagaaaaggtaaaaattcatcatacggcggtgaggtaacggtatataaggattttcaacgaatatgagaatgcctactggtgctcaaaatgaattctctcattgaaattctatgcgattttaacgaatgcgaacctcacgaattatctgaaattctacgccagcgaaagaaacaaaatttgaaatttttgagaagacacgcccttataacgagacaccttaggcacaatcagtttatctcaccggatgacattgcatttaacggttctaataggctttttgcctaccgaggttttctaggggttactgtcgaacagcatctctactcgagacaccgtgtcaagctacaattccctcaactcccatgtataactatgtaccagaataacggtcatagatgctattttccccttgaactgctggattttttataaaaatattacggctaacaggagtgggccttcacgttagaccgttccacccccgctagtcctaatatcactttaattttaattcaactttatttaacaaaaaaaaacaacaataaaatacaaaattaacaaaatccaaatggcatcacattaagctcctcatcgatgatccccttctggcagaccggcctgtacattttatgcttctccctcgtcaccactttcgaatcccgcgttggcctaaatattgatttattagtgatgcaaatatttttttttgaaaaactcacccaaaatcattcttgtagacgaagaacgccgggtcgacttcccctttcccgtaattcaaaaccatctccctgaatgtatcgtagtgcaaagtcttcctgttgtccacgtcgaacgtaatccctctaattttcataacatattcaatatcccccgtctgcttgtttctcatcttcagtgcgtactgcttcgcccctccgcaacaatattcttcaatctcatagccgccgtattcctcgctcatctctcccaaatatttccccgtcgtgatcggctccacatcccgatcgtgcctaacaaatatactgtccgtgtccgtgtacaatatttctcctccatttccctccgcttctctcataaattccaataattttaacctcgccatactcgtcgtcctgaaaattagtttatatacaaatttataatttttgaactcaccataaactgataacgatgttgctggacttgtgctccatcacaaagtcctccttgtccctgtagatcaatctaatcgcctcatccgaatactcaacaatatcacataattcaattttatggtcacacgctattttataaaactccgacgccctatctatcaccgcattcttgttcaaacaatttctcatcgaaaactttccctgaaagtgaaaattacctatcgtaatttattttcaattttcttacccataaactatttagcatcaacttgcttatgtaccgcaaccccggattcttcttcactttagccaattcaatgtcgattccatatttttccttatactcttctctccacatatccttctgctcccccgtctcaacccccttcgggaaaccgctcgcctcctccttcagcttcaaaaataatcgcacgtatcccttgaataaatcattcgcctcctcttcgtagtgccacgctctataaaatctgtccacagtataaccgcattccaacgcctttgcctgaaatgtcaaattttcttaaaattttcccacataacttcttaccaattcaacgctggtgtacgtcgccacgtatctccgctgtgccccatcatgggggcaattgtaattacatctcgtagtttccttcttaaatgttgacgcacatctccaacacaacgggaataataatctctcatcacacttcaactgcagaaccggaatccgcaaaccccgcggcgggttgaccctcactttatacaacccattatacttcaaatcctccggtctcgtccaatttacattaatctcatcactcttcggtataataatctccggcaaaccaatcgggtaagctgtaccgtaattcactgacggatacagactcacaatatcgtaaacactaatctttttcttctcatccgatttcgcaaacaatttcatcggcccagtcctccctcccgcataagccatccgcggatcaatcggtcccttctcatttcctctgtccgcgaagaagtctctcatttcctcatcctttttcaattccttctcaatttgacacccctagaaaaaaccggagataaaaaatgcaaaagtcaaataaacatacccaaacttcttcgacgtccaaagtcttccacagctccgccaatctctcctgcgtctcatcattcaattcctgggctgtccttcctccaatcagttccgccgcggggtcataacaattcaaacacccatgtatgtagcatcccatcacttcaatgcacttgtccatagttccttcattcacaataaatccatccaatttatattttccaactttgacctctcgtccattccctgcgtgccgtatctcaactccatctcgctggctccgccactctaaatacttaatggccaccacactggcccgatcacaccgctcatatcccttatccgggacaatcgataattgctcattcaataaaaacattgccttaaaaatattcatcgcgacccccgcattcgtacaactcctcggcaaggggtcaaatcctttcgtaatatcgttgatcaatattctcctaaactcaataatagacaatagcaaaatctccgtgtcgtttctgcaataattcatcaattcatcgttcaaataaaagggcgtctccttgttttcgttatacctgaaaaaaaattttttgttatgctttgtccctcttttcttaccatttttcgaatttagcgtatttctctttattcatagatcctggtgcgtaatcctccatcggtggtagaattgatgtttctcgagttcgcactttgaat

SEQ ID NO: 727 - DNA, 2966 bp, Heterodera glycines
  misc_feature (93)..(93): n is a, c, g, or t
agagataattaaatacaaaaatgtcctgaaatttaggggttaaaaaaaattaaaaaaattaaattttgaaattaccgtcaaaacgcccggcgntatgcgcaaaaatgtacgtatcgtaattcgtaaaggccattaaaatccattccacaaaatcctttgtcggctcgtgtccctccgcctcgctccaatccttggtcctctcatccccgcaaattttacaatttgtcctatttttgtcgtcacagcattccgtacacgtcactctcaccgaaatatatttaataatatgttccttctggtcccccttatacattgtatcctgcgatgtttccgaatcctgaaattaaggcgttttttttttgtatatatatatatattttttttttttgcttaaacttacccaaacgacaatacggtaaacatccttttcctctttttcctctatcggcatgatataacaaccccgtttggggtcgtggcacacactacaaagctggcaataagtctcaccgcattcatgccccttcttcggattaaataaataagtcttatcgcacatcacgcaacgcctccataagttacaagtctgatgtccatgatgataattataacactcccaattgtaaaagtaacgtcgacactttgggcactcaatcttcactccactctccttttcacatggcattcctccaactctattgcagtaataacacctggcccggcactccaatgtgtggtaaacatcacgcgagtaaaagcactcacagtcaatacagaacttcctcccacgattgaaaaagcaaacataattctttaatccatcccaatgaccattctccaaaaatatcggcactacattttcacgacccatagggcccttccacaaaactcggattgatttccgcggatccgcagatttctcaaatgcaacaacccggtatttactggggtaaatctcatcctaaaaaactcattatttgagaatctttttttaaaaacccacccaataattctgaacactcgataaatgctccactccataattcatttcatttccattaatctcacaattccgtaaaagttcatatgccgtctctttctgtcgcacaacattcttcataaaacgaataaacgaatatttatccataaccaaataattcatcgacgaagccagtgcgtagaacaaacaaaatttatccccattagaaatccttaataaatattattattataattattttaattatttcaattattaattttttttttgatttaaaaaaaatattttttttttttgttttgcttattttaaataattatttaaatttattattatttttttttctgtttttctattcaaatattatttttattttcttttttattatttttttttctgttttttttattcatatatatttttcaaattttcattatttatttatttttattttttttgcttcaataaattttatttaaaataattattttaaatttatttttattttttctgttttttccatttttttttttgtttttttttattcatttttttttctattcgttttttttcccttcattaaattatttgaaaatacttaccttatccgctgatgctccttgaatccaaaatcaaatttatgaacattcctcggcccctctccaccgggcattgtcacacacgttattttcatcgtaatttgctccgagagcaacagcattttcttattttcatctccgtccccgctctgccccaacttattaatctcctccagaatcacatccgcattattctgggggaacgcccgatacggcacccacaccgggaaagcaagcccggcgcccgtaattaccactccaaacatcctcactttccgattcattttttcttccgtagtcttaaaagccactttgatcatgttgtcgaccgcgtccttaatcgcttcatcggggcgtcccacatccgggttgatcgtaaattccgcaatgttcttcgtaaatccaaatttttcgcaaatcgtcgaacgataatccatcaatttaaaagtttccatttcttcaataaaattgtttctgaaaaattattgaataaaattgtctcttaaatatattattaaaaattacttacccgattgatctaaaatcccattttttagtcgacggtccgctttgttgagaggttccattgcgttttgcagccatttttaataatatttaataatttctaaatatttacgcacaatcttattttagcaaaatccaacttttggttgaactgattgggggtgaatttggagagcttttatatggggtgagtgatgtgcaaaattggacctgtcaatattttgattgacaggtgacctaattttggtccagattgcgaaatattgggaacaaaaaaaacaaaaaagtcacgtgcatatggcgaaatgaacggggaaattgcgaaataagggaccaatcaatcattttttggtccatattgcgaaatacttggaccaaaaaactaaaaataatggttaaatttaaataaaaaaaccatcaatcattttttggtgacaggttttcaaaaatatttgtctcatattgcgaaatatttggatgaaaaaaaaaacaaaaaaaaaagtcagttcagattgctaaataatggaaaaaccatcaatcaaatttattggcagatgacctacttttgaaagttttttttcccatcctattttatttattcattttcaatttatatttaaatagttaattttattgcccaattcattaatttatttatctgcattaatttgctgcaattattaattaaatttacacttctacaattccattattgattaatttgcgcggcggcggcatcgggcgcggggaaggagggcgttgaggaaatgcaaaaaaaaacgccctttggccaatttttcaaaatgggttttaatttccgggataaaaaatcctaaaaaaaa

SEQ ID NO: 728 - DNA, 9787 bp, Heterodera glycines
gacccttagggggtcctagggccatgcattttcccaaccaatcgactcttccaagaactttggaaggagggccactcttgggatgatgccctctcagaagaggactcaatccgctggaattctatccaaagccaatggaaagaagaggaaatcagaattcctcgccgcgcaatgctcaatgacacacagtcaattgagctccatgcatttgtggacgcatcggtccacacattcgcgaccgcgatatacgtacgctgcgccatgaacgaaaagattcaagcgtggctgattttctccaaaaatcgtttgaagccaaagagtgcctcaaaggcactcacgatacccaggatggagcttttggccatcctggtgggcaccagagcactcaaatttgctcaaaggcagttgcgccgtccaattgccagccttcatctttggagcgattcacaaatcgctctgtcatgggtcaaaacccatgaaactcaaccacaatttgttgagcgaaggctgaaagaaatccgagaatgtctcggatgtaccttccactttgtccgtactgcggacaacccagcggacctcgcaacacgcggagcaactccttcggagctccgcaaccatcatctctggtggaaagggccaacttggctcacacaggagagccatctttggcccaactaactctgtttccaagtaacagagtctgaccaacaaatctcggagaatgttggcccgagtggtgcgtttctcgcatacactcactcaaagcagccaaatgagcaggtcttaattgacccctcacgcttcagctcatggaagcgtctaatgcgaacgacaatgttcgtattaagattcctcgccttaatgtttaaaaggggcgaggaaacggttgcttcacttgcgaagcacagaaaggaaattcgccagatttccaagtctggggacttcaaggcggaagacttcgcactcgcagagcgagttctcatccgcctagaccagatggatgacgctgaagaattccagcactttaaaacagtgattggagacgacggaattctccgtctgaaaaccagactggagatgagtgagaagccatacagcttctctcatcccattcttctcgccaaacattccgctttggcaaagctgatcatcttggatcggcaccaaaaaaggcatcaccttggagtggacactactctgacagaattcctgagcgaattctggatgccaagtgcacgtttaaatgttaaacgagctcttcgggactgtcttttctgtcgccgaatgaatgcacaacaatttgcattaccaaccatgccacccttgccgggtgagcgagtgcgccgacacgcgccatttcagtccattggaattgactatctcgggccaacgacaatctcgttggccggagaaaaaataaaggcatggatcctcatcataacatgcctcgccacgcgcgctgtctaccttgaggcaacattggacctcacatcggaatcattcatcaatgttctccgtcgattcataagtcgacggggaaaacccgacatcatttggagcgacaacgctacgacattcaagctcgctcagaaaaccctggagcttctcagtgctccggggccggatcaggaagtacaaaacttcctgacccataatcgaatccagtggcgattcattgcccaaataagtccttaagcaggaggcttttacgagcgcctcgtgaagctagtcaaggactgcttcaagcgaactttgggccgaaggattctttccttcgaccaactcaacacattcgtggccgaagtggaggccaccctcaattacagaccgattactgcggtctcagacgcagtggatggaccaattccactgcgtcccattaatctcttacaaccagagattcagatcaattgggaaacaacaacagacccaattgattcagaggaacagttttcctccacgcacgaacgtttagcttcccgaatacaagcacttcgggaagccaacgacgttttctgggccaaatggcactctgagtatttgacattactcagagaaagagcccagtgggaccacaaaggcccacgactccaaaacttcggagaaccgaaggaagggatggtggtcctaatctctcaggacctcgtcccccgcaatcaatggccaatgggacgaattgttgaaacacacggacggcctggagccatccgaagtgttaaagttgaaatccctgtccgagggaccaacaacgggaaaccaaaggacatgccacgaaagacagtccttactcgtccagtgaaccgcatcttccccttggaagcgggtcctgaaatgaccaaccaagcaacagaggctgtttccgccgttgaacaaccaaatgaaaaccaacccaagctcgctcaagagccaggacatcaaatggtcaccagaagaaaggccaaactattggaaatacttccagtagtggctttgaccatcctcgcgcttgcatttccatttgcaagtggtttcccaatcgggaaatgtgatgagtgtggcctcacttgttacacgaaaggaatcgttgtgacagtgccacccgaaatccaaaagttcgaaatatgctgtgcagaaagctgcatagttcggcaaggcatcaaagccttgaacttcgaactaccaatcgaagtcctactcaacaatcatcactgtgaggccagattttggactgactcacagcacaccttcacatcaaacacgacctgccaggcagtcgatgaatgtgttctcatcgactgctacttttgtttcacacaaattgtgaatccaacatgccagcccgtcattgcggcaatgctggcaggaggcctgtccctaagcctcctgtgcttcatcttcaccatgtgttccatggtgggatacgccatggcaggactgagaatccttttttggattttctcagtcttgttcgcgcgcttattcaagccgcaaaaagagacatgggtgttgagtgaagaagaggaaaacctcctctatcctcaccgacgaatacgccggcacaggccagcaaacaagtaactgggccagtggccgagttagccaaatgacaatgcttgtcatggcatctcttccgtttgtacacgggggaattgagacagtggccataatggccaaatcagagagctgtctcaacaacggcacaacgaaaatgtgccaagtcaagggaagcgtaacccttgcgcttctcccggcaggacaaccgaatgtcctgtcaatgaagaccgatgatggtctcattttgggaacccttcaagtgatcttgaaggggctctctctcgaatgccaagcatacaccaaggcttggaaacgatcatacgagatcgcttccgtggccagcaaacgatgtccgtcggctggctcatgtgtcggtgacttttgcacaaaagtccgaccctccacagccatccgagagctgagggagaccgaaacgttccccgggaacagtttctgcatagacagcacggctttttggggaaaccaatgtctcctagcagccagttcatgtctcttctacaagtggtttgccaaaccacgctcatcagccatttacgaagtcatcggatgcaactcttgggagtttggcatccatattcaacttcgcctcgactctaccactggaagaagtgcgacagtcgaaactgtgcttcttccaggccgtgtgctcaaatggcacaacatcagcatttcaacaataggagtgagccaagcaccggctcccctactgaacgctgacttcctgattgaagggcgaagtgtcgcccttgtccgtgagaaaatcacggactctttccattgtacagacttgaaagccgcccaagctttcaattgtactctgggaatcgacgcatgcacgggctgtcttcccgatcacacagacgggacagtctcgtgccattgtcgcgtcgccaatctcgagggactaatggaagaccctcagcggagacttccgctctcattccgccattacgaactgcggaatcacggaaggcgaatattcgccataaccggatatagtccggtccaaatgaacattcaaatggacagccttcaaatgtccttggaaatgcaccagagtttgtgcacaatcacaccaaagcacatctctggctgctacaaatgtgcgacgggagctcagttttcctactcgtgccacactgacattggccaaacatttgccgacattcaatgagaagatggttcgcatttcacgagcaaatgtggcccgaacataacggaccacactgtcgtgctcccattccagcatcccgaaataagcacgacatgccaagtcatgtgcttggctgggagaaccaaattctccttggtgggacaactccattacatcccactccgacaacagtcagaattcggagcccgagtctccgaaagcctcgaagaggccagcaactcaggctgggctgacttcagtttcgactggaactccacttttcatgctctgtttggccttaaaacaggcctaattttcttcattgtcttgatgatcggcattcattggaagaggctccctatgaccaagaggggcccaacaggggatccccgtctcgacggttcttcgaggccattggcctccgaagaggcaatccgaatgttggcgaaatggcggaaaacaatggccgccaagcgcctctccaacgcggagagcgagccatggactatggccgccccaattcaccggacggcagctttgagaatcgcccacgaagggcggtccccaaccgtccaatgcgccgttggcagaacggccttttcattgtggccgtggctttgtgcctcggcaatttggcggagggaaaggaattcccttcgccaaggacttgccatcagccgcttgaagcggcggacatggcacgtgaaaatcaatggggattttcaccaatgcctttcccatggccattttcccacgatcagaaagcaaatctgatcaagggaccccgccctttaaatggcagtcagccctatataaaggcagggattttccatgtccccacatcattccacaccccaaccatgccaaaacccatcaaaatgccctcctcgtcgccctctgcctactcatcatcatcatcattagcatcatcgccggatcgccagtcgccgccaccgccccgcaaaaaggcggtggaattgttcaacatcgccgcagcgacaccggaaagggacgcaaaaagcggacggaacttttccgtccgcgatttcatcgacgcggaagcgaaggaggagtcgtcgtcaaaacgcatgccgacatgttcggcgtgccaactctctggccatcgccgcggggcaaaggcctgccccctttatgttcctcctcaaaaggagcgaacggcggcagcgagccgccccggcacatcaaacacacgccgcgactcccccgaggaaggggagatcaccgccgataaggcgggccgcgatcgcccaccggtaagggctccctccaaaggttggagggcagagccctcgatcagtcccccccgtaaaacgggggacaccaacaaacagcggggaaggtctcggaccctccgccatttcccaatggacaccattctgaaagccatggggccgatcgccccaatcaaaaaaattcccgcacaggacaatacgggaactgtggcgaacacgcagccaccaaaggccgccgcggacattgtggccattctcggagagctttccgctctccgcgcctctgtggcgtacttgacggctgagcaggcccgcctggctcagttcatccgccaccgcctgggcacaccgccaaacatgtcgggcggaaatgcgatgccttgtggccccgggcgtcggcgccaccatcagcgacagccaagctcggaggacgacgagcacccaacacaaaagcgggcaaagcaccaccaccatcgccgctcgccgtcgccggacacgcaacacaaaccaaagaaagagcgccgacaccaccgcgaagaatttcgatgatgccgcgggggggagtttgtcgctgacagcagcgacagatcttatcgatcgccagctgtttttgtttttcccacgctttttgctagtgatagtctaattaagttttttcctctgtgcccgccctcacattttcggcttataaaaagggcacccttttcattatatgctcacttccacatttccattcattcatttctgctgctgcttaataaatatatatgtgtgaaaagagtccgggggatttggtcgggacggttttcccctcccccttctgctgctcagcgtctgcgtcgtcgtccgccccgcgtcggtcttccccgcaggagtctctcactcctgcgggccttcgcttccaccggctcgtccgtcccttcccccacatttgggaaggcacggccgagaaagggaaagggggaagcaaacagctgattttgcccttggcaaagtcggctctcgcctccctcgctccccacaaagtttttgtcgcctccttggctgcgacaggtcagccccaatgttagacaaaattgctcataacgccaaataacgcaattggcgtaattctttgagcgctaattcattacactggtaaatgcatttataaattttttagtttatcgccggcaaaagataaactccgcaacttcaatttttttccaacgacgccagcacctccaccgatggggttggtgggggggggggggggggagaaactgttaataggtttttcataattgattatttttaacgctttttgggtgtcttttagaatcaaatttaaatttttttgttttttgtgttatttagtaacagattttgcaccaataatgcgataagctaataatttggtataaaagttcaaaaattgtaatgctcatttttaagggcatcttgaattcaaggatactttcaaattttcaatgagagagatatgggagagagaaagtgagtaagaataaatacctatttgtggtccccagagagaagaagagagacataataagatacagagagagagagacaaagagagtgagagagaaagtgagtaagaataaatacctatttgtgggccctaattacttatatattttggttcaaaataaccaatcgtgggtttttcgagggtgctgctcacaatctaaacatatgtatgcctaattcagaaccccggactcatatttcgaatatttatatttgagggaaagagcgcatgagagaggtatagtgagtcaaagtgagagggagagatagtaagtgggaggagataacagagagagattgagtgaaaagtgattggagcactatgggtcaacccagtgttagacaaaattgctcataacgccaaatagcgcaattgcttaatttttgcgcgctaatttaaattgtacactgttaaatgccttttttattattttttttatcagccataactcgcttagttccaaccaaaccggacaaatttaatatctaaaaaaatttttgcaaaggagaatttttttctaatcgaatgctaagcaatttgcgtctcagaaaaaagtaaatttttattaggttataactcgtctaaactgttgttttctaccaaaatacgaaaactaataattttttattgattctaaatgtccaagttattttgtacccttataaccaaaagtattcgaatttgcaaatttctattttttcatgtgctagagacatgaaaatagtacgccaaaatgagggaaaaagaaatgcaatgcctttatattatcattttaaatgagataaaagcgattatttcatttaaaaaagtgaatagtaaatgttgttttttacaccattaaaaacgaagagatagtatgccaaagtgagagaaattacaaagaaaaaaagaaacaacgatatagtactaggcttttatttgcacagtggagttagcccatagtgtttgagtaaaagagagagtgagagaagttgggcattttgaggaaaattttacaaaaaagcagagagaatgaaagagagtatttaaaagagagagacaaagtgagagggagggagagataacagaaagagatagagggagatggagatggaaagaatgaaagggtgaatgcgaaaaaagagagagataaaatgaaaaaagagagagagagggaaaaaatgaaagcgagagtgagaaagaaaagagagagagaaagagagagataaagagcgacaaaaacaaaagcgtgagagagatacagaaaaattgagggaaagagcgaatgagagagttagacaaagagagaggaagagatagagaaatgaggatagataacagagagagagagagagagagagcggaataaaaaggaaagagagagggaaagagcgacagggtgaaataaggaaagagatagagagggaaagagaaaagatagaaaagaaaaaatagagagagaggtataaaggaaagagagagagaaatagtgaaagatagagtgagaaaaagagagaggagagggagagataaaaaggaaagagagagagagagagtgaaacagaaagtgagaaggagagagagagcgagagggagagagagataacaatgagagagagagagagatggaaagagtgaaagggagaatgcgaaaaaagagagagcgagagtgagaaagagggagagagagagagaggaaaaaagtgaaagagagtgagaaagaaaaagagagagataaagagcgagagaaacaaaagcgtgagagaggcacagagagagtgagggaaagtagcatgagagaggtagagtgagacaaagtgagaggaacagatagggagagggggagatagagagtgggaggtgataacagagagagattgagtgaaaagtgattggagcactatgggtcaacccagtgttagacaaaattgctcataacgccaaatagcgcaattggcttaattttttgcgcgctaattcattacactggtaaatgcatttataaattttttagtttatcaccggccttaaaagataaactccgcaacttcaatttttttccaacgacgccagcacctccaccgatggggttggtggggggggggggggggaaactgttaataggtttttcataattgattatttttaacgcttttagggtgtcttttagaatcaaatttaaatttttttgtttttgtgttatttagttacagattttgcaccaataatgcgataaaaaagcagagagaatgaaagagagtatttaaaagagagagacaaagtgagagggagggagagataacagaaagagatagagggagatggagatggaaagaatgaaagggtgaatgcgaaaaaagagagagataaaatgaaaaaagagagagagagggaaaaaatgaaagcgagagtgagaaagaaaagagagagagaaagagagagataaagagcgacaaaaacaaaagcgtgagagagatacagaaaaattgagggaaagagcgaatgagagagttagacaaagagagaggaagagatagagaaatgaggatagataacagagagagagagagagagcggaataaaaaggaaagagagagggaaagagcgacagggtgaaataaggaaagagatagagagggaaagagaaaagatagaaaagaaaaaatagagagagaggtataaaggaaagagagagagaaatagtgaaagatagagtgagaaaaagagagaggagagggagagataaaaaggaaagagagagagagagagtgaaacagaaagtgagaaggagagagagagcgagagggagagagagat

SEQ ID NO: 729 - DNA, 1561 bp, Heterodera glycines
  misc_feature (19)..(19): n is a, c, g, or t
aaataaaatttatataatnagagcaaaaaattgcggatttttgtagtattttactcttctctaatgacttttcagaaccgagttatgaatttttttctgaaaaatcgaaaatttccagaaattctggaataactttttttcttttgaacattataaaaccaaataaatctcataaaattctcccgattttttgctatttttaaagctttaattcacttaaattgaccagtcctccattgagttatgaattttcaaattttaacccaaatttccaaggaccaaaaaaattaaaaatattttcgaatttttaaaaaattgcaaaaaatctgaaacttaaaataaacatcatatttgtgctcaggaccctaatttaccccagaaaaaattttttcaccctctttttcaacccaaaaaaaatttttgaaaatttctagggggcctagctcgaaaatttttgaaaattttcgaaaatgaagtataccgttcgatagagcttaaaaagctctacaattttgctctaaggccatttttggctaaaaccaacccctgacgagttatgggcccgggactcaaatgtcccgctcaggccaaaaattttttctatttccggaaaaaaatcgaaatttttccaaaaaaattaccagtcgatagagctcaaaaaatgatgttttggaagtggtctccgtttttcctgaaaaattcgttaaaaattcctaaaattcaaaaaccaaaaaaccgttttttaggcctagcttgaaaatttttcaaaaatttcgaaattttaaaacttggttggatagcctttcaaatactacacatttttgctcagaaacaatttttcggtcaaagcaacccctggcgagttattcgcctggtactgaagtgtacacttttgggtaaaaaaaattagccaaggctacagccttgggcgcccaacgtagggcttaggttttgctggcaaagttgtcggggatagtctgacttaaaatcctaccagcaagagctaagcgatcccggtccaaagaaaaaatttcgtagaagaaaaactgccagcccgagtgacaaatcgcttctcgggactcagtcgtccgcgctgaatttttttctatagttttcccggattctcctcaaaaagttgtaagacccttccaccactttcagggcgctcccggccttcggccgggagattttgttttttgaaacgaaactcaaaacctatataacatatatactagcgggtgcgtgaaccgtcggctatttcgctgggaaaaagcgcttcgcgctttgggagcttcgctacctagatttgatcgaattggttggagagatttttttgaatttttaaaaaatgattaggggtttttagtccacatcgaggatcaagacgggcgcttcgcgcttgttttttaaatctgttgaacttacatgggcgcttagcgcccgttttttagcttgttaggcgcttcgcgcccgtttttcaatttttgttggccttggacgggcgcttcgcgcccgttttttaaatctgttgaacttacacgggcgcttagcgcccgttttt

SEQ ID NO: 730 - DNA, 2917 bp, Heterodera glycines
agtgattaaaagtggtacaacagtgattaaagggggtacaaaagttattaaaaaacgtacaaaagtgattaaaagaggtacaacagtgattaaaagaggtgcaacagtgattagaagagttacaacagtgattagaagaggtacaaatttgatgaagaggtacaaaagtgataaaagaggtacaaaagtgattaaaaaacgtacaaaagtgattaaaaaacgtacaaaagtgattagaagaggtgcaacagtgattagaagagttacaacagtgattagaagaggtacaaatttgatgaagaggtacaaaagtgataaaagagttacaaaagtgattagaagaggtacaacagtgatcagaagaggtacaaagtgattagaagaggtacaacaatgattagaagaggtacagcagtgattagaagaggtacaacaatgattagaagaggtacaccagtgattagaagaggtacaagtgattagaagaggtacaacagtgattagaagaggtacaacagtgattagaagaggtacaacagtgattaaaatttgaacaaaagtgattagaagaggtacaatcatggattaaaatgaaataaataagaaaattgtattattggatgtattataaatttatcaaattaaaaaatccttttacttattaaaaataaagttagaaatttataatatagaatatttattgaaattgaaaggaactaatttctcgaattttataaaaatttaattcaaataaaaaaatgtaatttattattaataaaataaaaaatattttaaatgaataaaacaatgaaaacacgaaaaaaatggtagttattaattaaaaacaacgttggaaattattaattgaatatttatttaatttgaaattaaattattttttttacaaattcaaaaaaaaaaatgaaattctttaagttaaaaaaaataaatttaaataatttaaaagaaatcttcaaattaattaaaaacagtcaaaataacccaaaaatgcacagaaaaataatgttacaccgtccggattcgaactttgcacccccccccccccaaaaatgatgcctcagaatccccaatcacacagggattctgaggtcttgactatgtcaaaagttaaatctgattacgtattcgtgatcagcgtcataaaatacccctaaagacatgtttttggaatattttcggtgaaaaaatttttccacccaaaaatcctggtcacccccctatggtcccgaaaccaaaaatcacttttatttttataacaattcgcaaaaaagagataaaaatgtaaaataaaatttatattatagagaaaaaaattgcgaatttttgtagtattttacttttacagaatgacttttcagaagggagttctgaatttttttctgaaaaatctaaaatttccagaatttctggaataactttttttctttagaagatagaaatcccaaataaatcccataaaattctcccgattttttgctatttttaaagctttaattcacttaaattgagcagtccttcattgagttatgaattttcaaattttaacccaaatttccaaggaccaaaaaaattaaaaatattttcgaatttttaaaaaattccaaaaaatctgaaacttaaaataaacatcatatttgtgctcaggaccctaatttaccccagaaaaatatttttcaccctctttttcaacccaaaaaaaatttttgaaaatttctagggggcctagctcgaaaatttttgaaaatttcctatacatatagtacaccattcgatagcatttaaaatgctctacaaaaatgttctaaggcattttttggctaaaaccgacccctgacgagttatgggcccgggactcaaatgtcccgcttaggccaaaaattttttctatttccggaaaaaaatcgaaatttttccgaaaaaaataccattcgatagagctcgaaaaactatgttttggaagtggtctccgttttgccaggaaaattcgttaaaaaatcataaaattcaaaaacccgaaaaccattttttaggcctaactcgaaaaattttgaaaattttcgaaatttttaaatttcagaaaatcgagcttccaaaactctacaataagtccgctggcagcccttcggtcagatcaaaccctggcgtggcattcatctggtactgaagtgtactttttgagcacgcttcagttgccattttttacaggccaggggtttgctcaaaaaaatttttaaaaaataccaccttgtagaggacccttaggcggagtgccctttcagcgggcactttttgattcgagttttacaaaaaaagttaggggccttcaaatgcaaacaaaagtgagaattcagtccctggtactcagttggccctcggatcaaaaaacctatagttttcccagatgcgcctcaaaaagttgtaagacccttccaccactttcagggcgctcccggccttcggccgggagattttgttttttgaaacgaaactccttgtcaatataacgtatatagtaactagggtgcacagttggctttaaagtagaaaaaatacttctgtaaccccaatataatcggtattgacataagcgcttcgcgcaaaggactccgttgctagttcttgcgcggacatgaggccagtttattaaccgtcattagcggttagacaattttttttgtaaatttaaattgtccaacccccagggtccaccacgcggaggagcacggtgggaaactggcaaaaaccatggaccccactcgccggggggtgagatccaaactggaatccccggcgaggagctaagctctgaagaaagtacctgaaaaggacggggggtgaactccaaactggaatccccggaaatgcaatgtgcgctatctctcctcgaactctgaaa

SEQ ID NO: 731 - DNA, 3902 bp, Heterodera glycines
  misc_feature (7)..(7): n is a, c, g, or t
  misc_feature (52)..(52): n is a, c, g, or t
  misc_feature (3743)..(3743): n is a, c, g, or t
  misc_feature (3775)..(3775): n is a, c, g, or t
  misc_feature (3848)..(3848): n is a, c, g, or t
  misc_feature (3852)..(3852): n is a, c, g, or t
  misc_feature (3861)..(3861): n is a, c, g, or t
gacgacngatatacatttctgcataaaaaagctggctcatcaatacttatcntttccattgctttcattggtcttaacgtacgaaaaacttgggcctttgaatggatatttatagagatattttaaatttgtgctttgcccatatgcgtattccaggttatggtgggtctcaaaatgaaccaagatatatgggttataggaggaaatacgagaattattataaatgacttgcgctttgcctcgctttacggataaggtttgcccgccatcttccgggctcggacgaaaatagatcgctggacggtcatcatgaaggatggtaaacttactaaacggcttggggaatcccttcttgcattttcctttattattaagacaatgtggaccgcagtcatggaattgaaatttcggtaataattcacgtactttacgaatgaaatttgcccaatctgatttatcattttttgctggttcttcaggtatatgcgcccatattatattatcaacattctcagggatggcaagcaaacttgtgtgataaacacgatgggcatgaggaccgccgtatttcttttggaactcacggcattcttgaccaatcatttttcccaaaatatttttctgatctatcaaataatgtaaatggctaagtttatcctcataaatacgacatattaaatcgggccgatctacggttttctgacctttatggagaaaattacgggaaatttcacgccaacgcggattggttgtgaaagtgagaaagaatgaagcgttgcctggttttttaaagcgtgacattattgtggtagcatcataaaatttgtgttggaaatacgctcgtgtgcctggctctgatctgcggaacataacaatactccccaagtcttctgtggagctaagaccagcattacgtgaaagccagcgaagggcattttctggaagtgtactacgcaaatttaattcgggacgacgtaaataatttgcaacattcgtatcaattcgcgccgcgtaatcaagtgtaaatttctgacttagtccgccaccggaactccaaatgttgtgaatgtttttgtgttttcttaacgccatacgatagcggatatacgacctaatagataaaaactgccgcggaccgcgtttgtcaacagaatcaaccgaactggcaacggactcattgtcatcatctgatgcatcagcatctgaatcaccagtgttctcatcagattcgacatcaatctccatggcctcattcttttcgggcttatttaacggattgtatggaattttaaggtgaaagccatcatcaccatgtggaaacatcaaagggtagcaaagagaatctgtgagtggatgatgtggagggaattttttaagttttccttcgtcattggtaatccatatccctttcaaaaagggtggctgttcactttcagcccaaacggcaaacaatgaattcccctcatcgggtaaattggcttgtctcgaatgaatagaaacgtctcgaacacttgccggtgcatctcgagcctcgacgagcgttaaacggaaattaagtacagcctctgggcctttctcttttagagtattctgatattgtttatggaagtttaccaactcttgggcaagagggttatattttcgaataataaaatcaagcttttttattgtggtttcgtttactcgatcaccaccatacgctatgttctgagtcctttgcatgaaggctgtaacagggtcaagaatgtataattgcgaaaaggatggagaaaattttccgggtaaagttgagcctatttgacgagtgaattcaccatttaacaaatagcaaacatttccatcaagtgatgactcacggtatccaaccgaaacggacgcaaatgctaacaatgaattataaacattttcattagacaaaaattccttagcctctgggtcttgccctgacaagtagcgttttaatgttgggggatattcttcgtaaggaggcaaaacaacagaaccatgattacaacaatgacttgatgaaaattttccattctttttttcggcctcgctattcagtaaaagagcattacaataagcacaaattttatctccgagatttcccgaatcataataatcagtggtgtgcctggcacgtacatctgcgcaaggaattccctggtgtttggtatggcaacgcctggttatatcattatgaggcatttttggaatagtatctatgttatcatcggaagatacttcattactaacacttttttgaagacggagcgatcgacgggtagcagtactcaaattacttgtagaaggtggcctcaaaataacatcaggggttctatcaatatcaggttctacgcaaataaaggctccatctccatccctcggacatgtctgttcaatattcgactccacattatacaaaggcaatcgttgaggattttgaggtccatttgtcaaatttcttccaatatattctacgtcatcattatttatcaggtgcgccaaatgccacaaaattctccgcctctccaagttaatgtttaaatttgggaatttcagtgaacaatgatttaagtaggcctcagaataaagcagaacaaatacgccacaattaattccgtcatgttggggtgtaaattctgatggacttaatgtcctaattaccacatcatcatgagaaagaccaggtgtcaattcacaaattccgtttttaattatttcaattcttctcacatcatagccagggtattgaggatcaaaaagtctatcataatgcggcaaagaatcaataaatagacaaatcaagttatctcggtcacatcggtcaaaaattattaaagcaaaatgaccattaaagaaaatagtcatcaacaaaatgtcatagttctctgaataattaaagcagttatccatcacattatatgggaaagcatgagggccaacatgaaaattttgtaagtctgtgtattgtggattaacaactgtaactattttgtcaactatttttgatgaaagataacgttgaaaacaatagactaaatcatcactgaacatttcgttaggtatagaccacgcctctttaatgagatctttatttattgactgaatacatacacgtccaggggctataggttgcgagccagggatatcaatagaaccggaattcaataaggtcaataattcattagaaattatagattgattttcttgggcttgattaatattttcagtatttgagttcatatttccaacgttcatagacaaattgatgctatccggctttttaaggcgacctggtccgccactccttttctttgggcgacctcttcggttgccactacattttgaagaatcagaatcagagcagtccgaataatttaaaggttttgaaagagaggatccacgagaaaggtcagacattaatatttcattattcacttgattataacgggaacggaattcgacattatctgaactgcataatgcattcacatgccacaaaattctttttttctctgaaataatatgaatgggttcaagaataagtgagtgatcattgaaaatccatgattcggcaaataaacaaatgtagtatccacagctattaaaatcaggctgttgtgatacatttttatcagctatatttataacatcaatatcaacaccaacaaccatggaaattacatttttaataagctgacatctgtcatgttgaaagtttttattcaaaggatccattncgggaaggatcttgcttcagagaaatcatganataagtgccaatctcttggtctaaatggcaagtgcccaaatgatttgaagaatacggaaaacgattatttctngtgnaaatattgngtcaaaataaaacacgctcttttaagtgtgcgtttattcct

SEQ ID NO: 732 - DNA, 3162 bp, Heterodera glycines
  misc_feature (17)..(17): n is a, c, g, or t
atcatcatgagaaagancaggtgtcaattcacaaattccgtttttaattattcaattcttctcacatcatagccagggtattgaggatcaaaaagtctatcataatgcggcaaagaatcaataaatagacaaatcaagttatctcggtcacatcggtcaaaaattatgagagcaaaatgaccattaaagaaaatagtcatcaacaaaatgtcatagttctctgaataattaaagcagttatccatcacattatatgggaaagcatgagggccaacatgaaaattttgtaagtctgtgtattgtggattaacaactgtaactattttgtcaactatttttgatgcaagataacgttgaaaacaatagactaaatcatcactgaacatatcagtaggacaagaccacgtctctttaatgagatctttatttactgactgaatacatacacgtccaggggctataggttgcgagccagggatatcaatagaaccggaattcaataaggtcaataattcattagaaattatagattgattttcttgggcttgattaatattttcagtatttgagttcatatttccaacgttcatagacaaattgatgctatccggctttttaaggcgacctggtccgccactccttttctttgggcgacctcttcggttgccactacattttgaagaatcactaacagaatcagagcagtccgaataatttaaaggttttgaaagagaggatccacgcgaaaggtcagacattaatatttcattattcacttgattataacgggaacggaattcgacattatctgaactgcataatgcattcacatgccacaaaattctttttttctctgaaataatatgaatgggttcaagaataagtgagtgatcattgaaaatccatgattcggcaaataaacaaatgtagtatccacagctattaaaatcaggctgttgtgatacatttttatcagctatatttataacatcaatatcaacaccaacaaccatggaaattacatttttaataagctgacatctgtcatgttgaaagtttttattcaaaggatccattcgggaaggatcttgcttcagagaatcaatgaaataagtgccaatctcttggtcatagatggcaagtgcccaatgattttgaaagaataacggaaaaacgattatttctgttggaatatttgggtcaaaattaaaacacgctcttttaagtgtgcgtttattccttttaacatgaatatcagggtcagtcagtacggagtcgacgaccactgttcggcgagtggattttattgcaataagacagagatatgcaaacgttagctcatgatttaaccaagaatccaaattataaaatgccttttcaatcacattttgaccagaattaacatcaggaacattcaaatttgcccagcgggcaatttttgcggactcatcaattcgctgaataaattcaaggcttgttaaattagcaaaatctatctcttcaagtgattcattcaatggacaaccaaacgatttatcttttttaggaacgggagaatcaggacaaatgttttgttttttccaagaactttgaggtgtattcaaatgaaccttttcaaaggaattggctaatggtgtgtgtatattctttggtggtcttcctctcttacgagagtttgaattttgtggtgtgcttaaaacaaagtctgaaacaggggaagaagcttcactatggtccgaggtccataatgaggacaaaggtcgttccacgctccgcttcttccgcttgttcttttcattccattgctttgaaggcatttcattcactaaatatatgaaaaattaagccaatttaataatgcatcataaatatatgaagaaaataactttgaaagatgcaaaaataaaattatttatcaatagaaaaataatactaacgatgaaaataaaaacatgaaaaagaccatagtgaagcttcgtattttaaaaagaaatcgtataaaatcagacaccattagccaactctatttctaggtagccgcctaattctgaatcccagttctcgatgtttttctcgccttaaatccctatatttttcaattgtatcgagtaccgaatccgagtactgtctgtataccgacgttttcctcgtcctgacccaaattttttatttaatgaatattaaatatattacagcaccccaccccatcgcgaggacgcaattttgtcggaatcaattaaaaatcattcctagaatggcatacaagacgaattaaactttcgaaaaaccaacactgagtgggaaactaaacccaagagatacgaggattgatgcacccctaataaggaccgagagaaggaagcaaatatttcagcaaattactatctcaatgaaaaatgaacgacagtgaattcgttgaatataatctgtcacccccccccccccggtaccgccgtcgaacatgacgaactgagtacatccatgatgtaccaaattggaaacgaagagggcaacgaatagatgctgcaaattagtaaaaataggttaccaagccataaaatcatataatattgaaattgacatttctggccaaaatggtaccgaaaatacacaaatctattcatttaaatgccgtaagtgtcaatttcgatgaccactgatttttcaaaaaaaaaattgacactataggaatttgtggaagactgaacagatttgttgattttcggtaccattatattcggctcgacaagctggtaaaatagtgcctcattcgcacggttttgtccacttttcgacaaataccgaaaagtgtcaatttcaatgaccactgatttttcaaacaaaaaaaaattggcactattggaatttgtcgaaatccaaacatatttgatgattttcggtaccattagactcggctcgacgagctgagtaaaatggtacctcattcgcacggttttgaccacttttcgacaaataccgaaaagtgcaatttcaatgaccactgatttttcaaaaaaaaaaaattggcactattggaatttgtcgaaatccaaacatatttgatgattttcggtaccattagactcggctcgacgagctgagtaaaatggtacctcattcgcacggttttgtccacttttcgacaaataccgaaagtgtcaa

SEQ ID NO: 733 - DNA, 2501 bp, Heterodera glycines
  misc_feature (2384)..(2385): n is a, c, g, or t
  misc_feature (2440)..(2441): n is a, c, g, or t
  misc_feature (2448)..(2448): n is a, c, g, or t
tcgctcccccacaaaagttcttgtcgctcccttggctgcgacaaaatgggagccccgtaggggtcagttgttccttgccgaaaggacctgacctccatcaatcggccgtagccgccgatcaaaagtcttcgcccgctaaggggtgaagaacatcggctacagtcgccgatttactttctccctaccgaaagggaggaaggctcattcggccatcagcagccgactcttcatcttgcccaaccagtggcaagacactcggccatcagcagccgactcttcgtcttgcccaaccagtggcaagacactcggacatcagcagccgactcatttagcctaacccaacaaagggaaggctcattcggccattgcagccgctcattagcctaacccatcaaagggtaggcacattcggccaccagtcgccgacttctccatcttgcccaaccagtggcaagactcattcggccatcagtcgccgactcatttagccgaacccatcaaagggtaggcacattcggccaccagtcgccgacttcttcgtcttgcccaaccagtggcaagacacattcggccatcagcagccgactcatttagccgaacccatcaaagggtaggcacattcggccaccagtcgccgacttcttcgtcttgcccaacaagaagcaagacacattcggccatcgccgccgactcatttagcctcacccaacaaggggagacacaaacggccaccagcagccgaatcttcgagtcttcaccaacaagggttaaaggactccggccatcagcagccgaacctcccaaagcaggagaatcaacatgagcgggccaatccgctcaaaaatcgggccttgtgccgcccgtaccaaggcctacattgaggcggccacggtcaatctcggaaaggacacgacagacgagagcattcaagcagacctcacagcggagcgccgtggactccgccgagcgattcggcttttggaggattgcaatgacaaatggcaatccctcctgctcaaattcaatggagccgaccgccaacaagaggagcaacgctacgatgactttaagccatcgggaaagcacttcatggaatgggcggacaaagcccgaggtgcagtggacacgatcgatggagtgatcggtccagaggatgacgacgaaataactgggagcattatctctcagcccgccaatcctccacaaattcaacatgttcagcctcacccacctcgccatgaggtgaatctccctcccatttctctccccaaatttgcgggagagccaagggagtggccgatgttttggaggctcttccgttcctcagtggacaaccttccaatcgacgacttcaagaagcacatctatttgttggggtgccttccccacaactcgccagctaggcgggcagtcgacttgtacccaccctcggacgaaaattatccaagggttgtcgacatcttgaagaagcgatttggtgatagtaaaactatcactgagtccttgcaggcagagctactgcacctccccaagccgggagagtcagtgctctcgctccgcaactttgcagagtccgtggaacgaatctgtttccaactaatggacttcggcgaatctgaggacaacatgttcatggcttcgacgatcaagtcgaagcttcctttctccatcctcacccatgtggtggagaaagagctttcctcaggaaagacattttcgtgccttgacatcagaaaggcacttcaaacaatagtggaagtaaaggaggaagtgcagagatgtgcacatgtcctccgaggcgatgaacgaccacgttcatccgccttcaattccccacctcaacagaggggtgcctgggatcaaaggggtgaccaccgtcactccaacaaccgacggagccaaccaccaaggccatttaatcgcggaggaacgcctcagccagaatatagggcgttctccgctattaacaaaaatccggaaagggccaaaaccccagcaagaaaatggggtcggtcctgctcgctctgctcgggaactgatcatctcccgagcgagtgcccggcattcccaacaccgggagctcgtcgaaaacggctgaaagaacagcagcgctgcctcaactgccttgtgcaaggtcacaacactgaggagtgcacctcaccataccgttgccgaaactgtggcaacaaacaccacttcctcatatgcttcaagagggaggagtcccattcacggtcaaatgggaatcgttccgcttcctcccccaagtcgggaagagagccaggagggcgaaagttccatcagcggcaggtggaaagccagacccacctgatcacggctgggtttcaacagaacgatcagtcaaaccctcccgccagagaggnnggagatcgttcaatccatggggatgtccaccgtggacaccagcaaagggagagcnncacaggntccccagtgcaaaagccgcacgcgtatctgatgacgcgacggctgctggctaa

SEQ ID NO: 734 - DNA, 6651 bp, Heterodera glycines
  misc_feature (928)..(928): n is a, c, g, or t
cggacatttatataaagagtcaatagtaaaaataatcctctaagcttaaaagacccagaataataggatgctgtttccgtaggcataaaacattaattcattcattttaatcgacaggattttattagagaatcacgcagaaaatatttaattatttttaaaactcaaaaaataaaatagtccaattgctcctcagatatatgatgttgtctaggatttccacatgaggaggtacgacttaagagaaatagcaatcgttaccgaacatttatataaagagtcaatagtaaaaataattcaaaaatgcttaaaagacccagaataataggatgctgtttcagctggcataaaacattaattaatcgacaggattttattagagaatcatgcagaaaatatttaattatttttaaaactcaaaaaataaaatagtccaattgctcctcagatatatgatgttgtctaggatttccacatgagggggtacggcttaagagaaatagcaatcgttaccggacatttatataaagagtccatagtaaaaataattcaaaaatgcttaaaagacccagaataataggatgctgtttcagctggcataaaacattaattgattcattttaatcgacaggattttattagagaatcatgcagaaaatatttaattatttttaaaactcaaaaaataaaatagtccaattgctcctcagatatatgatgttgtctgggattttcacatgagggggtacggcttaagagaaatagcaatcgttaccggatatttatataaagatgtcgcagaagcgacagatcttatcgattattttttcccttcccgcatatttttgttccctcccccttttcactgtaccacccgcccccgactggcctatataagccagtcaatttcgcttatgtcttcagtcangtttttgtgttccactgctcacttccacatttccattcattcattttctccttctgcttaataaatatatatttgtgaagagagtccgggggatttggtcgggacggtttcccccgcccccttctgctgctcagcgtctgcgtcgtcgtccgcccagcgtcggtcttccccgcaggagtctctcactcctgcgggccttcgcttccaccggctcgtccgtcccttcccccacatttgggaaggcacggccgagaaagggaaagggggaagcaaacagctgattttgcccttggcaaagtcggctctcgcctccctcgctccccacaaaagtttttgtcgcctccttggctgcgacaaaattggagccccgtaggggtcagttgttccttgccgaaaggacctgacctccatcaatcggccgtagccgccgatcaaaaagtcttcgcccgccaaggggtgaagaacatcggctacagtcgccgatttactttctccctaccgaaagggaggaaggctcactcggccatcagcagccgactcttcgtcttgcccaaccagtggcaaggcactcggccatcagcagccgactcttcgtcttgcccaaccagtggcaagacactcggccatcgccgccgctcattcgcctaacccatcaaagggtaggcacattcggccaccagtcgccgacttcttcgtcttgcccaaccagtggcaagactcattcggccatcagcagccgactcatttagccgaacccatcaaagggttggcacattcggcctccagtcgccgacttcttcgtcttgcccaacaagaggcaagacacattcggccatcaccgccgacccaagtctcacccaacaaagggagacacaaccggccaccagcagccgaatcttcgagtcttcaccaacaagggttaaaggactccggccaccagcagccgaaaactcccaaagcaggagaatcaaaatgagcgggccaatccgttccaaaatcgggccttgtgccgcccgtaccaaggcctacattgaggcggccacggtcaatctcggaaaggacacgacagacgtgagcattcagcagacctcacagcggagcgccgtggactccgccgagcgattcggcttttggaggattgcaatgacaaatggcaatccctcctgctcaaattcaatggagccgaccgccaacaagaggagcaacgctacgatgactttaagccatcgggaaagcacttcatggaatgggcggacaaagcccgaggtgaagtggacacgatcgatggagtgatcggtccagaggatgacgacgaaataactgggagcattatctctcagcccgccaatcctccacaaattcaacatgttcagcctcccccacctcgccatgaggtgtacctacctcccatctctctcccagaattcacgggagagccaagggagtggccaatgttttggaggctcttccgttcctcagtggacaaccttccaatcgacgagttcaagaagcacatctatttgttggggtgccttccccacaactcgccagctaggcgcgcagtcgacttgtacccaccctcggacgaaaattatccgagggttgtcgacatcttgaagaagcgatttggtgatagtaaaactatcactgagtctttgcaggcagagctactgcacctccccaagccgggagagtcagtgctctcgctccgcaacttcgcggagtccgtggaacgaatctgtttccaactaaaatggacttcggcgaatctgaggaaaacatgttcatggcttcgacgatcaagtcgaagcttccgttctccatcctcacacacgtggtggagaaagagctttcctcgggaaggacattttcttgccttgacatcagaaaggcactccaagcaattgtgaggtaaaggaggaagtgcaaagatgtgcacatgtcctccgaggcgatgaacgaccccgttcatccgccttcaattccccacctcaacagagaggtgcatgggatcaaaggggtgacaatcgtcactccaacaatcgtcagagccaaccatcaaggccgtttaatcgtggaggaacgcctcagccagaatatagagcgttctccgcgatcaacaaaaacccggacagggccaaaaccccagcacgaaaatggggtcggtcctgctcgctctgctcgggaactgatcatcttccgagcgagtgcccggatttcccatcaccgggagcccgccgaaaacggctgacagagcagcagcgctgccacaattgccttatgcaaggccaccgaactgatgagtgcacctcaccacaacgttgccgaaattgtggcaacaaacaccacttcctcatatgcttcaagagggaggaatcccattcacggtcaaatgggaatcgttctggcccttcccccaagtcgggaagaaggccaggagggcaaaggttccctcaacggcaggtggaaagccaaaaccacctgatcacggctggatttcaaccaaacgatcagtcaacccctccgacaacagaggggcagatcgttcaatccatagggatgtccaccgtggataccagcaaagggagagccaacaaggctcccaagtgcaaaaaaccgcacgcgtatctgatgacgcgacggttgttggccaagtcaaatcgtgacagccgaaatataatcaaagtagcagttctctttgacccgggaagccaaacaacgtacggagcggatccgcttatcgagaagctccgcccgcacaaactcacctccgaagaaatggaggttcacgggtttggaggaaaacgggagccgttacgcttccattcacccatttactcggtccttctccaaagggaggacggaaaatgggaggaaattctcctcaatcggacggagaaaatctccactcacttcagcatggtcgaatggaccgctgatgaatccgtcacgaatcatcacgaggtctgtgaagcaatgtgcttcaccaatgaggagccaatgatactcctcagcgcaagacacttctggcaattcttccaagggaagagagaagtgtctcccgggctgtttgtgatcaacacatcgtttggcccgctgataaatggcgagtccaacattggaccgccgaactcaaatcaaaaagctctgtcaatgacggccatccaccgcacaaatgtggaacaaatgccaaccatcaacgaggttgagcatttcttcaacctcgaatccctggggatccaggatgatcctgcccaggatgacgaccaaacagctctgaagctgtttaacgaatccatccgtcaggaagctgacggaagatactccgtcaaatggccgtggaaggagtccaatccggacctctcttccaatttcaaaatcgcccacagcaggctgtcatcggtgctaaccaagctccgacattctccagaaattctggagaagtacgatgccaccatccgcgatcaactgcaacagggcatcatcgagaaggcccaaagggctcctggacagcttgagcacttcctcccgcaccatggagtgctcaccaaaaagctacgcgtcgtttatgacgcgagtgctcacacacgcggaacaccaagcctcaacagctgcctcttccgaggcccagtgcttctgccagatttggcaggcatgcttcttcggttccgttgcccgacctttccgcttctcgcggacattcaagccgcatttctccaaatttcattggagccggaagaccgggaggtcacgaagttcctctggctaaaggacacttcaaagggactgactcccgacaacttggcaatatttcgattttgccgagttgcgttcggggtcgtcagctcgccattcattttggcggcgacactccgccatcacttgcaacagttcgactccccactgtccagggagatttcggagtccatttatgtggacaatgtactcctcgagtgcgagacggtacaggaagccttggaaaaatacaaattttccaaggacatcctccaacaaggatgcttcaacctgagggaattcatctctaactcaaatgaggtgatgaaacaaatccctcaggaggatcagcttgataagccgaaggccaaagtccttggccttccttgggacaccgagaaagacgaaattgtcttcaaattcccaacaactgatccattgaggccagtcacacgaagactggtcctcagccatctagcatcgctcttcgaccctttgggggtccttgggccatgcattttgccagccaaacgactcttccaagaactttggaaggagggccactcttgggatgatgccctctcagaagaggactcaatccgctggaattctatacaaagccaatggaaagacgaggaaatcagaattcctcgccgcgcaatgctcaatgacacacagtcaattgagctccatgcatttgtggacgcatcggtccacacattcgcgaccgcgatatacgtacgctgcgccatgaacgaaaagattcaagcgtggctgattttctccaaaaatcgtttgaagccaaagagtgcctcaaaggcactcacgatacccaggatggagcttttggccatcctggtgggcaccagagcactcaaatttgctcaaaggcaattgcgtcgtccaattgccagccttcatctttggagcgattcacaaatcgctctgtcatgggtcaaaacccatgaaactcaaccacaatttgttgagcgaaggctgaaagaaatccgagaatgtctcggatgtacctttcatttcgtccgtactggggacaacccagcggacctcgcaacacgcggaggaactccttcggagctccgcaaccatcatctctggtggaaagggccaccttggctcgcacaagcgagtcaccattggcccagcgaactctgttttcaagtaacagagtcggatcaacagccatactcaacggagaatgttggtccgagtggtgcgtttctcgcacacactcactcgaaccagccaaatgagcaggtcttaattgacccctcacgcttcagctcatggaaacgccttatgcgaacaacaatgttcgtattaagattcctcgccttaatgtttaaaaggggcgaggaaacggttgctttactcgcgaagcacagaaaggaaattcgccagatttcaaagtctggggacttcaaggcggaagacttcgcactcgcggagcgagttctcatccgcctagaccagatggatgacgctgaagaattccagcactttaaaacagtgattggagacgacggaattctccgtctgaaaaccagactggagatgagtgagaagccatacagcttctctcatcccattcttctcgccaaacattccactttggcaaagctgatcattttggatcggcaccaaaaaaggcatcaccttggagtggacaccactctgacagaattcttgagtgaattctggatgccaagtgcccgtttaaatgttaaacggactcttcgggactgtctccattgtcgccgaatgaatgcacaacagtttgcattaccaaccatgccacccttgccgggtgagcgagtacgccgacacgcgccatttcagtcaattggaatgaacttttctcgggccaacaacaatttcgttggccggagaaaaaataaaggcatggatcctcatcataacatgcctcgcaacgcgcgctgtctaccttgaggtacaaaactttcctgacc

SEQ ID NO: 735 - DNA, 3238 bp, Heterodera glycines
  misc_feature (56)..(56): n is a, c, g, or t
  misc_feature (60)..(60): n is a, c, g, or t
ccactccgacaacagtcagaattcggagcccgagtctcccttcaaggcgaagaggncagnaactcagggtgggatgacttccttttcgactggaagtccacttttcatgatctgtttggccttaaaacaggcctaattttcttcattgtcttgatgatcggcattgtgatcatcattttcgttgtacacttctctcctgtgtacaagttatggagaacatttgcttggttgctcatgaaccaagctccgcgacccaacaacgccacaactttttccgtggctgccattctctttttggcggccggaggatccttcggatgggaacctcgaaaaggggattctttccccgtttcatgcggggaattaagaatccccgaccccgaattttcattcagggaagcagaggggaatacagtacccctccatcaaaaaatcgattaccgtaatcgatcgccaaaaactgatataaaagaaggaaatttgatgacaatttcattccttcgccatcatcaagctccaaacaacacccagcgcctcagcaaaaccatgccgattccgttccgagaacggccaccttttttctcggcaccaacaatcagccgacccacaaacgaagtggtcattaatgaccgcctcgtcatcgacatcatcggccaatacgaagccgagaacggacagagagcaaacaatgctcctcaacccggggctgacaatgctcctccgcccggggccgaagaccaaagaggcccctggtggttcgaccaggattgggggccccagctcccaatggtccctgaaaacaatggccaaaatcgccaaatggacgatcagcgagacgattggggagcccatgctcctccccgacgggaaccatcgccccgtgaacacacggagcgcctgaactcatgggttgagcgacaccacggccaacaatggtatgagacggctaccattcgccgtgaagcggaggaacacctccgccgagaactgcgcaccggtgccacgctttttgcggcacacctcggtccattcgctaatgtccgtttcgacgggttttcgcgctttggaccggctaacacgcaaatgtttccgggacggactgtccgggaacatttccgacggcgcgggttccaggtggacccgaatttgccatgcctccaagagtatggaggcttcagcaatagccaacaaggaatccatgtcgattactttccaatcgacatggtcaatgtccgattccaaatcggagcttatcaaagggaagctgagccccctcgtcttccccgaataagagcatatttggcattggaagaggctcccaatgaccaagaggggcccaacaggggacccccgtctcgacggttcttcgaggccattggcctccgaagaggcaatccgaatgttggcgaaatggcggaaaacaatggccgccaagcgcctctccaacgcggagagcgagccatggactatggccgccccaattaaccggacggcagctttgagaatcgcccacgaagggcggtccccaaccgtccaatgcgccgttggcagaacggccttttcattgtggccgtggctttgtgcctcggcaatttggcggagggaaaggaattcccttcgccaaggacttgccatcagccgcttgaagcggcggacatggcacgtgaaaatcaagggggattttcacgaatacttttcccatggccattttcccacgatcagaaagcaaatctgatccgatgactccgccccttcaatggcagcggaacctatataagggcagggataaggtatatcccaccatcacttgcccttcccaaaatgccgaaacccatcaaaatgccctcctcgtcatcgtccgcctattcatcatcatcatcatcatcatcatcatcatcgccggatcgccagtcgccgccaccgccccgcaaaaaggcggtggaactgttcaacagtctcgactcgagaaaaatctcgggtttttttggtctcggtctcgagtctcggtctcgggttttcaagtctcggtctcgattttcgagactcgagaccgagacttttttacacccctaatgattgttggcctttggtaaacttctattttataaattttaggttcttttttgttcaaatttgttaatatatgtgtggtccagcgggttgtgttcttggttttgttccttatttttgcgttggatcagttcccctccaagttttattttttcttctcatttttcaaaattaatgtttttttcgatgggagttcaaacacaattttaacaattaaaatcgtaaaaatgtcatttttggactaaatctattgtcgctgacagcagcgacagatcttatcgatcgccagctgtttttgtttttcccacgctttttgctagtgatattccaattaagttttttcctctgtgccccgcccctcacattttcggcctataaaaagggcacccttttcattaaatgctcacttccacatttccattcattcatttctgctgctgcttaataaatatatatttgtgaaaagagtccgggggatttggtcgggacggttttcccctcccccttctgctgctcagcgtctgcgtcgtcgtccgcccagcgtcggtcttccccgcaggagtctctcactcctgcgggccttcgcttccaccggctcgtccgtcccttcccccacatttgggaaggcacggccgagaaagggaaagggggaagcaaacagctgattttgcccttggcaaagtcggctctcgcctccctcgctccccacaaaagtttttgtcgcctccttggctgcgacaaaattggagccccgtaggggtcagttgttccttgccgaaagaacctgacctccttcaatcggccgtagccgccgatcaaaaagtcttcgcccgccaaggggtgaagaacatcggctacagtcgccgatttactttctccctactgaaagggaggaaggctcattcggccatcgccgccgctcattcgcctaacccatcaaagggtaggcacattcggccaccagtcgccgacttcttcgtcttgcccaaccagtggcaagacactcggccatcagcagccgactcttcgtcttgcccaaccagtggcaagacactcggccatcagcagccgattcatttagcctaacccaacaaagggaaggctctttcggccatcagccgccgacttttcagcctaaaacaacaaagggaaggctcattcggccatc

SEQ ID NO: 736 - DNA, 1430 bp, Heterodera glycines
  misc_feature (1370)..(1370): n is a, c, g, or t
ggtaaaagttaagtttaccccccccccctttttcgaaattttttttttgtttttaaaagtcatgaaaacatgtttccatgggttttcggggtcgctgatcacgaatccggcacccatttcggccaattccgaatcccgtacccgaattcgaacaaaaagccgaacattcaaattccaacatgcacaaaaatcgcaaaatattcaccaaatatgcacaaaaaaaacttgagatttagaggtgcaaaataatttaaaataaaattttttcctaggattttcaaatcggaaaatatttgacaaaaaatggtaaaacatgcatgaaatatgcagaaaattcaaaatatgcataaaatccggaacccgtcagttgggtcccagcggttttttggctacaacttttttctttgtcttccaaatcaaacattgttggtatcattcgaaagctgtaaatgtcctctattagcctgcaaaatgttgaaaaattaagtaaaggttcaaaaaatgatgggcagaataacttaaaaaaccagattttccaactttatggccacaaatttgttcaaaattgacgaaattttttgaaaaaattcaggctaatagagcatctgaagggctttcgaatgataccaataatgtttgatttggtgacaaagaaaaaagttatagtccaataacctgctggggcccaactgacgtagaccgtaaaaacccaaaatctgcaaaaatatgcaaataaaagtcccgactattatacgcaaacacaaaaagaaagtgtttttccctactatttagagcatgcagaagccagggaaaaaaacatttacatattttttgaacgcgtaaaaagttaagggcattttttcagataaaatattcagttttttgaatgcatttttatgctaaacatatgaacacccattttttttaattaaaaatgtgattgtaatttttctaaatatttttgatcttaaacatatcgcgaaaaacgaatggctttttaccgattgaaccaaaagttatgaattttggattttttcattttatgaagctttgaatgtgtctctcaacagttgcatttttttacaactctaatagttttatccgccccctagtcattactgctcatcttaccaaaatcactgctcattgtgcagttcaccgagatccccactctcagggctgcatttttatgtctgcaatttatgttaaaataagtaaaaataaaatggaagttcgtttttcgatcgttttttcactaaaatcagtaaatttatgtttatttttttcttctaaaattactttaataccggattcgttcattttatatgttttacgaaattaataaactgagaaatattattcctaaattntgtaaaaacacatgcccgacattagccatcctgataggaatcagcagctttaaaaatatt

SEQ ID NO: 737 - DNA, 1588 bp, Heterodera glycines
gcaatagcttagaaaaatcttttaaccatgttaagctttcgaatgttaccaacaatgttggattggttgacaaggaaaaaagttatagtcgaaaaaaggtgatttgcaacacaaaaatcactgccgcaatcgcttatgctttctttgtggcgtatgcctttttcttgcaaacaatttgctacagacatttcatttgccgtgtttgggaaaagagaaacaaaatttagggcatttgtatttaaggggaagaaaaatgcgaaaagaatcgatcccgtcctttcggtcgataatttatgcaaatggggaagggcgggaaaattcatgcaatatcgaatttacgaatgattgatcaccaaagaacataaatgactaattcatttaaaatgctaattatttaatcattcggcttatttggtaatttaagttgttggaatttgaattaatcaatttcaattctttttaaacatgtgtttttatgatcgataaacttcaacctatttaattgaaaaataaataaatattaaatcagccagcaggataaatgagaaattaatatccccagattttggggtttaagccatttaaaattatcgcttttagaggaggattataattaggatgcgatttataaaaaggtataaagcgtatccctaattataataaaggaaatcaatgacaaaacgaatctgcatcaaaaaccgggaataaatttgggttaacaacaatttcatctcagaacatttttgatgaatcaatgcaattattatattcatttggaaaaagattgccatagacaaagaaggggaggcaatttttggagaaaagggataatgacagcacaaaacacaaatggaagaagagggaaatgaatggctgggaaaaagaatattcggcaagagaacatttggggatggagcgaatgattaattagagcaaatgaatttgacgaaacggaagaaattagggaaaaatttaacattatgcataaaattatgaaaatttgaatgctgcggacggacacagcaaaaatgatgaaattaatgtgcaattatcaaattggtcaatttgggtccacaaacgctgtaagaaagcagggggacacaaaagaggtacaacaaaaagcagatgggcatgtaccaaaattgagcaaatttttaaaattttgcattttagtcaataaaaaaacggatgggaaaacccgacggcgggcgcactaattgatgtatttgtatcaaaaatgaacgaaataattattttgtttcggaaaaaattaccaaaattaatgagcaaaaatgagacatcaaaaatgatcagctgatcaatttgtccattcaataatctcaaaaacagctgatcatttctcaattatatttcactttcgcacagttcggcacccttttcagccgctttttcttttgattgtggagataattgcctaaaaagtcaattcatcaaaaaaataatttaaaaaaactttgcttgagtccatcaattccttcattaagcatttgtttggaaaatgttgaaaacctagtcttttaaattcttctggttataataattaattttaaatataaatttattttat

SEQ ID NO: 738 - DNA, 1320 bp, Heterodera glycines
aacaggcttggcaacaactttcgttcagcgaagtaaccttctcaccataataaccaaggacaggctattgaatgaaccaaattccggttggttgatatccgttccccattctttaatcaataagcagacggacctgaacaggtcattaattcggaccaacgtggccagccacacagaattgtagacaccattcaatttctctgatcgtccaattgtcaaatcaacgtggaattccaacttaatttttaataccggggtgtttcctctcgctctcaattccatctctgttcgcggatatttttgccttaaaatttgtcgaacctttcccaattcgtcagcaagacgaactgatgtttggtcgaacttgtagatgaaaaggtccaagtccgaaccgtgtcgagccaattgacataatgaggaaccaaaaactaggacttgacaatttattcccgcatatttgagccactggttcatcctttctgacaatgcaaatttctcatttgtcttttcctccgtctcggccacttcgtctgcgtggctcatcaatagttcactgattgagttggcttttgtcgaattttttggtttatctttagcttcgtctgtgcttgttatttcgagattttcgaaactttttaagtcgaatacctcttcctcaacaggaatattttgaaaattttcttccctattttttggccatccataatttggctgaacagcccgtgttgtaccttttggtgttgcctccttcacatcatctctgagttgcatcaacaatcgtcccagtgtgttcgaaccgttccactgttgtatgtccgctgttggccatttgtcataaatgagtcctggtctacaacccaccccccaaaactggtcgggtgataattcgcaaattatggccgatccagtgctcaacagcacatctttaagatcaggcaccgaaaacttggctttaagtgcttctttcatgatgccaattttgagctcagtccattcttggacagtcacttcgtcctccccgttcatgtttgcgaatttcttcatctcaaatgcgcttattcttttgccatatctatttgtccccagcataatcgcatccgccgcgtcgaaacgtttcagatacaacgctttttgggcacagtaatactgctccacacatcggtaggttcttccgtggatgacgaattcatacgcttcgttgaaattcgaaaagtaaaattgctgattaaaaaatcctagcaattcgcctctttcttcacccggacacggcggcaaaatggtgctctgtcattgatgaacggcggaattggcgggatactt

SEQ ID NO: 739 - DNA, 8125 bp, Heterodera glycines
tttccaaaaatcgtaacggccttgacccggaaactgctgtggcgggtggaaacgtggatttgagctggactgatgttgctgtaagtcctcaacaggacggattggtcgaattgcctgagtccattcgctgtgcgatggttggtcctcaacaggacggaaccttttcgactttgttgcgcccgaactatgatcatcagaaaatgattgttggcatcgcttcttatacagcgcacttcctcccctttgagtgattcgcggagcacccataaacacaagtctgttgatgtcaagttctactgtctgtgccggttccagccaggcgacgccttcaacatgtattggactaccaatccagaccgccggtttggcccatcttcccaaaaggctcaaaaatggtctgatgtgctcggcccattccgtcgtccgcacgacgaccatctgacaaacatcattaatgatgacgacctctggtaaccgatgccaccaggcaatgtccctgagtgagtgcaccagaactagggcacggagcccgttgtcttggaatgtccgtccaattggttccacttcgtcatccccgacgaatgcgatgggagcgttaataataacccttttttctccaacgccatcccaggggcgcctttcctcaacaggaatttgtgaaatgccctttctctcatccttcgattcttcctccttgtgttcgtcctcgagatctctttccatctcttcacaatcaagagacacggcatcgaagtctctggccatttctgaaatacatgtcacattagttataccatttatcactctcggtggttgttttgcccatttatagtgatttggggaatttgccttaacaagcgccttattttgaggaggttcctttgcccaattataatgaatttgtttcacagaactgtgttcctgctttctaatgccagagtcagaattattggcattttcggctaattctaagggatataagtgcttaatagcacgttcaataattgatttttccgaaattctgactctcgcagttcgttgtgacaaaatttcttctattttcctcaatttccaacaatttcttggagtttgtggttcagaaatgatcaccacgtccccaagttttggtgcttttcctggcgtgtgtttgttcccttgatgacgttcccttagacccaataaataggaatctttccaattttgccaaaatttttcagccatattcattgccttctggtatctttgcactacattagcagtgtttgaattttccaaaatataatcattgtatgtgttctcaacagatctagtgtttatttccaatctattgttaccaatgttgggtaaaattagatcaataggtcttaggggctgaataacttcagattgggaagtgtaagtgattggtctctcattgactattctctccacctctgaaaacaaagtccataattcctcaaaactgaggagtttatttcttatttcacctttttaagtggtacttaacagtcccaatcatacgctcatattgccctcctctccaaggggcaaaaggcgaaataaaaacccattcaattttttgttgattcgaaaaattctgcactttctcgtcctttaaaactttgagccaatgctccttctctttaatgctttgttgaacaatttcggttaaggctttgttgcctaacacgaagttagtgccattgtcggacacaattctctgaggaatcttccatcgtctgacaaatctcgtgaaggccaacaaaaatcttttcgcagtcatatccgtgactaattccaaatgaatcatcctcgtgagagcacatacgaatatcgcaccccaaactttatgtttgccttgtccgtctgatgacttaacagtcattgggccgaaataatctaaaccaattgtttcccaaattaaattgccacttatcctgtatgacggcagcggaggagcttcaggatatgcgtaagctttggcgtgaaaacgcgcgcagatccaacaacgagtattcggattgattctcagaactgagttcactttgcttcggactgaaggaatccaaaatttgcttctcaatgaagcaaccatattttccattcctgtatgtttcctttctcgatgaatgtccatgataattaaatccacaattggacaatttttattcaaatatataggatgaatagcataatggtccatgccactattttgcatacgcccctttgctctccaaattccgttctcttggaaaagattcagatttaagatcgtctcattagatggcggaaaggctttttgagcttctttccacaaatggacttcggcacgttcgacttcatcaatcgttagaggatttatttgcttactgaatgatttgacctcattacttggcttaacagctgaaatgataattttattcgctgagtttttgaaattttgaacggctcttagtacataagccaaagtatttcgacatcttcgaaattgtgaaaattgctcataattgagcaataattcaacttgttccattacactgcttttagtgaccaaactcatttctatgaatgagtcttggtgtttattttcattcggtgccgtcggatcatattccttgatgcttttgggccattctgatttgtctttatatagccaatttggaccgtaaaaccagcatttattctccatcagttcttccggtgaacaccctcggctggcatagtcagcaggattaaatttaccatcaacatgagatactggaatcatcttatcttgaatgaattttgttcgatttcgaatgaatcgatcctttaatttagaagagtttaaaaaatcaattacgtccgtagaatctgtccataaatgaacactgtcgattgtgattgctttttccaattctcttttaacaaagagaagattgttgcaacaaatttttgctgcgtgtaattcaagcgacggaattgttctgctggctttgctgagctgtgtcggtacgaccaggcttttggcgaatgctaactgagtttgtgctccttcattagtgttggctctgatgtaaatagcgcatcccaatcccgtttcggacgcatccgaaaaaccgtgtagctcgtagttgcgaacttctgttgcgtcgaaatattttctcgtaaatgaaagggtttttgcatcccaactattcatcagttttatccataccgaagccagatttttgtcaactattgtgtcccatttcaattttccattttgttcgaccgattggcggagtaatttgcctttcagtatgactgggctgacaatacccaacgggtcaaatgatttggcaatttgggacaaaattgtcctcctagttatttttccttctttaggaaatcgggctaacttaacagttaatttgtcagattctaagtcccacccaactccgagtaacttcgtctcttccttcttcccttggtcagtttctggtaatttttcaatctcagaccagtcattactgacgaattcgcggacattcattccggcatctcggaatactgcttttagcaaccggtatgtttgtccaattgttttgtcttggtcaataccaagtacaatgttgtccacataagtgtccttttccatcagacgtatctgtggttgccgatatttagcgaaatgatgtttcaatacaattgataaatgagcaggactacaaattacgccaaaagtgacgcgtgaaaatctgtattctacaattggactattttcatcttcaggattttcgtaccaaaggaacctcagtgcgtctctgtcatcgggatgaatagaaatttgcaaaaatgccttttctacatcacaagtgaccaaaactggcttaagtctggcccttaaaagtatacctgccaaatcgttgtataaatttggtcccttgttaagacattcgtttagacttggaaattcttttctcaattttgaacttgcatcaaacacaacgcgaattttggtgaattgtttgtcttgcctttctacaaaatgatgtggaagataatagaggacgccattgagttcgtccctttctttggttccttttaacttccaatagttaatggagctgtcaactcgttcgatcattcccttttccaattgatcatgaatgatttcatggtattgctttaataagcatggtttctcccttaattttttaaaattcgacttcagtcgtccgagtgcgagataatagttatccggcaaactcgtcacttcctccttccagctcagccgaacttcatatctttcaccattaaaattcaggttttgctcaaaattttggatccatttggcattgtcgtctctatcattggcgtctcccaggccgatcgtttccaatttgttgtgttgttcaaccataaaagtgagttcatcgtcgtcgggttgaagcttgttcccaaatttgggtgaaaattcaacaattttctcgactgaagttgtagaagcggtattggctagttctttagttgataacttaacttttccttcacccgaaagaatattgcccaacttcgattcactaatccaaaaaccattagccaattgctgtactggcttaacagccaagtggttataaacgtcaccaccaattaataataatggctcttcaaattttggaagtacttgaagtttgttggacaataacttgtcaattttagcgccctttatcttaacgtggggcaatttgggcatcactttatccagctgtcgcgcttgaatgttcatattaaaattctttcctaacaaattcagttccacaaccgaagtgacaaagtctcccaactttgttccctgtaagccctttgcttggaagtgaacttcgttgattttcattaagttcaattcttcaacaagaattttagcgatgtaagttttttcacttccgtcgtcgaggaaggcaaggactcttttcttccgttttggaaacatcgggtgacgaatgattacccacacacatttgagaagagaccaaatttcttttggatttttcatgcagctttgtatggcaaacacattggttgatgtgttttcttgcttctcagttgtggtggttgcgacttgtcctctggccactgatttccgtctttcgcataatgccgggtgatgtccggtacgttgacaaagaaaacattttctaagttttcttggacaatttcttgccatatgattattgaataagcaaatgtagcacattgctttcgcttctatttgttttcgcctgttcacaactgaactaaatttgtcacaatctaaagcgaagtgtttttcagcacaaaactggcatggaaatcgcgacggacttctgctttgactcgggcttgggcttgatgaatttgattctcttcttcgactttgattgggccatggtgaaccgggttttcttcccggagatcgtccgtatcggctcgattgtgaggatgagcgtaagcttgatccttccgatgaagttgaagtcccacgccatggctttggcttaacagcacccgatgattgtcgattatcctttttctcttggtctttgtatctgatagccaagtttaaggttgattccttttcttcactcttatgcttctctcttttggatgtgtgatgagtctgttcgggattagccctttgaactatgtcattgatttgtttaagctgctcaacagccgctttaaatgtttccctaaataggttggttgaccaatccgaaccatgaggcattgcactcagcttgacgttttttaagtctacatatctggtcaacacctttttggacaatttctgttccagactcatataaatttgaggtgaactcaaatcctgattataatgctcgagttgtcggcaaactcgttccaattccaactgaagtttcatgtcgtctccaagagatatcgaatttgaaagccgggccaattgattatgtaaatctctgattaaattttcatttttcccatacttgtcctttaataaggacaccgagagatcataattatctctggagaagggcaaaagtccttgaatgacttttttggcttcacccccaacagggaatccaaataactcattttttgtacgtaatccaaatcggcatcagcatgtattgtcgattcgaataatggccaaaagtcatcccaattactgccatcgaactcctttaggcttaattttggcaaggcaatgtttcggcgtgccgttcctccgggcccatcttgaagaagacgatcaatgttccctttcagcgtgcgggtatcggccaatttatgatttgcccttcgcaaaaaattttgcagatcgtttgcattgaccgatgcacgaaactggcgttgaaactccgtttttgcatcgccttgaagcgcagacagctcttgattgtacaatacccttgctgcttttatttcatccacttgcgtttggatttcgtccgcaatctctttccactccctttgatcacaaatcaaattgtgtctctgttgggaggtcaacacccctagaggaaggatgggcaagggcttgtcgaggtataattcaatggcatatttggcagtctctattcgttcgacataaatgtccgacattgagagtcccttttaaaattttatacagattttatttaatttgactgaatagtcacgatttaattcgtaaaatttatcaaattggtaattcgggagccccttggttaatagtatgaattaaacaattatatggttaaataacaaattgtatgtgtattaattgaatgttcaaaataaaatttaaaaatttaaattttactccattggctttggcgaagtcttatatgtatggtggagttactgtagaatgaatgaaatatttaattgattagtcagaactgaataatcaacactccccccaaaaaggacaaataaaataaataagttcaaattcaaataaagaaattaagtacaatttaaaaataaaaatgaaatcttaataaattaatttcagatcaaaactgatttgaaagaaataatagaaaggaacagattgattgtttgggttagtgtattgtttcccaattactgtaccctgattttgaaatcaaactgatttgtggggaagatagaaaacaaaacaataataaatgtaaacacaaatatgatttgtaaatttgcgttgtttattggtacaccggtagcaataggttttgggattattaccaagctgatcagcttgtcaatttaataattgaggattgctgtctccggccctacggcggcgggtcgccactaacgaaaatggccgtgtgcgaatgagaaaagcccgggcgtgagatttgaaggccaattgatcaattgaacaattgctcaattgaattccaaattgggcgattgttcaattaaacaattcgccggatcaatgagaatgggctaaccaggccaatttcccgtgatcaacacacggttcgttataccgaattgtgggcgccccaaataccgcccacaacacttggacctgatccttctcggcggttctggttctccggagtttgtgtgcagcaatcgtcaaggatccaaattccaatccggcgctcaaacggcaaatccggcacggcggtgcgaagtgtcaacggcgaattcggcacggcggtgaaaagtgtcaacggcaaattcggcacaaggcttcaaaggcaaattggcgtgaagagcaaagggtccacaggtgtatccggcttggtgatcagattccaaaaaggggaaagggaatggtcagaaatgccaacaatgcaaccacgagaaaacaaatgagatggaccggtcgctgatcagctaacgggttttccgatggggcaatcggagcctggctaaaaagccaattagacaacaaattgaagtgaggcgaaattcacaactgatcagtccaaaattggactgatcgaattgtccctttgggtctttcgggactgatcagaaaattgttctgatcagcgggagggggagtcccgcaattttgaagtaccgaaaccaataggctattccccgatccccgggattcgaattggttaagggggcagaaactcggtgttgttttcgtgcctcaggcaaggaaattttttccctccccacaagaaatttgtaagacaaatttatt

SEQ ID NO: 740 - DNA, 4332 bp, Heterodera glycines
  misc_feature (73)..(73): n is a, c, g, or t
  misc_feature (85)..(85): n is a, c, g, or t
  misc_feature (319)..(319): n is a, c, g, or t
ttcctttggttttttcgtgctgctttgtctggccgtctccgttggttgctgtgttttcttgcttctcggttgntggtggttgcgncttgtcctctggcctctgcttttcgtctttcgcctctgccgggtgcgtccggtgcgttggcctcgtccccgttttgtcggttttcttggtctgtttcttgccttgtgtttgttgcgtgcgctttgtggtctctttgctttcgcttctgtttgttttcgcctgttctcgtcgtgggctggctttgtcccttttctcctgcgggtgtgcttttccgctcttgtctggccttggctntcgcggcgtgtcttctgcttcgactcgggcttgggcttgatgaatttgattctcttcttcgactttcattgggccatggtgaaccggcttttcttcctggggctcttccgtatcggctggatttggaggatgagcgtgagcttgatccttccgatgaagttgaagttccacgccatggctttggcttaacagcaaccgatggttggcgatcgtctgttttcccttgatctttgtatctgacggccagatttaaggtcgattcttttacttcactcttatgtttctctctcttgtatgtatgttgagtttgttcgggattagccctttgaactatgtcattgatttgtttaagctgctcaatagccgctttaaatgtatccctaaataggtcggttgaccaatccgaaccatgaggcattgcactaagcttgacgtttttcaagtctacatatctggtcaacacctttttggacaatttctgttccaaactcatataaatttgaggagaactcaagtcctggttgtaatgctcgagttgtcggcaaactcgttccaattccaattgaagtttcatgtcgtcgccaagagacttcgaatttgaaagccgggccaattgattatgtaaatctctgattaaattttcatttttcccatacttgtcctttaataaggacaccgagagatcataattatccctggaaaagggcaaaagtccttgaatgacttttttggcttcacccctcaacagggaatccaaataactcattttttgtacgtaatccaaatcggcatcagcatgtattgtcgattcgaataatggccaaaagtcatcccaattactgccatcgaactccttcaggcttaattttggcaaggcaatgtttcggcgtgccgttcctccgggcccatcttgaagaagacgatcaatgttccctttcagcgtgcgggtatcggccaatttatgatttgcccttcgcaaaaaattttgcagatcgtttgcattgaccgatgcacgaaactggcgttgaaactccgtttttgcatcgccttgaagcgcagacagctcttgattgtacaatacccttgctgcttttatttcatccacttgcgtttggatttcgtccgcaatctctttccactccctttgatcacaaatcaaattgtgtctctgttgggaggtcaacacccctagaggaaggatgggcaagggcttgtcaaggtataattcaatggcatatttggcagtctctattcgttcgacataaatgtccgacattgagagtcccctttaaaattttattcagattttatttaatttgactgaatagtcacgattttattcgtaaaatttatcaaattggtaattcgggagccccttggtttatagtgtgaattaaaaaattatatggttaaataacaaattgtatgtgtattaattgaatgctcaaataaaatttaaaaatttaaattttactcaattggctttggcgaagtcttatatgtatggtggagttactgtagaatgaatgaaatatttaattgattagtcagaactgaataatcaacactccccccaaaaaggtcaaataaataaataagttcaaattcaaataaataaattaagtacaatttaaaaaaaaatgaaatcttaataaattaattttagatcaaaactgatttgaaagaataatagaaaggaacagattgattgtttgggttagtgtttgtttcccaattactgtaccctgattttgaaatcaaaactgatttgtggggaagacagaaaacaaaacaataataaatgtaaacacaaatatgatttgtaaatttgcgttgtttattggtacaccggtacaataggttttgggattattaccaagttgatcagcttttcaatttaataattacggattgctgtgtctccggccctacggcggcgggtcgccactaacaaaattgccgtgtgcgaatgataaaagcccgggtgtgagatttgaaggccaattgatcaattgaacaattgctcaattgaattccaacttgggcgattgttcaattgaacaattcgcagtgacaatgtgcttgggctgaacaagccaatttcccgtggttcgcacacggtttgttataccgaaattgtgggcgccccaaataccgcccacaacacttggacctgatccttctcggcggtttttggttctccggagtttgtgtgcagcaatcgttcaggatccaaatccaatccggcgcggcgcgcgaaagtcaaacggcaaatctggcacggcggtgcgaagtgtcaacggcgaattcggcacggcggtgcaaagtgtcaacggcgaatttggcacaaggtttcaaaggcaaattggcgtgaagagcagagagtccaacggcggatcaggcgtggtgatcagaatccaaaaagggggaaagggaacgatcagaaatgccaacaatgtaaccacgaaaaacaaatgagatggaccggtcgctgaaaagctaacgggttttccgatggggcaatcggagcctggctaaaaagccaatcagacaacaaattgaaataaggcgaaatttacaactgatcagtccaaaattggattgatcgaatttgtccctttgattcttttgggactgatcagaaaattgttccgatcagcgggaggggaagtcccgcaattttgaagtgccgaaatcaatgggctattccccgatccccgggattcgaattgattaagggggcagaaactcggtgttgttttcgtgccttaggcaaggaaaaattttccctccccacaagaaatttgtaagacaaatttattgttgttaaatgttcagcaaaataaaaagaatgaaaatgcaaaaacggggggaaaacgaagaagagacaaatgtgggcggatggatcgcaacaaattgaaatggtgagaatggcgttttatctgatggtcggtcatcatcgggacaaagggcgacgacgcggcgatgaagcagagagcgaacgagggaaagcgagcgagggaacagtggcagggggaagacaagcgaacgggggaaacagtggcgagtcgaagggcaaacgaacagtgcattggccaaggaagggggtgggggtgtttggccgccgtcgtgctgtaaacggagagacgattggatcggctggggcgacggcggtggagaagagcaaattgtgaaggcgtcgctgaggcggtgtacggctgaaagcaaaaaaggggggaataaggggatgaatgcattaagcgcagcccgcggcgaaccaccggctaaacagccaggcgaaatagttgaccaatgggagagaaccccctttctatgctttcttcggaaaggaaagcatagacaactataaatcgaaattgctagaattagcgattttcgacaggtagcaaaattttagaatattttttcgataaatcgcgcaaatgctcaccgtttgggcctgtatctttgcctgtataagatcactcgagtcccccagtgcactcccgaagaagattttttccgcaatgccaccacctaggaaggccatcactacggcaaaaaggtcgaaagttctgtagccaccatttttcctctcaaatgttgtttctccatcaacgcctctctttcgtaagcagttgacctaaatacagtgacaattacactcacattacgcaataaaactttcaaaaaataaatttccaagaaatagcaaaattttgataaatcagaaacatgaacacttcacccaaactacctctataaatttatcaagatgctcggggttcatgtaagctgacatgaaatgtccaatttcgtgcacacacacccttatttcggtgtaacaaccatttgttcttgttgttttgttaaatcctttattgaagcgtgaattcgattttgcctcatctcctctgaacactgcatacaaactcgcaggaactgagattgtgatgaggcacaaagggcacgaagtgcgaaaggctcgggcgagttccaattctgaatcaccg

SEQ ID NO: 741 - DNA, 3595 bp, Heterodera glycines
atgaaattttcttagcttataacttggtggaatactagagcaaataaaaccattttatcgctcattttgaagggaaaattctggagaatattgtaaattttatttgggttggccttaaattgtggacttggctaaaaaagaattaaaattattgaaatttttactagggtcaaaaaaattttcctcgggtcagattttcttgaaattttgtataggcctatattttgacctcctctagcgattccaagtttattttatggaacttaagtttttaactctagatcggctcttctatttttacaagggaaaatccccaaaaaattttaagttttgcaaagttttggcgtgctgattactaaataaataacactatgggtcaagcccagtgttagacaaaattactcataacgccaaatagcgcatttggcgtaaatttttgcgcgctatttcaaaatttacactggaaaatgccttttttgtattttttattttgatctgccataactcgcttcattcccaactaaactgaacaaatttggtatctaaaaaaagattttgaaaaggggaatctttttctaagcgaatgttaagtaatttgtcatctcagaaaaaagttgtgggaatttcaaacttttatcatgttataactcaagtcctaggcagctctttctaaccaaaatgctaaatttattcttttttctattgattctaaatgttcaaagtgattttgtatccttataaccaaaattattagaattttcgaatttggtgttttttcatgtgttagagacatgaaaatagtacgccaaaaggagaggaaaagaaattattaattttgtttgagttaaaattttggatcggagcgtaaaaaaataaaacttgagcgttaaaaatgttcgtaatttttttctctatcgctatgcaaaatttggtacggatttaacataaagaaaaaaagttagacatagaaaagtaaatgttgttttttacatcattaaaatgaagagatagtacgccaaagtgagagaaattacaaagaaaaagagaaacgacgagatagtactaggcttttctctgcacagtggagttgacccatagtgaaataataaacttatttgtacttggagcccaaaattgaatcgctatgtatacaaaaaatattcaccaattcccttttcatgactataaaaatcttttgttttccgctttgactctcattaaaaaaataaagcttccaacgaattattattctgctcttttgtttgaaatcattcggaactcggccaaaattgtgctaattgccaaaaatgaaccgacggtaatgaattttaaaagtcacaaattcgtcgtttatttgactaaactgtttttccataatttcagttggatttgcaacgacgtttggatggacattttccccagttttgaccgtcctcaactcggcctcaaattggcacttctttccccacgttttgatgcgttggtggacaaacatttcaatggcaaaagcgaattgacaatttggagacaaatcaaaattcgcaaggacaaaggaccaggaccgaagctgtctgtacgaatcgatgacaaaattgtgccatttccattgccggaccgtccgttgcccagcaaaatccgttttaagcgccttcggatgtggtaattaaaaatcagagctatcgcaataaaagcattcatcccattttcacagttacatcgatcactccgtcatcgcttttcttcgttcaaatcaccaaatttttgacaaaagaggcaccaatttatatttgtcgattccatcatcatactctacgaatggccagcagctgatttgggacatttttgttcgtgaaatttggccaattttttcggcaaatattcgccatttgcgcattaccaatggtgatgatttggaccatttgcttcgtcgcacttcgccgacaattctcactgatctcaatcagttggtttcaatccattcatttgatctgttgcccgctgcgtttggtgatggttttgatgggccaaattcaacaatttctgctggccaagcattgtccaaatggttgcactctccgagaaaagatggccaacccaagcgattgcgttgcggtaattacaacgaacaaacggacttagattggatcaacaatttcaaggaggtgtggccataatctcgacaaatcactgttttttgttttcaaattgtttagcattttctccgtgccaatgccatttcttccgtcagttacgaaattcatttttatgttcatgtgccgtcaatacaaatggtgccatttgatttggtgaacgaatgcacaaaggaaaagctgacattggccaaagcaaatgaaaatgaattggacaattggataatgaaacgatgcaaaattattggggagacggcagcggttcattgggaagacggaaattgggacaacaattgtaacaatgtgttcttttggcttttcggtaccactaattgcattgggtgagcaataaaaaggggatttgtttttatacatatccaaatttgcgatttgcgcctaattaaggccattgtctccgccaccagcagaagaagtggaagaggaagccggacaatgcatcacaaaagggccaaatgagtgacggacaaaacaacaaaaacagtgatcagccgcagaagaagaagaagtgaattaattaagaatgaccgatcgatcataattcaaatcagtgatcaaatgcaattttatgaagaagaacctctcaaatcctatataaataaatcggatatataaaaatggcaaaaacgtggactctgttgcagttaacgttttttctttgcacccaaatccaacaatcttggtgtcattcgaaagctcgtaacatgctttattagccttacaaaaagcaacaaaattttcaagcctggaaaaaatttattaagaaaaaacttcaaaatttttgttaagctttcgaatgatatcaacaatgttggatttagatgactcagaaaaaatgtttagtggaaaaacgagctggcgccgaaacgaagtggaccccatttcacggtcctaataagtttcaaggatctttttaacacatgaaattgcccacattttccagaaatccaaagttcaatctgaaaatttgaaattcaagacatttctcctttataattattaaatattattacatattttcacatctgagccattttcactgatgaaatttgtgcccggtccttatggacggaaccggtatcatagactaggagataggaccaatgcaggaatgcgagagaaatttcccattatctctccctttcctttcttttactctcttttcttttccattgcaatttactctctttttttcccactccttccttctcccacacacacgcacgcgtccaacagactgctgctgcacagcagcacgcgtctgttctctgtatgcccctctcacccgccgctgcccgcgtagacagacaatcagacagtgcactattttcccacctttccctcgctctacttttttcaaattcatttttaacgcaaaactcaaacaaaacgccacacaaattcaaacactggacacacacagacac

SEQ ID NO: 742 - DNA, 4748 bp, Heterodera glycines
cgtatttctcgtgaattatggaatgcgcacacaatcccccttttcggtttgttatttttttgttccaaatacattgttccctttttagatattaaattcaaacaattttatgtaaaaaaactcataatccaatcaatgagagacgaaacgaccctatgactaaaccaacccccaccgagttattcaactatttttgcaaattggcattttaaggattcgaccccttctcccatgcttctttcagtatggcaaagtgatcttctggttttgattgggtattaatccatgcttttccactgatcaaattccgctgagcaatgccattgagagcagacaaagatggagtaacaccaattcggtgattataggccaaatgattgaagccaaacattttgccaatacggttcaaaaattggcacaaatctctcttcaaaaatgggtggcatctaaaattttaattaatcaaatttttaaattttatatttacttacgttataatgaaaagttcgataaggaggccgaagaatgagttgagattaatgcagaaattagcaatcagctcattatatggccaatttaaaaggtcccataacaaaataattgttcccacgaaaatgttgcccaaattcagcgacaacggcggaatgagctgcttaccaatgcgaatgttttccgatagctttcaaaataaaatattttttttattaaatattttatttatgttacctgataacgaattgatagattattcgagccaatgttttggaacattttttgataaattttggaattgtatcggcttaattggtagaaaatgcctaactcaatgcttccgaccagcaattggacggcaattatgatcagattcgttattggttgcttatgatcatgtggtgaaggcgttgtggtggcaatataaattgggatgatcaactgcaaatagaatttttgatcgcttatatcttcttaatgcttaacaaaattttcaagaattccttttggtgtattacaaaataaaataaactttttaggatgaattgataatgtattcataaaatttattctgtatgagtatgccaaaattatgttgttttcgctataattagttataattggataataatttatgattactctcaccgcaaaaggcatccacagaatggtgaacagattgccacgattcttttcatatgttcgaacaaataaagtggccaatatgcgttcaacgatcagaacatgcggcacaaaattacgggcgtaaatgccgatgaaatatattttcaaaagtaccgggaaaaattgcatatgcttggcaccaaattggttcccagtgatgaatttgaacagacaaataacaaaacgacagcaaccacgcttaaaagtagaaaatgttttattatttttttttaaatttgtttttaattgaatttgatttaccaagataataaagaaactctggaagatgagaatggctttcatgttcgggtggatgaccgatgtgcgtgccaccaaaatcaaattggcaatggacaacggaatgccaacaaaatttatcaacagttcaacggcaccgccgaggaacaaaagaaacagttcaatgtcagttggtgccgttgtgttcattttctcatgttagcgtaagttgattatcttaatttaaaataaaaataattttaattattaaacaataaatttatatttttaatctgtcgatatgtaatttttgccttacaattctaatgaatagaaaaaatctttggttatcaaaagtaattaaatcaaaaacgttgttttaatattgttcagaatcttttgttaattaattggcaggtgtaaaatgaaattttgttcttgacatgagattaatctttttaacaaacaggtgcaaatttctctctaaaaagataatcttttaactaaatgagttacttttcagaaaacaaattttatcttttaataaacgatggaaagaagtgacacttaattaattgaaatgaataaaataattgtaattattgggtagccgagtttgaaagtggtatccaaaaacgtcatttttcagaaacatctctgaataaaaaatttgcaatgccatctgaaaacactatattaatataattctatattaggcttttatggccctaatttggttataagaatcatttgaggaatgattaggtctattttcgatcacaaaaataagttgcgaacattgcaataattaaaatttttaaaaaagatcacctcaaaatattaacattcaatgttaaatatatgttatagaggattaaataatataatgatttagtccaatatctcatttatttatcattcattatggatgtttttaaaattttttccatcatttgtgaaaattttctgacaatgatggttattaggtttcgcattttgaatttttagactaatggttatgaaatttgtgaatttgaattggatttcttccgcaatttcgacaggggtcggtgggaaaaaaattcagaatgtctaagaatttttttaagaaaaaggtattaaaaaaatttaaacatttttcattaaattatctcaacctttttttgattctcggaacagatatgtgtaacatttattttctgaattctttttttttttgaatttgtttctctttttttttgaatttgtttctctttttttctggcacgctcgttcttttatgttttttatttaattctgtttcattttttttaggtaaataaaaatattttttggtaaatatataaatatatttttttattttaataattacacatgcagctaattctaatttttggtctcgaatgccctctcgaagatcattcgatagccctaaagattttctattaacctgcaaaatttcaaagaatttcgttaagcttaaaaatttgtttgcttttgggcgatgttatgaattttctgtcaaaatttttattttgatgcttttttgagtaaccacccagcaccattgatttgtgacaaatgaagatcgaatgggcgcgaaattgtcaaattttctcttcattagtttttttttttactaaaaatattcttttttctgaattttcttcaagcgcataattccgacagaggcggaggcagcatatttctctccctattctcaagacctaaattcaaatatgcgtatcccactgcgggattgaattcaaattttttttttcgcgagacggaatcccacgggattaatccgcaaaatccgtacaaatttttaaatttattatgagttttttttattcatcatttttgaagaaatattagtcggggcaaaatggaaaaatcgatgagaaagatttaatcacttataaatcatcatattcatttacatattttagagaagaaaataacttttaaattattaagcttctacgatgaacaaattttttgtttttaaaatttttggccccttggtttaaaatttttgaaataaaaataaaataaatacgaactttaaataatgtcatgcgcatcagactatttaatttgatcatcaaattaccaattctttatttgttggtgtttatagttggttgaacgattttgcttaaatttttttttggtgtttttttatgattttgttttgaaataataaatttcctattttccaataataaatatttcttctatgatcaattaattcaataatgtttttgcttaatattattatttctttaattgttaaaattatgccaaatttaggagatatataaatggattcaaaaaatcctttatcttttgaattggtttattagttttattaatttattaatatataaatatgggcctcaaattggtttgaaacatttcattttaacgtttacacaatacatattgattaaatgaaagtgactttgatcaaattagttgtgttgaaaattacttcaattacttgtctcaagaaaactaaaaaaggaaactcggaaagtttttcttatttctatatttaagaccatcccaatttttacgccttatataaaacgaaaaatttaagtttgaggttacgcacaagtatttattcaatatattttttaaatattattaacacaatttcaggatataaataatgaaagaattattgaatgataatatttgataaaataaaaatcatatttaataaagctttaatgaaaacgcaaattttttaaaataaaatctttggagtttaaatcattatgataataatattaacattaataaaattaattattgtaaaaataattcatatttttaattatattaccaaattatgtaataagaggcaaataatattgtttagaatttaactatattttcaaataagaaaaataaatttaacccgcgccggtctctagtgctcagcgcctcaaaatacccaaagaaacttgttaaagaattcccaaaaaaaaaaaattcgggaccaatgaccgacatgattgctctttaaatttgtggaaaatatagaggaatatatcgttctgcaatttttccttcctgcgttaactttcaatttgaagcatattaaattggagagaaactttgctgaaatatagcacattgaatacaattaactgttaaagaatttttgcttttaatgcatttttttaacgaaatctggcggcgagatagccaaaaaacaaggcgcggcgagttagccccgcggcgagaaggcgcgcggcgagttggcccggcggcgagtttctcgcggcgagttggccgcggcgagttgggcggttcccttt

SEQ ID NO: 743 - DNA, 5236 bp, Heterodera glycines
  misc_feature (5074)..(5074): n is a, c, g, or t
gagagaaaattacagcacaaaatttaaaattgttaagttgaaaataaattaaaaaattatcattttaaagtatttatgcaattatttagtcaaaatatttggaatatgacttcgaatccaacgagacaattccattgttccaaaaacttcgagatgaaaaaaccgctgactatagtcagaaaacggcagaaattgacacgtgagtttgccaattattaaaattggggaaaaaattaaattattatttttgggttatcaaaaaatcgtctgggagggtatcattgtcaacaatgccattgctgttcattttcattttgatcaaatttttaattttttggcgaatactaaaattttggaatgatgccatacggtgcataaaatttcttaaaaaattttatactacaaattttggttgtcaaattttagtgccaaatttctgatttttaatttgttaaaacttttgcagagaaatggtcttacttattacaaatccttatctggtggctgtggacaaaatcaaacaattactcgccatactgaaaacaataccggacaaacaatgcgatcaaattgccaacgcttggcgccaaattcgaattgagtacgcaaaaagtctcattgagaaggcgcaagcagcagcagcacagcaggaaaaggaggaacagtcaaaacgacgaatttcattaatttaataattgccagtttttatgcatttttaaattagcaaaattatttgcataaatttatgaagaggtgtttttctgagggtttttagaacccggaattttgaaaagtgcaaaaaataatatttaataaaacctaaatttgaacatcttggaaatttgggaagaagccgaaaagcagtcgccggaaagtgattgagcaacatcacaaaatacttttttcatctgagactgtctaagttttcttttaatttgttgaaattttgattaactattcaagcatgatgactatttttaagtcacattaaattctcaaatcattggtaattacagttgagcataaactccaatttcttaatcgcaattagcatgaaagcaaaaaagacttcagaatttctatttttttcaattttttgattggaacatttacttttttctatgtggatgaagtaaaattttgtattatataaaattttaccgtccttaataatctgacttaaaagaaaaaattttcaaaaaataaataataatttgcgaagaatgaacgataaaaaataataactatcttatcctcctcattggcctcagttgttcattaaaacttgaaaaccgttgccattgtgttgaatgtttagcacttctccatagtttatgaatttttttgagaaataagtgctttttggccccggttttttaatgttttgttaaacaattattaattagtattttatattttatttttatttaaaatgatgtaaataaaaaaatatatatttagataaacaaaattcatttcataaaaactaaatcattatataaattgggtattcaaaataataattttttacccaaatttttggtcaattttagtaaaatttctgcaatttccaatatattaactacaggctctggctttttgacaatttaaagattgtaataatttttaattttaaaaatttcctgggcatttttaaaacgtcttgcctttttttcatacccagtaataccaactttcttctaatttttttgggatttttactaagctaagccaagagtgtttttttcggaataaacggtaaattgagtattttaggctttattgatgcttttaaaacaaattttgaccatttctctatcaaaaacctgttgttggttccaattgtcccaactccataattgaatgtcatatgcattttttgggcatttttgttcatccacattaattattctttggcatcctccgttccagcatttaaaggatgcatgataaaatggttgtgtattcttgtcatggcaatacacattcatctcatagaattgatcattattctgctgctgatcattcaaagaaataatgttgacaaaaaaaagattcagcgttatttcccaatttgttgtgccatttggttcggcaattttaccgccattgaaaaccacctgttttaattgatagattttttagaaatggcaaaagcaatttgcaaaattgagcattcctgttttggggtggcaggtcaaaaataaaaaataaaatcaacaaaaatgcacgcaaattcacaaattcgggtacagctttatctttggtacattaatgcaaaaatcccgccaaatggatcagattaaaaagatgagttatatgaatttgtgcgcgaatttttgtttgtttttaaaattttggtgtgcgaccaaaacaaaaaaattgccgaaaattaccgtagaattctcaaaggcaattttgcctcctgtatttgccattctgctgattcggataaaaactgaatagtgcctacattttatctcattaaaatcaactaaattcctttcaaaatgttgtttttctcctaaaaaggccatcgaattgtctgatgcgagacttttgtgttgtacaatggtcttagctacagtagcatgttcatcatgacagttcaccgtgatatggtaactaaaccataaaatcattagatattaccgtatgattcgatttttttctgtaaatttaaaatttaataaaaaaagaatgttgaaaacatatgcaattttttaagtaaaagacaaaaatatcttaaaaaatggcataaatttaaatgcaaatttttagacttgtaatgacttgtgcatttttgggcaaatatacatcttcgtccaacaattaaattaattatgcataacttacctaatttgactattttcatgaaaacttggcgataggtcaagaatcaatttgttttggccacaatttgcatcctttgaagtatagagaaatataaaaattttaaataaaatcccatatttttttgccatatttaataataattgcaaaaaaaataaaataaatgaataaatatttggcaatgctaatctacattaaaatgccacaagattttgcccacgtattaatttttaattattgataaatcgattgaatatatatatatatatatatattatacatttcagagtatttcacattacatttaaaaattttaatttcaccttaaagaataggtaaagaggaaaataatgtgtagcatgaaatgaaaataatggattttcacggatttcgtggccaatcaaaggaatttttgtcccacgaacaaaatggatgaattaacgggagatgatggcgttgctcatccaagcgctagaagttctcaggttgaaacaaaaattgaaaactagatcaaagttctaagctttgttagtgaagatactgttgaagattcagatgaagattaaggaataatttgtttcgtaccgcgcataaatatttatcttttaaatttattgtaagggattggccaccctcaaaaaccaatttttattttcactcagcagtcgtactttccactctttattatcacattttctcatctcatttattccgttcatccccgccccttttccgttcgcttcacacttttccttcccccagcgatcagttagtcagtcgtcagtcagtcgagtcgttaagcctattcgatcagtcgttcgtcatggaatatttcaatcaccattttatccggagagaataaattattctaataacatcgaggctttttggggaatttcaccaccaatcctgggcccgggattccttccccaaatcgtcctcccatttattcttcgaacggtgtgtcgactgggggacccaacacacctccctcactggtagcaccggatggttcgacttcacttcgggtggaaggtccatcgacgacgacaaaacgactacgacagcagctgtagtgcctgcgggcaaaataatggcgccggagagatgagaagtgtgatcacgcctgcgggcaaaatacagcgcgcttatggccagagaaataatgaatttagattgaatattcggagagatgttaattttatttgagaagatgattcaacaatttatgatgaaaaatgattcagcaatttatctccaaaagaacggccatgaaaagaaagagaaatgggtacccgcctgcgggcaaaatacagacaatgcgcatagtgcacttaaaaatgagatttatcagaattaaaatgagttaaaatgaaacggtaatttaaatgcactttattatgagactgatcagatttttaatttgagcccaagatgaaaatttatgcactttaaatatgagactgatgaagaaatgtaatttgaatcaataacgtgagattaattatgtgatttatacagtgcatcgaaaaatattaattagagaatatgaaaattcagaaagtgccaaaagtgccagcaaaataatgctcgagaaaatttctagggactaagttaaaatgactgccaattgtgcaagagaaaattcaaaagtcgaatgagaaattatttttactctgatcgcttaaatttcggccaaattaatgatttttgagcctatttgagttatttttttagggtgagtccatgttcggctaattagtgcccatttcaaagctcaaagatcaatccgataattttcattgcaattcgccatttatcagtcggccgtgagaacggaagccgcggcgactttttcatttatcggagattcgatcaattacacttcatgtgaacattagcggacattattgcacattcatttgatagagacgacattaatggaattcttttatggacattttatgtgagaattagcaatttattccggagaagaataagcttaagtccattttttttaatgtgatgcagtgaataataagctgatttggcaatatttggttttattccagcattaaaaaaaataataataacttgcacaaattcaccgatttctgaatgtatgccgacaaccctcggggggtcagcaccaactctgcctgcgggcaaaatacagaatttaattggagcaaccccgcctgcgggcaaaatacagatttanaggtgaaaagtgaggatcaaaatgaagtgataaatcgacccgtgtggcgcataacatgctgagccacatgactcgagtttgaaattattggagaagagtcagtcacgcttttgatgatggggctgaccgatttaaggactatttgtcactgacagggaaaaa

SEQ ID NO: 744 - DNA, 1942 bp, Heterodera glycines
attcgccatttatcagtcggccgtgagaacggaagccgcggcgatttttttcatttatcggagattcgatcaattacacttcatgtgaacattagcggacattattgcacattcatttgatagagacgacattaatggaattcttttatggacattttatgtgagaattagcaatttattccggagaagaataagcttaagtccattttttttatgtgatgcagtgaataataagctgatttggcaatatttggttttatttcagtattaaaaaataataataatttacaaaattcaccgatttctgaatgtatgccgacaaccctcggggggtcagcaccaactctgcctgtgggcaaaatacagatttaaaggtgaaaagtgaggatcaaaatgaagtgatcaaccgacccgtttggcgcataaacatgctgagccacatgaattcgaatttgggattatttggagaagagtcagtccacgcttttgatgattgggctgaccgatttaaggactatttgtcactgatagggaaaaattggaccgaagaagaaaatgtcactcgccttaaactggcgctcaaggacacgccgagggaactattcaaagaactcaagtctaaccaaatcacgacattcaccagcgctttggaagcactgagggccaaattagactcgcctcaaagacgagaagtggcgaagcggaccctttcagtttgccggcaacgtgaggacgaaactgttgcccaatttttgagacgtcttacgccattgattgactcaacaaatccttcttcaacgggtgatttgcgcaaagaaaaaatttgtgaggaatttttggaccggttaaagcctaacattagttttttgattcgtttggtcgggcttacgcaacccaaaaatttggaaacaatctgacaaaatgagtacaaagtgaaaggtgtttcaaaaatttaattagcgccaatgacagctcaaaaaaaacttttttttattcggtccttaattcggcagtccttcaaaaaaaaagattaggtgtataataaaatttattatttctattactgaattgtcttttggatggcaatgaattgtgataggcccgagggcccaatattgacttggattctatttttttaagccctaaaccgccaaaatatataggtttttggctcaaaaaaaaaatcaaaatttttttttgcactaataatgcaaatccaccttttggagctcaaaaaaggggggaaaagctaaaaatatcacccctaattaataataattaattcatttctttaaccttttccattgtttcccaatgcttcaaattgtccttggcctttggtgtcaattcggtgccccaattcaccatttgccgtcgcaccaattctgctgctatttttgcgtcaattgcctttcgctgggcgttcaaccgttccaattcatttccatcgtcggacagtgcaaaagaggacatagattgtctataatgggaaagaacctatagttcataccaaattatatatatatatattttttttgccaaaaaaaagtttatttttttacaattgttaaaaatggtttattccaaaaaaaatctttaagattgagttaactctaccaaatctcaattgcccttttaccaactaaacatttatttttttcttactttcaaaaaacctttttacaaaaaaaacctgataggaagagttgaagaaccacatgtgcagcgccaatgcagtgccccccccccccgcaaaaccccagcgcgagtccaatatcagcagaaaatgctaattggactgcgcttctcgccaatttattttatttaaacgatctgtcgtccgacggaaaatcattttttgccttttattcatctattattaatttttatcattaaccatttatattttagaaatctttaattaataaatagtacaataata

SEQ ID NO: 745 - DNA, 6906 bp, Heterodera glycines
gtccttcgacccaccacggtttttgagtttgggaactcagataaatattttcccacggttttattacccattccaatgaggacgattgattgagcaatatgtacattacttcatttttttatttattatagaagagagccagtccagtcattcatcatttttgcaaaatattagccgggcaaatggaaaaatcgattgggaaagatttaatcacaacaaaaaccatcatattcatttacatctctaagagaggaaataattattagtttttttaaaatttacattccttcttttttaacgtttaaattgagaattttagcgctttcagttttttaaactttttaatttttttaaatttatattcaagttttgatacaacatttccgggctggtttcggttaaacaatttcagttttaaaaaagcactttttgtcatttttaatccttgcttttgatttgattacattcttgaattcgtttttaggaattgatcaaatttaaattttgtttttagcattgatcaaatttaaattcgttttttaggaattgatcaaatttaaagtgtttcaagggctctttttattttttaaatggacaatttctaccaaaatgcagagcaggtttatttatttattgtctatatttttgcaatttctatattcgctctttttggaaaccaaatttatggcaagatattttgtggtttctatggaatttctgccctagttatgaatataaaaaataaatttgagcaagagattcaaatttaaagcaataaaaattttaagacaaaaattaccaaaaaaaaaaagtattttatatttcccaaaaaaaaggaaatgaaaatattgtagaatttgctcattaaattttttcaacaattttagggggatgatacaaatgagtccgaagaaagcagtctggaactgagtaagtttagcaaattttcgattttttaaagaagataattttaaaatatttaattaagagaataagttggcatttgcggtgccgacacaaaaaaaaattttgtttaatgcataactgaaataaaatgtttttttataaaaaatattacatttaatcaagcacaaccattcatccccaaattgttccaaattgtttgtatgcttttaagcagtaattagttaggttcaaatttagtcaaatgtatggtggaaaacacgaaaacggaggcggatatcgatgccgaagacaatgatggcaattctccatttatgctggctgtcatgaaccagcgcactcaaattgttcgttattttatctcgaaaggggtgcgaattgatcggaccaacaaaaatggtgaggaaaaatgttggatttcgaaacgaacgatattttagaggttttttttaatattttaacgaaaatatcaattgaataaaaatatttatttatttcggtattttaccgatggatccaatcacttgtacgatatctattaggttaaacacttaaatttattttttgctcagttggaattttgaaaaattttattacgaattccaaaatggaatttttgaaaaatatcattagaatttccaaatggaatttttgaaaaattttatgtcgaatttctaaatgtaatttattttgaaaaatacattagaatttccaaatggaattttgaaaaatattattaggaatttttccaaaaagatttttgtaaaaattttattacgaattccaaaatggaatatttgaaaaatttaattatgacattcaaacatttttttaaatttttcatttaatttgggtaattcaaagccattgcaggcatgtgcgcgctgcatttctgtgctggcgctgacgacagatttgagttgtgcaaattgttggtggacaacggggcaaatgccaacaaaaccgatggcattggtcatggcgttacgcccttgcatatcgcatgcggccaaggcgctttaaaaaatggttagaaaatgaaaattggcatgcgcatcctatggattggcattaattagggattactaggctcaatttgttaacggattttcttagaaagaattattaaatattttaataaccacttttgcattttgactaaaatttttacattaaaaattatattatgtataaaaaaaaatcaaatatatttaattcctgcggagggttgaaccaaggaaaacaagtagtaaatcagaaagattagccactaggccatttgcacagttgacagtctttttcttataaaatataacaaatccaacattgttagtatcattcgagagctgtaaatgttctctattaacctacaaaatttaaaaaatatggcccaaaaatttctgaaaacctgtttctgatgtacttttggccataaatttgttcaaaattgaaattttttggaattttgcaggctaatagagcatctgaagggctttcgaaagttcggtttttctaaatccgggtatgggagcggaacccgggaaatcccgttccgatttcggtcccactctatgtactctaaaaaatgaaactatttacttattcagttaaatttttggtggaacaatgcggaggcgacattgaacttgccgattctgatggtgcttcagcgattttttatgcagtggcgaaagagcaattcgatgttgttcaatatttggtctccaaaggagcgcgcattgatcaactcaaccacaaaggtgaggatggattggatatgactgatctggtaaatagtgaatattactagctagggttaagcctgaccccgtcccgaccccggaccccgagattttaggccatttattgcgagttgtaagtagggaccggacttttaggcacgaaaaattgcaaataggcacctaaaataggcacaaaaaatgtgaaaaaaagcacaaaaaattacaaaaagcgccaacaaaggcacaaaaaattggaaaaggcagcaaaaatcaacattttggacaactaaaaatataaattatactgggggtccggcggtgccgataggcgcagcagggaaaatttttttgtaaattgtaagaaatatgataagacaaattgaaaaaatttcaaaaaattttccatttttttcaaaaatactgaaaaaggcatgaaaaaaggcacgaaaatcacgtacccttgcataaggcactaaaattgcataaaggcaccaaaaagtccaagctagaagcttaaatcaagttaaaaactcgtttttcgtgcgtattaattaggccatagcaagttagcaaaaaaaaaaaaggcataagcctcaaaatccgaccctagttataagtagggcccggattcttagttttttaactattttttctgcggctttattttgatgagaaatgcacaaaaaacacatttttaattcggaaattcttcgttttaacgccactattcatcactaggaatcactattttggagcttcgccactaaaaaaaactattttggaagttggccactaaaatagttttttgccactattttggcgtttcgtcactatttttcccactattttggcattttttttggaaaatttcccaaaaattcaataaaaacgaaaaatataccccaagaatcgacctaaaaaaaaatcaaaaaatacacccctaagaatcgacctaaaatttttcaaaaatacacctctaagaattggaaaattttttcaaaatttcttccccaaattttttttcttgctcaatatttgctaagaaaatattggaaaggaaatgttcctcatttgtgactgcaaacagtgaataaaattgtttgccttaattttaaattattttcaaattaaaaaacagctatttaaaaaattacacccctaaatttggaactttttcgccactattttggcatttttttgtcactatttagttaattatttggggattttttatcactaaaaatccgggccctagttataagcaactaaaaaccaccgctggggatatacgatcttttttcctaaatttttcagtactttcctgttatgcgactacaagccaaaattttaaaaaaacaacaaaagggggcgcaaaaggcggtgaccaccaataaataaaatgggtgatacaatccaggggaagtcttgaagtcaatacacagggttttatatgcattacatgcgcgaattttggtttgtagtcgcataacaggaaactaccaatttttcaaaatttattatatgtacaattgatttattatatacgcacaggtcgttcgccattaattgttgcgtgtttggttggacatttgcaaattggtaatttaatgaaataattattggagcaggattttgtgctttttgaaaagggccgatatgaatttttattttaatttttaattaaaattcaattatttctttttttttaattctggtttttccaaaatttctcatttttaaatttataaacaaacaacaaaacaactttatgaatgccgtaaaatccccaaaactttaaccttacttaaaaatattaattgttttttaagccaaatttcttgtggaaaacggcgcggacatcgaagttgtcgcttctgatgggcttactgcggtgagggccgcaataataaaggacagtgttgaaattctcaaatatttgctcgtcaacggcgcgcgcattgaccgctgacgagtttttaagaacaagaactttattgatgagtttctaaactttgggataaaactgagaatttgtcattttacccatgctcataacttgaaaaattagctggaaacccgccgaaggttttttttacacttcgccttaaattttattccagtttattttatcgaattggtcggaataataggatgaaataattttttagcccatttattaattgatttttgccaaaaaatgactaccttttcttttatttatttatttattcaaaaattaaaaaagttaacaattgataaaaatttcaattacctagttttctttagttttcatttcatgaatgcggttgaattctttcattttctttgagttatgggcctgaattatctattattagaacaatttatttattttttaaatttatgctttcgttttattatcataaaataaattaatcatctcttttttagcccacttcttgtgtttttaagttttttaaaaatttttcacatttttttttcattgaacgtattcctaattaggtaaatcaaatattttttagggttttttgtatttattttaaaaattctacatgcataatttttgatctcaaatgctctcgcgatttattgatttagagaagagcgaagagcgcgaaattgtcaaaaatttcttgttcattagtttttaatcattttgttcttttctaaattttcttttggttaatcctttttcccaatttttttttgaagcattaatcccgactgcaggattgtaactcattttttgcgggacggaatcccgtgggattagtcccgcaaaatcccgcgccggtccctacccatatacttctgcatttggttcattctcaacagttttaggaattttctcgcattctcgacaaaaatggtcgaatatttatatttaaatataatatattttttaatcacacagtcaaagctcgctttgttaatatttatctgagctcccaaacccaaaaacacacaaaaccacttacctataggttttcttatgcgctgaaaacgatagaacaatccaaaaaatttaacgcgcttcaactttaaaccggtttttgaacgggtttaaaactcgaaaaattgaggataaaggtggggcctcctgaccttttaaaagggtcaaaccctgacaaatttttgtgaaattttattgttcgatcgttttcagcgcataagaaaatctataagtggttttgtgtgtttttgaggatgctaggtcgaaggactaaaagtgcaaaatttgctaaaattttgaataaatccactaataacttttctcagacgcaacctccttcgccagatttgcactttctgctcgttcacacccacccacgaccatcagacaagaagaatacaagtgattttgcgccccgacgttccaccatggcacacgagtgctacggctttggcaatgtgcgagcaattaagcacgcacatcgggccagatgctggggcatttgtgctgcaccgcaagcggcgcataagtagtgcctcccgacaccggggagcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaactccccgcctgacactgtcatcggcgcggggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattc

SEQ ID NO: 746 - DNA, 1075 bp, Heterodera glycines
taataatgcaatagtcatcttttttaatggaaccaaaacggccgcgccaattccttcgactcatcctttttaaaaatttattgtcataaacaaaataagtatcttacagagacaatttatttaatctttttgaaagtatcttaaaaaatatttttgtgcaaacaatgcgtgtaacaattattgctggtgaaaatgttgcttcattggagatttcggcagacatggaactggaaaacttcttggccttgtgcaagttcgaactcccctccattgccgacacaccaatcgaaagaatcgcgctcaactgcagcggtcggcaattcatcgccaatgctggactagcaaagaaacagcttaaggttggctgtctgtttattgttgaacaatgggtgattacaaatgcttttaaaaccaaaatcttgtctctcatctcacaactggccaattttaatgcattttttataatttactattgtccatagactcaaatttacagctttaaggatttcccccaattatcgtttttcaggagttgaacattcaacatgaagacgcgattcatttcgaaacgatcaggttctttgattgtcaaccctgtttccttttgacattttaatacggcactccaccgaaacttctttggtatttgaaaatgtcaaataaaaagaggggggggggtatcatcagaaaatgttaatggaccatcacccaaattgctttccgttgctgacctcactctgttgttcatttgatgcatttgctcttttcgttcagtgcttcttccaccgcccaaaccccccactcgtccctttccacgccgtcctcagccgcttcgtcctccctcggcgctccgctgcaaacttccaatttgatctcttccctcgtccaaaacatcaaagtgccccagaagcaaaagagcgtggcggaagaccgcgccatgtccgaccaaatcttcaccatgctccaacacccggcacggctcgacttcctccgggtggaccaccccgagttggccgctgcttatgagaaaaaccaacggacagaggttcttgtccatcgcatcagtttgtcttga

SEQ ID NO: 747 - DNA, 5167 bp, Heterodera glycines
  misc_feature (5085)..(5085): n is a, c, g, or t
  misc_feature (5108)..(5108): n is a, c, g, or t
  misc_feature (5114)..(5114): n is a, c, g, or t
  misc_feature (5131)..(5131): n is a, c, g, or t
  misc_feature (5139)..(5140): n is a, c, g, or t
  misc_feature (5156)..(5157): n is a, c, g, or t
tcccggcctttcaattccgggctctactgttgacatcatcatgaattttacgtaaaattgacaattgggcgatttttatttatcagtgccacctcccaatttgaaatgcaatattgtgtatttttatacaaaataaaaaaagggatttattcattttatgaaagaactatgcttgcattgataaaatattagcaaaaggcatttaggaaaaagccaagttaaaagttgttggaaagatagaaaagtgaaaaccttactcattttgtcatccttttcctcttctctcttccctctctcattgcctctaattcctcctctcttccctctctctctccatcccttccgtctcattgtcccacttccaaccccgtcagttcaatgtctccttcaacgcgcacaaatttgtagtcggtgttcggcgactccacacggtgtgcaaatgcgcagtaatggtggccgttgatgaaaatctgcagggagtacggctcgttgaacacggcgatgtccgccgcctgttccttcttcagtgggaaggcgccctcgcgctcttcctcgccccacacgccgtctttttgggagccgcggacaatctgttgagactgtaaagcatttcctttccatttgcccacacctttttctcgctaaaacgcggattcaaatggaaaagtgtgtccccgttggcaccgatcaaattgatgctgaaattgcccttcggaatgccatagacaaaaagacgttggcctgaaaaaacggacccactcaaacatggaaaggaacatttgtgctgttgcaattgctaaacgtgccgcttttgagagaagtgccgtggaaattcgcttggaatggaagttcgaagtagcgaccgccccagtgaacgccactcaatgtgacgtcgccacggaccttaaaaattgaagtgcctcgggcgggggaatgaatggccatttgtcaatgttttaaaaagggcacaacgccaacaaacagcaaaaaaaaagacatttctcaattacctgaatgtggtcaacgttggtgtaaaggattcttaaacattttcttcacaactgttccctccccaaaattgccactgaccgatgtttgaattcggtgatttgtttttgattggcgaatatttcgattcgatcttcgtggacctaatgacgggaaaatgggcgggaaatcggttgcaaggggaaaacaaaatgaattacgcggaatcgcaggtcgaagggctgtcccttggtgaaagggttcgagtggcgctcttccttcccccattctccggcctaaaatttcaaaacatgcaatcgaaagcattcattcccccaataaatgtatcgacaaaaacggagagcaagcagtacacgtacagcaaatgagttgagcacgactttgccttcgtcaaatcggacgctgaagtgcagcggcgcggagcccatgtgggcatcaatttcgacgcaattgctcaacaaattgacctcgaaacggtgcgcatccgcgttcacattgccatgaatgttcagtgtttgaccgggcgaaatttcggacatcaaccgagaagtgtaggggacgaggatggaccggtcctgggaagggggggggacaaaatggaggaaaagactcaaatggggggaattatcattttcagtttacgcaccatttttgttggagtttagaccaagaaataattgtaattttagaataatttaaggggtgtttctgaaaggataaattttggaaataaattttattttttatttatttttggcttggggcagaatgatgtgtaattggcagaataaacgagcagagagcagcaaacagcggtggttaaaagggaaaatatgaaaacaaacaaacggacaaacaaacaaaacgagagaatgaaattttgcgggacgacgggggaaagtaaaggaattattgcatttatacatagtggttgagaaatactttcagctcggcgtatataaccacacaaatatctaatgaaagaagttttatctttgtttttctgtttgcaatatatgtacctaattaacaatgagtcaccgctttttgtttttgttgccacataaaaaacgatcaaaaatttatttgagaataataaaaaaggacaaaacgcaaaatgggacatattttgagcgctaatcaaaaacacaaaattagataccaaatttattcagtttagttgggaatgaagcgagttatgtctgatcaaaataaaaaatacaaaaaaggtatttaccagtgtaaattttgaattagcgcgcaaaaattacgccaattacgcttttggcgttatgtgcaattttgtctaacattgggcttgacccatagtgagatagttgtctttggtaaaaacctatgtaaataaatgaaattttttggcagtaatagtctttttgagagatttcaaaagagaggcacgcccataaaaaatatacctgatcaaatatgtgttaatataacacaaattgttcttccgtttccgaaataattctgtttagctgttaataaaagcatagaaaatgccggaacgtttgacttatcgtagaaggctttgctacaacacaaagtccaataaaacgaaagtggtgaagacgcccgggggacggaatgtgttccactaccgcaataagcttggttcaatcccaaaatgtggcgacaccggtgtgccgttgaagggggtgagcaacgcaatgtcattaatgaaatgattggttaacgggaaaggcgaggtttaatttctgtttttggttgtttaaactgggctggacatacttttgcatgagagataaatctcccgtgggatatgccgacttatctcttcccttcagattaaagccgcgcgtccgcgtcaattggccaaaatgacaaagcgaaagaagacggtcacgcgcgcttacggcggttgtctcagcgctgcggctgtccgtcaacggatcatccgcgcctttttggttcgtacttatcactggactcaaagaattgttttgtgttgagattgtcaatattttacaaattaagaatatgaactccctaaattggtcgtttattttcatggttaaggtggaggaacaacagctggccaacaaaatactgaaggcgaaaagtggcggtgggaagaaataatgcggaagacggacggacagttcggtcattttaaggacggaattatttttgttgcttttttgttacctttgtgagtaaaagcattgctctgttcacaattcttcaaattacataaagggaggctaactttgaacatttttttaggggaagagtattaagaaaaaatcagcgcttaagcttattgggtatatgttctttattgagctggatccatggcctggattttctggctttttcgggatgtcgaattctgctgttcttgtcatatatttgctagacatctatctttatcaaaaaacaacaataacaaaatgatttcttcactcgagatttgttaactgaaatgcaatgtgaaagggaatgccctctttgaatttggcgtgagaactcccgcagatcagtccattctcaacacaaattgcgccattctcattcaattgtagtgtaaattttggtgtttttccgtaaatccattcgtcgctgcgcaaactgctaaaaattgcatcgagacctaaactgaatgaaaagatgagaacaaatttgtttgacatttaaattgccttcaaatttgtccatttcgccgttccaccgaaccaattcgctgcttttgtactgcaaaacgaacgctttgagaacagaatcggccaccttttgtagaggcattcatcattttgtgaactgataaaatattttaaagtgccataagactcgaaactccaaattgatcttcttacgaaaataaaattatttcgtgccgtaccgtttcggcatttccttctacattttgttttaaatgtcgtgccaaacagtcgacggattttgcgcggacacttcggctcgcattggtttgaatccgctgatcatcaaagggcgacttgagtgcgcgtcggacagtgccaatgtcaacatccaccagcaaagtgaagtgatggtatgcgcgtccgcgtgcaattcgtgcggctgtgcccgacactttggcaccgcttggctcaattagcaaatcgtcgcgttcgtttgcgatcagtcgcggagcggtggcagaagcacaaccgccgaacaatttggcattcagaaaatcggccacaatttgcaaattctttttgcgcgaatgccgttcatgtgtggtcataagactaatgttcaggttacctcaaagaaagagaatttttaaggttgggatttatttataaaaaagatggattgggcatttcttggcaaaatactccgttcttcctcgaaaataccttcgtcgtgataaacagcgcctccgccgctgtaccgtctcgaaattcgaatgccattggccgcacagaaacggacatcgctttccaaccacggattttgatacctgccgatgacaaccgctggagaattccttgaaaaataattattggcaaaattttgctgatttttgggataaaatcagtagattaaaacatataatatattttttggactgacctccaaatgagaagagaatcaccgtcctccttcacgccattgttccgaaaaagccattcctcaagggcgagattctcgtaaatacaacgtgacgacgaaatgaaaactgtgagtaaattgggaatttggtggatttttgttggaagtgccattcgcagaaaagaaaccgtttgtaaaattttcaaaaagaaatttttaatttttaaaattgacgttttgttttaaatttttgcaattaaatttaaatgcttaatttctttttaattttttggaaaaaaagaacagtttatacgtaaattgcttatttgttttattgcctcagatgcccaaaaaacatacgcaatcgaataaaacgaggaaaaggtcgggaagagaccttgacgagatccatgctgatctgatcaggcccgacaaaatgcaaagaattcaggtccttttcatcagtcattggggtgttttggcaatttccaattaatgtctaattttaggggngatggggacgttttgttttattnaatggngttctaaatggactttnctcccatnnttttaggaacggcctnntttgacgacg

SEQ ID NO: 748 - DNA, 2789 bp, Heterodera glycines
tttaggtcacaagcgtcgcctgcgcgccctcggagaaaaaccgtacacgcaaagagaggcggaattggccggcggattgggcgtggaagagcaaatcaaattggaaagcctggcggatttgacattttagcacccatttcttatagggtgaatttatgtttttttttgttgttgtttttgagttctttatcatacaaacagaaaataataaataacattttcgcaaaacaaaatatcaaacaatttcgatggatttcaattaacaacaaattgaaaaggttaaaccaaatgtgcattggtcatcaacaaaatcattaatactcaccaattattatcctaattctgaggggaatggaaatacctgagaatgagagatgcaactactgtttaagaatgctataaaatagcaaaaggaatgaaatgcacagtccattctatttcaaaacattgttttttgtgctaattaattactcttatgttgaatttaaaaccaaaattccctaacacaacgaaaattgactgattgtgagctgtgtcaattattacttttagcctgtctattagaagcttaaaatgtgctggagaaaattgcgttaacggacattgtaataaatttaatgaggacagcagtaaaaaacagaattgagatggcgaaggaaaacaaacaaaaggagcgaaaaacgaaagcacaaaaaataatgatggaagaacattatgaagaagcagtttggaaattaaagcttattcttctgatacgaaagattgtgtgcttccgctctgtcagctgttccttccgtgctgaggctgaccgatcgactcgcccgactttcgtttgagcaatgcttggcgaatgtattcggggaaaaggtcgtcacggcggaagatcatttcggaagtgaccttgggaagaaaaggaatttaagtcaccattccaatttccatttttgatgatgcatttgttaatcacctcaacttcgtcgtctctccgtttattttttggcgtttcgcccccatcctccgccgcctcttctgcccttctccgttccttcatttcgaagctcaacggtgggtacagcttgaccttgtactttttgcgcgggctttgtccccggtaataggcttggtacgtttttccgtcctcctcccaattgacatacaccttgatgaaatgagaggctaaggtattagccaaaatgcgcccagttaccagtgagccgggaatgtgtgcgcctccgttgcagccgaacattttgcactcgcagtcgacgatgtcacttgggaacacctcggaagaggaagtgccgtccaagaaatccacggtggcgtacagatgttccgagatggagtatatcagcccgtatccgatcagtcgctcgtctttcttctcctcctcttcctcgtcgtcgtcgcccgtctcttcgttcaggtccacgaccacgcgctgtttgagttcaaacacgcgcgagtctgttggatctgacaaaaaacgagggttgataaaacagctgtagcaaaatgccaatttttttcatttcctttgtttgcgtcatttctctgtgcattttgcaaaatgcacaaatgggtttcagacgcaacggtcattttggcacacacacaaaaggaccaaatggcacaattagcaatttcggtccaaacccgagtgtgcgagaagcgattgggagggaaagcaaaattgaatgggctatattaccaaaagcaccggcgaattgagcactgtggtgaaagacacaaatgggcaacgccccggggaattcgcggcgctcgaaaatgacatcggccagcggtgcgcaagtaacgtggaaacgcaatttagcaccgagttccttctcttcaacgcaaatggcacatcgaaccaaatgttccgactggtggccacaaaccttaaaaatgaatcgaattctccggcctgtttcggttttttgcattgataaaggaagttcaattgctcagaaattattacttcgcattggtacgaagtcggacgttcctcgccattatttctgacatttgggacctccggcgttgtacagtgttcgtctgctgcgggtacagtggcacggtcatactgtaggggaacacaattgttgttgttgcagcttctcacatgcggtagtgatgcggaataagaacagaagggagtgtggggaggaaggacggcgggcgacaatttggcggaggacaatttgaggaccaaagaaaggctgttgttgggctgcaaattggcgccattcagcagaagagggcaattgtagggaacagaagcagcagcggcactgtctgggtctgtctttttgggcgtaatggcattggcacattcgctggtcgaaaggctaaacggagggagaaatgaaaaaaagaaaacaattatatgaaagaattcttccatttcttaaataaattttgataaaatgaaaaaaaatctagcttatataagcaaatatatcaaaaaagcgaacgtgtcagcaagtcccgagtcaatttgtctgctgtcatcaaattcaaaatattttgtggaattttccggtggaacatcgacagattgcggcgataagtctggaggcgttgaaggcggacaatcggaggacgcaccgcgaaagccattgtaagcgatgtttgtcagtttggaaatcggcagaaatcttaaaatttgaatggcttttgtcgggaccctggatacttggatagagaattgccagccaattggctttttgaatggggtattgttggcatacagcgttgaaggccggtctttgactctagagatcccc

SEQ ID NO: 749 - DNA, 1329 bp, Heterodera glycines
  misc_feature (1253)..(1253): n is a, c, g, or t
ataggtgggcactgctgctgttgctgctgattctgctggtgttgtggcgttttgctttcaccacggggggtcgtcatgttggcgtcgaacgaagcgcgtgtttgggtccatcagtgcgcaaatgacgtgcacaaagccaagggttttgagtgacactgtgcattttgcgcatcaaagcgccactccgaagttcacacaatgcgcacgaggcggtgcgaatcagcacgtcgttggggtcgtcgcaacgttcgcacagccattcggcggacgacgacgacgacgaagttgagggggaagagtgatctgacgaggcgaaaacgatggcattgagcaatgggaagactctcattcggacaatcccttccctacccacactgacagtctttctgttcctgcttaagggtgcattggctcggataacacccaacgtggaccaccactttgcaattcgaacattccctcagttggtcgtccctcagtttcgaacgacccaagtccaacgtgtccatccgaaaatccttctcgaacatttggtcggatacaaatcgctttgacctgaacacgaaagaaaattctttttgttggattttaaagatttgattgattaaagggcactgacttttccggcactttctccaccggtgtgcccttcatccaaacggaacgttgcaaaaagaattgacagacggcacagtgcgggtacagtcgtccgctgcgcgagttgtgcaccttccgagcatttgatttataaattaaattttactatccaacaacataataaatatgtttgaaaatttagtgattgttcactttttgcaatgcgtggtgaaaatgcaccttttccgcgtacaaatccaccggtttgttggcccaaagtgcgtccatcagtttgcgtgccttgaaaatggctttctgtcgctttgtgcacggcactggcaaactgtcgtcgctgttattcgtctccacactgcccgacttggacgcgggttgggaggaggtcgaacctctgcgaacggacatggcacgagtttttgggcctggaaatagtaaagaatggaaaggaaagtccgaattaaaacacaccccatccctcccatttaaaatgaaacaaatttgcaatcacttcttaaaaagctcgacttaactttgcccgcactgtacggagtgggcgcttccccgtaccaatagtcgagccttaacgggaaacaaaaatcaaacaaatggtaagaaacattctttcagatagaggctgncccctctttgtattcgtttggtcgatatctctcatatggatgggcgccatgtcaatctccacacaatcgttcgaca

SEQ ID NO: 750 - DNA, 2567 bp, Heterodera glycines
  misc_feature (10)..(10): n is a, c, g, or t
  misc_feature (2552)..(2552): n is a, c, g, or t
ctccacacanatcgtttcgacaatagcacagcaccgcatttttgcctgcatttttgaaaagtgaaaattaggggtctttctgattaccgtaatcgatccaccgttcgagcgcaaagtttgtcgattctgcgcaattgtaacccaaattgaagcccatgtgataacctcgaggaaatgctggagaaataaaataattagaaatcagaatcaaaacaatcaaatcgacgccagttctattcgaatgatccatctcccgaccccatcctccgtttgtctccacgtttgattttgccgttttcttcaaccattccatttttctgccctcccattctgctcgcttactgatcataaattctccggggtattgcaccattgagccgaacggaacgccattcgtgcgcagcactgacggtgagacgatgtacactttgtggcggagaaatgccttgcaaatttggagaccgtccggaaatcgttgagccgccaatcgttcaaattttgccgccgcggacggaggaatggcataccaaaatttgggcttaaataaggaaaaattgaagagaatttcatggacactcccatcaaaatttattgaaaatgaacttcattgagtttttttaacctcgccaaaatggaggtaattgatggagtacagatccatgtcctcgacatgccacgggaacatcgttttccacatgccaaaatagagaaaaaccgtgttcacccctttgatctcgagctgaatgaaatgtcaaattaaaactttgttcttccatgtttggccaacctcttgctctttgagcaggtccaaaatggtgcccaacccgttcatgttgaactgagagacacccgggtcgtagatggagcccggcgtgtccgccccgtagatgggctcgtggtggagcaaattgcgccaaaaatgtcttaatccaatgattagtttgatgcataaagactaactaacattttggattaaaatatataattctataggttttaaaaattatatttttaaagattatgttttttaagaaaaaactgagggaataattgagttttgtaaagaaattgaaattacttgctgttaactatcttaatcgataaatatctctctgctttttgttgtcccaaccgaacaaatcgcataaagtaagtcgggttaattactcaataaaacaaaaaatgaaatgccacttgataaaactgatcaatttgcctgttttagtacctttccaattcggtgaggtcgtaattcggttttggaggacgaaattgcttggagagtgccatccgccggaaatcgccgacgcgcatttccttccggtaaacggtgttgttcttgacatagcatcccgtgctcgagccgccctcaatccgttctttcctgaaaggcttttattcgaaacgttttttagcctaagcaaagttgcgaaaattattaaatacgagaaaaacaaaaaaaattatgatttttcaattgatcagcagaaggggaaattctttttgagacagcggcgacacaattcggtaagcaacagaactcgccgccctcccgtcgtccgtccgttctgcggtcgtttcccccttcccctgccccccccccctttcgtcgtcttcccttacggcgccattgcgtcggtctgtctcttttcccttcccttctctcctcacttcgctttgtctttcctttgctcgccatttttaatgaaaaaattattttacttaaaccaaaaataactgcaatcactcaataacttttcaactgttgttatagtattattatgacagttgattaaaaatccaagtttcagatgactattattttttgcagaatgtgcagtgctcacactgggcaatgaatgacgaagtcgttcagatcggagtaatcggacggatttttggacggacgcgggtgccaaccgggcggaggaatgacctgtgaaagaaacaagttttgtggcaatatgtaacattgaaaaaataattagcaaaaaaatgacaattaaaaagtaaaatatccgacgaaatgtccgaccttacaaacgccagaagataaatgcgctctgctgcgctcgatagtttcgatgtatttgctgaaattcgaaaactcctccatcgtcggtcgaaaaaccattatctctccgtccgctgtgcccgtgttgacccattctttttccttggtgtaaatgggtctataagctgccattcgaactgtgaaaagattaaaaaagaactggtttaagctaaatgtaccaaaaaggcatttaggtaattaaacaaaagaaagtaacataaaaaacaataaattaatcgatcgcaccgaccgatcgaattcattgctctaaccgaataaagtcaatttgttatataaaaagtaaaaccccaaagtttctgaatgaaagtgcattccaccagcatgattcaccgctgtttcgcttgtcgcgtcactttcccgccgctttttactgcctatgcatttgcatttgtattcgctccctctctcccctttctaattctctccctcatatttaatgggttgctccctccaactnttttctcagctccgt

SEQ ID NO: 751 - DNA, 2969 bp, Heterodera glycines
gtctcaattcatgtgctttgtcgtggaatgtctctttccgacataaaaaaacacattaatgaaaagtgaatattttttgttagtgaaagtccaaagttaaattttggagagaacttttgagaccataaatgcttaaacccatgctcacagtcaaagtgccacacatttgaatacctaattcatttacagtaagcatagttaaaatttgcttgacgacaaaaaaatcgatacacagagaaatttaaatttaaattttatctggacgaaattatgtaaaggcaaaaatgatgtgcgcttcccctaaatctactcctctttgcatttcctttcgccatttcaccgacgacgacatgccctgaagcaataattaatcaccgggctgacccgcattcaaatttaaactacaaaaaatttaaaaaatgtaattggaaggagaaaaaaggaaaagaatagcggtaggggtcaactccgtctggccaactccgtctcagcaatgttcaaaaagctataacttttttctttgttggccaaacttcacaatcatggtatcattcgaaagccctagatgtttagaagatatttataagctatttctcagtgattaatcagctctcaaaaaagttgtcagtttaaaaccgcaaaaaaggcagaattttcaaagttttttatttctatctttttttatagttcgaaattttctgtaatttttagtaggctaatagagcctgtgaagagctttcgaatgatatcaagattgtttgattcggtcaataacttcaagagttatattgactcaaagttggctcagacggagttggccagacggagttggcccgttccgaaagaatagggaggaagaggacgacaagccattcattctttgcttacaaattagtcgaggtttaatttggaatttaatttgtcccagtggtctgcgttggtcttctgaccggtctgcttcttttataaaaataaaagatttgaactgtgatttaacctggacttagcgccttatttcagccttatttcgggctagattagttatgaaatttttctgtatcaatcaaagctctaatgattgtctaattgaatggagtctgtatggaaaagcaacgtcgaaagctgtgcaaaaatattgagccaataacagaattccgatactgactaaaaaatcttttacataaacttggtcacattctcaacatggtgaatgggacacatcaaaaattacataaaatctggaaatttttgaaaaattctaggagcgggttggaaaatgttagtaggcctatcataaaaagttcaaaatttctttaccgaatttcgttttggagtgagtcggtctacgctttttccccactgagatagagaaggtgtcaaaatcgatcaacacaaaaaatgactcctttctaccgtatattaagaaaaaatgaacggtaattgatcattaaagtaatttatcaccctttgtttctctgccgcttcaaatattaacccttcattccaaacgcactccgtttaagaattttaagctctttttgataggactgcctactcatatttttccagagaaaatccagcccactcctagaatttttaaattttaagaaatttttagtgtgtaccatttacctgaagaagtaatttcagcaaattggtgtaaaagattgatttattttttagtcagtgtcgaaaattctgttattggtccaactttaaccactcaaaacggggtgccgttgtttcgaccaattcgaaaatgttttggcccaatgcttttgcacttgactgtaaaatgaaaaagaagctctttttttatttgcttctcttcattgttaaggcggacataaggcccctccaccggtgaattttccgaattggcaatacgtacaaagcgttcgtttgtttgtcctcgatagtgagtgaatctcggattctgttttgataggccaaccgagcaaagaaggtgaaaatgtgtgatttgcatgctgcacttgtcgctgctccacaataatttggccatttcaatcccaacaatcgctcggcaaattctcgatcgatcggtgccgtgccgcttctcccatccatcgcactgatcagcaccaaatcagcaacaacaccttaggcgtgctgctgctgctctgcttgctgtggtcctcccattcgcttctcccctttaatctcttctccctcttccgttttgctgtcgtcgtttgctgcttcccccccctcccctataaataccgtaccgtcccttccctccggtgcccattttggctgtgtgttgattgccatctctgatgaaccaatggattaagtcttcgggtcttctccccgcttttcacccccattttaagctcatcctcgatagtttcgcattcaaattaataaaataattttgaagcaaatttgttgcaatttctccgtgtttttcatatgaaaagcttaaaagcccacaaagtccggtgcttttgtatgaaaaatgtcggtgaatttagtaccaaaaaagttttttcctttttcctccatttttttgtccttttccccgcggcgcataatttcttctccgatcacaaaaaaaggcgcccgtccgtccgtccgctgcgttttgcccgaggcgaaatgagggcggagtaaaaaaggtcccccccccccttttttttacaaatgcgcatctgttgccccccattaataaagtgcccttcccccgcttttacctcttttgccattttccgaccgtcgcaatttttgccgaccaatgcattcattcgtttgtacagtaattccttcctaccattttcagtttaaatttattttgctactctctctcataataaattcctttgtcaaatttttaatgcaatgatattttcctgtgattttttaccgtatgagcccataaatatcaggggatttccttttttaaatgacaaatttattccccgttaaaatggcgcggccaaatttgg

SEQ ID NO: 752 - DNA, 3986 bp, Heterodera glycines
gtgcacaactttctggtggactatcagtggggaaaaacgtaaattgtagatctgcacctgttagacgcaatgtgtaattaccatttattcgatcgctaaaattgaaccggtgtaaacaaaaattacgctcattcaaaagctcagggtcgtgaaatatcaaaccttttttccaagttttgggttacccaaaatcacgcaggtgagaggaaaaataaaagttcgtgtgatatttttgaaattccaaggtgaaatctgatttctatgtttgacatcttcaaatctgctgttctctctcgatttgaagtagaatttggtctggaggatgattatgcattcgagttccgaaaaactcaccattactctcaaaaccccaacctttgcatccttgttggtaaagttcacacttccaccaagttttattttttgtcattttgtgtttgtgataacaatacccgtcacaaaactttccttttgcagagttaacagtgattaattttgccatttttaaatgtaaatctcttaaattcttttattatatttttacatattcgaacatttctttgcctttttaccactttaaaatagcttctatctcaactactgttctgttttgcctttcatcacttaacacgaaaatcagcgtcgttcgttgtattttctgttcttgaaatatttgacttttccatttttagtttcacctcttttcatcacttctctagaatttcatcaatgttcttagacttttcacatcttttcaccacttaaaattgaaaatcacctgttgccaattgtttttcacctcttttcaccacttaccacaggacatttcacctgtcgcatattgttttttcacctcttttcaccacttaccacaggacattcacatgttgcatattgttttttcacctcttttcaccacttaccacaggacattcacatgtcgcatattggtttttcacctgttttcacctatttccaaatgtttttcacctcttttcaccacttaccacaggacattcacatgtcgcatattggtttttcacctgttttcacctatttccaaatgttttttcacctcttttcaccacttaccacaggacatttcacctgtcgcatattgtttttttcacctcttttcaccacttaccacaggacattcacctgtcgcatattgtttttcacctcttttcaccacttaccactaaccatttcgcttgtcgcctactgcgtttcaccaactttcactatttatcagtgaacatttttgcttttaccttttcacttttcaccatatacatttgcttttcacgacttatcacagagttttacctattcatttgcctgtttgaccacatactaacacataattcatctatcccccttgtatcatcattccttttcattctcatttcaccggttttcgttgcatattcatctcttttcactatgaaacaatagcattagacttttccttatagtttcacaactctcttcccttttcgggtaaacatttaaccagtttcccattgactttcccctctcttcaccttgtatttagaattgctttttcttttgcttttcatactatttcctctgccttttcaagcagccattgtccatgtattttacatcgtatgcaaattttgtcaaaagctgaaaatgcttttgataagaagtgattgattaacaataatcataaatatttgaaatattagccttgtcatctataatcttacataaatcggaggaagttttattttagtatgaacggcatttgtgtccctttctgaatttatttctattcttttcccattaagttggactttgggttttaaaatttttgataaattcttttctactcgaggattatcttttttattaaatgtttcattggatttttctttttggactttgggctttaaaatttttgaaaaattcttttctactcgaggattatcttttttattaaatgtttcactagatttttctttatttttcggaggtcttcctctaggctttctttctttattcattttacaaaattgttgtgctttaaagatatttagttttgcaattaatttttatttatacattattaacataataaaatgttattcatctgtctgttattgtaacaataaactttcagaaattgataaaaatttagtgaaatgcaatgcaataatattcaaaaggagaaaaaatttaaatccctttcacggttcataactagaaaattggatgaaacaaatttgcaaaattacgaaaaataattaaagtcatgtaaatactaattaccccttaataaacagtcggtcgaaagaaagatatattttattttttttcatctatattaaaaatccctaattctattggaaaatttgaaacctttaaaaatatttgatcctagattttttgataactttttgatcgaaaataatttttagggagctataaaagtgttatttgaaatgaatggaattttcattcttttttcaaatattcctaaaatatatcattgtagattggaatcccacaaaagcctgctcagaattacattcggtgcctgatattatttttaaatttaatcttgttaaaatttcgctggcggctgttggcaaaataggcgcttcgaatctgcacaggtgttcatttaattttctgtcatagctctgccaatctatgaatggagtgagcaaggtttaatgaggaaaacgagatactcaagccttttaatccatgaaaatgtataatcttattaggtgtaatctaataaatcattacattaaaatgaatttttggacaaaatttgcgattttaaagctttttgtttttactaaaatattaattggggttttaacatgagtaatcaatatcttaatatcgtcccgatctttttcaatgccttaagcttggagattttaaaaggtctaagttgggaagtgttttcaattatctagacatattcaaaagctgtataccatcttatgtcacaaaaaaaagcattttcaagggaagaaaattaatattataatttaaacattcaaaaatgtagaacggttaaaatatatattcaaaagaaaaggttcgggaactcaaaaggattgccttttcatattaaattatttattgaaatatttcaaatttttaaatgcaaaaacaataataaattacgttaaagagttaaaagggaatcttttaccagagcattatttgtatataaattagctcagcgggaaaactttagatgaaaatcccctaccattgagtttgggattcaattaaatttgaaatagaaagaagaacaacgagaattacgtggcaaagacataagagtaattatttttaacttccctaaatccaaaatctaaaaataatgatgaataacagaaaaaaacaatttatggggaagaggtgaagggagcaaaaaaaattatcaagaaaaattattttttaaattgctacgaatgactttaaacaacatacattcagaattttcaattttattattttttttaatgggatttgaattatctttgggtcattgagctgactgatgataattaattaattttgcttaaattttcaaaattttgggcagcctatattttgaactcgttttttatgtgggacaaaattttttcaaaaattgaaaaagtatagaaaattggaaaatccaaaaatattttaaagaaaccctatgggatggaaaattaattataaataagttttgttctcagctttatcctgcagagtttgatgagcttctgatcatttttcggataattatttggatttaatttatctttaaattagtaattaaaaattcagaattacgggagccagagcatcatagaaatagtgcaacaacagttattaaatggaataaacaatttggaatgattaaatttataaccaagaccaataggcatgggtttttgcttaaaggtaatagtcgggtgtctctttacattttaatcgttttc

SEQ ID NO: 753 - DNA, 3857 bp, Heterodera glycines
ctttccttttccgcccgctcacctgatggtccacgcccgaggcggtcgcaagcagtcccccgctgtttgccagctgaacggaggtccgtcgtaacgaatctgtcgcccggacatatccgataaagtgccacctaaaagtggcaaaaaactgtttgttgtaaaaaaacaacaatttctaaaaagtgtaccggcagccattagcaatgcctcgggcgcggcaatgtcccattttttggtgtcccccgcggcgtaaacaaaagcagtggccccctccaaacagcgcaacactttaaagcccgcgcctcctgcgcgttccacttcgctgatcagctttttctcctccaacgcgtccaatgccttttgcacctaaggcggaagaaggaaaaaataccaattatattcaattaaaataaaattgaaagaacaaaaagctgttcgaccaattcggagcggctacggaaggtaatgacagcgacccgcggcggcatttgttcattagctaaaaaaagggggggtgagaatattcggcagctcccggaaaatgcgtcaattccgaattcctgacacaaataaaaagtcgaaatacaaatttaaattttacccatttttggttctaaaatgcgtaaataatctcttattgcaggattggtgcctttcagttttgtttccgtgtttttcaaccgattttgaacaaaaaacgggtaaaattgaaacttggactttcgacttttagttcgaattcggttccgggattcggaatttcaacgaagttcttacagaattttactttgtttacactacttaatgctacagaacttttttaaaaattgtactgatgcattttccggtcacatactcggcacaaccagacaaataaatgctgctttacccttcgggaaattcatattttgttgcgccgttttcttaaggccaaaagtgccaactccgacaattgaccaaacggttcgactttgttccccattataaaacggctgatgcacaatgccggccaccggtcggcctttgtaagtgatgccaatgagcacagtgacatgacgaaggagcgcttgaaatttatttatttttgccatttgtgacctaatttatctgaccccgattatcttttgactttgtaaaatcggaagtgccgtccaacgggtcgacccaaacaacaagctaacacggggacaacaaattatatgcgaaaagcaacgggcaaattaaagccttgcatcttgcaattaaaaaattaaaacaacaaaaggacattgggaaaagaaaaattattcaattggcaaattaattattaaacattaaaaaagccggacggacgtcttttaagaagatgtgaaaatgatgtgaaggcggcaaagcttcaagcggttcaaagggcgtcgatgggagctcaatttcctgcaaaaagggcaattagccgaaaagggatcaaaggcggcattcattcacttcctcgccaacaatcgtaagatttttgccgaatttctcgcgcagtgaccgttcaatgcacaattgagcagatctaaacgtcaatttatccacaaaaaaatggaacaataattaggaggattccttttattgaaagccgaaaaatgcgactaatgaatatggcgttttgcccagaaaactttcgtatttttagggaatttgcgggtgtaattcgcttaatccgcccttccttttgataaaatgccaaaatgtccaaccgatcggcctcggtttgtaaatcctccattagtcccgtttggtccttgttcacaatttgcaggtcaccactgttccttatgtcctaaattggtctgtttttaattgagggcttcgcaggtgattagtgccttaataattccgaccaccgcttcggacagtcgcaccgacgaggcgaccaaccgcgtgagcacacacgcctctttaatatgaaaattattgtatgcaaattaaaaatgcccgatgctgtgagctaggctgctaaccatgggggggggggcatgagggcagttgacccatcgcaccgaaatccgaaaaatgggtaatttttttaaattttacctcaattttcttaataattttgaacaaaaattttctaaaatttaactgaactgccgggtcacaaattttaccgtaatttttccaaaattttaacttaaaatggctaagattttcccttatttttttacggcaccgaaaatttaggtcaattaaactgacaaaagaatttttgacttgaagggcaaaaaaaaaccttcgcttatccctcatccgaatttttttttctgattaccgggcctattgtttagcaattaaaatgaaaaggaaaatcaatgtttactaaaatccattgttaattcataaagtaatggcatatatctttgtatgcctgactatatgcactttggcatgcccatttttggcagagtgtcaatacatcgctgacatgccaaaaagggataatttgcgttatcaaatgcgaagaaatagcacatggaagacggttaaacaaaatttcagatagcacaatccaatgaaaaaagaatgggcagagaaacgaacacaattggcgatgcgttggcatattgcgcagggccagccaaatttacgaaattcactgcccctcccaccccaatgatttggcatgtgtctaatatcaattgataactaactcatcaataattcacgttaaaaatcagatttctgttaacatcaatctgtgtggtaaaatattgattgaacttattaggacaacaatataatggcattccaacaactgtttaagcatatgaaaaaaagaagaaaaaaacttgagttgcagggctgggaattttgggcaaaaccgagaccgagacttgtcgagatttatttccgacgaaaatattaaaaaattaagttttttttatttcataaaagtcaatgaatcggatattattagaaattcataattttaaatctatgaaggtggggatgcagttcctttcggcaccgccctaaacatttttgagcatccttaaattgccaatattttttgttaatagatttgcactttaaatatctatttttgaatttgacagaaagaatacttctttcaaatattgctttaaaagaatatgcatgtaaaaagaaaatgttaaaatctttccccattttcgcaaatgatttttcactcagatcccattcttaccggtgcttgtttttcccagttggtcccggccctaccggcaacgagatctgggcttttcaaaatccgaagaccgggaatcgagacatcggccgtctaagtctggccctcttttaatttaaatttgaaaagtaaacttaagtcaacagttatggcataaatattgagaccatccatataaaattccaatatttaaaaattaattcttctctttggcgagcattttgtgagtctgattatgaaagcacgcgaaattaagagactcgagattgagggacatggaaagaccatttttattcacagtctttaaatttttgtaaattcatggagattttttaacatatttgaataaaagtaccaattagagaacttttggtcaattaaaaagtatattaaattttcccaaaaaacacaagccaacccacacattttgagcccaataatttcattcttcaaaaagggcacaaacgcggaaactgatgaaatggcataataccaagtaattacgcgtaaaatatttaggggtactttaaggtgcagatcaagaatttggaattagatattggttaggactttcgtaaggcctccgaatccctgcatatatggggattctgaggcatcattctgaggggggagtgggtcaggttcggatccgggtgaagaaagtgatttt

SEQ ID NO: 754 - DNA, 6704 bp, Heterodera glycines
  misc_feature (6640)..(6640): n is a, c, g, or t
  misc_feature (6679)..(6679): n is a, c, g, or t
atcttttgaattttggtttttgttgatcactcggaaatgggcaatttctgccgcacatttcacaactgttaattgacgtttttacttcttcgaataattattttgagggtatggatgtgacaggctaatactaattgtgtttgaaattatttcacatatttttcatacagtatctcacagtcccccgaacaattacctaatcctaatgttcagcgtttaaaacctatttaaaataagggtttagatacttccatcctataatatttccattggactctcgttcattggcatttcatctgtgatttatttattttaataattttttttttgtgtattcgatccgcatttgtcagaccaaatttaatattccttcaaaatatcaaatcataattttgcctattgtagtaaatgaacgacatcatcagcaggaattgtatttccttttttacgctgcccgtccaagtgcatggacaaagttggagccgaacagtcataaaaatgtccggtacaccttccttttgaaaattgaaaaaggaaaatgcctttctcctacattttaaattaaaaatagttgaaaatagtaatactttttatttaattgaattgcgaatatggaagataaaaatgcagtcacaaatcaaaaaaaattgaatgtaaaattttctcatcccggtatcggtattttgactgactgagcaccgctaattcggcaatttggctttttcgacattgtcatttcagatataaacgcaaaaactaaaattcgctcacaaatcgagatgaaaacgcaattagtcaggcaaaatttaatgaacgatttttcataatgattggactgagtaaaataaattatttgttgattttttccgctttcccaaggttaataaaatttttgcttgctttgtttggcgtttagtctctttttttccattgtacaatctcacaaattttccacattgccttaccaactgctgacgaggtcattttgacctcttttactttacgattgaccccaaaattcataagatatggcgatggacagaaaaaatgataaaaagaatgacaattacttaatttagtcatttttattactctgttcaacgggctcccattctatgttgaatagtctaagaaattgcaataaaaatttccagcgacaattaaacatgtattaagtttaattaaatgatttagtgcgggaaacggtgcacggttcccggtaattggacacttagtgttcaaaattccggcagtgtacaccaattttcaggtctccgcacttacggtacaaaattttgagtctgtcacagaaatgccaccacatacaacccacccataacatttatatatcgttttaatggaaaatgtatagcgtgtttgttcgtgccaaaaatgtttgatttgttgagtaagaaaaaagatatagtccaaaaattcgtccggggatgcttcagtgggcgacgttttgtcctgttccgaattgttttgccacgttttctcgatattcccgcgcgcccgggctctactgcttaatttacttttagtttttccgttaccttttttcctatttaaaactttttccttttcaatagctgttaaattttttttaaataaaattatgaaaaaaaatttaaaatcttaaatcctttaagtctctttcggatgttccggaacccggctttttcccgagccgaagtccggctccgatggtttcagttcgatttcgactaaaaaattttttatagctaaatcttcgtttttttttattttcatggtacaatccccacactgaaaatttttatttttcatattttttttggtaagcttaaggtgcatttataattctctaccttaaaagatcgtcagcgagagaaaatgaattgttttaactgtaaaagccagtctaaattggaatagccaaaaatgttaaaattgtccaacttacagtagttaaacatttctttgcattcattttggtgtttcggttcgatatgaaatttttgttattttttgatggacaaaaaggtccaaaggtttacaaaaatgaacgaaaattagaaacattgaaaataataaataattttattacagaactaatggacatatgaattttagaaatatttccaaatgaatcgcgccagatcggacccagagcttaatgcaaattttcctcagcgaacaaacgatttgttcggtgggagagtttactgtattggcagtcttaggcggttgaccaatgtaatcttccttatcgacaccggtaaagcgtatgacaataattaacatgccgccaaaaaaaattttcaatttttattatttttgatcacgaaattgagatttcacctgacaatcggggattccttgatatttgcttttgaaaaattcaaaaaattcattgaacctgatccattcacaaaaaactccctatattcacaacattggcgtagaaaaattaagaaattctcaatttagctctaaaattcgataaaaaactttggcatggccgcgtccggtctctactaattataattaaggctctcccttttgtttgatcgcggcgcaattcattcgcgaacacaatttggctattgttaacaccaatatcacgttctctcttggaggagttggtggtgttagtctccgaactttgggccggtaatttaagaattaatataaccgaataaaataataaaaacaaaagcaagtctcatcatttcaaattttattttaactttttgtagtgtaatcgatattttttcagggctgaaggtgtagaaatgagaatcggaaggaccagattctcttctgatttggattgtgtcagggatgaatcataccatgttctgtgagcttttaaagttttataccccaatcggatatttgcggcaaaactttttgttttgttttgcggtcaaagccaaaatcggacatttgcggtccgacattttgcgatttcgcccaaatttcatggtcaaaataaaaattaaacccaaaacgagctcattttttacattttaaccattcattaagcccttgtgcaaggtgctacaatgttactcaaaaaatcatcaaaatgggcgttaataaaaaacggtgccgcgcgtttcgcgaaaaccgcaaatatttaaaaagagagactgagccacatcagtacgatgtctctatttgttaaattaataaaaacaatttaatgtgttttaagctactataatcaaacaaagcaaagcaaaggaatattttttaagtaaaataaatataaaaatattttaattagtttatttaaaagtgtttttgtgaatgaggttctgtgatttgttaattaactgataacttatatttttattgataatttgcatgcgtgcatatgtaaaaatatgaatcggcgatttctgtatgcaaccaactatttgatctttaacatccgatagccttaagtgttttctattattctactaaatttcaaagagtttcgttaacttaagaaagttaacaacaaaaaggttcaaaaaaacttgcttttttgagtttctctgattattatttttttaaaacttaatgaatttttttgaaattttgcagaaaaacttcgggctaccgaataacaccaagattataaaatttaattaattttgggcgaacttatgaataatttactgtcaaaaaattttttaagcatttttgagtaatggcctggcactttcagaaagggaaacggttaaaagtgcgctgcacaaaaagcattttttcaaaacaaaaaagtcgtcgccttgctaagaatcgcaaaaaaaattttttcgtttttgatgaaattctgttaaaaattgacaaaaattttcaaaaatttttccccggcggcccaaatgtctttggaaaaactgcgccgagaaaaaatattttgaaaaacaaaaaataacaaaatcgattatactgatcatgatgattttaatgatgatttaaactatttttcctttttttttgttaggcttctattcctgtttacaatttacatttattaactttcaaatggaaaagcaaataatttttaaataaaagttttcatacttttaataattcatttaaattacaaatttaatgcccaaatagccttaataaaaaataaaaattaattaaaaaaaattttatcaaaataataattttatttttcacgttttaagattgggatgcagcattttggtgtctagaggggtggcaattaactgtcaaccgaggactgttacgtttctgaatggaaatgcagttcagtttatgaccgaagaggggttcagacaactcagaacaacagcttctatcagctttggttcaaattcttatggaacattacatggtctgttcacttaaaataggttttatatttcatttccaccatttttaagctattggttattttgcgccccaacgtataaactttattaatgacggtgatgaccatatagaaaagccatacgatttaataagtttgttttgtaacttttatatatagcactaaatttaattttaaaattttcatgtaccgtcacttggacattacaaggaagaggtattgcggtagtaaaaatagataccttcgatccaaaggtagtattttttaataataatttaacagtagaaaataaagctgagcgggactgaaaaattttgaaaaaaaattgaaaaatttcaaaaattttaatctcaattcatagatgaataatcatttaaatatttttttaaataaaactgcattttttttaaattccaaaagactcggtgcttaaaatctttttgagaattgttaattgttttaataaattataataatctcttaaatttatttactacaaatagctttttttcttgcgcagttttccgaaaaactttttgggaacattgtggggggggggggtgggtccggcggtgccgataggcgccgccgggaaaaattgaaaattgagtgaaatatattaacagcttgtcctaaaaatgatcaaagccttggttaaatttgtggtttgggcagtttaaaaaaataatattttaagttgtaatactttttattataaattgaaattgaaataatgtacagaaaatatggaacattttcagttcagttggggaattgcacccaagcgataaatataagtagaaatagggcggctacacgggcccgggtatttaagcaaaaaacgagcccgggcattaccgggtactgaagttttgttacttaaaaagtgtaaaatccacttttttggcgtttggttactacttttcactatttcaacattttttagaaaattccttaacaaaaatgcaataaagtacacctataagaatcgacctaaaaaatttcaaataatacacccttaagaatcgatctaaaaaatttttggaaaattttttcaagagatcatagaccaaattttttcccagacgcccattcttaccagtacttatttagtcccgttgggagcgggactggcaaactgggaccgggatttttttttcagaaactgggaccgtggcctgaaaaaactgggaattcccaatccggtcctgcttagccctagtctaaaataacaagtaacaaaatgggattggagggtccttttttgctttctcttttttgaaactgcttaatgttctattaaattttcgttttcaggaaaacacaatcaatcatgacgtattggatgacttgcacaagacgttcgctgccattgagcagaattcgtcagtgcgtggcgttgtgctgatgtccggcaaaccaaacgtaaggagaggcagaaaattcaaagaaataataattattttctttgtagtgctcaaattcagtaacaatggaaatttgtactgtaatagctaattgagcttttttattgtatattttttctggaaaataaataattttaatttttcttttaaaagtcctttgttgccggtgccgacgttggcatgctgtcgcggtgcgcaacaacagaagtggcaaaaagactctcacattttaaatggatagaggccagcaaaaagccggtgagttatgatgaacaacaaattaagatttaataaaaaaatttcttcattacattaatgatagttataaaatacacaaaattatttttttttataatcttagtaatcatttaaatgatatatcaaatttaatttcaaatcaaattaattgaccctaaattgctttttgatcgttgctgccatctccggctcctgcattggtattggcttggagatggcgctggcgtgccactaccggatcgcggtcagctggcccaagacgcagtttgcactgcccgaggtgatgcttggtctgttgccgtgcgccggcggcactcagcggttgcccaggctgatttcgctgcagaacgccctcgacatgatgctaaccggtgactaatgcataactgaaattaattaaacatttttatttcccttttttctttggtgtcttaattttcaacaatcgtttttttattttaggaaagttcgttaggccttacaaagccaagaagatgggcctggttgaccaacttggggtgggtgacatgtcgttggtcggagcggggaggagctcaattgtcggcggtcggggacgccgatcggggaatgagcgaattttattttaacccanaaaaataaacaaattttttggggggaaatgctcataaantgttcattttttgcactttaatcat

SEQ ID NO: 755 - DNA, 5572 bp, Heterodera glycines
  misc_feature (5410)..(5410): n is a, c, g, or t
  misc_feature (5448)..(5449): n is a, c, g, or t
  misc_feature (5456)..(5458): n is a, c, g, or t
  misc_feature (5460)..(5460): n is a, c, g, or t
  misc_feature (5472)..(5472): n is a, c, g, or t
  misc_feature (5522)..(5522): n is a, c, g, or t
tgagaacaattttgatgaaccaatacaaagatgatgggaaattctgaattattatttttttcttacatgattttctaaaaatgtttaatttgttaacaatgctaaaacaataaataaataaaaaggggaaaaaattgaaagtgacaaattggcttaatgttagttgactccggtcccctcctcttccccctttgtatttttctctggttatctcccttgttacgcactatttcactgcccccaaagtgtataaatagcgcgagttttggcataccacgctcacttttcaaatcattcgaaaaaatttcaacaaaaaatggcgctcaacatgcaggacaaaaagggtctcctccaccaaattcttggcgaagctgacatcacggtgacaaccagcggaatcacgatcagcggtccccgtctctcctccccccgttttattccctttgatgaggccggccgctgccgctcatgtcgtggcaccgaggtggaagtggacgcgatggtcaccaaggagggcatcaccatttggtgtacgcgtatcgaccgggtgcaatttgtcccattcgacatcatctacgacttgcccggtcactgcttcttccgggtgaagaaaaaggcgcgggtgttcaacattccctacggggacctgcctgccatcacattcccaaaccaccaagaacaacagcagcagctgcaacagcagcaacaaaacgatttacgccaaaaagctaacacggcgatggacttggtggagagtggactgctagctgattcgttgcgtgaagaaggcgtgcagaggactgagctgaagcggaaggcaaaagttgcgctcgatctgattgatgccggtttgaccggcgatgcactttatgaggagggacaacgttggaagaaggccaaaactgcactcagcgttctcggaaacatgctgctggccgattcgcttccggaaaagaagactgcggagctcccgcttccgccagccgaaaaaattgaatcactgccacttccaccactcgaaaaaatgaaaacacccccacttccacctgccgacaaaatgccttcgccgctccctccatcaaaagtggaaagtgatgagcaacaattctacgacagcatttctgcggctaccactatgatggacagcgcctcaatgcagcagcaggcgccgctcaaaagaaaacaactgactccaaaaggcaaaagcaacggtatgaagaaggcagctgagccgcagcatcatcacaatgtgggggacatggacaagactcttgacgaattctttgagagcgttagcgcagcgacgaccaatttgtctatataaattgttgtttcatgcaattgtattgaattttaattaatttattaacacgaaatgcttaattctttctccaataaagatatttgctttaaattaccatttggactaattatttccggtccctcctcctccggtaaaacccaattcctattgaaatttgttgccgaatgcgataaactaattacaccaaaacccgtctccaccatttactgttttggtgaaatgaatcccgctgtacccattctccaaaaatcgggggttgatgtttattcgggtgttcctccggaagagctgatcaaacgcatgccaaagccccttttgctgatcctcgacgacttgatgctgtccattgatgagcactatttgtccgacttgttcaccaaaaagtcccaccaccaccaatttgccgtcgtgttcgttacgcagaatttgtttgagcgaaagatcaaagtggcccgcctgtccgcccagtacctggtactgatgcgagcacccaactcgctgttgtccatccgtaacattggcgtacagcttttcccgcgtcagctcgacttctttcttgacgcctatcgcaaagcgaccgctcgcccatacggctatttactaattgacatgcacgcctcatctgaccccgtgcttcgccttcgcacaaatatatttaaggacgagcaagaggaggatcaaggcttagttgtgtttgtaccaaagaatggagcccagtagtcaggatgaacaagctaaaattagtcaactcatccacgagaattccaaatggctttgtgcgctggccagaacgaggtccgcgaaaaagtgttgcaagctgatacggaaagcgaacgctgatcaactgctagcgctggtggaaatttgtttgaacattgtcgcatctcgatttcgcttgaacaaacgtcagaagaacaggctgatgccctacgcagattttgttcgctgcctgagcagagtgagaagtgaacgaggcgcgagacgtatgattgttcagaagggagcaggggttggcggactgttcgctgcactcctaacacccgtgttaattgaagttgccaaatcatttgtgagcaaaaatgtataaataccgtaaaaaattgttgttatttcacacttgttgtttcataaaatggcaaataaatttgtgcttgtaccacaagaaatttaccggggtctcacctctgcgactgacacgggtgacatcaatttggatgctgtacgacacgatttgacgcgtgccagggctgaacgaacaaacccttcagctaaaaatgtcagctacaatcaacagcttaggcgatacttgcaaatgagacgggaggtcacggacaaaccagcacgggttgagctagtcaagggattgagtgttctgatgaggcgaggcggtgctgatgatgaagcagaagttgtagatacaccaccccgccctcctcgtcctcctcctccaccaccgcctcctggtcagcatcctcctcgtcgtccaccaagccctccaggcccaggcccgtccccgccggggagtcctccgccgcgtccacagcgtcctccgagaccacctagagctgctgcgccgccctctcggagagatgggcgtgtggaggaatggcgaaaaaagagaaacgacatacaacaacggcagccggttgtgcgggaccttcttgctgaagcagctgctgctccgctacccgaaagtgacgaagaggatgactacatgttggagagcggattcgctctgccagcaccatcacaatattatggcgatttgcccgttctgcctgacaacgcggacgcaattgaggagatggacactgcacagcacaggattgcaaccagaagaaagttaaagaaagcagatgacgatgatggcgatgacgatttgcatcgcaaaaaataccgggtctattatcctcctcccccttctcgcccacccccgtctcgtccacagccaaaaattgaaacacctcgacctccaccgcgtcctagcctcaagaaagaaccacaaccactgctcgatcctcggccatccacatcacaacaagttgatcgcaaacataaaagggagccaaagttcgatctggatccgcgaccatccacatcacggcaagccgggtacaacccccctgcggaaccaaaacatgagcagaaaccgtcaaaaaagccacctcctcgcgccacaccctatcatattccgaaaagagagccaaaaattgaagaaacactgccgcggcagcaaccttctcctgctgccccacaagtgccgcctgttccgccacctaggagagggaccaaacgtcgacaccccccggaaaatggtgatgagagtggtgagctgcgcatacgtaaacgagtgaggcaagcgcgaagagtacgagtgtattactcaccagagccgggtccatcaacatcagcacaaagcgatgaacaacaacaacaacaacaacaacaacaacaacgtgaactgtttgccattccgtcaaatcagctgaccatggcacagagaattgagctaatatacatcaaatgcaaccgttatgccgatcgtatgggtgtccggggaaacgcaattatcaacactcaaaatgctcaaccattggtgcgaagcaatttgcgaacggccatcaggtatataattgacagaagagcgggtcgacctaccattagaccaccgggagcggaccaattggaggagcggcttaggcaggacccaattttgtattcattgacggctccaccaaagagaccatcgcagagcacaagcagcaggacgtcaataaagaaggaatttcatccgaaaaaatggaaatgatcaacaccactcttgacaagctgtacaacgatccatcctctccggctgcgtttgccggtgttagtgcactgtggaaggaggcgcggaaaaagctaaagaatttacgcaaaaaggatgtacaacactatttggagggacaccgcacgtacaccctgatgcgccccaggcgggtacgatttccgagagcaaaaactgtagctgctggcttcatgaccgacgtccaagtggatttggctgactttcaagcgctttctcgtcacaatcgcggtcaccgatacctgctggttgcggttgatgttctctcaaaacgcctgtttgtcgttccactcaaaaataagaaggccgaggagatgctggatgcattcaaagagcttgtcaagcaaatgccaatggtcccacaccgcattttctccgacaaaggcaccgaattcaaaaacaaattgctgaaggaattctttgaggagcaggagattgagaaacatgagcccgtgcattcgtcagtgaaagcgtcagttgctgagcgggcaatccgaaatgtgaagcagcgactgtacagatactttgccgaaagggagacgctgaattgggttgatgttgtacaacaaatagtggatggaattaacagcactccgtcacgggttcacggaatgcgaccaattgatgtcaattttgaaaatgctcagaaggtgtggaagcgaatttatgaatcaccgcaaaaacgcaagaagccacgtttccgtaaagatgaatttgtgcgcatgagcagagagaagggacagttcgagaaggggtatttgccaaactatggagacgaaatcttggaaattgacgaggtgctgaaggcggtgcgtcccatcagatacaagctccgggatgatcgtggtgaaaaattccggggcaccttctatgaccaggagttggcccgcgtgagaaaagatgccgacaccagttacagaattgaaaaagtgtacagaaagcgaagaaaaccggatggaaccacagagatgctcgtaaagttcattgggtatcccgaacgagaatggattgacgagtctcagattgtataaaagcgtttgaatttttgtgtatttctcatcagttgaataaatccataatgtcaaacagtttctttgtgtttttgcctagcaatgtgacggattatccggacaatcaaccaaacaaattccgggtccggcttccaaagcctttgcatttcaacgggtcttgggtgtgtgggctgcacagcattagctacccatactcgtggtcacaattgngacattggatgagcagtggatagacatccacttcacgnnatattgnnngntcccctgagaangacaacaccgcatcgtacgcgtgccggtcccaggtcttcacagaatcgangtgacagctgagagacttttgacgacacgctgagaaccatgccatgctaa

SEQ ID NO: 756 - DNA, 954 bp, Heterodera glycines
aaaaacgcaagaagccacgtttccgtaaagatgaatttgtacgcatgagcagagagaagggacagttcgagaaggggtatttgccaaactatggagacgaaatcttggaaattgacgaggtgctgaaggcggtgcgccccatcagatacaagctccgggatgatcgtggtgaaaaattccggggcaccttttatgagcaggagttggcccgcgtgagaaaagatgccggcaccagttacagaattgaaaaagtgtacaggaagagaagaaaacaggatggatcaacagagatgctcgtaaagttcattgggtatcccgaacgagaatggattgacgagtctcagattgtataaaagcgtttgaatttttgtgtatttctcatcagttgaataaatccataatgtcaaatagtttctttgtgtttttgcctagcaatgtgacggattatccggacaatcaaccaaacaagttccgggtcaggcttccaaaacctttgcatttcaacgggtcttgggtgtgtgggctgcacagcattagctacccatactcgtggtcaacaattgggacattggatgagcagtggatagacatccacttcacggatattggtgttcctgaagaagacaaacaccgcatcgtacgcgtgccggtaccgagatcgtcacacaatcgggttgaacagctgagagactttgtagcaacaacgctgagaaaccatgccaatgctaaactaaagccgcttcctcgagaggaagaggcggaccgtaataggacaaaaccactatattctccaccgcctgctaaaagaagtataaaagacgtgaatgatttgtctttgtttccttcacccccgagagttaatgagccggaaaagccgcctaagtctcctccagcacatgtaccacctactgaaccggtaactcctcctccggcatcacccccgagagttgatga

SEQ ID NO: 757 - DNA, 3110 bp, Heterodera glycines
  misc_feature (3028)..(3028): n is a, c, g, or t
actatgggagacgaaatcttggaaattgacgaggtgctgaaggcggtgcgccccatcagatacaagctccgggatgatcgtggtgaaaaattccggggcaccttttatgagcaggagttggcccgcgtgagaaaagatgccggcaccagttacagaattgaaaaagtgtacagaaagcgaagaaaaccggatggaaccacagagatgctcgtaaagttcattgggtatcccgaacgagaatggattgacgagtctcagattgtataaaagcgtttgaatttttgtgtatttctcatcagttgaataaatccataatgtcaaatagtttctttgtgtttttgcctagcaatgtgacggattatccggacaatcagccaaacaaattccgggtccggcttccaaaacctttgcatttcaacgggtcttgggtgtgtgggctgcacagcattagctacccatactcgtggtcaacaattggtacattggatgagcagtggatagacatccacttcacggatattggggttcctgaagaagacaaacaccgcattgtacgcgtgccggtcccaaggtcttcacagaatcgagttgaacagctgagagactttttgacgacaacgctgagaaaccatgccaatgctaaactaaagccgcttcctcgagaggaagaggcggaccgtaacaggacaaaaccactttactctccgccacctgcaaagcgtgcccggagatctctagcgctctcttcgcctcccagacatgaagaagctcctgcacgaccacttgaatcgcctcctttgtatgacgagccaaagctgcaaaaagcacaaaaaacacccgaaaaaccagccaaaacagccccggctacaccaattctgcttgactcgccaccgttgtatgacgagacaaagctgcaaaaaccacaaaaaacacccgaaaaaccagcaaaaactccagctaagccaccgtcgcaagctcctcctataccagcaacccctacagcagctgtttctaaaccgtctcaaccgattgctcctgttgctcctccaacacctactgctaaatcagtagcaacacccactccagctaaaacggtttctcctcctccagctaaaacgccttctcctcctcctccagctaaaatgccttctcctccttctcctcctccagctaaaaccgcttctcctccttctcctcctccggctaaaacggcttctcctcctcctccggctaaaacggcttctcctcctgccactactattaccactactaccaagccaaaaacaccgcctccgctggtcaaacatagtcctcctccaacagctgcaaaacagccttctcccgtaaagactacgcccgcgtctaagctaaagcccgcgaaaacggttccaaaaccaccaccacctcctcctaaacaaaaaacaccaccaaaaccttcaccgatacttgagtcaccgcctcggtatgaagaatcgaacagaacaattgtaaagccaccagtcatacaaccatctccacctcatcttgaagaagcgaacaaaacaattaccaaacaaacgacatttaatactactgcaaaagaagtgatgccgacagagcctgttgcagctgctttaacacaactagcagatttaccagaaaacaccttcagctttcgcatcaatccgctcccagttgtgccccgctcagtatcgattcaataccttgatgatgttgaacgttttaaagtttcattcaatgatcggttgatacgtcatttgtcattctcaccacagttgggctatgtgctcgggtttgaaaaccctcagcacgtgatgtctaatgaagtggcaaaatatccggtggatttgcgaggcggaatctcgagttttgccgtttactcaaaaggactaactgagaatatgattgttggaaattcgctgagttcgctgctccgtgttgtgtcagtcagcggtgcaacacccggtgactacaatgagaaaatttacgattcgcccatttttgcgcgagtgctacccagggagatcaacgaaattgagattgagctgcgcacaatggacaagggtcgcctcgtcccattcgcctacggcacgacgctggtcgtgttattatttaagaaagtgataaatttctgaaaccactcattttttgtattcattcattcattaaacgtaaaaaaaataaaatggttcatattgtgtttgaccctcgcagtgccgggtacgacgagtatgtgcaatacggtagcggaatagaacacgaacatcacttcattgggtccagtccctttcaacgagggtatgggcagcggggagcaggggttggagacgtgtttcgcggtctttggcgcttttttctcccaatcctccgccgcgttggcaccacggtaggatcggaggcattgagcacgggtcaacgagtgttggagcgagtcgggaacgacggaatgccacttaaggaggcactggtaagcgaaggaaagaaaggaattgataccgtactggagaagggaggcctaccaaaacagtttggcagtggtggaagaatgggtataaaaagaagaagaaaacacgcaccaagtcaccatacaataattggccgaacaatcagtaaaccagcgagaaaacgtgttcgatccgacgcatttggactttactaaatggcattccacaaaattgacaatgacagtgtgaactccatcaccaatgccttggactttttccgcatcccgccaaccaacgtcagcgtctcatcctccaaagtgtttgaactgctcccaagtaaccctctgaccgacaccccctatcacttcaagcttcactccagtcaaaattatattgatctctccaaatgctatttactgtctgaatttcgaattcgcaaagaaaatgcaaatggtcaactggttgaccttgcagctgatgaggttgctccgattcaactgattggacacacattcattcgaaacatcaaaatgagcatcaatggccgtgaagtgttcaacgcaaattctctgatggcctacaantcgtatttttcacacgaactctcctattcaacagcggccaaggactcgcatttgaatgctgcaggttactaccgtgacactg

SEQ ID NO: 758 - DNA, 4203 bp, Heterodera glycines
  misc_feature (4078)..(4078): n is a, c, g, or t
acacctaaagcatgcatctcctcaaaaacctcctatccccttttagctcctcctccacctccagcacaaacgcagccatcttttgtcaagaccacacccgcatctaaaatattgactccgtctcggattgatgagtcgaatagaacaatagtattgccatcagtaaaagaaacaactccaccgcgctttgccaagacagtgatactaccgcaaaagaagtgaagccgaccgaacctgttgcagctgctttaacacaactagcagatttaccagaaaacaacttcagctttcgaatcaatccgctcccagttgtgccccgctcagtatcgattcaataccttgatgatgttgaacgttttaaagtctcattcaatgatcggttgatacgtcatttgtcattctcaccgcagttgggctacgtgctcgggtttgaaaaccctcagcacgtggtgtctaatgaggtagcaaaatatccggtggatttgcggggcggaatctcgagttttgccgtttactcaaaaggactaactgagaatatgattgttggaaattcgctgagttcactgctccgtgttgtgtcagtcagcggtgcaacacccaatgactacaatgagaaaatttacgattcacccatttttgcgcgagtgctgcccagggagatcaacgaaattgagattgagctacgcacaatggacaagggccgcctcgtcccattcgcgtacggcacgacgctggtcgtgttattatttaagaaagtgataaatttctgaaaccactcattttttgtattcattcattcattttaacgtaaataaaatggttcatattgtgtttgaccctcgcagtgccgggtacgacgagtatgtgcaatacggtagcggaatagaacacgaacatcacttcattgggtccagtccctttcaacgagggtatgggcagcggggagcaggggttggagacgtgtttcgcggtctttggcgcttttttctcccaatcctccgccgcgttggcaccacggtaggatcggaggcattgagcacgggtcaacgagtgttggagcgagtcgggaacgacggaatgccacttaaggaggcactggtaagcgaaggaaagaaaggaattgataccgtattggagaagggaggcctaccaaaacagtttggcagtggtggaagaatgggtataaaaagaagaagaaaacacgcaccaagtcaccatacaataattggccgaacaatcagtaaaccagcgagaaaacgtgttcgatccgacgcatttggactttactaaatggcattccacaaaattgacaatgacagtgtgaactccatcaccaatgccttggactttttccgcatcccaccaactaacgtcagtgtctcatcctccaaagtgtttgagctgctcccaagtaaccccctgaccgacaccccctatcacttcaagcttcactccagtcaaaattatattgatctctccaaatgctatttgttatccgagtttcgaattcgtaaggaaaatgcaaatggtcaactggttgaccttgcagctgatgaggttgctccgattcaactgattggacacacattcattcgaaacatcaaaatgagcatcaatggccgtgaagtgttcaacgcaaattctctgatggcctacaaatcgtatttttcacacgaactctcctattcaacagcggccaaggactcgcatttgaatgctgcaggttactatcgtgacactggtggtgtgcttgaggtgggagacggatgcactgcacgacgcaacctgtttgtaggcagcagaacagcacaattcattgccaaaattgacgccgatttgtttaaccagcctctctacttgatcaacttttgtgagctggacattgaaattttgcccaacgacaacgactttgtcctaatcacaccacccggtgttgctgcagccactcgctaccatttcgaagttgtcggtttgaaaatgtatgtgaagaaggtgtccctgatggacggattggcgttggacattgcgcgaaagcttgagttgaagccggcacgatatgcagtgaggaaaacgctgatgaagtcgctgttcatcagtcatgggcgttttgaatttacgtctaatttgttcatggatcaaattccccggcgtatcacaatgggattggtggccaatgctgactatgttggcaccgtttcacgcagccccttcaactttcaaccatttaatgtgcgtgaaatttccataattgccaatgggcgctcctatcctcaagcagcctacgacttggactacccaaacggaaagtatgtgcgccccttcaacgacatgaacgaagcggtgggattcgccaactcatcggaaagcaacgggattactctcgcacaattcggcactacgcattgcatttacatgttcaacttgacgagcagtggagacgaccaagcggcgctttttgatctgataaggaacgggaccacagcagtgagcatcaaatttaatcaggcggtgcccgctggaggaataatgttggtggtgatgggcgagtgcgactcgctggtgatgttggataaaaatcgatcgatcagcactgacatcactatttaaggcacacttattttcattttttccataacgataaacatgtattccaaaaaagttggcgttattttattccttcttcggatttctcttcccgtagtgtcatgccgagaggaaattcctgagtactctgaatatataagaagaaaggcaatgcttacatccacaaccacaacaacgattccatttacaacaagcacatcaacaaccaccacctcatctcccccaaaaagtgacaagttaattgaagagcaagtgtcagctggtctcacaccactcattcaattgtgcaaagatcgaccagaagaggggaatttattccaacaagccgtttgctgggcggtgttcgcattgtatttgatgcttattgtcagcctggttctccatcaactttgctcaattttttggctcaagaatggacagcgtgcaaatcacatcaattttgagcgaaaaccgggggaccgcacaagtctttcggggctgcttcgccagtgaccaattaccgcctccggtcactctacaatatcccgcagcgctaattgtgaaccgggacccacattacaagggagggtctcattggtgtgcaatttatgcgaagggaatggaagaaccagtgatttattatgacagcttagcccaaaaaataccatctgtcattgtgtcatcattcctgaataagtttccgatgggtctaagaaaaaatattcgttcctatcaatcccaattagtgtcaacatgtgccccacactgtattgtttttgtctaccacatgtcacaaggtcattcatttgaaaattttattgagaaattggaaaaatcgacaaattctgatctgtatgtaataataatgatgaataaaatggtcaaataaatgcttacaaaacgctaaagaaaaaatacaaattgtcaggctgactaagctcagggagaattcggacatacccagcgtactttttcaagtgtggattgaacagccaaaaaaattcaaaaccatcacttcggacctccggaaaaatgccatgtgatagcattacactcatcggttgttgcagaatccacggcatgtgttgacggtagaaaattccacagcaaatgggccgcttcatgagccaaggagttggtgagctcattgcaaaatcgagcagaagtccaaacaaattcccaatggcaattgactaaaaattttgtgttgtcattaaaaatttaaagtatttcactcacatttatggcttgggtcatcacgaaataaatctcgaacaaattcgttccaagtcgtccgtagcacaggtagtgcaggagctcatttcggctgaggtcctgcggcagttcttcctgtagaagcagtctccccactttcttcttcttcggtgtccttttctcctcaaacatcacatcgactaaagcaataacacccttctaaaaatatttttggtaataaaatgaaaaataaaaaaggggaaattaccaaatattcaanagcacttttggcgttgactacggaaacactcgaattggtagcaaacagggccaattggagcccgcttcacatttgcaaataggcagaccaaaggcacgaaactgatcaattcgcaatttaattca

SEQ ID NO: 759 - DNA, 1734 bp, Heterodera glycines
  misc_feature (1617)..(1617): n is a, c, g, or t
  misc_feature (1625)..(1626): n is a, c, g, or t
  misc_feature (1649)..(1649): n is a, c, g, or t
gggccaattggggcccggtttcacatttgaaaaaaggcagaccaaaggccgggaaaatgaaacaattcgccaattaaattcagccgggagcgttggacgaagcttggggtttttttccattcaatgggaagagcattgttgaaattggggcgttttctttttccaaaattgaataaagaatgatttcgatttcttgctgggaataattttggtgcgcaagtgggcgtggccaaagtgcactcattgtacacacggtcattttaccgattcattttaaaaattttcacttttcttgcacatgtgctgttttcctctcctcttcctcacttgtcttgtgctttatggggaccatattatttaattgggaattttggggaccgtctaataaaattaatatttttgctgttaaccagggcggtagctataattacaaaaagcaccgtttatcctggcagcaatttgccttttagggcttgaggtcgttcgcgtgacttgactaatttcccgagtcgtttaggtgccctgtcgtcttgtgcttcatgggtggcggtgtgctgctcttcaggccatagttggtttatattttttgactattttccatgcccaaatatttattattcattcaccattttacgtcattttccatgccggcgctcgcatataaataccgagattttactcattcctcctcactccattctcagattaaaaaaatggacaatcatccccgaaaacgatcctctaacttttccattgaccatattctctccgcacctaaaaggccccgacaaggcttcctgatcaatgaactcttgggcgtagtccacttccttggatcttttcaacaaggcgaaggaacatcaaaacaggccaaggactacgttaaaaaattggacaacagcattgaacacgtggccaaattccactacgtaaaagtcaagtcaaagttcaccattacggatttgccaagcacacctgaggcactgttggccggaattttccaacactgcatcgacgaggctattgctgacagccgtgagcgcaacatcgagcctacacacctcggctgtatgatcagcagccctctgttggaaggcggcgacatcccaactccagtgcgacagatgactaacaacactctcgacaccattctcaaccagttcaaaaaagtggcgcagtccaaacaacagaaaaatgtatcgttatggggtgagccgtttaccgtcaccataacgacattgaatcgcaatggactgccacccaaacgtcgtgtcaaagggggagctcgtcgccctgtcaaaacggccgttcaccaccgaattaatgaccaatgcctgattaaaattcgcaataacgacaaccacttctgccttttctatgcgctgcaggcaacaatggtcgacaaaacgtgcaattggcctcgctggaagttttcccgttacttgaacaaccaatacggacagcagggacaacttcatcgtgatgcagttgagctcatgaagcaggtgaaagcaccaatggacttggatggctacgacgcagatactttcgtgcctctcattgttgatcactgggacaatatgcagcaacaacacccgctttgctgtgttcatcttntggatcgnntgggacagtataaaccgatctancagtacattgacaacatttacgacactccgctgctgttgtactttcatgaggaccattttgatggtggcagaagcagggcggtct

SEQ ID NO: 760 - DNA, 5857 bp, Heterodera glycines
aatggtgccaccattgggtgaaattggtccctttgcatcttcgttggcctccgattgcaaaatcagtgaagccttaattcgcaagtcgctgctggtggaggcaaaacggcgcaaattttggaacgcaaaaaccattgaaaaaatggattttcaggcaaatttttagaatggcatttttcccataaaatcgcaaataaccccaaaacgctattcatttttaaaatttattcctctgaaattgacattttgtttactcgattcatgaaaaccctgcaaatgcttttaaaattttccaaaaattgtgaggatggccaaaggaaaaatttttttttgaaaattttagtgccgccaaaaccatcaattttcaaggatacatttaaatttgttttcgtatttgcaggagattgtcccgttcttttgccatcattacgtgttggaaagtttcacggaaacgcggagcgtagcggaggcaattgacgcgtcgtcctcgtcttccgccgccgcgtccataggacgaacgcgcagcgaggaccacgacgacaatgtaaaatggatttttttaatttttgggagaggatacaacatatttttgaattttggcttattaaaattaactctcaccacttttggcatggaatattgaactccttccaaaaacatggcatttttctctaaattcccgttaattttccttcaatttccaaaaaaaaatttttggtttttttccaggcaaccggcagccgaacttttgccagttcgacgtcggcttttgtcaccaatgaccaccaacaacagcagcaaattcatcggcggaccagcggcaccacaacatttgttaagggaactgccttaattagtcgtggtagcattgttggcggattggtggaactgaaaacgtttggcatggcgtcgtcgaacggcgcggagttggggctgaacccgtgggactttgacgtgcagccggacgacgactttgtcagccaagtgagtgatagctcaaaatggaattgattgattgtgcaggcatatttactctgatgaatgtgccaaattttgattccgactcaattttcggcaggcaatcccgagagtgaaatcgggaatgacaaaatttaagcgatttgtctcttattctcctgtgatggtgccgtagtgttattatgccgtcgtaaattttaaaaattgaaaaaaagttttcccaatttttaaattgttttcccatttttgtttttatatatttcctttattttgtacagaccaaaatcttggaaatgccaaattcgcatcggctcggcgcctgtcacagctgtaagggtgaaatgttggtgcactgtttccactgccgtgggtcgggcaacgacaaatgctcatactgccggcaagtgtttttttattatttatattttttgttataattttaaaataacatttttagtggcaccggcatgaaggcgggcgttgctcatccaggtaaaaaactgacgtggacaccacaaaatgggtatttcggcacaaacccttaaatagttatgtctgaatccaaaatccttgaccaaaaaatctctaaatttgtcgtatattccaaaaactcctcaaattaaattttttatcaaaccacaaaaacctatttgtttataggaggcgcactacctttttagaagaaatttctatacaaaatgttttcgaagtgttatatagcgttttttcaaaatttatgatgaaatattattttttttaaacagtgaaattttttcatttttttaactttttcggggaggcggggaataaagagcacacattataaggactcttgatgctatttctttctgttcatcctctgtgtccccaattttcagctgtgtacacccatccgatgattggcggcggcacttttcccggcgcgcccgcttctgttggtggttgtggtgttgctggtactgctccaaaccgtggtgctgctggtttccaccaccaacaccagcttcaccacccgtttgccaacccgtcaatggtccgtccggcactgctcggtgcccagcgggacaaaccgtacgcggccggcacgcccgtccatttcatggcaaaggctgggctaccaccaccggtgcgagtattgtattatacatcttacatgtacacccaaatgtcgccagcagaaaatcgcaggaaaaaacaataataaaaaaattttcaaaaaattcaggaaaagttctaaaaaaattttttaaagctttttgttttttgaaaatctaggtgttactggaaagcaaatttctgaatttccacaagaataaaaaaacataagaattttcttttatcttattgctcgaatgaaaattaatttgtattttactgtattccgacagtatgccaagtgaaaatcatttccgggtgcatttaaaaaaatcaacctgattatatgactccgtgaaagccctggcaggatccgatcctgatccgggcccttccctatacaatcatcataaaaaaataatttctgttttccagggcattggccaacacgacctgtgcattttctgccacggccggggcatccgcgactgccagcactgcaagggccagggcaaaaagcactgtttgacatgcggtggcaatggccaagtgcacgtgtacaccaaactcaaagtggtcttgtgagtcgtttgttcatttttttatttcggtcatttcaaatgtttggcgtaatggtgttgtgtccgtacccaaactctggacttttcccggttacttttcagcaaggcttcttttaagacaatttattaaaatggaaatcaaaagtggaaatgcaaagttaaataaagaatgatcgctttttaatagtaagaaaaacaaagcaaattgttaagtgagttgtatcgctttaggcagggatcctgaggataagagaataagcaaagacttaaataccaatgacaaatgggaggggccaaacagatggaattacacaaaattgtttggaagaatattttccgatggattggacgaaggggtcacttttatgagtgagtgaggaacagaagggccagggaaattacaacataggaaatgccaaaaacggagaaaagagaaacaaataaataaatggcaatgattaagccaaaaatgcagatccaacaaatggttttttcaaattttagttctgtcgagtgcaccgattattacagcgcgtgcggcgtgcctgaagttctcttacgacaggcgaacggcgagctgattttctccgaaacgcggccttatgtaagtgccccccccccctcaaattttatagattttttttccaaattagactaattaaattatccgatcaaggaaaatatttcgaccacttttacggttggagaaagatcactttttgtggagaaaaatagtttttttttttgcattaattcattttttaaatattaaatgtcatttacgctttaaaaattcatttgtcagaggcaaaatacggtgataaataaattaaaatcaaattattgggaatatatttagattaataaaaaatttcaatagaattatggtgaaattcttttaaggtgcagccaattaaacgggacggactcaccgaaatcaacgatgtcagccgacgcttctgtgccgcccacctgaagaagttgttggactcgtgccgtgtgctgaagcaacggcactgtgtggagagcattgaggtggccaaagtgcgctttcgtcttggctcaaaaatgggccatttttttgtgtacggacgccaacggttgtgctacattccggaggggccgacccggtgcagtgtgatgtgaaaagtgtgtgcacgaacgacccaaaaagcggagggaccgtcaaatgacggacagacaaactgacaaaactaccgtagtactattactacggtgtaaaaatactgtattagacaatgccaatgaatgaaccgccggagaaattaggccgccgtatttgctaatgagcgcagttagccacccccgaaaaaatagtgaaattttactttctctgcactttgggaaatttaaaatttaaaaaaatctttaaaattattttttgttttctattaaaatataaatttgatttgaagaatggtaattaaaatttttaattttttaaaggaatttcaaatttcgaaaaaaacacagaacaactatttctcatttccatttgagcaaatacggtattctcagctcgaatgtattcccatcctcaggcctcttccggtgaaaaattcctaaaatttaaatttcgacagtttttcctcttgtccatggtttcttaatcctgatttttggactaaaagccccaaacaatcaatttgaatttatcttttttgtgtttaaatgcaacccaaagaatgatctctcgcgttttgcttactttttgttcaattcatcttttcctagcgtttttctccctcatcaagttcaagcagttcagctttaatatttacatttaaatcccaaattcggttgatttttcgcctcggtttttgttgttattttctagtcatcatttttttttattcttcctcaccttttttcattacaattttttgttcatttaccttatacaaatatatttgtggtgcaaatgctaataaaaatgcaagtattcatttttctcatacatttaaataaatatttttttaatatacatttagttgaattattaaattgccacattttttattaaaataattcaatgttttttaagtgttttagttttttgttttttgctcgtttatgaagttcgtctttctgttgctgttggtcagctgcttcctgctgctgattgtgaacattgcttttggcattgacgaccattcatcatcatcatcgtcgtcagcagccgacggcgttggcacgtgtcccgcgctttcggcattcccattttggctgcgccgccagtgccccccatttgaggatacgcgttgtgccatagcgtttccaagcgatgtgccggcaccgcccgggcaactcagctgcgcgttgggtaattctggcggatggacaactgggccccggaaaactcaaattgtggcagaatgattggaccaccgcccaaattgggttgactcggacaacggagttatgtttcaaaaaacttttccgatgccaagttgctctcccaccgtgattatatggatcggaagaaattttgtagttggaatcggttcaatatgggaataaattgtttgtttttgaatcctgacaaagaggcccctaatattgggaattgcaattttggaggggacaaacaaaactcggcaaaccatctgccggtgtagggaggggtaatttttttttgaatttccaatttaaaaaccgagtctgaatttcgtgtttgaatatgctgctgaaccaacatgttttacagcgagtgcccagcccaacgcgcgccttcgccagctgtccgcccgtgagctgctcgcgttcgcgaagcggcgcgacccgtacgggcgcccggtgtgcatgctgacactgttctacgcgcccgactgtgtgttctcggccaaggtgcgtgaaggtggtggtggtgggcggaacaggttgtgtttccccctctcccctcgaaattttttttgaaatataatggatttgaaaatttccgtgcggggaacgacgaggggctgggaatgaagcgcatccgatggtggggcggattagaggggctatgacggttgtcccccggggagttattatttttgaggcttgttaattccggcgggtgaaatacatagccaaattttttcactttagttgggaccctttcactgtgccccgcccccatttcatcgcgtaaaaaacaaaacttttagatttttttaatttacatttttaaaaaatttttc

SEQ ID NO: 761 - DNA, 3058 bp, Heterodera glycines
ggtggggtgaacggatgaaattcggcatggcaatttcaattttgggacaattgtagtacgccaattagagaccggaattcggagaaaacccgtgcccaaagtcaagggatgtgtcaagccaaggggaaaattactgttcttcgatattcgaatcaaaacccacttttaggggtcgggaaatttttttttggaattttgagtgaaacctgacaaagctgcatttgcggctgcaattcggggcaaaaagcgacggagccgtcccaaaagagatgaagacgaagaagcaccattaccgttacattcatcctccatgatgaatttgaataaaatattcgattatttttgcgggctaaataaaacaatattaaatattcccgaaaaatttgcaaaaattatatgggatccttaaaatttaggcatttttcatgcgcccattttcgaatgaatgggggaaacgaaaaattagtcagtccgtgccataattttgtgccaaaaataaaggaagaaatgaccaagataaaaaaatagaattaaaatggtacaaaacatttcatacatcaattagaatttgataaataaatatatatttatttgtgtgtgtgtttgaacgaaaatataaaagagcagacacatcatacagtaaatcaaatcgaccgattcgtactgtaatttttgtaattgttgtcactctcactatctgctggcgcttacgcataaaaagaaagccatacgaatgggttgtttttttgtcatgggaccgaagaaacaaaaatgcatacagaaaacggaattggattggattgatcagctctgatcaccaaacaatgtgacgatttacaacacaattagcagccaattaattgcttggatatgtttttacgataattaatcactttctctctctctcccccattctttccctccgatcaaattaaataacgcccgcccccggctgttctgttgatccgtgtttcagtgaagtgactgggcggaggcctcgagttccggcaacaaatagggaaatggctgcccagtttgagaaagcgaggcctgaacaatggaagaaaatttgtcaggtataaagtctgtgcgtaaaattgaaagctaaatttcattataatccacgcgacatgccccaccatttccaccctttttcggccaccaaaattaaaatatattttgtcctggacttgtgctatattatttatttttttgctcttcgggccaaaaaatttatctagtgttatttttcaaacttttcagcgccgggtgaaaccccaggaaattggagcagttttgcgggacaaatgtttgcctttggaggcaaatgttcaataaataatggtacaatgggttatatgtaaggcaccgcctgggaaaaactcatggaacttttaatgaaaaagtgagaaaaaaattgtgcaaattttccgccacccacccgtgtctccgtgtcccattggaaatggatgagtgcggacgggaccaattcgtagtccaacagcgtgtgctcctcctcgcgcaactgttgctgctgctgctgattggcaccaagcgcagcggtcagtgtgaaagtgccgtgatggatggccaagtgttgggccacaaactcacgcacattggcaaaccgttcgtgcacattgaaaatgccctgaacaaaagtggggtaataaaaggaacataaaattattaaagcgccgggttttcgctttgaaaaagtcgaatcattatagaatgcaataaaagtctaactcaaacaacaacaaaaaaccattagaattcaaaaatttcgcaccgaaaagcaaatcgcttttttaaaattttgcacgattattcatttactctggccgggtttttacggaaaatcttttataacgatttttcatgaaatttaaaaaatttttttttataaaatactccatagaatttcgaaaaaatcactagaattttttttattgccgcccccaatcagttttctcccggcaaaaactgttcactcgcctgcagcacaaagctgttggggaagcggacccggatgtagcagtacttgaacgggttgccctccgcgtcctttcgcttggtgtccgcctcgcgcatcttccgagtccgcaacgtcattatcttctccaactcttccgacattcgctgttgctcccgtcggatttcttcaacagttcgcttgaaaaagtcgggcggaatttccgggttcggcaactgctgttggttcgactcaattttgaacacctgagacaaatttggttttttgacattgtttgaaatagttgaatgtgagggtaggatgggtataggtataatagtgacaaacaaattatccaataaaatttcataaaaaattctcgttgcgcctttcagcaccgccggaaccaaacttgacaggttttttttttgaaaaattggaccgcaaaaaaggcaaataattttaattactacaggactgacagaatatcaaacacttggtcacacccaccttcgcttcacgaaacactcggatcgcaatcggtttgccgtccaacagtgtcgccaatgcgttgcgcagcgtgtccacaccaccggcggttggctgtgccgacagcaccaggtaacgctccgccgattgttgctgtccatcagccgcgggggcggcacgcatttcctcacgaaaaccaatcgctttcaaaaattcaatggtccctttcactggcagcactttttcctgaaaaatgcaaagaaaaatttttggaaatttattttttctatcccaaattccctcataatcagaaatatgcgggcaacgaaagtgggaaaatgcatgaattcgtaggcctcccgaggtccggtttgtcccagaccgttaaagttccagtgaatggtacaaaaaattcgaaaaattacaagttttttctaatgtgcaccgtacccgttcaggaaaaactccaaaaatcctactatgaccgtcgctataattccaaaaaatattgttggaggaggattcaaatttatttattttctcattcttcggggagggggtgggggggtggtggttttctggtacttaaat

SEQ ID NO: 762 - DNA, 5048 bp, Heterodera glycines
  misc_feature (4838)..(4838): n is a, c, g, or t
  misc_feature (4880)..(4880): n is a, c, g, or t
  misc_feature (4996)..(4996): n is a, c, g, or t
  misc_feature (5033)..(5033): n is a, c, g, or t
gaagaaagaagaaaaatcaatgatttggcagcagctcttaacattaatcaaaggcttcaccagcctcgatgctggaaaaagtttctttttctcagaaagtctcaggaggcctttactgttacgggtaaagcgccacacggccacaactcaaaataacttcttcaatagaatagtaaaaacctggaatgtccttccagtcgtagcggtgcaaactaataaggcaaaggaattcaggggtttcctaaaagcaacgagttatgagtaggaatattcatgtaccatctagtacattccatatttcatcgcccgcgaatttgaaacacttcaattatctttatttcggtgttcatattgtatcttataatatgatcggaggtggattctaagttatcttttttgccactcgtaggagcgggggatgggggggtggtggttttctggtacttaaattttccaaaaaatgttttttttttggcggattaatacaaaaaataaaatttttagcgccgcttactgcaaacactcggttgctcagtcgaatttggcgatacttctgctcgttcgggtggtcaatgatgttttgcaaatatttgcggatggtttccagcgcggcacttcgctgttcgtcgtcacggcaaaatgtgtgcaacatccaaacggaggcgctcaacggttcgtcagccacgtgctcgaacagtgtgctttcaatggcattgtacatctatgcacgtttattggaaataaccaaaacttggtactccaaaaggaaagagtattcgaaaaaagtgtttttttaatgatttggatggaaataattaaaatggggtccgttttgcccaactcttttgaatccaaccccattgttttcacgaagtgtatgaaaatgcttcatcataacggttttttgcgcggtgtctatcagtgatgccgcgggttgagaaaaatttcgggttcggactactagaaatttttttctataaaaacgttgccaaaatttttatttgaaaagattagaaaatcaggtaagttaaaagaaatagtttggccatgagttttttgaaaatataatacctccgacttgggcagtgccatgtcttcgtcaaaaatttcgcacgtgtaccgcaccgttgacgtaccatcggcctgttgttgctggttccgtcgctgttggtccaccggtcgttgtggcccgacactgccgccgtccccagcaccgctctgttgcggttgtgccaaccgacgctgttcctcttccaactctttcttggcctaaacaaaaaaaaattaggttctctcaaaaattgatgcattttttgcaaattgttcgcaactaattgcatcaagaatttagaaaatttaaatagggtccctacctgcattcggaccattttttgcatcggtgtcagcccagcatttgggtcgttctgttgcttgccatgcattcgcttctccgccgcagccgcaatcaattcagcatcagagcgacgctaatagaaaaaaaaattttttttggctttgccgtaaatgggaattttaatctcggcccatcgccaagagtattatgtcattaattaaaaaccattataatgggcaactctaaaaacaaacttttaatccttggaatcattcggtagtactaagtattctctattaggctgcaaaatttcaaaaaaattttttttgttaactttcgaaaaagtattgccaaaaatatttggaaaacaagagttttttgagttcttttgtcaccttttttgaaacttaatttcaattttacattctgatagagagcacttttggctatcgactgatacgttgaaattaaaattttgcttgttttggagcagttatgaataattttttgccaaattttcatatcggtggtttttaaacaacgccttttattgcggtttttttttaattctgcaccatcgccaaatccccctctccctccaactcgtttcaaaaattcgtcttttgaaaaaaacagttaacccatgtcaacctgctgagcgcctggcgacggtgaccgtgtgctgctcgtggtacgtcccgccgcttgttccgttcgctgttgttgcgctgggccgcccagctggcgaccaccgcccaacttcttgaatttgttgtccaacttcttcttcttgaccaagtctttgagtttttgcattatttatttggcctggaaaaagaaaattgcgcacaatttttgttggaaaaatgttgtaacaaaaagcctaaatcctgtggtaaattgctccagaaatctgccccgttccgaccgagtctctcaaatcaaaggatttttgaaaatcagaaaaacttggagaattggacgtatgtaaaacaaatttccaactttgccgtacaacaaaattgcagaattaacaaataggtatattgtgaacactaaagtgcaacacatcatgaccaaatcatggtaaaatgagcatgaaaaacaatataaaaaatgccattttcattttaaaccaccgaaacacataacatggaaatgggagagtggaggaaggaattttggtgctgaaaaaacaaaaatgtaataggcaattttatgttatataataattcatgtaaaaacatcgttcgcggtcattccgttcattcattgctcctcttcctcctcctcgtccgattcgctgctgctttcgctcagcgaaaagttgcggtcctgcgcagccacctcgtcctcgtcagaccggttgccgttgtcaactgtgggtaaatttgcgtgaaaatttggagaaaaacgaattttttttggatttccaaagcggaaaagttccaccaccccagtggaaaaattttgaatgaaaatttgtaatagattttagagcgaaaacaaatttttttttttttgatttccaaagtccggaaaagactcaagctcggtaaaatgggttttgaccaatagaccaattaaaattcaaagcgtaacaaaaatctttcgagtcggtatctcccatatttcatgtaaactgttgtttgctgttgaactcactgaattccacttcgccctcattttgctcctcgccgacctcgttcagttttgtgctctccggcaactgacccgaattcttcagaatgcgtgcctcgtccggcgtgtattttaaaatcacatccgcctggaaaaattttcagtctaaatcagtaaatttaagaaacgaaggcgttatctacgaaagcctggcgagctgaaaaacacaggggaagttattcacgaaaaatgcgatttttgtgtccatttttagaaaaacttgtaacaccgggacaacaaacaacgattggaatttgccagacttttctttagttgtttcctttacccaaaaaaattttttcggggcaatgaaaaggggcgagtgattcgcaatttcaaaaaatccatgatgcctttttatagcaaatgtaatacaataaaaactatacatcggacgggaccgaccccagccgttttgccgggatttcggtccaggttttttttcagagaaagcaactgaaccttgagtccaggaaaatggaaatcccggtccgggattgccgaccctaccattttctagtcccgctttttttcaagagtccgatttctactgccccacgtgccttgtcatcttggtaccctcgcaagccgatcagaatgatgtcgccggtgttgatccacacttttttgcgcaacttgccccgtatgtggcacaggcgatttttgccgtcaaaacaaaatgctgtcaaccgaccgttgcccaacattttcaccacctgggcatatgctgaaaaaacaattgtttttttcaatttgtgacatttgttcgaatttggaacctcactaaagctaattgtataaaatttttgcaaatcctaaaacataaataactccagcttttttttgaggattgtacaataatttaaagattatggaagcatgggaaatctcgggcctttaatggttaattctgagtaaaacaaaaatggaataaaattgtcttggaaaagttcatgccttggtcgtcgccgtccttttcgacgagttcccgtttcattatatcattttcattcttccctcggcgacgatttttgcctcctttccctttattcttcggcattagtatttagaaaaatcttaaaaatgaaaaagtaatgttaataatgacgaaaatgtccacattacacattcgaaatctgggtttaattaatcgattaaataaattggatcaaaaatcccttttttagagaaaaaatgcatttgaaccctgctgaaaatccaaattggtatctcgaaaaaagatgtttttattttgaaatcatttaaccattctcttgcaaatgtacataagtgagaaaataaaatatttcaaaacgccaaaaaatattttacacataaaataaattttttcgaaatataaacaatgtacagaatgaagaaaaaactctctttttactaaatgcccccggttaaaccggaaaatttctccagctttgtttctaggattatgaagttatgcttaaattacgccaaagtgattccaacccgcaaaactaagactttgacgacaaaaattagattaaaaaaaaatcgacgatccttttcggacactttttgggatatgggccaacagtgccgatagtcaccgtcggtcgggaaaacattgaaaaatgatatgatttttaagatttttatattttggagaaccacaaattatactaatggcccacaaaaatccaaagtgatcattccaataaaaaataacatttttatgagcacgccaataattcaaaatctgattgatcacttctcatcaattcattcacttctgctgatcacttgnggccgggagttgctttgagaagcctaaaaaagaaaagcatanaaacttgaatgtttgaataagcattcgctgacccatctcccaattgcgcattgcaattaacaacatggctaattctgttccattggttataaatacgccagtcaaacgcctcctcnttcccattttgtccatttgctttcatctcgcgcattnggacaacggaccaac

SEQ ID NO: 763 - DNA, 3838 bp, Heterodera glycines
aaaacattgatcagctcaccattacttacattaatttcctccgtaattccacatgacagaaaagatttggcgatcagttccttcgaaagtgaacatacttttggtatggaagagaatccattgaatttataattcatattaaacatccaacagttgaaaaacccctatctatttattgaattttacctgaaaattttcgaaaaatttttggtatggaaatggctggtatggaaacggcggtatggaaatgggtcgatcccttctgcattcgaccgcagaatgctgtttcgaacaccgagtgttttcctcgggtgaggggcttgtttaaactcgaaattttgattcatttttttaaaatgattacctaaatactgttattgtttgaattaaattatgccattttttgcttttgtatagaaaacaatgacagttgaaaaatcggtgtcaaaggctgagagagggcgctgtttttttgacattcacatcgatggtgagccggttggacgcattgtgatggaattgtttgacgagcttgttccccacacaaccgagtttgcatttaatggacatttttgcgtattttatttggcaataggaattttgtgatgctttgtactggccaggctggcattggcaaagtgacgggcaaaccgttgcacttcaaaggctcaatgtttcatcgggtcatcaaaaattttatgatccaggcagcgatttcagcgccgcaaacggcacaggaggttcccattttttcatgttcttgtttttgtcggaaaatgagtaaatggaagtccaaatttgatagttttgaggaaaaaaggggcttgcccacaattgcattggcattcaaaagaagggtcttttcggtgtcgtcaaaatatttaaatacactatagaaagaaggattctatagtcaagtcactcagtaagtgagtggtacaagccaaatacactatagaaacaagagttctatagacattcactcagtaaggcataagccaagtatacgaaaactatagaaagaagagttctgtatccaagtcactcattaagtgagtggtacaagccaaatacactagaaagaaggattctatagacaagtcactcagtacagaagtacaccgcctccgcctcaggatgacgaacctcacgaggaggaagaggcatttgcagagccagcggaagtgctgcctcccgctctgatagaaaatgcaaaattttcagaaatttactcattcttgtttgaaaaattctttcaaatgagtcaaaaaaattacaaatgattttttcatgaaatccgttaaacactcatacctacagtcgtcttaacctactcgtctcttaaaaaactgacccaaatgatttccccagtttgctgcttgaacctgattctcatttcttcaaaatcgaagcaacagcgaaagcggatgaattcgtcaattccaaatctaaaacatattacattatggatgcaattcctcaattctctgaccgaaacctacgtcaattcatcactgtcattttccagcacagcgcatcggaagccagtctccacaaaccaattttgttcatcgtcatcttgtatttcaagcgtcaggttgttcactctagattttttgtttgcagataattgttcactaatttaaaaaacccactggccaatggaagtctgtgaggggccaaaaacaccggaaaaacgcttccgattgttgggatcaagcatttgataataagtgtcaacattggcatggtaaaaattgccccccatgacggctgacgtacatcctgtgagaatgtaaaactcacttcaatcaaatgctgtggatcaaagctctcacccgtatccaataagatagcgttcacttctgttttggagccaagcagacacatgtgtttggcgcccatacaagtcattgtttgcgtagttctgatcaaccatgtctgttgttgaagcacttcttttgagtccaaaaagaagcctgacacgcaacgatcctagccaagggggtgccaatatctaacgacagagactgcgcttcttcaccaattggccactgttggcgatgacaacgtcggccaacgtctagaaaagtgaccattaaatggaaactaatttaaatatatattaaaaaaacaaaccagacaacgagcacacataaagtgcttaaacgagcgttcacagacaaagcccaaagcgccatcttccagctctggcttttccatgcacacggggtatatttcgaatgttgcttcaacagtcgtctaaaaaagcagaattttgtcacatatttcatctgcctaatacaagtgggctatagaaattttatagactaatttaatttaccatgaggcggaggcgacacttccgctggctctgcaaatgcctcctcctcctcgtgaggttcgtcatcctgaggcggaggcggtgtacttctgtactgagtgacttgtctatagaatccttctttctagtgtatttggcttgtaccactcacttaatgagtgacttggatacagaactcttctttctatagttttcgtatacttggcttatgccttactgagtgaatgtctatagaactcttgtttctatagtgtatttggcttgtaccactcacttactgagtgacttgactatagaatccttctttctatagtgtatttaaatattttgacgacaccgaaaagacccttcttttgaatgccaatgcaattgtgggcaagccccttttttcctcaaaactatcaaatttggacttccatttactcattttccgacaaaaacaagaacatgaaaaaatgggaacctcctgtgccgtttgcggcgctgaaatcgctgccttggatcataaaatttttgatgacccgatgaaacattgagcctttgaagtgcaacggtttgcccgtcactttgaagcagcgccgtctctcagcctttgacaccgatttttaaactgtcttttaattaaattaataattttttttaatttttttctatacaaaagcaaaaaatggcatactttaattcaaacaataacagtatttaggtaatcattttaaaaaaatgaatcaaaatttcgagtttaaacgagcccctcacccgaggaaaacactcggtgttcgaaacggcattctgcggtcgaatgcagaagggatcgacccatttccataccgccgtttccataccagccatttccataccaaaaatttttcgaaaattttcaggtaaaattcaataaatagataggggtttttcaactgttggatgtttaatatgaattataaattcaatggattctctcccataccaaaagtatgaatattaaagacagtgaaattaaaaatccaagaaaaaataacattttatgtttcaaatggatgcaacggtttgcccgtcactttgaaaaagggaggggatcgtcgtggaagaagggtcgtaaggaagggggaaaatttaaaattagcacaatttccttagcgaaattaatacaaaattcaaaaaaattttcccggcggcgcctatcggcaccgccggaccgcccgccattccatcccccttcatcaagttttttggaaaaaacgcgcaggaaaaaaattcgtattcggtccacccttcccaatttcttgaaagacaaatccctattggatacccaatctcccaagcctcgaaatcccaaatcatggcaaacttattgtcatctgaatgtgtaattgacgtcccctcccccaaaaaacctgtcttcgttctcctcctccccctcctcttccgtgtcatgggctgacgcactgcgcttcttcaccaattggccgctgttggcgatgacaacgtcggccaacg

SEQ ID NO: 764 - DNA, 4182 bp, Heterodera glycines
  misc_feature (4086)..(4086): n is a, c, g, or t
  misc_feature (4133)..(4134): n is a, c, g, or t
  misc_feature (4140)..(4141): n is a, c, g, or t
  misc_feature (4145)..(4145): n is a, c, g, or t
  misc_feature (4168)..(4168): n is a, c, g, or t
  misc_feature (4170)..(4170): n is a, c, g, or t
gaccatctgcgatgtgtattttttgaaaatctattttttcaaaatacgatcatagttatagtatttatttggtaaaacaattaatttgttaaactgattacaaattatgttttcaattcttcattttatattgtgctttgaccccctccccttttccctaaatttttttatgttttcaaaagtcatttaaacatttttacaaggattttggggtctctgatcacgaatccggcacccgaaaatagcatttctaacattaaaattttaaataaatatattgaccattttttgataactttttgttgagaatatttttttactttggcaaattgaaggttttgttcgcttcagacatgcacctgaagcttcaaaaagcgaattcgcaatgggtttttgggtgcaccttttgtggacaaaaataatttattgggaaaaatgtttaaggtttcaagatgcagcgctaatttttttttgaaaaacagatgtccattgagggggatgacgttcgcgggtgggaaggacagacgatgttctacatggatggccggcacctacacactcccccaattcaaaacaaaattggccacccttttgggcgggagggcggcggagatcatgttcaccgggaccagcgtcgggcatgtgcaggatgaggacgagtggctgcttttggcagatcacgtaaataaaattaaaacacattccaatttgagtccagggtcggaattaggcaaacctatggtcagatgtggaccaggaacctcgagattttacgggtagtgatataaaagttgattagggaccacaattctgcaccgttgctcactactgcattagcatcatgtctattatgaaagaaaatggcatatagttatgagcaatgaaaggcaaataaaattttttttaatttttgggagtttttaaatatttgcgccaaaaagccatttttaacatgcgccaaaaaagcttgcgccaaaatacctgctccaaagtgggcggtccccaataataaatacagggtacacccccaaatcacgacgccgaatctcgccgaaacaaaattaaaaattcttaaagatggccctaataactccgggtccgaggagaacaagggcacagcaccgcgcattgatgcaacaatacatcgacgaagcacacgattatgccaatggcatattgcaacgacaccgcgccaaaatcgaaagggtaaatttaggcgtttaggggcccgaaatgaatatggtataaaaaagatacggattaaaaagtcgtctttttactgtccaatttgaccattactgaaaaaattaaagctatttaaaaaatacgaatcgggtttctatatgaaccgaattattgtaaacactgatgaagttttctttttatggacaggccgccatcgtgatgaggtttcacccccgaaaaaaattgttccgtcgcgagttatcgaggtatagttgaaatgccaattttgttttgttcattttttgtattgtcatgccatccccgtcctggctgggactgacccggttaggtggtcgattggcacatgagttacagcaaagacaaatcgatatttcgggttttcgtaaacgttccgctttgattttctaaaaaaatgagtgtagcgactttttgtgtccacaacaccgaaaaagtccgaattgaggttatgacgaaattttttaaaattttgtagattaatatagaaaccaaaagaactaatcgaatgttaccaaaaatatggttgataatgagaagagttgttagcaacgacgccgagacggtcggcgccgaaattagcgattttcattcttttttgggttcactaaaattctgagtgcatgtttgttattttagtaataaaatgtgattttaagcattctcggtccgccaacagttgtgacacgtgatgggcaccagcagcgtggacgtgtgaatggtaaccacgtgcttggcttttaatactgtacatttttaattttcattggcaagaagagccaataaatccgcaaaattcctgactcgaaaaattacattttgaattgaaccaaaaaagtaggcgtgactacaaaaaatcgaaaattttttcggctcgagaaactgaaactttcgcacagccctatggcttgacaaaacgcacaaaatgctttgccctcaggtgctgtgcgtggttttggtcctgcccgcgtttctgattctgttcgactccgttggccaacacacaccgaaaagcacggcgtggcgctgaagagacttcaaagacacactagcggacgtcacggacaggtggaagatgatgggcttggtgtccagcaggggactttcagatttacaagtgtcaaattgactaacaaataccaattttgtcttatgacaaaagcctcaatatttaagggtctcgggactcaaatgagactgattttgaatgtcaagtcaagttctgaacggtaaaaaattttcctgttttaaactacataaacattccaatttgaatccagggtaggaggcgaatattgcctaattgtaagccaaaaaatgcaaaaggtgattattcaattcattcactcattcattcatggcaatttgctcgaggcgccaattgaaaaattttcacacaaatttacattcattgttgtataaataaagcccaaataatgccgtagggaaggggcggcaatttgatgaaaagtgccaaatttgatgaagcggaagttacccgagagagagaaaaagtttttttgtcaagattcggcatgccatttaaggggggagcacagcctcgtaaaatcgcaaatttttaattcctaggcctcaaattttgaaagtgttggattccgttaaacccattttatatgtaaggctcgagaatcttgagtttttgaattttccgagactctcaaatttaagattttcatctaaccattggtcgagactctcgattaacagtttaatcatcaaataaactaaaatttcgcatttttacgcaaaaaagtattactgtaattctttagttagttctttgtatactgtaatctcgagactcttgaaccacccattttgtgctaaaatttatttggccttttttcagcaaagcaataatatgggcaaactcgcggcagctactgccggcgcaacagcacataatcaccatcaccaccatcaccataaccaccaccaccgtaatcatcattatcacaacaataatcaccattcctcatcgtctgcgcgtaacggtagttcgtccgccgccgcaacaactacggtagcccaccatgtggctactggtgaacaagcaacaggcggaatgccaacattgccattggtggtggcatcattaagcaacggcggcaatgccatggacaatgccactgtgccacgaactccagcaagtggtggcagcacatttgacgagctgttcaaaccttccaccaatggctactgtagcaccaacaacaataacaacaacaccaatagtgttatgaatacggtaggtttggacagggaaagggaaatatttcaattctctcccgggtactgtagttacagtacaagtttgtgtcaacgtttccaaaattccttttgccatattataagtctcttccacagaagggcaaatacatactgtatactgatttgtgatcgcctcctttatccctttaactgatgattgatcatttttccttcatccatttaacatcgtagtttttcttcgtcatactgtatacttttttttgttacagcagcaacagcagctgatggccacccaaatgatggcgcatatgttcgccgctgcgcaacaacagcaacaacagcaacaactgatcagtgctggcggcactgatcagcaggttgccgccgccgctgccgctgcggccgctaccacactgatggccaccgcgcagatggccgcgcatatggccgcggcatccgccgctggcggatttggtgggtgtactattattgcaatgatcggctctgatcagtttcttaatcaatattttggtagtaattaccatggctaagatttgcccaatcaatcatcaattgatctcatatgatcaacatttttcactttatgattgngagtaatattatcactgatatacatatatctgctatttattatcaanntgattnnactnatggattttggatttattgccangntttctggatatg

SEQ ID NO: 765 - DNA, 3736 bp, Heterodera glycines
  misc_feature (22)..(22): n is a, c, g, or t
gggggggggaatgagagcactntcattaattaatggtatcaaaattaaattcgctttttctcgagactctcggcttaattgatacttctacaacgaaattccattcgcatatttcgcgatatgcatattttacgtgcatattttggcattttttttaaatactcaaaaatttgaaaaaatgggaattatgccaaacataatgtccaaaaatctcaattttcttcaaaattaataaagtttacatagctttattttgtattttttcttctaaaaagatgttatgcatttttaatataaaaattcattagcgttttaatcgattttttaattaatttccatcggaaaacaaatttatgtttttataacaaataaaaagtacaaattaatcaattgcatgttgtagacttatgttttccggatgtattttagtttttgttttgttttttgagcagacgacaaaaaataatcgtggcttaaaaattactaaaaaattaataattaaaaaaaatgcccgacaaatcaaatcgaagtgatcactgatcaaaagtcattaaaataaattcaatacttaataaatttcacaaatcgtctaaaaaattctaaattttttagtaaaattttctttgggttgaattttaagttttgtttcacttatgttcaaaaattctcggcatcattaagccctgcttgcgccggaagaatcttggcacattgcgtctcagttttgcttcagtcccgacaaaagtcgctttattcccctctccctcgccccctaattatccatgtctaatgtggccagggttagcaccgaataatggcaaattaaggctttaattaactctattaatgcgcttcccccacggagcagtacaaaacgttgccggacgaatttttagaccataacttctttttttttctcaaccaaattaaaaaacattcatgatattgttctaaagcacttgagaaactacaaacttgcaaaatcaaaaaaagaaaaattcggacaataccaagaatgcttaatttgattgaaaatgaagaaagttatggccctaaaaaaatcttccggcgatgttttgggggttcaccgcttcccccatcagtacgcctgaaatagcaatgcttgatcaactccctgatcactttttttcatgttcagctgattgcttgttcttgtccaactcggcagctttccaccagcagcagcagcagcaacagtcgcccatggatttgatgtccgtgctccaagcattggccaccgcttcgtccgccgccggtgccttttccgcttcgtctcccaccgttgtgtctgcgtttggtggcaccgctgcttcgcaacattttccgtttggcagtgccggcaccgtcaacgccgccatctctggtgcttctccggtaaccgtaggcggcggcacgtcggcggatgcgggcggctttttgatggcagccgcagcaatggccgccgcgggtggtgccaatgcgtgcggtggcggtggagtgccaccgcctacgacgacgtctggcgcggcaacaacgccgcttttgtcccaacttacgctgccgctaacaccgtcggcaatgccatcgacaggcacaggcaataatagtaacggcggcggtagcaacggttgtggcggtgccggtgccaccaacggtagcagcaacgcgccgtcgccttcaccgcagaagcgagcacgcacccggatcgcggatgagcaagtgaaaatccttagacaggtgcggtgttgataggataaggagtgtacggatcagttttcggcgccgaccgtttcggcacggcaccgcccaatttgaaatagttttggccataacttttttttgtagccttacgaaatttttgggtttttcagtcaaacagaaaacccttaagggctctatcgcaagttaccaaatttggagttataataactgatgatggtattaatggtacggtatcttccttcccttacagtactttgacatcaacaactcgcccagcgaggagcaaatcaaggagatggcgcacaaagctcagttgcctgagaaggttatcaaggtaaaatgggttcattgaccccaaatactgatcagtgatcaattaccattattcgaatcaattaaattgccgctaattaattaattattattataagttacaaattccgtaaataattaattacatcactagcacccacacggcgattcaattttgggctccaagtacaattaagttggttttttcgtcttagtggtctgtgagttagtcatcaaaaagggggtctcaggttcaaatcctccttgtgtttgtgtataaatttcaattttttaaagcaaataaataaaatattaataaaaacagaacgccaaaagaacaaatacaaatagtggaaggtagacattatattttacccttgattttattaaatttttttagcttataactttgtcaataatagaccaaataaaaccattttatgctcattttggagggaaaattctgaagaatatttcttaattagtcaaaagtttaaaaaaattgtttattgacaaaaaaatgaaccatgtgttattttatatgttagagacatggaaatagtgcgtcaagatgagagaaaaagaaaaaactttgtccttgaaaaaaattttttcctattgaccaattttcttgaaattttgcataaacacatattttaacccaacctactggatgatgctttgttttttatcaaaatgctttttaactcgagatcggctcttccgtttttacaagggaaaatccccataaaatttttaagttttgcaaagttttggcgttctgattactaaataatatcgtgagacgcattcgcaaaaattagatgttttactgccgataaaataaggaatttttggtcaatccttgattttgcatgtttactgattgaaataaaaagttcaaaaaatgcaatcatatcattacatttatcatatcagctaatacaaattccctttgcctaactatgcctcttcattggacttctgtggacactcgcaacgcacttttgtgcgccgccgttccttccattggcgccttcgtgggctcgacgatggccatcaaagatcaggaattggttcaatttctcaaggtttgctgcatcagaggtgagcaattaattccaaaaagcttttagaatcaaaactttccttctttcgcccgttgttgcaaatacaattatttgctggccaacactgccgtcaccattccgttcggttacgcttcttatttggtctacaaaattggaggaggtttgttaggtcaaaattgctaaggaaattatcaaatcaccctttgagcataacatgcttgtcgttgtgaaacataaattaaattaaaattaagaaaaccgttaggactaccaaataatggctttattgcagttcacacgagacaaaaaaagactagacaataaaataattgacaaatttttataaaaccaattttttgaagttttctagccataacttttttgaggctcaaaaatttttttttaaactgtagattagtgaaggactcttggggctggttatcaattataatgtttggttctggtcggttttatgcatcccatgcatattatgcgtcccatggatggttatcctcagtttcttaggccagaacttttttcttacttggtcaatacctatattcttggtatcaaacgaaagcttaaggtctatataagcttttgttgtttca

SEQ ID NO: 766 - DNA, 1304 bp, Heterodera glycines
aaatggggatgagagggaagaggaagagaatggcagcggaaaaaaggagcgggtgatagtggaagagagggaagagaagaaaagaggagagatgagaaagaaggaggaacaacaacaataatggaagaggatgaacagcagcaggaaaagaacagggaggaagaggaggaaaagagagagagggaagaggaggcggaaaagggaaaggaagaagaagaagcagagaggatgatggacaataaggaagaggaggaggaagagcaggcggaagaggaagagcaaaaactaaaggatgagggaagaatggaagaggaagaggaagaccgacggcatcggcatggggatgaagcattggtggaaaggcacggagataaagcgtcgtcgtcgccgccctcccattccgcggcggcatttgtcgaccccggcactttcttggccagccttggcaacccaacggcacagcaatcggcggcaatgatgcccccgctgttcccgttcttcggcactggcgccgctaacagtgcggcggcaacgccgggtgcaagcggtggtggcatggagtcatttgcctcaatgttctcgggtgagccgggggtaattttgccatcgcatttcggcacttttttcttgacttttttctggcatacttagaaatttattagctggatttttatcactatgattgaaatttccggtttttgttttacattttggcactttaaagcttcatcattgatagaaaaatctattctattttggcatttttatagagggtattttgtatcctgcataattggaattttggcttaattgatcatagttggacttctcctgttgcttttgccattctggatgaattttcttttcacttaaacattggtatctttggcctaatcattggtcggattttgtttttatttttagcatttttccttggcttaatcatagatgggctcttctcttcccatttcggcactttttggtttaattacacctatcaaatgcatttcctgttccagcttttccgttccattcttttggccaattggcgacagccgcttcttcctccacacccacttccaatggcttttcctctccatccgcggcacaacagcagcagcaacaaccatctccgtttctccagccgtcgcccgccggcctcatggcagccgctgctgcggcagcggctggcaccaacaacggcggcacatttggccacctgttttcgggccagaatatgttgctgaacagtttgatgggccaacaatcggctaagcgcggcacagcatcctctaccctccatg

SEQ ID NO: 767 - DNA, 4161 bp, Heterodera glycines
gcattgggactgtacggggcgacggtgctcagcggctattttttggtgcccatgctcaagaagcaggatactaaggcggtaggcaacctacaagttcatcttcccatctccaattccaaccctttaagctgactgccaacgctgttgtccttgccggactttccgtcgccacttctgtggctttctacaacatcgacaagatttccgcttattggacgtgagttatttgggagttgtgtcaattgtatttgccaattcagcatgcccttcactctttgggccattttctgcgctggacttacggtgaaggcttgaaatgtttgaagtcggctgcctttttctggattgtcattttatgttaactcatcttttgttgagttaggaatattttacttccaagtaaattgtctcgacatttgccataacattaattatttggtaggatgagctctttaaatattttttttcaattctcaatttatcgtttattttattgaaacggttttattatgagtaccgcatccgaaagtggaagtgacaaaattgtgttccaaaaggtttgtgctcaatggtcatgggttttctgcaaaagtcgattgctttaagaatgttactgggcgaggtagccaggttttggatgacgccgagtttgttaaaatgtatgatcggtcgacttcgaaaaccttggtacttttccctattaaactgctaattttggtggccctattcagaacacttcctcagccaatgacaacgcacagtcaaaccaacagaaagaacaggttcagaaggttggtagctcatttccttctgtctgactttttttcattaatttatttttaagtggaaagtcggtgatcaatgcatggcactctacgaagtggacggaaagtggtacccggccaaaatcgagcagatttcgcctgtaaaaaacacatgcactgtctcttacattggttacgaccaaaaggccattctgaagttggaggacattttggggtatgttttttttaatatagcgaaatcccttcaaatataatcaaatgttggctgttttttgaactataaagagtttttacttgtttggtcataacttctattttgatccagtagtgccgaatttgccgcaaattcgcactttcaacaccattcggttgatctcaattggtacttcaacacttctcactccctttcattttttgaacaaactccgcccataaagcgtagaagactgtccatcgaacagccaattgtgagtttaaccagcggaaatagttgcaatgaatagtagctgtttcgatggaatttggcggattcttcaaagtgccggacattccgcagcatatcctcgagggcaaaagcgggccaaagtggcgggaaagagagggacgacctggcggtcagaaggaatggcatgagaccactgataggaagcggccaaaaacttccgattattttgcataccttcgcttcctcttccggatggccccgcgccaaccttcgattggacagcataaaataaatgaactgtataaatgttcgacttcggttgcagagcgtttcttttccacttatggtctgttctcgaccaatttgtctcattgtcaggcattgaccaaatttttgcccgagtccaattgttgcattggaaatgagaaaagcggcaccacatcggacaacttaaaaaccccagatttcgttagtgaaaacagcacaactgtccgtttatatttggagggaattcgtgacaagctcagaccaaatatgtcaggaattgtcgttagcaacgtattcaatttttatttaagtgaatccgatgttgaggctgccgatgaccatggcgatgagcgtgaagcggaagggacaagcggaacgactaaggcaaaagacaaattggagaaagcaattttccctttcctcagattgcggacaatgatgtgaaaaaagatgcatttccggtatctttttagtatatatacaaggggtgtctcgggacaaaatttttattaatgaggttttcaaaaaaaattgtttaaatttaaattttaagttttcctcttcccccccccccctcccttacgcctaacgaggtggtgcaggccccttacgataaggggggggggttgtctcgagacagaccttgttctttcacaaattaaagcgagtccgtcctaataaatttagatcccggatttatgtcctccaccaccgccatcgatgtttggaaagatagccgttgcgggcaatgagaaggaggcactgaccaacatgcttatgtcgtggtacatgtccggataccacaccggtctgatttcgccgttcattctatttgatttaaaaagcgttttaggcttctaccagggtgttatgcatgaaaagacgacccgtcagaagccaaaatagataacgttgccatacggcttaaaaatcatctcactggttgctgtccatttttattgtctctcccctccctcagttattgtttaattttcttgttcagacataaattgccggtcaacatttccaaagcaataaacggatagcctttattgaagcgtaacacacatataaaaacgtgaagcatttgaaagaatatgaaggcgttcaactacatagcttaaatgcgatgcttttgttatgggcagaagttttgttaattatggtttttgctgaaaagaattcgaaaaatggactaaataaagcacggaaagcgtcagtttgtgcatcccatggccgagtggttcttttcgcttgtcacagtcccttcaaagggtccactttcaccaccttcggcgcttgtgcatttgctttttcctcttcggcttttttcgctgcagctttctgctgttttaggcgcattgcttctgcgtccctttccatccgtttctcagtggacgtgcccttacacaaagaatgaagtgtatgtaattactaattaggaattgtttttgaaaaatagtcgaaatttaaatttgatcctttggtttttaagttggtaaatcccatcacacctgctcttgctttttttgctgttgctgtttcttcagattgcgctccctggccaagtcgcgttggttaccgcctaaagcgaaggcaaatttatgcgtaatttcgatttaattacgagtcattttatacgaaatgttcttgttgtgaagaaatcaagaaagtgcaacgtgcaagtgcaactgtaattaattggtttaacctaaactattaaattaagtaaacaattgttgcgatgaattaaacaaaatgattttaaaacgaatgagcagaccgacgaatggacaatactgacaactcagtatttcgtttgtgaatgggagaaaatggagctaattgtaagtatgacgaagaaccagttttaataaaggagtcccctcgtcctgtccctctcagcttttatgtgttcccgttcccccccccccccccctccccccacagaatgattattgtgcggcggttgagtgcttaaacatgttggaagaattggggcaaagattattgttggttattctgattcattcacacatttatatttgattatcacatcgactctcaaaaagacatatgccaatgaagagaatgccagagaaaaatgcaatactcattttggcctatggaagttttttccgccttatagattccatccaatttttgtataccggtaaattaaataattttgcacagaattatcggaccgggtcactatagtctggccgttatagtcagggggtcggtgtagtctggcaagctgtttttgcccataactcttacaaatgttttttgtcaattataaaccaggttaaaatatctatgtttagctacaatacaaatggaatatcccaattaggaaaaaagcgaaattttcagtttggcgccgcctttgttcagtcaaatttatattcttcaggcaaagtaaaaccctaatttttcacattaatttaaaaaattttttcaggtaactatttggttctagtcggttttacgcgtcccatgacactttaagcgtcccatgacattttacgcgtcccatcacattttacgcgtcccaacaacactttacgagtcccatcacattttacgcgtcccatcatattttacgcgtcaaaaaatgtttttcgaaccgtcaatcggaaactttatacctttcgaata

SEQ ID NO: 768 - DNA, 1228 bp, Heterodera glycines
atacggcttgtatgcgtctctaattataacattcctcgtatgaacacctgtgaactctgctttgacattctttcgtcaaactttgtcagttgcttttaatattaaaaattagcgaattatcttatccaaatttaccactattaataccgaggcatccaccgtgggtctgttctatacggcttgtatgcgtctctaattataacattcctcgtatgaacacctgtgaactctgctttgacattctttcgtcaaactttgtcagttgcttttaatattaaaaattagcgaattatcttatccaaatttaccactattaataccgaggcatccaccgtgggtctgttctatacggcttgtatgcgtctctaattataacattcctcgtatgaacacctgtgaactctgctttgacattctttcgtcaaactttgtcagttgcttttaatattaaaaattagcgaattatcttatccaaatttaccactattaataccgaggcatccaccgtgggtctgttctatacggcttgtatgcgtctctaattataacattcctcgtatgaacacctgtgaactctgctttgacattctttcgtcaaactttgtcagttgcttttaatattaaaaattagcgaattatcttatccaaatttaccactattaataccgaggcatccaccgtgggttgttctatacggcttgtatgcgtctctaattataacattcctcgtatgaacacctgtgaactctgctttgacattctttcgtcaaactttgtcagttgcttttaatattaaaaattagcgaattatcttatccaaatttaccactattaataccgaggcatccaccgtgggttgttctatacggcttgtatgcgtctctaattataacattcctcgtatgaacacctgtgaactctgctttgacattctttcgtcaaactttgtcagttgcttttaatattaaaaattagcgaattatcttatccaaatttaccactattaataccgaggcatccaccgtgggtctgctgttctatacggcttgtatgcgtctctaattataacattcctcgtatgaacacctgtgacctctgctttgacattctttcgtcaaactttgtcaattgctttaatattaaaaattagcgaattatcttatccaaatttaccactattaatacgaggatccacccgtgggtgtctatacggcttgatgcgtctcta

SEQ ID NO: 769 - DNA, 5668 bp, Heterodera glycines
aagttcttgggcgagaaaatttaaagcgctgcggagatgcaaaaatatttgcggccactttaccgcagtttttatacacgggaactgtcaatcatataaagaagggaacgccgaagcgacttcatttcaattccatttcggttgaggcggggggtcggggccattctttgcctctcggggcgcttgcccacaaatattcaaatttttccatcaatcatctttatctgccaccacggcacggcagcacggcatggcagtgggtggagtcagcagccgcaccatccgcaagtttacttcatttgccactttcgtctgctttcaattttgtcagcagcagaaccatcctcaatttcaattctcattgtttgtcagtttcgaccactttccattgccaacatgtcttttattgcccccggcactttcgcgttcctttcaaaagactatggggaatttccgactgggcattttgacccaaacagagcatacgacccaaattcacttgcagaactttcgtaatggcatttattttgcttccattatctttcattttttctttgtagtcaatggagaaaagagtttctggacggccgatacggatccaaacaaccaacccctccttccaccccgcgtgccccatcgcccagcttcccaatcccggtcatcgttggtaattttgaatttgttttttggattttgcaaatatctatcttgacaggaaatcgtccacaggatgaaaattgtttgggttttccacaaatatcttgtctgattttttccattttagggcggcagatgttcccaaatgacgatggatacgaatcggaagatgatgaaattctcttgccacctccgccgatccccccgcaacttggccaccctccgccaaatgtgccggtaatttcggtctcgcttttcgttgctttttctcaaatttccgagtgcttttttcaggcagttcgagttcagccaatgcatgttgggcagcagcggctgccgctgagagacctgccgcaaattttccaccctccaccaaatgtgccggtaattttgggtctttctttcgattgctttttctcaattcccgagtgcatttttcaggccgttcgtgtccaaccaatgcagcaacccgtaccaatgagagccgtgccacaattcctccaccctccgccaaatgctccggtaatcttgagtctcgttttcggttgttttttcaaaatcccgagtgcattgtttttcaggaaattggtgtgggaccaattcatgatgggcaacaaccactaccactaagagcgttgccacaattcgcccaacctccaccaaatgtgccggtaattttgggtcgtttttttgttgctttttttaattcccgaatgttttttcaggccgttcgtgtccaaccaattcaacaaccgataccattgagagacgtgccgctatttgtcaacccaccaccaaatgtgccggtaattttggctcgcttttgttactttttttcaagatcccgaatgcattttttcaggtaattcgtgtccaaccgatgcctcaaccgttgccgttgagagacatgccgcaaattcaccatccaccgcgaaatgtgacttcaatttggatcaaattgtggttgctttttctcagtctctgggtgtttcttcagggaattcatgttcgacaaattcaacgggaatacgccgtaccgcaatttgcccatccgccgccaaacgtgccgtatcatccaccagaaaacgttccggtaatgttgggtcttgtttctcatatttccggatgcttattcaggtaatccaaccacggcaacgaccgcgcgagctgagagacgtgccactattcgaccacccactgccaaacggacaggtaatttcagaccctgtcttttacctaacaccgaaacatcttttcttaagcaaatgtatgccaaccccccgagagtgctggaagtgatccgacggctgggcgagtggagaggaagaccaagggacccagacgtccgcctcaatgaatgaatggaatttggattttgataaaatttgttgttttaattttttgaattgataagggttaaatcccgttacctaaattgtttgaaaattattaaaattttaagaaattagatgctaaacctaacctttgacaaagattatgaaaaaatgaaaagaaatgacgaaatttttggaatgttccttctttttattatttatggattttttttcatgtgcattattctggtgctagtaagatattgccgaatgaattaattggttttttctcttcattttaaaatatttcacgtccccatgccctgcccacttcccacggaattgatcaaggaaataattgacgctctcccccctccaaaaacacatcggcttttgcgcgtaaattttgttttggcatactttgttaaatgtcggttttattccatgatgagaagattgtttcgcccagagcatatatcaataccaatggcccgaagaactggaatttatttctttttcgatgttcatactccccctatttattttccactctaccaataataacatttaaaataaaattataattttttatttcttatctgattaatttcgatcaatattttttgataattaaacaaattgtatttttccaaaaagaattttctcgcagtagcaactcatcgtcttttttactcccttcataaaatgtctcgcttttgccccctcgcccaaatcaatgaatcgggtcggcttaacacaccaaaggggaaatttagtgagttccaaacctatcaaattaaaaaagaattttgatattcgttttaggtcttttttacgctttggaaattgctcgaagctaccagctcatagggaaaagtataacggaaaacaaattccgttatctgatgaagacggagaagaaacaaagggaaatggccatggaattgatggaaaaggcagggataaacacggatgacaaaacttttggtacccaacaccttgaggctgtacaaaaatactgggacagggaattcccggatatgtttcgcattgtggcttttgaaatggtaaccaaattcgcttgaaaaaatatcccgttacttatttttagaagaccgggcttaggccaattttcaaaggagaaggtgttcgaagaaatgaagtgggtgtgataagagaaggagaccattgggatgggatcaaatcggcttcttggttttttggtgttcgatacttctgtgtcagctgtgaagtgacgtatgatcgacctgaaagacacagaatggagtgtaaggaacgctgcaaaaaatgttgccggatgggatttgggtttccatgtgcaaatgtatgcgaggaaatacactgcggcgaatgcaatctcaagttttacaacccgaaatgttttgaagcgcacaagaaggcggcttgtattgagtacaaaaaatgcgaaaagtgccgagagacacacaatactcggaacaaacacacatgcggggaaaagttttgcaaactgtgcaaagtttgtcacccagggcggcaatgtttcatcaaaaaaatttcaagtgcgaccacagaaagcctacagaattgtggcatacgacctagagacgactgtagatgggggagaacaccggctttaatcttgttagtgcggcacgtacttgtagcatttgtgcgggagaagagcgggaatgtgagatttgcgaaggccccagtaaaatcacatggtcagtagcggacggttttgatccaatgagcgagtttatcgtttggataatgggttttcaacgatttgaaacgattgctttcgcgcattatgctgggaggttcgattcacactttgtcttgtccgagctaacaaagaaggaaattgcgacggagttgatgatggctgatttgaaaatttatcaaataaaggcgggaagagtgtactttcgggatttttggatgcttagtcagaataaattggcggaccttccaaaaaccttggggttaaaaactgcagctaaattgtattttccacacaaatacaataagaatgagaattttgggaagagattacccaacctgccttctttgggagactactgcccggacaatatgaaggaggaagaagccgtaaaattggaagcatggcacaatgagaattttcaaacggaatttgaactaggtagggaaaatagcatttttttctttgaaaataaaatttaaggggaacaactcaagacgtattgcgaaaacgatgttgaaattttgatggaatcaattttgaagtttcggcagttatttttggggataacaggagatttggatgtgatgaaggacagcgtgacaatcgctggtgttgtgatgaagatatttagggcaaaatttttgaaggacaggcatattccgatcatgcctgagggagggtacgagaaagctgagaatcagagcaaaatcgcagtgaaatatttcgaatggctggcccaaaaaaagggagtaaaagtgcggcatgcgtgtaacggaggagaagtggaatttggtgggctgaaggtggactgtgtgattggggcagagaaaaaaataattgagtttcaggtaaaagaaaaaatattttctttttaaaaaatacttaaggggtgtgcatttcacgggtgtccgagatgttttttaccttggactatagcgccaaacggacggacaatggaagagaatcaaagtagaaccgaaattcgtatggaaattttgagggaaaagtgcaaaaatttttcaatcggagaagtttgggtaaataaaacatttagaaatatttattaattgttagttttagaagtgtgatgtcagagaggaattgaagaaaaataaggagatgaaaaagttctttgaaagtgtgccggacaagggaccgatcaatccgagggatgcttatgccggaggaagaacgatgccattttgtttgtacgcaaaggctaccgaagaaattgagatatcaatgttcgacatcattagtttgtacccctttgttaattatggtaaaattctgcttaatttttgttagtttcctttcgcttaagacaccccataccccgttggagtcccgaaaattgtagtgagcaggaattttaatgtgaattggacagcacccgacgacgtaccctatgatggacttttgaaagtaaaagtgatcccaccgaaaaatcttttgtaccccctcctccccgtgcacatcgatgaaatgctcctcttccctaattgttggtcttgtgcgagaagggccaaaaatgaatttgtgatgacaaaagatgtgaaaaaatgtaaccatcgtcccacgcagagagcatttttggggacattcacatcaattgagttgcggaaggctttagagctaggatatagaattgtgggattctatcgagcgtatcattttgaacagtttgacaatcaactgttcaaaggatatgtgcggatgtttttgaagataaaggtggaggcgtcggggtggccggcggaggtgaaaagtgaagaggaaaagagagcattcatcgaaatgtacaaggcgaaatacgatatctgccttgattatgataagattgggttaatcccggaataaaaatgattgcaaaattggggaaaaataaaaaaaatcctctaaaaattggttcaatttaaagggattaaaaagtttggggggaaaa

SEQ ID NO: 770 - DNA, 3898 bp, Heterodera glycines
atatattcgagttaagtctataaaagggaatgttaaagcgttctgaaggtttgaatatttcaaagggattaagatctgttcggccataaattattttatgagccatgaacagatcagacagctttcgcctgctttcaagtgtcggcagttgaaggtattctaatctttgttggtatggaatgggtggaaggctgcatttaaaaagaactcttttggtgaaatatttttgacatttttcaatttttttaatgttttttagaagagatggattccaaacctcaggagcatattccaataacggtctaacataagttttgtacaaaataatccaaatcctagaagattttgatttaataaccccgaaatatagaacgcatacgtaaatatgcattctttattatttgtgtgacatgattggaaaattgcaatttattatcaatatttatgcctaattccctaatggatccccacatttattatatttccctcaatttttttatttcttttggggttttattcccccaatgaaagaacaaaaattttttaattgaaattttgatttccccttaattttgccccctttctggtaaattatgcaagggttaaggaaaattctggaccggaatgggttaaaccaaattaccaattttactccccccccatataaatttttttttcccccccggggggaaaccctggaaaaacctaaaaaaaaacaaaaaaaaaaaggtctgggaaaacccggggggggccaaaccaatttttttgggggggaaaaaacccccccttttaaccaaaaaaccctttttcaaaaaaacccctttacccccaaaaaaaggggcccccccaaatctcttttttttcttttttaaaaaaaaatattgggcgcgggccccgagttttttttaaaaaaaaaaaaaaaaaaaaattttttttttttttttttttttttgccgcccccaccccccccccacaggcttaaataaggggcggggggacatttttaaaaaaaaaaaaaaaaaaaaaaaaatttttttttttttttaaaaaaaaaaaaccaaaaaaaaaaataaaaaaaaaaaaattattttttttttttttttttattaggaaaaaaaaaaaaaaaaacacacaaaccaaaaaaaaaaaacaaaagccgctccgcaaaaaaaacccaaaaaattttttttaaagaatagtcctaatttggaaaaatgtttcgaagaagaggggggagttcccccacaaacgaaaataaaaaatttgggataaaagagcatgtgacaactttctattttaaatgcccagaaaacgaagatcccgaaaaaatgtttaaaaaaatcctgaaaaaattaatgggggatgcaatgagccgagaagctgagccgggctggaaaattgagaaaatttcagtggacctttattgcagtgccctgtcagaccccgtgatcatccctgcccgccccttccaacaatcgaacccagacattgttttcaacgagttcatgcacagacagcaatcatttggggaagtgaatttgttagaccagagaatttcaataattattgccacttattctttccctgttaaataaatttgtttcatttttccctttcattattttttgtttattacaataattatttattcgaccttttttctttattaatttttcagttaaaatgtactcgtttcaaaaatattttgaggaggctctcgaaaaagaagattttttctgccagaaaaacagagcagaagtggaggcattgttaattgaggcttcaaattataaaattataatacacagggactacgaaagccgctattctgattatattgccacctatcgccgcaccccactcttctgtttctgcatgattgagagaaatttaagatttttttacgacacaggaaccgggacgcctataggaagggttacaaccgtgctacatgttaccgttgaggcgagctatacaggagaggggttcatttcgcctatgttttccttttggttttattgggagggcaggagtcaaacaacaaacgaatctttcacgagccgtctttatttgtacactgtttcgatgctaagagcaatgggcaaagcctggggcagagaactacttttgaaccctgttgaagttttaattgatatgttctaccaacgtatagataggttggaacatagaaaaaacaattaaaaaaaatattttagagatttggtcggatcgtggtcattgttctatagactcccaccctcactttttgacacttcacgccgggtggttgcggagaataaactggaagaatttttaaaattaccatcattttttcgcatgcttttttataataaatattaaatgttcatgttgtatttaaagtgaaggttttgacccaaatatttaatcaattttaatttattattttttcgtagaaattcagaaaaaaatgcaaacaattgctgaaattaaaaatttcgagattattgaaggcggaagagtttttattgtgagagcgagaattgagaacgtagtacatgtggagtacagggtttgtattaaaaatgaaaaaaatatatcagtttttaaggcttgcgttttatgccgtaagggggcgtgttcatgtggcgttgagaaggcactgacaccttatttgaaggtgtctgtggcagatgatactgagatattggaaaatgtggcattttttggtgtacgtgggaagaaaaacggaatggtaatgttttaaagaaaaaataccattctaatttaaattcaggaggagttgagaggattgtctggggccgtgtgcaccatgaaaatcggcgcgagggtgaaagaattcggagggaagaaggggatctattactctttgatcgatattgttagcctttaaatctataaatgaacttgttaattttttctaataaaaatgttgggtttaaaattatttttcctctttattatagcgaacgcggcagaaagctgctgctgcatttcaaaggaagaaaaacagcaattaggtagtatccgacgaacaattgaggccgtatttggagatataatcagattaacgaaagaggccaaagatttttctttctcggcacataataccatggttgaagctcaaaaaataaaagacaaaaaccctagtgttcacggggtaaaattttggcatgaaaagcttttaaatggggtaagaaagatccatacgctatttgataaaataaaaaatgaggagaataacattaaaaatataaaaaaaagtatggaaaaatgccttgacagaaaagatgcggaaatgtgccaagaactagcggatgaggcaaaacaatcaatagaattagcaaaaaattatagaaaggaaattgggcaaacttatcggaccgcttactcgcaacccgatttatgcattggagacttggccaataaattaaaagaaacaatgcgagaaaagcaaatacatttggaaaggccaagaccccaaacagaatttagagacgaatttattgcatataaaatataaaagaaaaatttaaaaaatgaaaaataaaaaaatgaattctgaaaaatcagaaaaagctaataccattttggtggaagctgaaaaaaagagacagaaagagcctggagggatgtagctgcgttagcagaagaagttggcgattttgccaaatcttctcgggaaacgcttaatcgtgcaataaaatctagggaaaaagctccgtatgctaatggtgttcgggaattatatcttaaaatgtcagattcaatttgggaaattttcaaaatcatggaccaaatcaatttggagtcaataaaggctgaatctgcgtggcgtgagttcgaaagatgtaaaacaatggaccaggcaacaaagtttgaggaacaatcgcaaaat

SEQ ID NO: 771 - DNA, 4862 bp, Heterodera glycines
aattggataaggaggggagtccgaaactgctcattcattatctagcccattcaagacggcatataagacaatgaatttatttgagttttattttgtttaggccactttccgtgcaataactcgtggcgaacgacgacgccatcactgtcaactttttgatcagagtgaatgtgaagaagagtcatcctttttataaatgtcatttaaaatcacttgtgaaaacgatctttcaaaattaaatcatttttttgtttttgtgatcgtctctatttccagtagaaatcattattttgtttctttccaatgctatttttctcccatatatgttcgttcttgtggaaccgaataaattttgtcgtcaactttcctatttttcaaaaattattaattcgtttttgcgagaccaaatgtgaaatttttttaaatatcggcgtgcaaaacaagaaaaaaacaacaaataacaaaaagtgaggatccaccattaacgcattttgacgtcctccgcccccctttactcctcctccattttttccttcttgaccttctttttggcggctcggtactcggccaccaccaccgcgtggtcacgttcgtacggctcgagtgttacctaaaaaagtggagggggatttccattgccaagatgtgacgatttgcttttttgtgcgtcctaatggttggacaattttacaagaacgcaatccattccaatgcaacatccaatccacctgctcaatgggtttgaactgctcctcgcgcaatttgttcacttcgccggcaaacaccgcctccggctccgccgtgctgtccacacagttcgccttgatggagatgaccacatggccgttgttcttcagaaatttgtgcgcattgtgtgccacaatccgtgcctggtccggctgtgccacgtccgagaaaattgtgtccacaatgccaatctgtgcgcgcagtgattttaggaaaaaaacttgtattcaattttgggaagacgaaattgacacgtaaaccaaaaaagatggttttcaaatttggattaaaattcaatttagaaaactcgcaagagccgaaagtttaagcgaatgaccctatttgtgaggaaattaggtatgatgcaaatagctaattgtaagttgactgaccatcatggagtatttgtgcgggtgccgtgcgtcgtccacaattggcaccacgttgggccgcttcttggccatgccgagcaggtcacgtccactgcgatgtgaaaactcaactgcatagaccatgccttcctaaagaaagaaggtatctatttacaaatccaagacaaaaaaaattatttggcatacgggtccaacgatgtcggacacatgggaaacggaagtgccggaagcggcgccaagataaagcacacgggcacctaaagcatgcaaatattgcgcatgtgaaaataaatttgagtagaaaaatcggtcccgattcaatccgtaccggacggtttttcatgaaccccgtggatttataaatttggcatccttttctagccaacttagaaacataatcacaaacgaaagaattagaatggaagttcgaaactaatgctccaaagcatttacgcagatgaaaagcttttaggcaccaaattccggcaaactcttgattttcgacttttgttggagtcagggtccgagatttgaaaacggccaaactaatgcaaacacgaaatcccaagaatcatgcacccaatgtttttcatcgaaaacaaaagggttatcaaccaattgcgagtgcttgacggaaactgacccgggtaaatgtgcgtgtcctcaatgccggccatgacggcggcggccagtttggagcggaacgggttccacacccggtactcgactggcggtgccgggccggcagccgcggcggtgggtgctgagacaccgttgctgccattcgttgtctcttccgtcttcggcgttattgcagcaatcggcgcattttcggtctgctgggaggagatgcgcttctcgccgtacaccgactcgcccggcaccatgttcagcgtgcacagcgcgtcctccttgcccttgacgatgaaaatgcctgcgggaaattcgacggatgatctgatcaggcgtgaacacaatcaacctctgatccggtgcggctccacaatgaccttgcgtcccccgcgcatgcctccgccggcgccacccccgcggggtgaaccgccgcgtccacgtggcgagccaccgcgtcgcccgcggcgaaccaccgcctccccgaccgccaccaccaccgcgtggactgcctcctcgaccaccaaagccacgcttaagaatttcaaaaaattttttgcttttatccacgcatttatcgcgaaaaaatcaatttgagattttgaggaattttgggtggaattttaaggaaattggtccgtcgttaccaccccagggaatgtgcccagttttgagagcaattcaactcgttcctgatggtttttggatttgtgtaaaccgctccaactatttgcgagtgcatgaagttgaagatgtacggcaaccatttggagtccttcttcaattagtttgtcccaccttaaaccctccgccaccgccgcctccctccccgttgctctgacgaaaaccgccaccaccaccgcccccacggaagcctcgaccaccaccgcctctgcccccacggtcaccaccaccgccacggcctcggaaacctttgcgaaagagaaagaaatgaagcaaatgtatggaatcgaatagccacttgaccaatgcgaattcgtaaccagaactcgaaagataaatcgaaaattttaatttttgactctgggttcgaaccccctagcaaacgtatttaagtccagaaataaactttagaagtgcttgtaaattaaaaaagccctttccgtttgtgggttttaatgttaaaaagctctttttaactttctcttctcacctcctcgtccgccgccaccgcgtggagaaaattcgggtcttcccattctttgattattatttttgaaggatgctgaaaaaatgcttttgcggaaaattatttgataagaaaaaacaaaaagtcataaaaacacaacggtcaaaacgtataaaatcatttgaacaaaacaaagtttggaaattcagtaattcattcaaatgcaaatgtacactgtgaataatagagaaaatggagaggaggaaaagaaatgagaaacgttttaaaagttccgaaaataccgttttttcgtaaatttctaaaaagaaatttccaaccttttttttacgtttaggtaaattaacccatcaagtcctcccgcaagaaaatggaaaaacattgcaaacaaataataaaaataaaatgatcaatcaaaaacaatgaccttcttgctcaccccccccccccccctccgttgttgttcatgttggctttttggtgattgcagcggacgtctccaacctgggggcgggcggtttgaagttggcgccacggaagggctccaatttgcgctcctttttcttcacaaagtcgcgccacgagccgcgccgctcgtcccggctctcctcatagttcttcttgtactcctcctccaacttgcgcttctccgccgcctcctgcaccgactcggccaaccgccgcttctcctcgttggcccgctcctccagcgtccgtcgcttcttctcccggtcggcaaacacctgcaaaatgtggtgtatcccttttcaaataaaaaatgaaatctgattctggcattttgtatatcgcaatttcaaataattgacaaagcaatccgatacgacacccatttcgacaaatttcgaaccccgtgcccgaattcaaacattaagttaaaccttcaattttaaatcttcgatttcttgtttgaattcgggtaccgtggttcgaatttaccgaaatggatgtcatattcgtggtttcgataggatagaaatggtcattttttggcaattttttgctcatcccaaagccttttttgggtcaaacgatatactgggtttttgaacatttcaattgacccacaatatagttaaaaatgagaaaaaacctttgtcacggtgatccaaagtgcacgtgcgtagccctgtggtgtttcttcttcaatggcgtcagcttttccatcctaaaaatgaatacattttaaatggaatttcgatttttgagataaaaatgggaaacctttcgcattttgcgcttcttctcgctgatttgcactgccagccgcgctttggcctcctcgtacatgtctcggcagcgtgacaattcgtccgggtcttcgacggtggcgattgcctatagaacgaaaagaatttcaccgaaacttgtaaaatcatttccgaattttttacttttttgttgaaattatataggggattggagaaaaacaactcctttcatccttaaccaattaaactttgctaacaaataaggcaaaatgcaatgactgaataattgggaaagggaacagagattaagaaaaatgaatacgatttagagtttttggtttgttttatccattaattctccaatcacttataaattagtaataattgaatatcaataattgtcttagaaatgctgataaagtatgaaaggaactttgcccacatacaacttaattggtggtacttggagagtattgggagccaggaaacaacccaatccatctccatgagtcatttttctgattgcgagaaatgtcagatggaaggatttggtgcgtacctttttcagtgcgtcaaatgcgcgttccgccctctcccgacagttcggatttttgtccggatggatcagcagggacaacttcttgtacttcttgcgcgcatcctccacatttgtgtctggctccagctggagcacct

SEQ ID NO: 772 - DNA, 2082 bp, Heterodera glycines
attttcgaattcacctgtggaatcctgggttccgttgaatttctgctcgttgtcattgagtttcgtctcggtcaaagctttcccatcggcgctggtgagcttcaggagattcgtcttgaccaaggattgaacaacagcgcacagctgatcgccgggaaagtcggtgccaagagcgacgtgcagttcgccaagtgtgtacgtgttgcgttcgttgtactgcatgaggacggcaatttgttgcgtgttgcactgcaaaaaaaaacaatttttgaataacttatatgatttttcggtgaattgaatttgattttatcacgaaatccttatttttaatgtcgaaattgcttaccaaaaatgagtatttcgacgggaaagtgttgctcgtcgagaccaattcaccgcggcacatttgcaacgcccaggtcagcttacggccattgaaacggttggtgtagtactgagtgtaggctaaaaagtaatgggttcttccctttgggagttctctccaccacccgccttccccaaacgtacagtcaatgcagtcgaggagaggacgcgggatttcgaatttgaccggctgctgcagtggccacacgttcgacatgacgacaatgacggagaagtcaacgttggatgtcctcggctgctaaaatgggataaaactgcctcaataaaattaaaatttcgttagcgacctgcttgaattgctcggagtggtccctgctcagcgcgacatcagtcagcaatcgctccaacttggaggtgtactcgaacccgcacatgtgcttcagctttgcgatcatgcatcgctcctgctcctcgctggctgacgtgtcgtagacgaggcgcttgcacaaaaacttgtggaaaaacgcttggaacatgtccttgtcgtcgatgtatttgaagacggtcatctgacaatgggatattagtattttaaaaaaaagaaattgatggaacatttcaaactttaaagtccaaacaaacccaccacttgctccaggttctcatccatcttctcgtcctccatgttgcgtgcacttttgcgcaaaagctgatcacagtagaggaccaacagctgcggtgatttggacgcattccgagccatcgccgtaatttcgttgttgttgatgaacttgcggaaggcgcagtccattgcttgcacaaagccatggtcagttttgaaggaatccaccaccaagcgattgtagagttcgtgcctttaaaacggttcattatttcctaaaacccgcataaacttacattttgaggatacagctgatgtattgcttcggatcgttgaacgcctcacgcgcaatttgctgaatggacgccttgccctcccgttcgatgtactcctccaggatctctttgagcttggccaacccgtttggcacacgcgaacaaagtgtgtactgaaaaagaattttatgcaaaaaattgagaaaaagtggtttctgcaagtctcaccatccgtccaagatggtcattctgttggcgagtgagcaatgactgagaaataaatgtacaatcatgtaaaattggcaaaaaaatttcgctacctcaaatttgtcgtggaagagctcgaggtgctgcttgatcaacgccgtgtcacatgcctccatcagcgagtccattgtcgtgttgtccaaataaatttggcaccggtcccgctcttcgccaagcctctcttcaacctagaaagcagagagaaacataatcaaatttggtttcataaatgagacgtcaccgattcacccacctttatcatatagtcatcaaaaacatgacgcacattattgtgtcacactaaaatcacagaacagacactaatgttttagcaaaaacatgacgcacattattgtaatgtcgacattgttcaaattgtccgtctttttgtcctgccgccacaatttggcatcgctccaacacaaaattaatatgtgtatatacatcatcatcatcttctgccttcaatgtcagcttttctttagtccgttcgttcaccaattcaaactgcgcaattgtggtgtaagttttgaattggattatgtaactggcagaagagttggcacggag

SEQ ID NO: 773 - DNA, 2391 bp, Heterodera glycines
tcaaaatgcacaaaacccatccaagggtacctcaagaaagcgctgctcaaagtagttgcggtccacttggtatttgacactcggacgatgcaccaccgaattctgctgctgttgttgggcgaccgcagctgttgctggtcctccgacgtccgccgctgggtcgtgctcgttgatgccaagttcgactggaaacaaggaatgcaaattagcgggtgttcgaacgaaagagtggcggcagaatctggtcgccgaacgaaagacccattccctgactccccagccccgcctcggggtccaaatttgtaagcaaaagcttaactgtatgaggcgaccacgccgctgatcagtcgcgtggtgatgcgttccccgttgcggtccttctccaccagcgccagcgcagcggacgtgatgttgtggtgcagttcgtcaaagatcaccgacttccagatggagacagccaactgaaattcgagaatttaaaaatgaaacccatccccaattcatgtatgaccgtcaaaccactcacattgtacacttccaaaattccgggacgcaccgcctcgtcgatgttccgtctgatccaatgtcggttcaagtaggaaaaaatgccattcaccacagtggaggagaactggaatttggtccactgctcggtgtagtagtccagcagctggtcaccggacagacgctggcattcctgaacaaaaacaaatttgaattcggtatcctgtacaattttatttcccacctccccaatttgtgcaaaacaacaaaacctgaagcaacttccttgtgtactcttcgacgaagtggcgcagtcgagtgtagagctcctcgccgacaaactctgcaccagccgttcccgccgtcgtgcggttgccccgacgcgcccgattgttcgttgtttcgtgcgtgaagtcgttctgctggttggtgcagtaattgaagacgagactaaaaacaaaaaatcctaatgttggcacatggaagaagttaggaatgcttttctcttcgaaaagaatggtcaaccccaaatttttaaaagcggtgaatgctgctgcccaaatttcactacccggtttatggtggttccatgtttcggtatctgcaatcattttttatcgcgaccctcttaagtctttcataacagttaaacctgttaaaactaacgtgtaatactccatatagcgctgcggtgccattctctcctgcgtcttgaagatggactcaaggccgggcaaaagatccttccaaattgtctcgaatctgaccggatgattattcatccttgattggcagctgacaacagtaaattagaagacaaatatatgtgcttaagtatcgctgaaaagcattgaaaagcgttttgttgtcattaatcactataattttatagttgcagttttggaaaacaaaaaattgctaaatttgggttcaagtgcactttaagcgtccaatctactgttagaagtccagtttaggccataactttctcttggtcatacctacattcttggcatcaaaggaaagttgaaagtcctctgaaatttcataaacacaagaacgagtaaatactgacattaagaaaaaaattacaacgagatacgaaagcagccgtttttagaatatatcaaaaataatttgctagacttcaagctcttgcttgataccaagaatgtaggtattgtccgagtaagaaaaaagttatggcaaacgaaactgaagattggacttctaacagtcaattgtgatgcctaaaattcactagagcacgagcaattgaaaaaagggcagtctatgctagcaattagcaatagcatattcctaagtttatgtttttgtgattcaaattaaatacataactaatttaaaatgatgaacaaagtgcatttaggcacatggaaaatttgattattgaagataataaaaaaaaaaacggcacggcatagaaagtgaagttttcaaaaaagtaaataatggcaaaaaatgggatttggtcgcgaatttataaacataattctgcagcggattacctagttctcaaaaaaggacgcaacttcttcttcttctctttgtcattcatttttcctttgtttctctaatggcaattttatgtactatttctttgaaaacattcgtgttaaaaacttttttattttgaagcaaatccaacgtcgaaatcagcaggaacatcaaatcaaaacctttttcataaactgcgccaaatcgaagaataaaaaaaaatgccagaatgccgatttcagattccgacatttttaggcttggaatcccgattgccgaaatttttgaggacgtcagcaaaatccctggatggaataaatgtctctttccattcaattttattagcattaatttaaaagataaaatttt

SEQ ID NO: 774 - DNA, 3404 bp, Heterodera glycines
  misc_feature (39)..(39): n is a, c, g, or t
cggttactgtactctaccgtccagtgagtgtacggtgcncggcgtgccgtcgtcgttactgtgcgcgaccggtggtggcttgggcagcgactcttcccgctccactgtcactaccggcgcgtcgtaggaagcggcagcggcattttcatcctcctcttccgctgcttcggcttcagccggcggtgtctgcttttgatgttgttgctgttgttgtgccgtcgttgaatatgaacaaaacgccaaaaataagaaaagtgccaaaatggtggcggcggcacattttttgtgctccgacatatgaataatatcagctgaacgcaaagcaatcactgatcaaaaaatacacagcaaaagtttttaaaagctgattagtccaattcagcagtgcacattttccgtatcggatcagtgatcacataatatgtcctaaatatgattgaaattttcacatatagagcaacggattttgaactaaatagagaggaaaaaaattcggggaccgcaaacgagaagccggatttgaccgaacgagaatctcgaatttgtagggcgtgaatatttggtttggcaagcggatcgtcgttaaaccctcgtagttctgcttgctgttcaaacatagacgtaacggaattcccagttttgactcccaacgttttcaatagggttcgagccccgcccccgcccccgcccccgggggcgggacaggttttttgggctcacccccgcccccgcccccgtgactctgacccccgcaacccccgcccccgcgaccttcacccccgcgggggcacgggggtgaaaatacacccctaagaatggcatattcgtgcgaaataaggcaaaaaatttagacaattttgaattttttttaactatcgagaaatttttatgaaataaaataaattttacttgttttttattttatttgtggattggtggataaatacagggtttctttatgttcttgtttctaagaaatgttctgatttgggggtaatgccttattttcatttaaaagaagaaaatttctgaaaaatttggctaagttctaacaaaattcatataaattcttaaaattttccccggcggcgcctatcggcaccgccggaactctcccctcgcacattcatcaagtttttttttttgaaaaatgtgccgcaagaaaaaaaatttaaaaaatctgagttccaattttgagtaaatcacgataatttaatatagttaaaaaacgtaaatttatcgaaaaagtcttaatttttttggtgaatatctgttagaaataaatttaaaattcgcccctatcggcacgccccccccaaaaaaaaaattttttcttaaaaaaaattacccaaaaatccctaaattttgggatcgagccatttccctaccgccatttccctactaaggcatttgggccatttccctaccaaagtatgaatattaataaacagtacgattaaaacaagcaagaaaaaatgcatttgagaaatgttcgatcattttgaattatggcgacgaataagagtgatctgaccattttttatgctcgtttttactctctgatttgttgttgttttccgtttaaatataaattttctctctctttctcgatgcatcccttgggtatgtacagggctcccaactctgctgattttcaaagcttttgctcatttctaggggtcaaaactgattatttgatgagatgctgatttgctgctttttgagaaaatttgttgattttttgaaaaaagagctttacgagttggtggccgaacgtttcgtcactgaaataaaataaagaattttaaagggaaaaaatattaaaaattatatacatagatacataatctatttgaaaaacactagtctaatacatatttaactttctgattcgtaggccgattaatttgttttagaaattggttcgatcatgagaataacctttaacctcccccgtgttttggtggttatttgtgggttatttctgacacttggctaatgttgagttctggaagtgtgttaaactgtgataacaagaaattttagggatgacaaaatatatccttgaacctaacccagtgtggtactccttgttttgctacccccccccccccgaaaaattttaaaaattaatatttttgggcttttcaaggtcactgatcatcatcaatatggcgtttgttttgacatctgctgatacctggtcatagactggacaaaatatctgtgattttttaaaatattttggggagggaggcgtagcaaaacaaggaagtacccccagtgttaagcattttgttaagcgaatgtttaaagatttggtcgctggcagcacattgtatccgattactataatgtaacggtcaacgggattatgtgaaaaggccttaagaaagtccatttatctgcaacacaacaatttgtaacaactctttgctggattcaaaaacctgcgggacaagacccattgaaaatttattcaaaaaactaattttcgaacgcccatatcttttttctaactcatccaatcggttagcatttgcttagaaaaagcttcttctcatcaattgctttcgaatgataccaaaattttcaaattgttgccaatttccaaaaactcttacaagagctcattttcgggatggtgtgttatgtatgtgaaatatcacaccacttaacacaaatttaatgctttttggttcaaaaattttattaagtatatggcatagtgtttatttttattttttttatttcagtgacgaaacatcagggagccttacgagttggcatagcacgagttatgtatgattttccattttaatcgtttagatagtttgactttttcataactagggatggtaaaaatatggatataaaatcgcgaaatatggccataaaatatggactaaaaatcgcgaaatatggacataaaatggtaaaaatctcaaaatatggacataaaatggcaaaaatatggacataaatttttctaaattgaggggtaaattttcaaaaaaacccgaccaaaaaaccgaaattttccattttttgcttatctttcacataaattaaccaatttttaagaaaatttaaatttaatcaatttttttgacaaaattttgctaaaaaatgtctttttcggaaaattttccggtctttggggttaaaacggccaatttagctgatgggggccgttctaataggggtttttttgggaaaatgccaaaatatggacataaatcgcaaaatatggaaaatatggatatagaaatccatcttaaaagcttcaaaccaagctaaaaacatgtttttcgtgcgtttcaggcctcccacattccaggaaaaaaatatggatttccatataattaccatccctaatcataacgtttgccaattttcaaaat

SEQ ID NO: 775 - DNA, 2105 bp, Heterodera glycines
ttcagccggcggtgtctgcttttgatgttgttgctgttgttgtgccgtcgttgaatatgaacaaaacgccaaaactaagaaaagtgccaaaatggtggcggcggcacattttttgtgctccgacatatgaataatatcagctgaacgcaaagcaatcactgatcaaaaaatacacagcaaaagtttttaaaagctgattagtccaattcagcagtgcacattttccgtatcggatcagtgatcacataatatgtcctaaatatgattgaaattttcacatatagagcaacggattttgaactaaatagagaggaaaaaaaattcggggaccgcaaacgagaagccggatttgaccgaacgagaatctcgaatttgtagggcgtgaatatttggtttggcaagcggatcgtcgttaaaccctcgtagttctgcttgctgtccaaacatagacgtaacggaattcccagttttgactcccaacgttttcgggattcggaatctcgacttccgatttttctttgagattcaaaggcttctttggtgctggccgggattaaatgctatgctattgtatagaataacgaggtttggaaagaaagtgtcgaccgcttcaaaacaggacagaaaagaggaaaagcagcagcagcaggatgccgattttgaaggtgctttttaacggaaagtgccgcccacagcacaaaaaaaagtgatttccgtctgctgctgcacccaatttgatccacaatttgagcacggatcagtgacagcgaccgacggagcggagaatggaaggaaaagaaaggggaaaataaggcgaaggaacgaacgaacgaatgaataatggttgatgaagttggctgtgctgctgatctgctgctggttgcacttttttgttgtttttgttttgtttgtggcgatgcgatttgtctgtttccgcattttgtttcgcgtcacttcggcggcgcaacccatcgatcggtttttagtcggttgccgcgacgtgctgttgttgctgctgcagatttaggcggtgttgggaaagcgaatgtacggggggggggaataattggtgggaccggcgccgcagggcggggggggggggtggtcggattataagagcacgtatccactctctctccctgattttgccatttttgatgatgatgctcgagagtcgcggcttcgagtcttgttgacagaaaagtcttcgtctcgctcgtatcgagtcttgggtccctaagtctcagtctcgagtttcgagaatttttcagtggtttttcgctgacaacaattcgacgccgcaagaggccgaattgccagagatgtttatttttttaatcatttttggctgtattttttttctcatttagcaagctaatagggctaagactttccaaaacctttcaaatggcactaattttttaaaatatttatacaataaaaatttaatctttcgtatccacaaatatttttcgtacaaaattttatggtgaattaaaaagggataaagggagggatatgatgatggtgatgaagtgagggaatctcttttactgctgcggcactcattcccctcctccaaatcattttcccacttcagcggcaaattcccatcgacgaataaataaagaggagaaaccctcgactttttgttcaatggattggaaaggcgggaagaagaaaaagggagggggaaaaagaatgcttttcaaaatcaacggcagcagcagagagtcagtcagctcaacgttagttttcaaagtcacacttttttggaggagtcttagaaactcgaatatttaactttttatgccgaaatattaaatttataatggcacttagtgaatgtttagattttactagttcaatgcgctttgtaaatgtcaaattttagaaaattttttagaggatgttatggatgagcgtccgccggctgggtgcaccccaaaatttcgccgccgaaatttctccgacgaaattactccgccgaaatttcgccggacggaatttcgccggccgaaatttcgccgggacatattttcgccggcgaaattactccgtaacataatttcgccacaaatttttattaatatatttggaaattt

SEQ ID NO: 776 - DNA, 1630 bp, Heterodera glycines
aaatgccaaaaaaacaaatagtgaatgcctttattcgtgtggaaaatgcgctgctggtgaacacaaattccgacaacaacaatttccacccaataatgatcatcttcagcttcgctttcgcatcgtcggtcctttgtctttcggttgttctcttctccctgcgcttgtcgctgcttatgctttcttggctgccgccatcttctttttgaccgccagcacggaagagcggggcgggcacggacagtagccgctgtccttgccgggctgtcccggtgctccgggctgtccaggctgtccaccgtttccaggctggccgggctgaccaggcgcgccaggtgggccgggcggtccttggcctccgggctgtcctggctgaccttggcctccggggtttccattctggccaggcgctccgggcggtcccttcgggccaggaatagggcgcctgaacgaaattgaatcgggtttaattttacaaccaatggttaaagtgtacttacgagacaactccgttcgctccaggctgtccgggttggccagaggctccggggcgtccgggctgcccaggctgtccttggggtccgggcgcgccaggcgttccaggtcctccaccttgagcgggcgtaccaggctgtccaggggctccttgctgtccgggcggtccctgtcctccggggcggccgggcgggccagcagggcagcgtgggcaggggatgttctggggagggcaaggagcagctgcaatgggaggcatgattattagcaggggggaggtcagccaaaaaatgccaaccgggttggccaggctgtccagcctgtccgggctgtcctgcgcttccaggctgtccgggctgtccaggcggtccagccgggccgggcggaccagggggacagcttggttgttggaggccagcgcactggcagtgtccgggcagttgacgcttggcacggaagatggagttgaaggggttcgcacggggcttcgacggcggcgtcaccaccacttgcacgtccatcaagtcagtccatgccgagtcggtgttgacgcggaaggcctggaaaattggcaaattttggtgcattcattgtttgagtgcggccggctgagtacctcaactccgttgcgcactttgctgttcatttggctcatctccgagtacagagatggcagagtgacaactgtggcgatgatagccaacagcgagcacaccgaggcaatcccgagaacaatgtgagtctcttgcattttgcactaaattatttatgaatttggtgtgtccaaatgtaaataattattttttgaggggcgagggtttatttcactggaactaatgaatttgaaatgcccaaaaataattaatgctggtggtggagttacgagaattactgcccgccttttatatgtgaatattttgccacttttttctctatcaacccattttccttctacccattttgccctcggggcattttcgtatagcctttgcgctgtttgtcccccctgggggtacgtctcattgtcagcccacccccccccctttttgccccttttcccctttcgctgttcttttgcctcttttccttttttatcgccttcgtcagtcatttcaatttccattttttcttgttt

SEQ ID NO: 777 - DNA, 1042 bp, Heterodera glycines
tctcttttccatctctaaatggtcatttttggaatgtttctttaatttcatttctttttgtcataattataatttcgacttgtgtctaaaatataatattttgttgtaaaattttttttattcttaaaaaggcatttgcttcaccactttccaagtaaaaaatatataattgtaaagaataaacttatgggttatttctgagaataataactaaagctggcagattcttaattagcaactaaaactatcacagaaaagtttcttatattttccataacatgacatttttacgggagggaaattattattacttaaatacattaaaatattccccaaattaggaaataataggcaataattttttcaattatttacagtaaaaaaagataaagctaaatttatccagcaactgcagcagcaggttgcaattatcgttttggcataatctcaatttaaatgatgaaattttttctaaaaccttaattatcatccaacaaaaaaattcaattgtgcccttaaaaaaattcattttctcgaaatttacgtgcatagaataaaaatcaatgagaaaaatgatcttttctttcaaatcatctatcactgttcactctttgattcggcacagctttattgtataaaatttgccaagaaaaagcataatgaagccatatttactaaaaattcaaatttatttaattgaaaaaaaacaaaattgtacaaattatcattggcattccgaaaccaaatgcagaacagctgttattgtctaaaaaatcactttttatgaaagacaaaataatattttataccactgtttgtgttttcatcggaataagttttttcaataattgttgccgtctccgtctcatttttggaaaatgatttttccaaaattggcacataatttggtgttggtgttgaagtgaccatttcatgtaaattcattttttttggcacaatcgtagcgatttcagataaattatatgatgctgttagttgttggattgtcgacataaatgacacactcactccatctgctaaa

SEQ ID NO: 778 - DNA, 2872 bp, Heterodera glycines
  misc_feature (11)..(11): n is a, c, g, or t
  misc_feature (37)..(37): n is a, c, g, or t
  misc_feature (66)..(66): n is a, c, g, or t
  misc_feature (74)..(74): n is a, c, g, or t
aaaattatttntattcttaaaaaggcattgctttcancacttcccaagtaaaaaatatatattgtnaaagaatnaacttatgggttatttctgagaataataactaaagctggcagattcttaattagcaactaaaactatcacagaaaagtttcttatattttccataacatgacatttttacgggagggaaattattattacttaaatacattaaaatattccccaaattaggaaataataggcaataattttttcaattatttacagtaaaaaaagataaagctaaatttatccagcaactgcagcagcagcagcaggttgcaattatcgttttggcataatctcaatttaaatgatgaaattttttctaaaaccttaattatcatccaacaaaaaaattcaattgtgcccttaaaaaattcattttctcgaaatttacgtgcatagaataaaaatcaatgagaaaaatgatcttttctttcaaatcatccatcactgttcactctttgattcggcacagctttattgtataaaatttgccaagaaaaagcataatgaagccatatttactaaaaattcaaatttatttaattgaaaaaaaacaaaattgtacaaattatcattggcattccgaaaccaaatgcagaacagctgttattgtctaaaaaatcactttttatgaaagacaaaataatattttataccactgtttgtgttttcatcggaataagttttttcaataattgttgccgtctccgtctcatttttggaaaatgatttttccaaaattggcacataatttggtgttggtgttgaagtgaccatttcatgtaaattcattttttttggcacaatcgtagcgatttcagataaattatatgatgttgttagttgttgggttgtcgacataaatgaaaaatcgtctccatctgctaaaatgtttggtttaaatacttttttattggcagaactcaaaaaattagtcaaaatacatataattataattgattcttgattatacgccctttcaaattcactaataattatgaatcactgagttttgcttcttttcagatttttttttgactaaattaaatgttaaatggactaatgtaatacatttgacaatttacagatttttcgagataaatccgtcaacttttcataaaaacaaccaattaaatactcttggtatcacacgctagcgcatagattgctttttggttagtactttctgaaaactcaatgaaattttctgaaattttatgctaatagagcaagcccagagctatcgtaatatgtagatttttaatttggttgtgtttaaaaaaagtaacgaaaaatgtgtaagtttggcagttttacaaaacgacctagcacccaaaaaatcctttacagagatgggtaatgcgccccgatagcttacaagggatatcccgaacggtgtctgccaaatcagattaaaacaacctttaccgtgtagagcatagtggatttgcgaaatgcggaattaatcccgcaggatcccctccagacaaaagatttttagttcaaatcccgcaactcgatccgcaaattagaaatttccaggctctactaactatattaattaattaaatgtttcacctcctcctgatggcggcattacaacattggttgtattgtacagcgggaaattcttgttgctcatgtcgtccattttgcgtccaattgtacaaaatgaacagctcacagcaaggccatacaaatctttcatctccttctcaacattgtcgctacatgcacctttctccgggcttttggcacacccataatgcgtaagccattcatttccttaaaatatttgataaagtgaattatgacgagctaaaaatgccatccacaaaattgtcgaatcatcctaaaaaaaatttagtctaagggatttgttcctggaatcccggcatttttgcccctaagaccggagagaataatcctaattttatatacatattaactgatacgggttcgaatgtcaaattgtataaatttttcagtatagtataatgatgaacagagttgtaggctctgtatttaatagtaattaagtcacatgttccataccagggatgggctgaggtttcgcttttcgcatttcgcctttcgcattattcgcattttttggcgtttcgcatttcgcttttcgcatttcgctttttggcgcgaaatgcgacttttacacccctaagaattggattaaattcccaaaaaatttttcaaaattttacctataaattggctaattttcagtgaaaaactgtttataaatgatcaaaatttccaatttttccccggcggcgcctatcggcaccgtcgcgcccccaaaactcctattttttcttagaaaatggcccaaaatcgcaaaatttggtaatttgatgaaaaactgttctcagcggcgcgccaaaactcttatttctcattagaaaaatgatacaaaaatcacaaaatttgatgattttttggtgaaaatctgtcaacaaattttaatcaaattttcaaaaattttcccggcggcgcctgccggcgacgcctgccggtgccgcctgccccctccctcttcccaaaaagtttttttggaaaaagcgcgcctcaaaaaagcgttttattgatttttaaagttggaataaaattttaaaaaatgatttttgctttatgattttaactattaaaaagttgtagaaaaaatttcgcttttcgcatttcgcttttcgcattttcgcatattttggcttttcgcatttcgcttttttttcatttcgcatttttcagtttcgcaaatttcgcttgtcgcatttcgctttttatttttcaatttggtccatgcctg

SEQ ID NO: 779 - DNA, 4570 bp, Heterodera glycines
  misc_feature (66)..(66): n is a, c, g, or t
tgttccatacctctgttttcattgtccaagcataatagtacggttccaaaaaagcctttttttctntaagaggattatgatggtttcatacatgacatttcttaattttcgagtcattcttaaaaagtttggtcaagtattttcgtttatgagcccatacatttcttccacctaagatcggggaggaactctaattagataagacttgaagcattaggttgaactttaaatccatatttgtgggatataaataagaacagagttgtgaactcagtatttaagtagtaattaaactccttgacccatatttgggttttaaattgagtcgtgctccagggaaccgtcaaactttaaaattaattaacattcatcattataattacccttttcaattcgtttaattggtcttatttaaccaaagtcatacctcttaaacaatgcgaagcataacaatatttgtatgccgattgccagaaatatgttgactcgcattcttcttcggaaaagttcatcttcaagccaacaccgtttattgtccctaccgtatcccttctgcatttaagctgggctagaaagaaaaattaataatttactttttttattttaaatttaataccatttgaacaaccaagtgcgtttatcataacaataaataagaaaatttgaagtaaattcattgctaaattatttctttaaattaagataaataaaaaaaattaaaaataatgcatttaattatcacaataagatttttattgaataaaattgattttttttaattttaaatcaaatgatgaaattaatgagagtgaaatataattgagaattaccaatacaactaatcaaacaaatttatgaatgtcatttatgctggattttaataaaatatttaaaaggcagaaaatggctgagtaaataaaatgaattcaaaattttcatattataaaaatttaaaataaaagacaaattatcacaaagtttgatgcaattaaagagaaattgaaggcaattggaaaatatgtttgggaaaacagaagcagaattgagacaaaaattggtaaattattaggcgcaaatcgcaaaaaaaaatatacaaatgaaaaaagaaatgaatttaaataaaaataaaatgatgaaaaagagtttttatgaacagaaaaagaaagaattcattgaaagatttgatgaatttaaaagtttatattgccaaggaaaacagaaagaatttgtgaaggtattgggcatttctgagttgacatttagaaaacggaaaaaagaattagcgccaaaatatcacaaaattaagacgattttaatagttattttgtttaattttcattttaaggacggtattccaatgaggacaattgagaaagatgaagcaatatttcaaaattaaagaaaacaatcccaaaactagtgacaaaataattgccaataaattgacaattggcttttcaactttgcaacaatggaaaaaggcttcattttcgaattgaatgatttggtaaaatatgtttacaattgaatttatttctttttatttttcattccgtcacttttattataaataaattcgctgattccaattttcagtgccgttttttttttggttattattctatggtttcacaaatttttagattattttgagtattttaaaattggtttttgaaaaaaataaatgataattgcatttaaaaaatttcacttcacttttttatttttattattataataaatttttatcgaaagaattgatttttatttgaaattaaatgaagaaattaatgataatgtgaggtataattgagaattttcaaacacaactaatcaaacaaatttatgaatgtcatttatgctggattttaatagaagttttggaggaaaatcatttcgggggattccgaatgtcccatggattcctaagaaaaatggtttcctttttacaaaataagcccggtgccgagttatgacgtgccaaattttatagttttttatgtataaaaaaaaatttgcatgtattttatctatttcaaagcttttaaaatgcatttcatatttttaataattttcattgcttttaaaattgaatccggaaaaatccaaccaaattttggcgaaatattcggcaacgcatgggacaataataaaagagaagaaaaagcgatcaaaattgaacaaaatgagcaaaatgataactcagcgacagttgatcaaatgggtgagggaaatggaacgtacccaaatgatcaaaagaaaagtgaaatcattagcaaatttgatgcaattaaacaaaagttaagagaaaaagaaaattttcacgaaaagaacagaaataaaattgagaagaaaattgctagattattaggcgcaaatcgccataaaatatataaatggaaaaaagaattatatttaaataaaaataaaattttttatgagaagaaaaagagagaattcattgaacgatttgatgaatttaaaagtttatatggccaaggaaaacagaaagaatttgtgaaggaattgggcatttcttatgacacatttcgcaaatggaaaaaagaattggtgccaaaatacaataaaagtaagataatttgtttttctttttttagagaaatttgagtgaatttattattctccaccttgcgcagcgggtttcaaaatttaatcgacttttgccgggttcaattttaaaatcaatgaaaattactaaaattaaaataccacaaattcaatttataattattttaaaatattttttgaaatgaaaatgtgttgattaatttttgagtttatttattttatattagctgaaaatgaaatattttgagatggcaggaaaaactgcatatactacaaatttaattgtaaactataaaaagtaatagataaaaaaaccgtaggcctataatgttaaacgacgactattccttaatcatctaaccggcattcaacagcttatctacaaacatatacaatttttttattattttttaataaattttcggctgcataatgacataaagattaatcgattaaaaaatcattaggccatttaagcgtaggcgaaatatgaaatattgccaatgcttacgtgtagttttaatttctatttgtttaaaatgggaattaaattataggaccgatggtgaaatgccccaatagcctcggttttaatagccaaattactccgctctccggataaatgtgtgatgctaacattcttatagacggacgatatgagaaaagttaattaatgatcgcttgtacaatgaaataaaaatttggcggagatttatgttaaaatagaaaatatttttagtattatttaaaaatttttaaattaaaatcattttttagcaccaatgacccagggacggtcccacaatttcggctccggcagtgtgcaaataggcgatgctgggaaaattttcgaaaattttctcattggtttaggattttacgaataattatttttaatgaaaaatttgggagagggaaacttgtaaaggaaagaaaccaatatggaaaatcaaaaaaaaattcacaaattttagcaaagagctaaaagtcatctaaaataaattataattagttggtgaaccttcaaaactcgaataaaattcttaaattattcaatttttctgaagttttagcctaattatccataaatggcataataatgccctttcccacacattttttgattggcgagaatttcgaggcggagaatttctcgggcttttgctactaggctcttagtaggtttttttttgaaatttctcaggtactactttcacggggctcatttatcgaatgtgattctcgataaaaaagcttctttttttgcaaccccatatgaataaaaaaattttagttttaaaaattttcctttttcgaaaacgttataaaatatttaataatcatttaaatgaccaaaattaagttttttggttaagttttacgtgttttgcgccggaaaaatccttaatgcaaaaaccggtaccggtaccaactttttccaccggtaccggtaccggtaaaatccaacgtaaaaatttttggacaaatttttcaatacaaaatttttattcagtttatttatttatttaatttatttattcataaaaaataaaaaagtcatcagaagggcgagaaccacttactctgacgactatcagataaatgtcgtagagtaagtgacaaaatatatggatgatcacaggaattaaaaaaagacaaaatatgtgaaaataaataaattgaggtcaaagtcaaatgaggtcgaaatatcaaatcacttagaaatttgttacattctaactttcccggtcttacatattaccctagtgaacttttaagttttattttaaattgatttaaagaatttgtttttattagttctttatcgagttgattccacaattttgttaccctcccagcaaagggaatgaattttttgccccagtttgtattttgtgttaaatctataaaaggggatgttaaagcgtgctgatggattaaaggtagaaaatagtttcagatctgttcggccataagcaat

SEQ ID NO: 780 - DNA, 3126 bp, Heterodera glycines
ggggatgaaaaaaacttttgatgtattgggggggcacaacttttttgggtaaaaaaaagttgtgccaatggaatgtgttgcggcggtgggagagtgattaattatttgtgtgaagggggggggggggtgctggtgtgttcacggcgctgcagcgaggaacggcggcgcgtggagaaagagaaaagagtgtatgcaaaagtgagagagtgaaacggtgagagagagggagagatagagagagaagaaacaaacattgggtgagagagtagagagacagacagtcagagaaaaattttgtgcacaaagtgaggggttgagaaccaaaacagcatcatcttttgctaatggagaaggggggcgctgaccaatgccattgacatattgattcgatactccaaataaattgggctcattttagcataattataccattaaatttataatggaattgttttatttatttattatttatttattttttgttagatagtacagtattactttcatggcaccacgacgcaaaagaaaggcggctcaattggtcgggcaggacgaagcggtggtgaacggaccgagcgcacaggtgaattgtgttcaccatcaaattttcacatttaaatttcatatgctttttattttcacagttgccaacgaatgacggacaacaattggcgtcagcagcaccagtgacaaacaatggcaccgtccaacaagcggagaacgacggaactgatgcggtggcggcagcagcagcaattgatgacaccggcggacaagtacaatttttgtattttcgttagctaagggcgggcgcttttggtttaaaaattcaccggatggtataattgaggatgtaaggcacacaaatgcacctttttaataaaaaatacattttcctaaagccaagagtaaactgggacgcttcgtggccaaatgtatgagctgatgagtgatgagtgcactggccggccgaattgaaccttttcacaatttaaatttcatcatttaaattttaccatttatttcaccatttattttcatcatttaaaaataaattttttcgtatatttattcaaaatataatatggaaaaaaaaaatttgacaaatatttaatgttccatgtaaaatgtggtgcacactcgacaatagggacatttatcaggactgggtgaaatttttaaatgaagaatcaaacactgacggcatagtccaacgtgcccacaggccccaaagaattgcgccatccctatagtacacaagcacatcccccctatatttgggtacaacaaagtggcggggaactggacaagtgccaatgggtcccccccaacgaaatacggctttcgtttcgctaccagcttgaagtgcggcttccattgggttgcgcgctgccgttgtactgagctgctgttctctggtcagtggcccaaactcgcggctgatgcgaccgtagggttgtcccatgcgcatcctttcacaattccgttccctcagtttttcgcacaccctgcaccgggccgaatggcactcgccgcatccttcaacagaacaatttggttcaaaaatttttttgacaaaactatattacttgctattccaaacagcgatggtgcaattgaagatttgcggcgggacattttatatttttagagggtttgtgtaataagacaatgaatggtccttccactcgctttgtccctatccatgtgcccccccctcccccccccccctcagtgtctgccagattcaaattcggcaagccaattaatcatcaccccagatttcatctgaagcaaacacaaaaaaggaaattgagggactgtctcaaaaaatgtttattgtgcagaattaaatattaattcaaattatggattgcatcatcaaaatccattattgtcttttggtcaaagttcactttttcttcattggcgccaaaaggtcggttgcgcggcagttggcccacacgcattcctcacacatctcaaagccgaaggcaaaacggtccccctccaggcgcttcactttctgctggttgttgtacagacgattccaatcatctcaaaatttatggattcaaattaaaatttgatgaaattgttattaattattaccatggcacaaataggtggtcagcaaaaatttgccttttgccaatttccacaactctcggtcgtccactttgcgtttcttcgttgccaactcatccttcggctcaacatttttggccgtctcttcatgtggcttgggcgactcgggaccaattattttatgttgctcagcaggagcagtagcagtagtaagaggagcaatgcgtcttttcattttgacaaaaattggtaaaatgattctgggtttttggcaggcaaaatgttttggcttttagtgggcgggcatgtctaaaaccgtgactcttttcaaatagtgtaggcgtggccacacttttgcgcaaataaaagtaaaatttttcaacttcatcccactttcattctcctgccatggttcttgtaagcacattttgcgctcagcttctcaactgccctgtcaagtcattgcgcgaccggctcaaccacccagaggatcgggcgcttgtgctgaaacacatcattgggcgcaaagcgcgcacgacctacaacgaccgtaatgggatgaccaaaactttcttcgtcactggaatttcggcacaaggcgccgcatttcttcctgcatatgggcaattgcgcaacccgttcaacatcaatgtggcggcacatttttatgcacggcaccgcataaagcttcacttcccgtatgcaccgtgcataattgaacgcttttcgcggggaggggaggatcggcactacccaatggaacttcttgagctgattgatgacaacatggacatggacatcaacaacaacgagcattggctgggccgtcttttcactgaaattgacgacaaacaatcgtcgtcaaactcatccgacacaacaatgcgcctaatatttgagagagacatggatgaagacagcggacgcaatgaatgctcagtgtgtgtgtctcaccaatgtttgagcatgagtgctcatccacccagtccttcttctgcagataggtgatgagtatgtgctgctcgtccactcgtcgat

SEQ ID NO: 781 - DNA, 6853 bp, Heterodera glycines
  misc_feature (19)..(20): n is a, c, g, or t
ggggggggggttgtttatnnaatagttccaagtatatcggtacgaaggcgtttgaccgatttctgtttagtgtgtttttcttccgacctgctggggtgtttgctggtaggaaatcgtgtggtcccaaccttgattgtagtttatttataccttttttcgctttaccaattgcaccaccttctcttgcatcatttctctttgtgtatcgtttaaagtcgaacccttgacctttttgggcatttatgttgttggctgctttctctagcaaatttttgagccccgtctttccctcactgacaagtgactctttgaggtccctaccctctaatacattggatagaactcgatttccagattcaagtccttggcgcccgatggccgtcccgatttctttcccgattggtattaggtaacgcaatagactcctaaaaacagacccgataccactaccgcgctggtatggaacccctctgaacacattataaccaccgtattggacgactacttctggagaaatttgggttaatgctgaccattcaactttaaaaggatcaaaatcaacgtgcatttttctttcttttttttttgcgttttttaaattgagttttctagttatttatatttgtttaaacacatttttttgcataaatttgttcacaaaaaaatctggtgatatttttgcgcgttttagcagttgcaaaattgcttcaaagtgcatccccatacaccgtccaaatataaagaaaatcacatgctttccgcatgagtgtgagtatggtgcttggagcgaaagttgatgaaactgaatttgagcaaaactctttaaaaatttttggatgaaagggcttagcggtggccaaattcctgtcgaatcgtagtattccacccgattttgctgctcgcaatacacggcaacccaatgtgaacaaggtgaaccgctcggatcaacgttaatcaccattgagtaaggagctggtgtggctgctactgctggaatttgatctgatggaaaacaccctaaaaaggtcgaacgcgtgactgggtttcgagcaagaattttatttatttgaacactgttcatttttaaaagtaggaactttttctaaagtgtaaggttaatgtacatgtaccgtattgaaatggcattaagttaccactggaggttcggatttcgatgaaaatttcacttatttctttgactagtacgcgatggtattggacggagagaaactgctcctctataatttcgtcaggttttccccgaatcgtaacgatacgcaaaactggggcaatcacgtcaccaatcatcattggttcaattagatcaggtgcataaacatgaaaagaagcaactcctccactcatgtctggcataaattttgcaatcgtttctttttcagtgaaatcggttgagttaaaacccaaaatgtaggccaattggtctgaaatttttattttttgcacataacgatcgtccagtttcaacgaaaatctgttcgttgcactgtcaaaatgcagaaaacatgcagagtacgctgattggaaaacttttatccatgctgtcatgcctaattctttggtttgatcgagaatcttcctttcttcgtcattcatcagtgcaatttccgcattcaacttttctgttatcagtccctctaagtgttctaaattacggccacgtagacgcaaaaaatatttatcaagctttttctgatattcctcttcagtgtcatcccaattccgcagggggaccttgcttgttgctgcacgtttttctctctcaagtagaccaccactggttgccccgtaaaggtcaagcaacgtgtcaacccccgctaaaagggcgtttaataattgttcttcgttttcgtcatcatcatcatcatcatcatcattaacatttcttttgtctctttgttgttgttgttgtttattgatgtactcggctctgcccaattgacgtgctgtattggccgcttcagtgaattttttctgtacgccttccactttaactgcgaacggtttgttgccttcttcaagcagtttgtaaagacttttccaaagctcaacggggtttgtcacgttagaggatggaattggtatttgaacattctctccaattttccattcaatttgaacaaattggtcctctgatgtgccgagtgagggccacgaatgggggtatatgatcacgcctaagcccacatcccattccgaattaaattgaagttttcttggtagtcgaactcgaaaagagtttgtgcgatttccttcaacatttgtgttggaaggaacgatcacatagaatgagtttgatgaaggcattctcatttgaaatttaaaaaaaagagcccctttatatatttttccatgtcatcgagcttgcaggaatccagctgttgtgccgttgactgtagcctttccatttcaccaaaacgtattcaacaccttgctttttcctctttcggacgaccttttcaatgtcatatagggtatcatcatcatcatcatcatcatcatttttgcgcactagcacacgacagagatcgttggcatagaaacgacccttaatcagtgaaccatcgtcatcacgtattcggtacgtgacgggaaagcggtcagtgtgcacttcggcaacagtgaacacttcgttggtgaagcgtccggtgtagcccttttggaacacgtgtttgtacttctcaatgcgcacacggtcacccacctggaaacgtggtagtggttgtttccgctttaattccgctgtcccaccaatagcgttctgcttgagttttttcctgagcttttcggcattctcaaaattcacatcaactgggcgcatttttatgcttgagttgtacgagtggtttattccatgcacaatttgctgtatcacatcaacccatttttgggtaccccgttccgtgaaatagcgataaaggcgttctttgatggttcggttggcccgctctgccatccctgcgtgaattcgcggcgaggtgtacataaaaaagtttttcacgttcttatttttgaaatattcctgaacctcttttgccttaaattcgagcccttggtcggtcaacaatgtccatggtatgtatttggagcgtttaaacaagcgttcaaaagcagcaaccatgtcggagctctttttgcttttcaccggctcaacaaagagctgtctgctcagtgtgtcgatgcagacaagaaggtacttgtagccgtgattctctcgcgacaatttgtcaaagacagacaggtctgcttgccattcggtgtgcagtccagaagcgagtgttggtagttgtttgtagcgcctcttcgcttgtctatgaatggtgtatgtgcgttgggtggccaaatagtccactacatcctttctactcatttgattgttcacctttttcgcctcgcgcaaaagcggctcaacgctggtaaagctgaccgatgagttaacatctttgtacagctggtccaacagctgttctttctttcggtctatcaccatagtgtcggtttgaacctgaagacacttttccctcctcccccttcgcacttctttttatgtccttttccatgcctaaagtcagtcaggcctttgccaaattgtagaggctgttccggaaacaaatacttttttagcaacggatcctctcttgccttttcagcaaattccttgtagcccacaggcggccctttgaattcgcttcgtttgtccctgttcaacaaatggctgacaattgcctccacgttgctcgttttaaactcggacccatctgcgcgcaaaacctttccctgatcactgactcccagactgtgccccttttttcgaatgtgtgtgatcagtgcatttttggtcatctggtagttgtgttttggttgaaggcgatcagccgtttctcctcctcctcctcctcctccttttcctgcttccccatctcttgctctgagcactctttttgctgcggcaccacctgttgacgccgtggacgatgatgattgtgcgtcgtcccactgttccccatcatctacatcaccctcttctttttccgtttctccatttccactgctgtttggtgtttctgctgctgctgctgctgcttttctttgttgtttttgggcaggtctgcgatttgataatgcccccgccttttgtgtgtagtggtgtctttgcctcctcaacccaaacgctgatggtacaatgtttttctccaatctttttggcgttgaatgatcgatcgtttgcggcggcggcggcggcggcggcgttgctgcatttttttctctctccttttcgtgctgaagtcgaacattgatcggctgctcctcctgctcgcgcaccagtttgttgagccgtttgaattcctgatggtattgtgcggccttctgctcttcgttcagctccctgctgcgctcaatttgttggatgcgcgagcgcaaaagcccaattggtgtgccgtcggcaccgtctgctgctgctgctgctgctgctgctgcttggggttgaacaaataccgactgaaagacgtcctccgggacgagaaacattcgcattgcgtgacgcattttttttgcgctctcctcaaatatatgagtgttcctgttgtttcgcttttatatatttatttatttatttccccgtcaattagtttttttttggcaaaaatttgtccatcaacactggtaagagaacactggccaacatactggctaccattgggaacccagcaccggtttgttgttgttgttgttgttgttgatgattcagcaatagcaccctgcgagctgttttagcgcaacgcgcgcgtgctaagctcctcaactggtgcttcagttcacccaaccgttgaatttgtcgcttccctaacggaacacgacccttcaacacattaaaacacatttccacaaagcagagcagctgttgatccaaagcgttctcaatcatttggcgctgactgctttttgagcgatatttagagcgaaagtggcgtaagaagtcagcatttttcaacatcagcgggctaacattcatattatgtttaactgtacgtcttcttccttttacatgcttcattttgcaacataaaccaatggggggagcccgccctgctctccatatatattcgtttttaggcgcagcaattccggactctcggggtgcatgtcaatcaataggtagccaaactgcttttcggttgcatctcggtatgcttccgtgaaatagttgtttttcgttggaaatagctgcgaggcgagtgtgcgcacttggagcgcccctgccgggttacgcatcagcaccagatagtgcgagttgttgcgcgcaacccgtagttctttcgcgaacaaatgttgagtgaccaacacaacgctaaccccccaattgtgcgatccccgggtgaacacagtgtcaagaaattgttgccccataccaaccatgagatcatccagcaccatcagcagttttccatcactctcttttgcgcgccggttaacctgctcttcggttgggcttccagcatgtacaacaaccctacagccgccgatgtgtccacttttctgtagctgtattatatttgggttcaactccccataacaatagaaaatctcggagatgggttccgaaactagcgcattcacattcctcagcattcgcagcacccattccgattttccactccccgtgctccccgagattgtcagcgtgaacgggtgtctgaattgcaaatgtttttcatcaaatttttgaaaattgtcagccatttgtttaatttcataaattgtttcaaaatacctacattttctattttatatatacatataataaaaaataagtgtgtgtgtgtttagatcattcttaaattgttcaaacaccaaatggacgcaattcttgcaaccgattggctccacaatgcgttcccagagcgaaagacaacaacaacaacaacaacaacaacaacaatttctagtgtgggagaagaattagacgatgccgtcaaagcagtgagttttacacaaaaataaatttaaaaaaataaaataaaaaaataaatgaataaataaaatcaaggacgagcaaatcagttggcttaaaattatcgaagaggaggaggagcgaggaaatgaattgcaaactggtgaaatggaagtggaacgagcgaaaggtttggttgtttacaagaaaaaaaatgaaaaaaaaatttagagattgagccgccaaagcgacaacacttacagtccaagtgtagctgtaacgaaaagcaaaagagtgtcccgctgattgactttctctgccaacactacaaatgttctgttaaagagcttcacgttctgcttcagacgctgaacaaacgtcgcgaaatttcggaaatgttgcgctctcagcttcagttacgcaccaatcatctgcgtcctgcctggaaaaattttcgcgtccattgcaacgaactgacaattcatcctgctcaaactgcatatgccatgcgcggttatcttggcattacggttttttaatttaaatttatcagctcctcaattgtatagatgatatacattgtttttaggtccgtatttactactatgtgaagcatggcgtaaagctcgtttatcctcagcttccctgtgttcatcaatttggcggtggtgaccattgttctctgtttccgcttgagtgtctgagcgtcataaaagatgcttgattaatacgcatcgggtgttttatatgtgattaagtttgctgtgttattgttgttgttgttgttgttgttgttttttttttaatttctcctagataaaaaatgttaattattcaaaatagtgaccgcggtgtttaaattacagctgttccttcacaaaa

SEQ ID NO: 782 - DNA, 2786 bp, Heterodera glycines
aaaaaccaaaataacgagttcgaacaaaatgtcgaaaagtcgaacattgttcgaactcaacaaaaatgatcaggaagacatttccagacaggggttacaccaaggggggtcaaaatgttgttatttttgcaccaaaacgacgtttagacccacttttagcagttcgaacaaatttcattaaccatttccggtcacagaacatttctaagacctcaaaagagactttaaatgtttgtacagtgactgggagccctgggtaattgaaaataacgagttcgaacaaaaggtcgaaaagtcgaacattgttcgaactcttcaaaaatgatcaggattaggtctaaaatctgaattaaataaaaatgaatataaagtagcgtaataaagtgatttaatacatttaacttaaagtaattttaaaatgcattttttcatttgaaaatattctttttcatattagaaaattaatatataaaaacgaatataattaaggaattaatatttattataaaatgagaaggatgtttgttgctgatgaaaatttaacaaaattgaaaaaatgagaaaaagagaaaaaggcaatgttaaggagcttaaatatccttaatcaacggtaaagggctgcgcatataatcaattaattgaaaaatcgaaacagaggcgtccaccatcactctctcaccgccacacgcccgcctccgcagcgcttgtggtgaagcaaaggggaaaatttttcaccatttagtcaacaattatccagttcctttcaactcaccctgtggccaagtggttaagctcctcgcttccactctcaacggttcgagtccactaccatgtttttgatttttcacgatttttcggaattttcatcataaagtcaacaattatcccatacctttcaactgcccctgtggccaagtggttaagctcctcgcttccactctcaacggttcgagtccactaccatgtttttgatttttcacaatttttcggaaatagtcgcgcagctctcgctcatttaaattattaattaaaatttaaattaattaaattctcgcgcacaagtccatccaataggtttgggttgaagggatcaaagatcatccaataggtatgggggggggggggggtcaatgtactctctctctctctctctcgaggagaccatccaataggtttgggtttgtggaaggggatgtcagagaaaaaaagtagacacactcaaattatcgatcgaaaatcaatcgataatttgattgggaatattatctactcccattttgatgttctttggtcgtcctttggtatggttcaatcttttgtaactcattagctgcagcaaaaggcggaaattcctcaacatttccggccgactttcgcattgtggcaaatcccatcgaaattcaattgaatttggcgtacccaaaaaggccattcccaactctcaacgcattggaattggttgaggcggacggacgggcaatgtaaatttgttcgtcttcaccccggggggaggggggaggcttttccttcttagcccctgactgtttgttgcccattcattcttcccacacatccaaattggtctaaaaatgtaaaaatttcacatttttcattgaattgactctcgagggaacatcttttagtgcgatgatccaattaaatttaaatcattcaatcatttgttgtgcttacaattgtttcctaatgctaaaatgacacctgtcctatccctttattaaaccttttaaggctcattaaccaccacaaatcgtcccttcctcctctcttatgcgtgccatttcccatagtgatgctgcgatgtttgtcagtttgtttttttcgcctttttctcatccgttggatcaccaaatggcattttcccccgtacatcagctgcaacggcacgtccgtcgcattgattcctcacagttcgctgacattgacgccgaactgaagccgcaatggtcgattaatgtcccacggctttgccgaaaaccatgtccatttctcgcctcagggtctggctgctgcttgtcacaatgccaatttcgtgcattattggcaacactttggtggtggcggctgtcctctccaacaaaagtctgcagacaccgaccaattatttgttgctcagtttggcatgtgccgatttgatggttggcactttggtcacccctttccatatttacatgacggtgagcaatttaggcacaaactcatccccccccccccccccctctttgggcttcagataaattcgctgcattggcatttgcccgtttttacttgctacatttactgcgtgttggacgttctcgcctccacgtcctctattgtgcatttgctgctgatcagcatggataggttcggcgattgatcgctctgttcgatttggtcagagtgcacttccccccataactcacagattggtggcggccacaaagccagcggattacaaaacgcacaaacacaggcggaggtatgtcctcccttctcctgctgctaattgatgatcttcgcaccttcgaagagtgtacctggcgatcgccttctgctggctgttcagcttgtgtctgtctcttccgcttgtgtttggcttcaacgcggacactgaacgctatctgttggaggagcaccactgcggcatttacagccccacttacatgttcggctcctccattttcgccttctttttgccccttttgttcatgtctttgatttacgggtgccattattccaactcaataatccttctgatcagctcacttttagttacatttttttca

SEQ ID NO: 783 - DNA, 3526 bp, Heterodera glycines
ccggagggcaatttctcgggtttggggccgatttgggtaacatcgccacctcagcgatggagacagtgatcggcaagtggcggtcgctggtcaagcaaaccaatcgaagattgttttagggatcgatcagaaaaaccgtaatatgatcacatgggagaaaccgctgttgaagaaaatcgaggagacggctgccgaacacgcgagttcgcttaacgaaagcgagcgggagcaagtccgttccaacgcaatttatgggacagggggggggggatccaatcacttcaccgaatcatttgatcaattcgattaccactttctgatcacatatcatttttcattccgttttggttttttcatctgatcatccgataattcttcgcttttttgcttggtcatctcactgcccccgccccatccgttcagcttcaaaacattctccaagtcacgagttcgtccgcagcttctcagacaagcgtttacgaatgcttcgatgacaaattaaagcggcgattgtgtgtttcgaattgggcagaaaaagcatatgtcagcagcgacattctgttagaggagagggaggagatcagtcaggccccgccctcctcggtgattttggacgccgtcacgactttggacccaagtttcggcaaggactcggccataagtggtaaggccggaaaaaagctcccgtaagcctcttagcatttagtgcttttctcataaatgggcatttaattccgcggcattttcctttttaattgactattttgataacgaacagcaaatgttgccaatcaaaagcccaatcagcaacaaaagatgatgggcatgaacatgttggaagtgcccaaaatgaacgcagcggcgagacgaaggcattccgaaaacggacaaagacgggtctcagtgatcagtggcagtgccaatttggtggtggacgcgcgggaaagggagaagcaacaccgacgcttttcactacaaccgcccagggacaacgaaaacgaagagaatttgttgaaagtgccgaacagaattgtaagggaaagggagagaaaaaaatagggagggggtagggagagagagacaaggggagagagacagagagggggaaaagagagaccggggagagagagagagagagaaaggagagatgccacagagggaggaagaaaaagggatagagataatccggcgatttggaatcccttctcttcaaaaatgcagttaaaaatattaagcaaaaaggtattttcaacaattagcttccctcccgccattccttaccaaaagcgatcagattccatttttaattccttcgcggggagcgcaacaaaactttggagtgaattgacaaatgaatattcataaaatcattttaaacaaaacaaaactttaaaataatgaatggattaagcagtgattcctcccttttgtggactttttctttaacaataataaatgatcaaataataatgctttttggcaggggagtaaaaagtccatgcggagactgtccgagctgatctccggctgggaacggccctcgcgctcttcccttggccaactgctcacttttgctcgcagagactccgtttatatagcgcggaaaaagttggcagggctcaaagattgggcattgggtgagttcggtttggtcggaagcgatcgatcggaagggaatttggacagaatttccactgataaaactttgtttcttaagacctgattgccaagctaaagtctaaacaggtaggcaatgagcccaaattctttcgatcgctctccttccctttttagggattggccattcgaagagaggcgagggctaccaaattggtcgctaccgtaatgggtagacactgtgcattttgtcgtgctctaacattccgttaagccgtttttcttatctgctgggccccctatttttcgatgaacttgtacaaaatttacaaattgtacaacgaccaatggtcgcatcagtccgaattcactttccattggctcagtgcgttgggttacctcaattcgtccctcaatttcttcatttattccgcaattaacaaggtgatggatgggtgggtgcctcggcgactctttcggcaatttttcgactttaagaaatttcgtatcactttttggcgattgctcggcctcaggcgaagccaacgcaagaaaaaggcatggcttcttccgccagcacagcacaaaaagaaacgaccaaagaagacggacagagacaaagagcaacaacagaaccaaacggagcagaaccaaaaaatgcagcaaaacaacggaaaaagtggcgaagagagcgacggaaaggaaaacggacgaaagtcagggaatggaaggaagaatgaaacggaggaggagaaggaggggaagggaacggcacagaaagagcagcgaaagtgccatcagaagaagcagacgaagggttcagaggagaaaagggcaaacagcgggggaaggacggacggagagagcgggagggggaggagggcaaagcgcaaaaacaatgccggggccgaagagcgacagcaaaatcggaagaaacgattcgtgtcactaatgtgagtcattagatacttaatgggctaattgtaggaaatggatgcgtattaagtccactgagccgacatttgtccattcggaagccccaaattgtggtcgaagatttggcaaacccaatccaaacttcgatgaccatttccgctggaggggagacaacgtacaggtggtgggcatgggattggcacttaatggccgaatggccaaaatttggaaagcaattccagacgatcgtcggacgattgcatccaacgctcatgctcagaagtgtttggcggtggcattgtctttccgagcggagcccatcacaacagccgcagggggtcggacatgagcaattcgtcggcatcacttcagctgcacgacatccaccaaattgaagcacagagtgccgaagaaatggcccaagcggaggtgaagccggaagtgttcatctgatggacatactcgcggttaattaaatgccaaatattgcttcatattttttttatcatttatgccattgttatgagagagtttgccatttccgtcctttctgatcggtcccttcgcaaatccctcgcaattcttctgcttatctccacggcgatgcttaatttcgctgatcagtcccgcgtttgcctttgtccatcccattatttgtgctcagtttcttcctttcccaacttatttcttacaattagctgctgcaccagtgggggttgtgcttttaattcaccaaaattggcattgtcttactgtatccgttctgagcaccgtacccagccgtatagggccaaccgccgtagtaggacgcagtcgaatagccaccgtagcccgggtacattccaccataccctaggccaccattcctcccataatagccacctaaactccgtgttgttaatttcgtcacaaaaagttagtaccataatatgagggcgaatatccgctaccgtaagaaggactgtcgtacata

SEQ ID NO: 784 - DNA, 1797 bp, Heterodera glycines
  misc_feature (22)..(22): n is a, c, g, or t
gttggaaatgtttattgatttngatcagatgggggggggaacagaagcaggcgatgatgcgtcagtcggtgaacggtgcaattgacccactcactcactcactcaatcatccggatgatgacgagtcgcgaagattatgatgaaggggaggaggaggaggatgagttcctccgtccccaacctcagccaccaccactcaactcactaatcggatgaaatcgaacgaaggcaaacaaaacgaagaaaggaaaaaggaagaaaaaaaacatcggacaaattaatgggaaagtaacggaaaaggcggaaatgaaaatgaattgggatgccaatgccaacaatttgcatgggttgtatataattcttccccatttgctgcttcttttcatatgatgggcttcacacgtttcatgctaacattcgcctaatatttctttttccgagtcgttgaatttataaaattgtcaaaattaaattaattttttctagtaaatgtataaaaaaagataagcataaggatgattgatcattgtcagttcattccgttccttatccggatgaagaaaatgttgaaatggttgaagtcgatgcccacttttgcatcttcgcgtgtgatctcacttccgtttctgcaccttccgcttcttcttcctcctcttaattttcatttttgacaattaaaattgtggctaattaccctgtgccgatttgcgatggaaagggtccctcgccggaatgtttggcacgtccacacttggcagcattgtcacccctcgggccttcgctcccttctaaagcgaactttcagcaattagtcgtaatggaataaatgtgtggaatgagtggcctgagcgaataaatggcgttttgttagctgaacaaattgactatcagaagaagggacccgaatgcgaatttcgctggtggaaagtctctcggggagtcctaaaaagggacgggcgggggaggaaagtgccgatcagtgctgatcagcttcaaaccattggcgagcagctgatcgaccgcaaaagtcagctgggaagggatcattcattcactcttcaaatccccccccccctttcattatcccatcattcacttctcttttcgtctctgtaaatttcactcttccgaaagtgcgctccatttgactgtaactgaagttcatttgcatttggtcacttctgccgttgtcttcttcttctgctgctgctgttgctgtgtccccatgctttttcaaattttacaataattaattaaattaattatttaaatgatggcattttgcttcgatttggagtatttccatgttgtccgtgcccagctgcttgtgccgtgtcatctccacccttttgccgtgtccctccgctgctgcgcttgtccgtccgctcgactgtcccctcgtcatcggtctccacgtttcgtttgtgcggcccgagccgagggcgaatgtttcttctttgaccaattggtcgaaactgtgaaggaagtagcgagacgcttctgtgcccaactctctggccattgagatcactttgcgtgccatcatctgaaggggaggaaaagggcaccgtcgcaaaaagcggacgaatgacctgccaatttttaatggcatgtttgcgttggaatgcgcgtgttttggtggtctgtttgatcaccatcagtccccgactttcccgtccgagtccgcccattcggatggaatattccattaaattggccaccaatttccgcgactccaacgaccgttcgaataccattatcaatttcgcgtacttaaccaatttcaaatggatttaa

SEQ ID NO: 785 - DNA, 9817 bp, Heterodera glycines
ctgagagattaagcacaacaattgagatcgatcatttctcaaatacaattaattattcattttcgtacacttaatcagacgacatttttgttgctttgatccgcttcttcttctccttctttttcttccgctggtggcgacaatggcctaaaattaattaaatattttatttttcgataaaattcaaatgctattgctgctgctcacccaatggatttatcgaaactccacagatcaaatctgacattgttcaaattggcactcggattttcgcggttttcccacttaactggcgccgtcgccgtctccccaattgggcaccgttgcaacagccaattatacacatttaagtcgaattcgtcgatctcctgtttcagtgtcagcttttctttcgtcacttcgttcatcaattcaaatggcgcaattggcattgtttccacacgaaaataaagttgaatttggtaactgacagaagtggtggcacggcgaaatgtctaaacaaaattggtaaaataaaaacaatttgacgaaaattctggcgagacgacctctttgaagttgttgacccattcgaaatttggtggactcacataagcacggaaacgtaattgctttggttgtccattttttgtcggagtgtgaagccatttggtcaacgcttgaccagcatttccatttggcccatcgtcagcaattccatcggggcacagataaccggaatcgattgaaatcaattgatcaagatcagtgagaagtgtcggtgaaatgcgactgcgcaaattgtccaaatcatcgccatcgtgaaagccaaaatgacgaatgcttttcgcaaaaataggccaaatttcgcgggtaaaaacatcccaaatcggttggacatccgtatcaattgaatgcacaaacacttccaatttggtgccacttttgtcaaagaatcgcttcttggagcggaaaaatttgatcacggaatggtcaatgtagctaaagcaagagaacaatgctttagcgtacacaaaagttaagactgactgaatatgaaggttcttaaagcaaattttgttgggcagttgacgatccgacaacggaaaatccacaaaactgccatcgatccgtacagacactttcggttttggtccattatcgtttgcatttggtccttcgtcctttacaattctgattgttctccaaattgtcaattcgctttttccatcaaaatgcgtgtccaccaaaacatcaaaacgataggaaagcaatgccattttgagtccgagttgggcatggtcaaaagatggcagaatgtccatccaaacatccgcacaaatccaactgaaacatgggaaaaattgcatggaaaatgaaaatttaatttttcaaaagaattcattaccgtctgttcatttttgcgatatgtattatgaatgaaaaagtctttttgacctcattatatacccaaatcgccgccagatttttcgttaaaaaaatgcattaaaagcaaaaattctttaacagttaattgtattcaatgtgttatatttcagcaaagttttaaagagcaatcatgtcggtcattggtcccgaattttttttttctgggaattctttaacaagtttctttgggtattttgaggcgctgagcactagagaccggcgcgggacgggatcccgcgcgggatttttcgggatcccagtccgcaatcccacattttttttaaatgcgggattaatcccgcgggatcccgtcccgcaaagaattttgagttccaatcccgcagcgggatccgcaaatttgaaatttccggtctctactgagcactccatttcaacctatttataacaccagcctgaattcgaataaagtcgaaaagaatcaaattgtgttatggaccagtgtttgttattttaatgattcttatgaaataaattaatgcattttttaattttatatcaaaataatgaggtaacctttcaatgaaaaaaatctggcggcgagatagccaaaaaacaaggcgcggcgagttggccgcggcgagttgggcggcggcgagatagcgccgcggcgagttggccacgcggcgagtttctcgcggcgagatggccgcggcgagttggccgcggcgaagtgaccccgacccactagggctgccaaaaatatggatataaaatcgcgaaatatggccataaaatatggaccaaaaatcgcaaaatatggacataaataactttcggcattttttggaaaaacaaataagtggatcagcggaatgaatgatttatttgtgaaaatgtcgtctaattgcgtggaaatgaattaattatttttgagaaatgatcgatctcgccaataggaaacggattttatgccatcattttctctttgaaatgcttttgttgattctttcgttcgaataaaacgtatgtatgtacactaataccttattgaaaaccttcagagtttccgaaatgaaccgtaacagaacggacaaaactaaggactgaagttctgtcttaacaggactcctgctgaccctgccaaacttctgggaaagtactgtacttggtcattggtccgtcacgtttgggccccatgactttttttgactataattttttccttggtcaaccaaatccaagaatcttggtagcattcgaaagcataaagttagaagctttttttttgagctattgcttcgtcgattagacaattccagaaaagaaatatatgaaaaatggaaaaaaaccgaaattttggagttttttttcctaatttttttttcaacaataaaagcgcacaaagtcacacaaccgaggcacactattatttaaggggatcaactggaccaataagctttcggcattttttggaaaaacaaataaaattgacaaatttgaaacgaatggagggagatttactgtatttccaaattctctagataatcattgattattaatagggtttgtaattatatggactaaaaaacgcgaaatatggacattaaatatggactaaaaaagcccgaaatatggactaaaaaggccaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttagtggtgtatttttcgttttttttatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccctagttatatgtagggcgaggattcttagtttttaaactattttttctgcggcttagttacgacgagaaatgcacgaaaaacacatttttagctcggaaattctttgttttaacgccactattcatcactaggaatcattattttggagcttcgccactaaaaaaaattattttgaagttggccactaaaatacttttttgccactattttggcgtttcgtcattatttttgccactattttggcattttttgtagctgaaaaggggaattgcttttattatctaataagaatgtttctcaatttgaattacaaaattcgtagtatcttaaatcaaacgtcgccacaaatcaaactgaaatgcatgcgaaaagataaataggcaaatgaaaaatttgtaatttttaaaattcctcgccctctgttcatttttgctgcaactttgccgttttccaattgattgatgtcacaaatgaattaataattgccctgcaaaatccttttctaaacaataatacaaaagtttgatatgtccaactgctttaaatgggaagacagcgaaaattggggtgccaatgccaatttgaaccatatccgatttgatctgtggagtttcagtgaatccattgggtgagcagtaatattatagttaaggtggttccctcctcctctaaaaaattcttaatttcaaaaaagtcgccgggacatttggagactgcggtattaatagagactgggctataattagagcatatacggtacataattggacgcataaaaatgattgagcggataaattgaaaaaaataatatttttttacaaatactccgtctgttttttgccaaaaaatgtgatgaatttatttctgtttcaaaattgtttttgcgttctttttgctctctcatttttcccaactctctctttttaagttacataacaacagagttttgccttgccttttgtgacacaattgaaaaatcgtttttccacgatagcttttttctttggcatccaaatccaacaatcttggtatcattcgaaagctcttaacatgctttattagccttatcaaaaacgaaaagtttttcaagcctggaaaaaattttattaagaaaaaacttcaaaaattttgacttttcgcaattttcatgcataacttttttgataattgtctaatcgcaaagcaatagcttagaaaaagcttctaaattgattagctttcgaacgacaccaacaatgttggatttggtttacaaagaaaaaagttatagccaaaaacatgctggcgccgaaacgggagcgccgaaacgcagtggacccgatggcaaaagaccaacaattggtttttacaatggcacttttttcgagtgagcgcatttgtcactcaaaacaagtttttttcgaatgtgaaaaattttaaaattgtttaatgtattcgcgttttcgtattactgggcatgaaatcatttttcaaatgaacttagacgacaaaacactaactgacaggaaaaacttcatgcgcgacgttacatcagaaattttcagcaaaaatccaaacaaaattggtcttcaatgccattttgaggcaaaagtatgttttatataattggaacgaacgaatcaacaaaagcatttgtgacagggaaaaagcatcaaattgagatctgtcgtttctcatcatttcttaaaagcaattaatctccgttgctttgatccgcttcttcttcttcctcttccgctggtggtgacaatggcctaaaattaattaagtttttttatttttagacaaatcaaaaattgctgtttttgctgctcacccaatggattgactgaaactccacagatcaaatcggatatggttcaaattggcattggcaccccaattaccgtccactatccgtgttttatacaaaaaaggcctcctttctgctcacccaatgtcatcgtaaaggcggaagaagactttgttcaaattggcatccgaattttcgtccttcttctgctgttgtttctgaaccgccgccgtctccccaataattgggcatctctccaacagccaattgaattcaccagtgccattttcatccttcgtcagtgtcagcttctcattggtccgttcgttcaccaattcaaatggttcaattggcgttgtttccacatgaataaaaagttgaatatggtaactgacagagcgaatgacaatacgaattttgtagccgaccgaagcagtggcacggagaaatgtctaaacaaaattagtaaataaaaataataataataaaagaaaatatgacagatcacctctctgaaattgttgatcgatcggatgacacattcggaatttgaaaaaacattgcaacgcaatcgcttcgcttttccatttttgctcggcgtgtgcaaccatttggacaacgcttggccagcagttgcatttggcccatcgtcagaaattccatcggggcacagtccataggaagtgattgaatacaattgatcaagatcagtgagaagtgtcggtgaaatgcggcgacgcaaattgtccaaagcatcggcaccgtgaaaggccaaatgccgaatgtttgtcgcaaaaatgggccaaatttcacggacaaaaacatcccaaatttgatccgtttcgtatgaatacacttccaactccaaattggtgcccattctgtcccaaatttgtttgttgacacggataaatgcaagcacagaatggtcaatgtacctgaaaagggggaaatgatacaataacacaaatgattgcaaattggtcgcttctgtacagaaatttttgaattacataatcataaggtccataaatcggattttgtttggcaacggatggtcctgcatcggaaattccacaaatttgtccttgttgtccttgatttgcataaatagtttcgcttttgctccaattttttcctcgtcctccatgccctttcgaattgtaatgtcattccaaattgtcaattcgccttttccatcaaaatgtttgtccactaaaatgtcgaaacggtcggaaatcagtgccattttgagtccgagttggggacggtcaaaagatggcagaatgtccatccaaacatccgcacaaatccaactgaaaaattggaaacgaaaattttaatttttcaaaaatttccttaccgtcggttcattttggaggctcaattagcacacttttccctttaaaatctgttgttatgtaacttaaaaagagacagttaaaatgagaaagcaaagtacaaatcaatcaatgatgcataaggctgggaatttaaggcactaaaaatcgccaaaaagtcacgaaaaaaagtcctgaaaaattaggtgaattaatttatagaataacactttgatcatatttaaaatatcttaattttaggccattgtcgccaccagcgaaagaaaaagaagaagcgggcaaaagcaacgaaaatgtcgtctaattattagggaatagaattacatggaaatccatatttttttcctggactgtgggaggcctgaaacgcacgaaaaacatgtttttagcttggtttgaagcttctaggaaggatttctatatccatattttccatatttttccatatttcgcgatttatgtccatatttccatatttttccatattttggcattttggtccatattttatgtccatattttggcatttttcaaaaaaacctctattagaacggcccccagcagctaaatttagcttttttgagcccaaacccgaaaaaattttcaaaaaatcattttttcgccaaaatttctcgagaatattgaataaatttaaattttcttaaaattaataaattatgtcaaaaataagcaaaaaagcgaaaatttcgcttttgttgttgattttgcgctaaaaaaattaataaattttagcttttatgttttttttcttttaaaatgattgcacgtaattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaataaatttgaagaaattttgcactcaattttgaaaaatttatgtccatattttgcgatttttggtccatattttatggccatatttcgcgattttagatccatatttttggactccctagtaatttcaattacatatttatttgtttatattaaagcatttttatttattttttcagctacattgaccattccgtcattaaatttctccgtgccaacaagcaaatttgggacagcaaaggcaccaaattggaacttgttgtgtacgtagacgaatttgaaaatgatgaacagccagtttggcattgtttttcctatgaaatttggcccatttttgcgacaaacattcgccatttgagcatttataatgccgatgctttggacaatttgcgtcgtcgtatttcactgacaattctcactgatcttgatcaattggattcaatcaattctggtgatctgttccccgatgcaattgctgacgatgggccgaatgcaaattcttctggccaagcattgcacaaatggttgcacacgccgagaaaagatggacagccaaagcgattgagttcctggagttgctcgtgttttagtctcacaagaataaacacatggttctacaatcataaacaggtcgatgattgatcatggaattttttctttcaatttctttttttactgtgctaaaaatgactaaaccctcaagaaactgcgcggctaagcatttaaaccgctttttgggaaggtttaaaactcgaaaaatggacaaaacaccaaaattaattggaaatcctaaaaaaaaaaaaaataaattttctggcggcaaaaaaacattttattgttttctttcacttgaaataaatttttcaaaaatgctgattttttgtcggccaaatgttgattttgacaattttcagttgggcgtcctgcattttatccttttttttttttgtttgaaaatggtcgtcaatatgttattgttttggtactttttgttaaggcatttctctgtgccaccacttcagtcagttacaaaattcaaatgttaacaacgcaagttgagccatttgaattggtgaatgaatggaccaacgagaagctgacactgatgaagaaaggaccatatcattcgctgttgaagcgatgcccaattattggggagacggcggcggttaaatgggaagacgacgaaaattcggaccatttgaatgcatttttcatccgtcttggtgaaaattgcattgggtgagcagaaaggaggccttacttttgtatagagcacagacaggatttgagacagtattctctgtacagtactttctccaaatcttggcagggccataggagtccctgttaaaacgggtgcccccaaaatcacgccgccgaaatgacgccgctagaaaattaaaaaaatatttttaaatttagaaaaaatttttataagaaaatttcaagaaaaattaaattttttggaaaatttttcgaaaactgtaatttatataaaattttaaaaaaaacactgaaaatttttcaaatttttttttctttaaatttttcttattcgcttcgctctttggtttgtctgtcctattataatggtccatcttgggaaaactctggtcctaaaccagggcttcgatatctgaggatttttcctcattttgtggtcttttagagggtcaaagaggattttttttgaaactgacgatttgcggatttttgtggtattttgagaaatttgaggatttttgtggtcttatgattttttgaaaaattaggtatatttggcaaaatgttcgaattttttcgtcaaatcttatttctttacgaaaaatcttcattttgcaataaattttaattaatttcctttagatgattttacaaaaaaaaataaacaggcattcgatagagggggtcaaaatcattttttttgaaaaaatctgttaacaaatcgcactcaaaatcccaaattttttccggcagcgcctatcggcactgccggaccggactcactccccccgatattcccaaaaagttttttggaaaaaccgcgccacgaataaagcaatttaaaggcaaaaaaattaacagattgtcaatttatttaa

SEQ ID NO: 786 - DNA, 2678 bp, Heterodera glycines
acgcttggccggcagttgcatttggcccatcgtcagaaattccatcggggcacagtccaataacggcacaaacacttccaatttggtgccacttctgtcccaaatttgcttgttggaacggagaaatgcgagcacagaatggtcaatgtagctgataaagtgaaaaaatgaagattggttttctgtatattttttgatttactaaatctgaaggtccttaaaacggattttgttgggcaacggatggtccggcaatggaaatgccacgcatttgtcatcgatcagaacagacagtttcgcttttgggccttcgcccttttcaattctgattgttctccaaattgtgaattcgcttttgccatcgaaatgtttgtccaccaaaacatcgaaacggtcggaaagcaatgccattttgaggccaagttgagcatggtcaaaagatggcagaatgtccatccaaacatccgcacaaatccaactgagattcgtaaaaaaatgtatgggtaaatgaaaattttgtaatttaaaaaaaattccttaccgtcgattcatttttgtggctcaatttgccgtttttccaattgattggtgtgtcaaaaaaggcaaggcaaaactctgttgttatgtaacttaaaaagagagagttgggaaaaatgagagagcaaaaagaacacaaaaacaattttgaaacagacataaattcatcacatttttttacgtgcttattaaaaaaaaattttgaaaaaatttgaccaaaaatgttattcatcattatgtgtcaaaaaaacaaaaaaaaatttttccaaaaaaaagtgaaaaaattttcaaaatagtgctctttgcaagtagcgcccaaattttctaatttagcatttttggttcaaaaacagcataaatgatctcttatgcagtattgatggcttatagtttgtttccgtgtattaaaccgatttttaagaaaaaatctaatttcgaaattttgacttttcgattttttgttcgagttcgggtccggggttggaaattgagaacgattttcttatagaagtttagtcctatattacaatactaatgccatagaaatttattttaaaatatttgtatcactgacgcattttccactgaccgattttccggtcacgaatcaaatgcaatcaatcaataattagtcaatcgtttaatgaacaattaagtagctcgatcacctccttgaaagtgttgatccatgttatttcacaaaaataagcacagcaatacaattcattcgcttttccatttttgctcggcgtgtgcaaccatttggacaacgcttggccggcagttgcttttggcccatcgtcagaaattccatcgggtaaaagaccaccagaattaatgaaattcaattgatcaagatcagtgagaagtgtcggtgaagtgtgacgacgcaaattgtaaaaatgattggcattaggaaagcacaaatggcgaacgtttgtcgcaaaaataggcaaaatttcgcgggtaaaaacatcccaaattggttggacatccgtatcaaatgcatacacattcaaatccaaaatagtgccacttctgtcccaaatttgcttgttggaacgaagaaatgcgagcacagaatggtcaacgtaactgaaaaggggaaaaatgaagattggttttctgtatattttttgatttactaaatctgaaggtccttaaaacggattttgttgggcaacggatggtccggcaatggaaatgccacgcatttgtcatcgatcagaacagacagtttcgcttttgggcctttgtccttgcgaattgcgattcttctccaaattgtcaattcgctttttgcatcgaaatgtttgtccaccaaaacatcgaaacggtcggaaagcaatgccattttgagtccaagttgagcatggtcaaaagatggcagaatgtccatccaaacgtcaccacaaatccaactgaaacataagaaaattgggtaaatgaaaatttgcaattttttaaaagaaattgcttaccgtctgttcattttttctctattatgcatcaaaaatgtcttttcggcctctttatatatctaccaaaataaaagtgagagatttgaaaacggatgaacggatggggggagattaaaatgatttgttggccaaaaataatggccataacgcattaatttatgcgtatataaagagagagtaatggggaagggtgttttgctgattttgttcaatacatacataatttacacggcttccttatttttgtaaatgcatatattttttcctggattctccgtatcctaattcaaaattgattgagctgataccgtccgtatatctctaattatccccccggatgattattgttcaacctccttagataggggaggggggctaattagagataataggtaaagtgaattagagtgaaaaaacaatatttcagtgtgaatgggtaaggccaaggcaaccgatgcagaaattaggtttcctaaatttttttgtatatattttttgaattttggtcaaaattttaacatttttgatcgcaaaacgacggaattgttcaaattttatttattgttaatccaactcaaattcctatttttacaaatttaaaaaaatttagataagtttcaaaaaagttatggccaaaaatgtgtaaaaactggttgtttg

SEQ ID NO: 787 - DNA, 2021 bp, Heterodera glycines
aaacactattttggagctttgccactaaaaaaaattattttgaaagttggccactaaaataatttttcgccactattttggcgtttcgtcattatttttgccactattttggcattttttggaaaatttcccaaaaaatgcaataaaaacgaaaaatacacccctaagaatctacctaaaaattttcaaaaaatacacccctaagaatctacctaaaaattttcaaaaatacacccctaagaattggaaaattttcacaaaaattcttcccccaaattttttttttcttgttcaatatttgctaagaaaatattttgtaactgcaatcagtgaaaaagttgtttgccttattttaaattattttcaaattaaaaaacagctatttaaaaaattacacccctaaatttggaacttgttcgccactattttgccatttttttgtcagtatttagttaattattttgggattttttgccactaaaaatcctcgccctagtcataacactaacaaatttttttcattgagtgtgggacttttcaggccaatatgccgcgataatcaccagaggctgcacaaaatacttttaaaaatataatgaattttaatttgttaaaatatccattaaaatttttatacacaaaaaaataaaatattacaattttttatagtgaaaatgattgtaataaataagattctttcacatttttacatcggctttttcttattcattgggctctctaaaatttttgcattaaaaattcgcaaaaaaaaaaggttttatgtaaattaattttacatcgcttcaaacattttccatttgttgaccagaatggatttgaatgccaatttgaattcgtcaaatttagcgcttatttcttccatttttggcattttgaattttttgttacttttatttttgcctccattctcctcggcattttccaatggattgaatttcaaaaaatcttttctgattgtggcgtcaaattgtgccaacaatgggttcatttgtgcactgtttacgttcgaacttatgccaataagccaaactttgcaaaaattgggccttaaatttattaaataatttaaaaattaataaataaatttaattaataatttattattatccaatttataaaattgtttacttaaatgccaatgccaaaaattcatttgccatttcgcagttgtgctggtaaatgtcggggtacaaatgtgtgccaatgtttggcccattttttgggtccaaatcgtataaaatttgccgacggattcgcccgtcaacgaactgacaaaatttgtcaaaaatttgcgtttgttgctcagccacacaattgatcagcacaaaatatgtatactaaattaattattaaaaatattaattattttttttaattttgaacatttttttatcaagtaattattaaataataaatatttgtgttttcttcgtgccttttctataaacccattattttgttcatgtagcaattttttccattcaaaattatgtgtcatttcaattaaatttgtcattttcaatgctaaaataaattttttttttttttaatttaaaaaattttgtaaaaattttttttgcctttgatcatttcattttgtatcactttggcactgcagtttgtgaccaaacttgccacatttaattcaggaaaaattggcgtatacacaggcatttcctgttcctctggattttgtacaaaaaatgggttgacaatgttggatttgtccaattcactgagttgaactggcataaaatttggtctaaaaatttaaaattgaaaaataaattctcgactccacactcccgaaaatttatggaatttttttggcccattaaatgacaaaaatttatacatttttaccttgtcgaataaaaaaggaagaatttttggattaaaaatggaagtgaagcatttggatagagaagcacaattttgctgaccattattgtcaaaattgcaccgttcaaataaccatatttgttggaataaatataatt

SEQ ID NO: 788 - DNA, 6786 bp, Heterodera glycines
aaaaaaatttgttaggtttatggcttagggcgaggatttttagggggcaaaaaatcccaaaattatttaactaaatcctgacaaaaaaatggcaaaatagtggcgaaccagttccaaattaggggtgtatttttttaaatagctgtttttttaattgaaaattaattaaaataaggcaaacaactttttttcactgattgcagttacaaaatattttcttagcaaatatgaacaaagaaaaaaaaaatttgggggaagaatttttgtgaaaattttccaattcttaggggtgtatttttgaaaatttttaggtagattcttaggggtgtattttttgaaaatttttaggtagattcttaggggtgtatttttcgtttttattgcattttttgggaaattttccaaaaaaatgccaaaatagtggcaaaaataataaacgccaaaatagtggcgaaaaattattttagtggccaactttcaaaataattttttttagtggcaaagctccaaaatagtgtttcctagtgatgaatagtggcgttaaaacgaagaatttccgaactaaaaatgtgtttttcgtgcatttctcgttgaaataaagccgcagaaaaaatagttaaaaaactaaaaatcctcgccctagttatgacgttactcaaaacaacctaccttaataaaaaaaataatcaaaatttgctataactttgcttaaaagcatcaactttttaattcttgaaatatttcgatagcctttaattttctcgttaatctgcaatttttcaaaataatttatttgattttaaaaaattatgaccaattaatgtctagataacctagtttgttgagttaaagtgatgaataattttttttccaaaatttctaatttaatgttttaatgtaatgaatcagcaccattttttctgtattttccagttttttgtttgttttgtttttcaaatttaactgtttaattaataatatcagtaaacattaaaaattattttataaatactagcttaataaaagaaaaatgaaataattatttataaaaaattaatcacaaacaaaacttaaaaaacaccacaaaacaataaacaaaatttttgcgaataattggaaaacttttttcagaatttaaccacataaaaattgaaaatcaagcaacttccatttgttcacgagaatagacttgagttgcaatttaaaattctcaaatttgccaacaatttcaaatgtttctggcattttttcactctgagtttgcttatttccattaatcgagttgaaattcaaaaaatctttgctgattgcggcatcaaattgtgccaacaatgggttcatttgtgcactatttacgttcgaacttatgccaataagccaaactttgcaaaaattgggccttaaatttattaaataatttaaaaattaataaataaatttaattaataatttattattatccaatttataaaattgtttacttaaatgccaatgccaaaaattcatttgccatttcgcagttgtgctggtaaatgtcggggtacaaatgtgtgccaatgtttggcccattttttgggtccaaatcgtataaaatttgccgacggattcgcccgtcaacgaactgacaaaatttgtcaaaaatttgcgtttgttgctcagccacacaattgatcagcacaaaatatgtatactaaattaattcatatatgaattcttttaaataattattttgttaaaaataattttcataattttactttatcaacaaagggcacgcttttgtgtagcaatatgttcaggttaaaatcaggcattttggcttctaattttattgtcgtaatgctaaaaatttataaaaaattcaataaattaaaaaaaattgaaaaaaataaataattaaattcaattttctcatttataccttttatcatttctttttgaattaattttgccccactatgtgttattaatcggccaacattttgttcaggaaatgttggggtatatattggcatttcctgttctgacgaagtgccaagaaaaatttgagatttttcggcattcgaatggctcaatggcgcaagtattaatggcaaattaattgacctaaaaataaattattgcaaattaatttttttggtaagtttttattgggcattaatcaaaatatataacaaccacaatataaattcatatatattttattatgtttattaaggatgtaactttttctaccctttaaaacgaagaaattctcgaaaaattttaaaaaaatgaaaaaatttaaaagggtaatttttttagcaatttttttaccttgtcgaataaaaaaggaagaatttttcgattaaaaatggaaatgaagcatttggatagagaagcacaattttgctgaccattattgtcaaaattgcaccgttcaaataaccatatttgttggaataaatgtaattttctaaattaaattttcatattttttaaatttaaatatatttctaaccttttgcccacaattttatagcgataaacatttgctgaaaatatgtttgttgtttatttcgagaaacggagaatgaattatcaaaaattttcccccaatttccattatttttgtcctcaagcaattcactgacaataaaaaataacgaacgatggcctaaaataataaaaaaaaattaatgaatcccttttaataaactgaaataattaattaattaaatttttcgtcacggccaaaatttgaaaaaattttaaaattagccctaggacccaaattggctgggcccaaccaatcagtgtaatttataaagttttcatcctgccaaaatttgagaaataaattttattttaattagccttgggaccaaaacggcggcgcccaacaagtcatgctttcgcgggacttattaatgctaatgggccgactaattaatgctaataggccccaagttaataaattggttgaaggacacctacttgacaatgcgcgaatcattttttggtgcgtttcatcagtgaatggccataatatttgaataaaattatccaaaatttgatgattaatgactaacggtaattcgctattgtccgaaattgccgcaaaagacaaatcaaaattaatgccattcaagttgaaagtgatcaaaaaaattgtgccattaatgatttttcgcaaatttgtcacttcattgttctggaaaaaagtgattttaatttattcaaaataaataaataatagagcgattaaatttttaaaaaaaaccaaaaggaggagggtggacagatctttttggttgcaaattttttttgtgataatagctgataaaatcttgttcagggagatttgcggaatctctaatcacgaatctgacatctattttgacaaattcctaatcccccgaactcgaaccaaaatcgaaaattaacaaattttgattatggtattttgcaaatttaaattaaaataaatgtaataaattcattaaaaattttacttcaaaaagaagcgaataaagtgacgttttattggctgttgaagagcagacatttttttggcatttagttttctcgttgccaaaaaatgcgttcattcgaattgttttttctggcacaatgcacaaaaggtcaatgcccgagtcaattgaatgggaattaagaaaatatgagccggaaatcaaaagcctggcttttcttttagactacaataaatttataaatataaatataaaattaaatatttatatatttattaaagcaaaataaatatttttttattggataaaaaagtttacttacccaacttttgacaattgtgtaaatgattttgagagaattttttattttaatgttatattccgccatagtctcatgctcaatttccgtcaaataatttttttgctaaaaaattaatgaattttaaataaaaatttctttttaaaattatcccaaaagaatccgaattatttacttcgttaaaatgcaattgttgtgatattttcggaaaagttggatgcaaaaaattgttttgttctgtttcaggtatcgttttattgaaaatttcaatatctaaaaaataggaatttcgaaaaatgtttaaaaattacgaaaaaaattaaaatttttaatcgaaacttgccaagtgcaatttgtgtgtccattttctttggtaatgttgaaaattttaaatagttctttagaaataacttttgacaaaacatttcgcgcaaattgtatccaatttttgtccattcattaccaatttggcatttgtcgttggcaaaaaatgccgacaaaatttttctctcatgaattttcgtcctaattaattggtatgaataatcaaatgcttcttcactgccaaattttacattttccgtaaattgtaaaattttgcacaaaattttgtgcaagttttttcgaaaattatgcagttcctccacatatataggctgaaatttgaacagattattgatggtaaaattaatttcttgttacttttgtacaggcctaaaataaaaatttcgggggggggggggattcgaagacctttttttgatattaaagcaaaaaaattttcacaggaatttcagaaattatcagcgccgggcagaaaaagcaggaattttagccgttttttgctaaaaaatcaccaatttttggcattttgtggtcaatttttcaaaaaataataagttgaaattggggtatggcaaacctattttttcttgaaatttttaaaatttttatttcgggaagggcggctggctatgttctgcttttgtatattttaaaatttactaggtacctgtaatgtaagtgaatttgtccattcaattttgatcaaaatcaacgaatttgactgatcaaaagtgtcaaattttgggaaaatttttctttccattttttgcaattgttcccacatttgaatgcgtttttcaatttcattcacataggcaccgatgtcgagcagtacaatttggtaatcagcccaaggtgaggataaaaattcagcatattttccatataaaaatgagtcatccaaaaatgctaatagaaatgtttataagtggcaaataattgaaatgtttttccaattaaagaattattattattttaaaaaagtaattttttctataaaaaacaattttattattattattatttattttttattataaatttatttcaccttgaaaaaagtgtggtgtcaaattcatttgtatctttgctaaaaaaatttctcatttgaatttgtttaaatttattaatttttaaatttattttaccattttcaaaagtctgtcgtaatttgactgggccaatctcaggaaatttttccacaaatccttcgtaaaaaattggattttcattaaactttgacttaaaaaatgatcgaattccttcagcaccattttcgcgggtgaatgcatttttcagataattactgaaaacattttccgtctcgcacaaactttaaaacaaaaaaagggataattctaaaaaccaaatatttaatttttgtttattttttattttttgtcatatataaaaaataataatttggaaccataagcgcacaaaattttaaagagaattaaagagaaaaggaaaggaaagctaatctcaaaatatggtaaccatttttttggatttcaattttataattttggtaaataatttatttatataccaattttaacaatttagttttgaaaaatgatcaaaggctcattaatcaaatctgctaaaagaagaagcaaaaagttttctttgaaattgatgggtcgtttcgtaaaatccgccagtttagcaatttttcgataaaatatggcataattttgcttaaaagtaacaaattttacacattcttggtatcgctttagtagtaacgatttttctctatttgcccgcaaattttcaaataaaataatcaaattattaaatataaattatggcagaaaataatacttattttcatacaactttttcgaaaatttgactaaattttttgcaattttacaggctaatagagaaaaacctgggctttcagaagatgtcaagaatgtaaaattgattgcttttcagcaaagttatgccatgttttgtcgaaaaaaaaacaaaaatttggccatcccatttaagccattttttcggtggtggccaaatttatttaatttatcacacctaatcattttattcgcataatcttccaccaattgatcgcctgcattgcgcacattgtcatccaccgagtcaacccaaattggatgattttcggacaaatctttaatttgtttatacaaaatgatcagtcgcagccatcgccaccggacgggtgccaatgcttcgtcaaagttggcattttgccaacattcattggcattagtgctgacgatgccacggcgccatgcaaaatgaatgagcgcctttaaatcctcaaattcttctccaccactgttgtcattccatttaataatttgatgggttttggtaaaaatgtcaattattcgtgcggcataaatgcgaatgcttaactatgggacccaaacttaaggagtaccctcatcttcaccgcgtggttttttgtgcatggggtaagaaaaaaacgatacattttgaagctatgcaattttttcaaatttcgctgcaatttcaacaaataaaaaacagctacctgactgaacggccggaccctgattttccaaggttttcaaaaggccaaaaaaccatcatttggctatatttaagctcgaaaaaaacttcggaccgaaaaacaaacacgaaaaa

SEQ ID NO: 789 - DNA, 4149 bp, Heterodera glycines
ttcttccgcgcattgatgccgcttagatgaaagaaaaatggcggcaaaatcaaaattttagccgaatatgtacaattggcaccataaatttaaacgacaaacgtcaaattaggcattttgtctccgaatttggtcattcattacgagagcttccttttttagccaaatgcctaaaattttgcgcacttgatacgcaaagataagcacgaaaaacgcgttttccgcttggtttgggttgtccacgatgacttttaataatgcctatttttgcctatttcagggtttttgtgcctaaggtgcctattttaggatttttgaaaaaatccttaacaaaaatgcaataaaaacgaaaaaaacaccactaagatccgacccgaaaaaaaatttcagaaaatacacacctaagaattgaaaaaatttttttaaaagaatgatcccaaaatttaatattttttctcaataaaaatttttggtttaaaatttttccttattttggaaaaaactttaaactatttaatatttcttttacaattgaaaaatttaagtttttacgtgttttaatacctaaaaagcgttaataaaaaaattttgtttgcctattttagtgcctattcgaggatttttgtgcctatttaatgcctattttgcgattttttaatgcctttttaggtgcctacgcgattttttgtgcctaaaaaggaagccctagtcattacgacaaaaaattctgtcgtttaaatatggcgtttttaaaaaatctaccgtaaatttgtcgtttggtcgtcacttttcttttggatattggatatgagtttttgaaaaaccgggatccgctccagaaaagccgggattttcggaactccgacctagtgcaaacattaatttcgaatataatttgaaactgcttaagactatgaacatgtccgtcgctgctggccatgaattgctgcacgcgctcggctttgatcatgagcaaagccgaagtgatgcccggaattacgtcattttacgggaagatgacggagtaattaacaaatattttcactaatttttcatatactcattataaaagcaatcgaaaattaatccaaacacgcaaaactttgacttcgcttacgatttcgggtcggtgatgcattattatccatctgggggcgaccatgaaaagtaagaaacagttggattttaatgatcaaaaattggatttaaaggggcttatacgatcggatcactttgccacggttttaccaacaaacgattggccaaaccgaacgaatctctttcaaagacgcggccataattaaccgaatttattgcgaaggcaaaaatggtcgaaaatttcaggaaattttcatttgtttagactcatgcaaagaccatgataacaagtgccaaaacgggggctatttgaatccgaatgattgcacaaaatgtcattgtccggacggatacggtggcgaatactgtaaagaactcgaagagagtgagcaattaattgattcaattaagatgggattaaattttataatttcaagatttgaattgcgaggatttgagtggaattccgagagaattggtggccaatcagtcagcagtgttattgaagacgaaggccaaatgtggggggaatttgccgtgccgatgccattggcgaattaaggcaataaataatatttttgaatttttaggttttttaattaatgcaaattttaattgtttttagcctgaagtggggaaaaaggcgcgaattcagttcaaaagtttgagcaatttgtttgaatgcacacacaactgctcatcggcgtatgtcgaggtcaaataccgagccgacaaaagggcccaagaaaaaagacaaataattaattttaattaattattaattagcataatgatggctcattaaggtgccaaactttgttgtgccgcatcactcactgatctgaaagcaaatgaatacaaaaattggattgaggcggaaaagccggacatggacattgtcatttctgcgcacctttcaccaaaatggaccgtaccatccaccgtattcgaactgacgtatgaatcaggcaaggaaaatttttaaattaattttatttgttttttaaatttttttttaaatatttattatttttaattggctttatttaaatgtttttccaaccattacaaaatggaaaattaattgttcaaaaatctgttaaggcaacgccaaacccataaattcgagcaaatgcgtaaataccgataatttgtttgccgagaaaaggaaccccggcaccagcggtttgaagtgttatgacggggtcaaacaccaattttatgactgctcctgtcacggtgataagaaatgcctcgctgaagaaaaatgggcacacgacgcctttctttgtccaataataaaggtaattaattaattatttatttatttattccaaaagacaccgccacacaaacctttcatataatataggcaatttaatttttaggcactaaaaattaccattttttgtatcaaaaaagcggaaataaggataaatctggcaaattataaaaactctatttgattaattaatttgtaaattcaaggtaaatggaattcaaatccaaggaagccgacaacgagtgtttactgacccaaaggattttcgatacgattggactcggattgaggttaattgttatgtgagttgggtcttctaatttcaaaaatttgtttaattgactaattttacagaaggccgaagcaggtaccgtaagcttttggggctacagtaagccggagacaaacgaaatcattcgggtggacgaaatccactgtttgacttataaagctgctggagtgccaaaacggttcaagagtttgcaagtcgaagaacagccaccgatgaaaaaactgagtccaagtccattcttggccaataatgcttcatcacttatccatgtgttcgtgccatttgttggccatccatgagagaggggggagattaatgatcagtaggtgatctgtctgctacagctgatcagcattggccaatttcttatatatttttttactttttaatagagatcggaccggtcggtttttttcgggttttttttcggtttttgatcgaaacaaaccgaccgagaaatttttgagtttttcggtttttcgttttcggtttttttccgaaaccgaccctcttgtccggtctctattttttaagtgtgtcaatgttttatgtaagtccctctcgtatttgtatttttaacgcatcataaccagcatgggctatataatttattggctaaacgtgcaaaaatatctctgccttaaatagacaaaaaaaaaatggacaaattttatttgaaggcatataaacaattaaaaatttaattaatgcctgtggcggtgtctttttgtttatttattcattttatttttttatgacaccaatgtattttatgcatttatactaattatttgttttttttttcttcttaaaaaatggataaataaaaatccgggccaatatcttttgaagacaataaatttaatgaaaaattcatgaacaaaaaataaatttaaaatcaaataaaaaatcaggaatgttattttttgcgcttttcctccaatttttaaacacatcacggcttttaacaccacaatataattattaaaattttttaattttcaaaatattggtaaagcctaactcgttttaatgaatttgtaaacaaaaatcaatacaacaacacaaacatttaaatggctaacaataagttgaacatttggatcacatatgtacctaatcacatcaataatcaatcaatcgattcacttttactgtttctgatcagtgatcaccactcggccctggcaaaccgtcgagaagactgaaaaacaattaaaaaaaattatcatttggatttttgaagtttttcttcacacccatcgtcgactccgtcgtccgcgatgaaaatatcaattgcgttttgtcgagcagtacagagcattgcgtcattcatcgccttttccaatgtttcctcacttccttctgctgcaattggacaacggatgagcttaaaaacatttgctccttcatgaatcggtgccaatgtcaattgatctccagtcaattcgttggtccgtttaaatgacgcaatgga

SEQ ID NO: 790 - DNA, 2899 bp, Heterodera glycines
  misc_feature (75)..(75): n is a, c, g, or t
  misc_feature (114)..(114): n is a, c, g, or t
  misc_feature (2849)..(2849): n is a, c, g, or t
tgtcaaaaaataggacttacctactcctctcaaaaaattagctgggtcgaaatttttaaatttggcattatgttntaaaaatctctaccttgttttttttatgttcactaagtntaggatgtttgttcttagtattctcaaacacacggttaaaattgagccttactgcccttggtagagattttactgaggcgttggtggagcgtttaaatcgtcaatttgctaattacgtatgtactttgaatttaaatgtatcatgttacagatcaaagagtattcaggttatatcaaatgtcgggctgtgcattactttttacgactaaaaaatacggcgcttcttacatattggtttttgtttcttgctttattaagttaaacaattttattttatagcccggtgacgcatcaacgcatacgcctgtcctattccgttatgttgtttttcaaccaatgataaatgaaattcttgagggcaacatactgcgctcgaaccaggaagggatcacaatcagtatgcagtttttcagcgacataacagttgcgccagacaaattgcctgcagtttctaaattgtatttattttattttaaacattattgtctaatgttctaactttttttttattttagtgatgagtctgttcaagtttggagatgggagtatcaaaatgaaaatggtgatatcacgccattctatatggatccaggaaaacgcgtaaggtttgttattgttttttggtatagcaatgatttgaatttttctatattttcccgcgtgtgctaggcattcattttttcccggcccgtctattagctccgccgggaccctcccccaccccttctcccggtctcaaattttaagaaattatccaatgctttaaaaaaaatcagctgaaaaattagtaaaaactttaaagaatttttttttaagtttttctaggttaaaaaatccatttagatttttttttaatctaaaaattaagttttagttgaaagttcttagaaatttttttttgtacgagttgccattgacccgtattttctgtgctttttcggctagttttgaattatttaatggggtagtaaagactcatttattgacaattcttttacaagctagaaacgagtcaagaatttgttaccgcttttctacatttatacattctcccatgcagttttctcaattaaacattcaggtcaatggacgtcctttggagtttattcagccagaaattctgcgcatcaaacttcaagagccaattctaattgcgatatgccctaccttaaattgacttttcttttgctgtcgcttccgttcggttgcccattaagctttgtcaatcatcgtcttgaccaaccgcagtcagcagtcacttcgggtagtccccctgttgtcccaattgcctcacttctcttgtgccgctttaagctgatcgcacatgtcacttaaatatgttcctttgtcgtgcaacgcagcgttgcatccctcgttcgtgggtgtgcgaccaggagaacgattgttcggatgggcaggacgagaagaactgcggtgcattttatacctaatggtttcgttggacttttctttttatttgtgcagagactcctcaaaaacgatgctctgaaagtgaatacgaatgcaaaaacacacaatcaatgcaacggaatgcaaatgacaactcttggctcaaccacttggcccgcaccggtttcacacacacgtgcatccaaagaaatgggtttgcgacggggaggccgactgtgtggagaaggatgacgagttgaactgcgaaggaagtgagtaactgacgaaaattcgtcgatcacaattcttttttggttattcttttctctgatcggcctttctgcacatgactttttcaaatttgtcaggtttctgtttttgatatttcagagcttaaatgtgacgagaaacactttgagtgcaaaggcttttgacttgcattctgtgacttcgtgcattccaatcgaatgggtatgcgatgggcaggtaattctcgactaatattagaggaatagggtcaattgttctgctttcatttaggctgattgtttggacatgaaggacgaagcaaactgtacagctaaagaaacgaagcctgaatgtgaaaaggactgagtttcggtgaatcactcattaatcaattcttttactccaattgattctcaaggtgcgattctggtcaatgcatttacaaaagttggcgctgtgatggggacagtgactgtatggatggaagtgacgaaaacaactgcaaggtggacacgtgcggttctgttgacaagttcaaggtcatcacgcgaagagtccacctgaaaatgcaaactgacagttttagtgcaaatcatcgactttctgcattcccaacaaatggaaatgcgatggcgaaccggtaatttaatgttggaatttagaaatttgtttatcaaacctaatttcaatttttatgtgttttgatagctaagtaatgcaaaaaattctttgacaggtaaaagtcgaaataaaatcaggcgatcggtgaatgacataaggacaaaaaatgtttttggttttgttaaggacttcctgaccactcggatgaaacggactgcgaaggggttactgctcaacaggaagtgcactgcaaggaacatgtttgtttcaacgtctttgcccttttcccaattcaattgtctttctctgcactttgtccaggagtttgcgtgtgcctctcgttcccaatgcatcagcagtttttggcaatgcgacggcgacgaggactgtttcgatgggagtgcgagcacaactgctgcattcagtgcaaaccgaaagagaaggcgtgcgctgancgaaagagttgcattgacgaggaattgtggtgcgaccgatcggaggactg

SEQ ID NO: 791 - DNA, 1857 bp, Heterodera glycines
  misc_feature (35)..(35): n is a, c, g, or t
catttgaacactttgtcaggtaaaagtctaatttntggaattaatttaatttatcccacaatttcaaatggatttgtaaatcagtcaaacagttcttgttttttttaaattagcatatccatctgaatgactttctgcgaattctttgcaaaattggctctgttctcgtggaaatattgtgcatttaccacgcaattttgaaatttcacatggacgaggacaaattggcactgaaaaatggacaaaaggacgacacggggggaagggaaagcgaaaacagtgacaaacagggggagcaatttgcagaagacaatttcgacacgaatccgttgggtggggctttttatttattttcatttgcactttaaatcattcaaaaatttaaaaagcaaaaagcgaccccctaattaaaatagttcaaatgaaaagaaattaaagtcatttgaaatcaaaatataaaaaatgcccaaatacatctaattttgcaatttcattgttttttagttgagaaaggcgttatgcaaaagtcgctcattgacaatgccttcgatgtgttcgaatgcgcctcccaaaatttgaattgtcttttggccaatgccgagatgagtgccatcaaattcgaccagttcatcaaagttgttgagttggcggaaaggtcccatattttatcatttttattttgaatttgtaaatttactatcaataattattcaattaattcctcctcatttccatttgctcagattccggaccttcggtcgccaatattttggcaatccgtgccaactcatccgacacactttgatggaccaatcgcgcaaatatattgagcgataccatgccgagaaaatggaggaggttaaaatgtttttggagagcgaaacgttcactctttgcccggtgcccgtccaattcacactgtttgaccttccggtgagaaagaattggtcgtttttaagtcaatgattgacacttttgacggggttttccctaggttttcccaatggattgcattttaaaaaatgcttttcaaatttaggaatttttcttcctcaaagagttgcaacagaaacagcaaaatgatgaacaaacggaggaagagactgaacagaactcagtggagacatttgtccacggcaaatccatccgtttttcggtgtttcgacattcttcggaaatggacacggaaatattcccttattcacctgaacaattcgacgaaagtgtgaggagaaaggcacaaaaaatggacatgaaaaacttttttgcgaagagaaagcattaaaaaattattttgaaataaacaaaaaatatggaaaaacaaattcagccccgacgaattggtgacagacgacggatgatctgcaaaaatggcgaagtctctcagtgttcgtcgtccgatgacggcactcgaaattccattgaagacgaatcactggcgccgtcgccgcacaacgcaatgccaaatttatgcaattccgcgctgaatcttttacgtgtgattggcaagtgctttatttgcttagagttggcatacctgtgcaagggggtagtcaaagggggagggtcatgacgtcagacgtaagaaatcggggggggggtaaaaagaagaagaagaggaaggaaaaaagggaaaaggcagcgtcgaaatcaaggaaagtgccgtgaaattttccaattcagctacgtccgacactcttttcttacgttcgacgaattctgctgaagaatattcgtcgaacgtaagaggagaggctgaaaaattcctaaaattttgctttcttttttttaaagatttcattaaaaattcaaatatttttcctaaaaaagttggcttataatagcaaaaaacctaat

SEQ ID NO: 792 - DNA, 2849 bp, Heterodera glycines
tttatactagagctcgattggacctggacccaatcctgtttttttcctggacctggttttttgcccaagtccaacattgaatccaggtccaggcccattttatgccacaaatttgttttttcccccatatgcattttaccccattttcagtcccttgcggcggtgttcgatttgggcgacgcttcgtttggctgtgtggcggccaaaattatactctttcagtcaattctgaagcaaatttcggcgaccgattggacaaccggggaaatccattcgcaacattcgccttatgtggacacaattgtccaagtgaatggagaaaaagaggggggggggggggtgaatattggccaaaagcaaaggaaaaaatggccaaaataacaattatcagccttttccataaggttttactggtgttcctttttaggaatgttcgcaattcaaacaaaagttcgtccgccttttcccctacgttcacatttccgacgaattgtacgccgccatttggtccatgcttttgctgtgcattttccgtattttggtccaggggtacgcggacgcccaatttgtttcagtggcaccattgacaaaaacgtaattttttaggtacgccgacgtaaaaaagtgcagcattgagggaagagcactgcaactgttggatgtcgagcaattatgtggggaattggaggagatcaccggactgaggcaatttcacaatcatccctttattttattgtaaattcccgaaattaggcctcttccccaccgaccgttcgtcgaaaatttcgtcaaagcattttatttgccgtttggagagcttcaaaattggatggtgaatcatacagtgagtggagaaaaaatagggattttaattgggattcttaacaaattcaaggagtacagcctaagccaaacgagcgcaattttaaatgcagcggctggggcggcggcgatcagctcgtcctccgtcgctacgaactccagaaaagcgaccatgtcgcgcatcatggccaatctgttggacgcgggcggaattggggaaggcggcaactctcttttccaatgaataattccaattttttgtttaattttacgttatttccatccgttcatcttttgaatttataattacgcaaaagaacactcacattttgtaattctaacaatcccagttttgtttgtatatattgaatgttgttaattgtgataaaaaaaaaggcttggatttaaatttttcgaaaaattagttattcaaatttttaaatatacatataataaataattataaatagcaaagttttgtgtttaattggtgctgtatgtttccgtcagtaaacgatttcgtcagtgaacgaattcgtcagcaattattttcgtcagtgatgtgtttttttaaccttttatttttatattaatcattgtgtccattttttttgattagcaaacaaattcgtcagcgaacgatttcgtcagtgaattaatgtttttaaaaaaacgctatacttaaaatcaaatttaaaagtgcaggtggtaggcacaagcacgaaggtaatcaagtgggtcacgattttcgatatcctgaaggagtgcattcaaattgttgtcctgcctaacatatttccattttcttgctgcatgcgccccccttattccatcagctggtgcgacttgaaagtccacaattcgctgagaccacatttcgtcttcctcgatcattttgcgcacaaaattgctcaaacgttgatttccttttaaaagagtattctaaattccatgccatccctcgacgctgttgttgctgcgtgaaaacccaagtgccaaacgctcagtcatattccacaattgaatgggaaaaagtgcatctcgctgtgccaagttcattgcttcaattctgtcgcggatccagccgtccgcagccgcgcccatatttccgttgtcttggtcaacaagcggctcttcattctcaatgacatgacgtggtccaatccatgtcatgaggaagtaaagaatcaattctaagcggtaaaaatcaatgaaaaattgggggagggcgatgtttttagaattttgcaaagaacccaaccctgtagctcagcagttggatggagcgtcgacaccaagatgcaaaagtagttataaacaaggtcgacaggtacaaatgccaaagcttgaagtgatcggatgtttcgttgaagctcaacattttggaggtattgagtgtgaagatttggaagtcgttgaattcggcgataaattgcttggccaaaatgaaaaaggcagccactttgggttaagttggcaaaaacaattcgcgtagaattgatggctgctgattcgaagtcactcattagacgttgcggtgcccaattgtttccaacactgtctctgattgcttcaaaaaaacgcacgtatgttgccccttccttattcggcagtaaaccatatacgcatggaactgagcaatggtcgatgatagcgctcattgtgtataactgtgcaaatccacgcgggcatgacttaagcgggccaatttaaaatagtaccaaggattctttgcctaacaattttgggtaaaactttatctgccccccattttgaagaaaaacggatgtcatattcgtgatcagtgaccccaaaatcccccgtatatttacttcgaatgtaccatcaatggcacattcagtgttgtattgtcgaagaatttcgagagcagatgcagaacagaaaacaatcattcaatggccgttaaaaatttcattgcaaatgacgcggtttagaagagcatcaggcagtacgatgttttcaacaggcaaaacatcaaggccaacatctccgacctatattatttt

SEQ ID NO: 793 - DNA, 6886 bp, Heterodera glycines
tccaaccctaaaaacctctaaaccaactttaacacaaaaaaggagttataccccaaaacctgacttagcgcctgcactccatcggcagaattcataaccattagccttctcctgctattttttttaaatcattacttaagcattttcaggttattatcaataaaaaacaatgtataaatacaaaaaaggtcagcaaaaaggcgagagcaagaaagaaacttgacgaaagtttcaaaagggcgctgaggggaaggggaagaaggtcgacccgggcaaggacctgtgttcacgaagcaacacacggctggatattgtggaatacaaaagattgtagcgacaaattcgaaaaggtaagtaatcggaagaaaataaacaaacgaccataaccattgttaacgaaatttttaccccaaaaagtcaggctggaattttactccgacgatgaccctttttttactttaacacattttttggtgcgcttttaaaaaaaaatatgggacgatgcctaggaaaaatagtgaatttggcgcatgtaggcaccgtcgaacccacccccccccgttcattaagtttggaaaatgccgcaaaaattgttagaaaactggtttcttgatcccgattcggagtcaaaaaattcacgtttatagttaattggattcacaaaattcaagtccacaaaaaatgacttcattttattttttgtttccggtttattagatctttgttcggtcgaagccgggtctgtttgacaatggcttttgcgaatacctcacaaccaagtggtacacgaggcccagctcaaggccaaattggtcatgacgcaagaaggacgcgcagcagaagagatttattttgggagttcgattgggcatttttcggactcggaggatgcgctaatattggcagatacgatcagataatcgatttgattggtatattgtaattctttggttaagaaataaactcaaaggttcgtagtcggtcggcctttttgctcacttttgagtcaaatgagaatttaggcgctacttaaaaggagtcttttgaatttatcaaaaattaaaaacaataggggggacccttttggtttgcaacattttttaatatatagtcattaaaatttatttcctggggttcttggggtccctaacctcgaattcgcgatgcgagatccgccgaatttgtgactccgcggcaattttggataatttaaaggggaaattattttctgaagcgagtgttttatatttttgtttatgaaaaagtaaagcccggtaaaaaaaatttccgtgagcggcatcgggagtgcaaaattttccgggacgggcgtccagaacggtaatcctgtaaaatcccgctcccgtaaaaaatcccgttcaccgaaaaaagcgtgagtcgggagcgggaatcccgtaaaatcccgctggagacccgatcccgccgggctctatgaaaaagcaagagatttatggaaagcatagtcaaaaatatttggcacgctccaaaaagaattttgatcgacggacgtggaaacgctcattcaaaactggacaaagagtctttgccagaaattacagagacggttcgaagtggatggcaggccaaatcatgagccaaataagttcatcactgtttcttgtccgaacagctggtggagtttggaagcggcatttagaccagctgaaaacggacgagacgaagcccgatctggagagcaacaccgacgcggactcaacatcgtccattggtgatcagacggaagtcgcaaaggacggaggacagccgaggacgtggacgaagagccgaacgatccgcaaaatgttgcatgatccgccattgagaagatcggtgcgcgaacgaaggccacgacaggtcttcgaccccagcgcgtgatcgctgacttcagcttgtggtgaggagacggaacccgtcagttgggccccggcacgtttgggccccagcggttttttggctataacttttttctttgtcaaccaaatccgacattttggtagcattcgaaagccctaagtgtcttctattagccttcaaaattttgaaaaatttcgttaaggttcagaaaagttattgccaggaaaattcaaaaaaccaaattttccaacctttttggccataaatttgttcaaaattgacaaaagtttttggatttttgcaggctaataaagcatttgaagggctttcgaatgataccaataatctttctcagtgcaaataggtttattatttatttagtaatcagaacgccaaaactttgcaaaacttaaaatttttttgtgattttcccttgtaaaaatagaagagccgatctcgagttaaaaactagacagctaaaaaataaactgtgattcgatagaggggacaaaatatgggcctatacaaaatttcaaaaaaagttacccacaggaaaaaattttttcccatggcaaacatttcaatactttaattcttttttagccaagtgcgcaatttaaggccaaatcaaataaaactaacaatattatctagaaaaaaattatcgatgctgtacgtaactaactcttattgaaaataatttttttttgacacgaaaacttttaataaaaaatatttctgccttctttaaaagacagagttcccaagttttttttttcaaaataagacaaaatggcctaaaaactaagattctgaccccaaaaataagattttttctaaaactaatatttgcgtgaaggaaacgcaataaaaacatgaaaaattgacttaaaacaatattttattagcgtaaaaacaattaaaattgatcatcaaaagtatttttcccatccgcctattttctctgacaatttgtgattggaaatgagcatttggtacatttgtgggcaagaaagatcataattgactttggtttggaccaacgccttgactgtttcgacttgcaaaagatttcgtttatcagtccattgcgatccgcacaaagagaataccctctccacaaatgcattcgagacaggcacggaaagtacgacgctgaccagcttgagcagattaggcaaatctgcttcaaacagcttcttccacttctgttcgggggttaatttttgaaattcatcatttgggaaagaattcaatatttggtttgcttcgctaacatcgtcaaacaaatcatttgttaactcgggcgcaatttgtcgagccagagccaatgcatcgtcgtggggaattttgcggtatgccagcgcaacccattgcaacttttcaggaaatcggtcaatgcgatgccatttgtccaaatacgccagaaccgaagtgtaaaacgactgaaaatttttgaaaatatgcaaccgacaatttttacttgaaattgttcctccaacgcttcgcgtgtgctctcatcgacttttcccattgccaaatctgcaccataaaacctttcactttttcgttgttcaattttccctctaaatttgtccatttccagcaaaagttcgggcaaaatgactttttctttctaaatttataaaattttttcatttaagatttgtaaaacaacctgaaaaaagtcaattgtcttattaaataagccaagaatgtggtgtaaaaaatgaatgatcgcaaacgattgttcagaaaaaacgaaaaaaaagtcataaagaagtgccggacacttttctggttttgaaaagtaggcgattaacacagattccagccgaatcattttgcccaacacattatgcatcgatgtccatcttgttggcccatgacgattcaagcgttcaaactcaacctaaatttatagcttagaatttatcattccttattccgcacctccaattcctcacaaaatccttttagctcctcaattcgtttggttgaatttttaaaatgccctgccattttaaaaatcactgcctcaatgtccattgctcttccttcaattctcaaattgtccgttgcctttttcgccgcattgtgcaaaacatggcacacacaccccacaccaatcaatcgttcattttgttgtcttagacggaaaaataaattgttttctcctgcgcgctcttctccaccgaaattggcttttgtgttgtccgccgaaagtgccgttaaatttgatacattcaaatcgtatttttccattattttgttgatccattggtgcaccttttattgcaattaaaaatgcaaaaaattgatctcacttcaaatgatgtttcgcccggaagtgactccaagtcaatcaaacgggtttcaataccattgtcttttgtaaaaaaccgaacaacaagaggaaaaagtttttgattcccaaagtttgacgcatcgatcgataaagagaatggtttgtcagccagtcgttcaacgatttttttcacggaataaggagccaacacgccttaacaataattgaaaaaagtttttgtatttatgcgataccagttagaatttttgccgtttttgtttgtccgcaacttatttttttcgcaatatttgaatcgggaaaaattgtgcgcaacaagccgtccgaggacaaacaatccaccgagcgaaaagattggcaatgttgtgcagtgtgataagcgatagtgcctattaattataaaattttgatcagaaaaaagcctgttaaccttcggccgccagaactttacggtcttcagttgatggggcggaagtgtttggcataaattcctgcaatggaattgatctgtttgctgcttttgccgctttctgatgttttccagttttttggtgcaacgaaattgcacttttcccgatggacagcagattgatatcatcgttgcagacgacacagagggcaaattcttcgccttttcggcttttctttatgtgccggaattccttttcgtagctctccaaatagatatttttacgttttgggggcatcttgggcattcacactcaagaaaacgaagtaaaatataatttatttgaaaatcgaattaattaaaaatattcgcttcaataaaaaaataagtaaagttattcaattttgtagatttttatttgcaaatccaaaataagaacgaaatatgcacgtcgagtcaaaaataagataaatcttagaaataaggacattttcattttctaagatccggcccctccaaataaggacaaatcttagaaataaggacacttgggaactctgtaatataatcatcactttttccaatcccatgctgattaatcgggcacatttgtaaacccttcccagaataaaaatgactaaattttatggttttagccaatatttaagaattagaagttttggggcatgcggtaccggtaagcgctgtcggaaaaaattttcagaatttttaatgaattttgttaaaaaatagcaaaatttttcagaaatttccctcttttccccttcgccggcgacccctaccttaattttttttaaaaaaaagaaaaaaaacacaagctacaactaacaaaagaagaaaactattcatcaaaaaggactttttttcacggtaggggtcaactccgtctcagcaatgttcaaaaagctataacttttttctttgttggccaaacttcacaatcatggtatcattcgaaagccctagatgtttagaagatatttataagctatttctcagtgattaatcagctctcaaaaaagttgtcagtttaaaaccgcaaaaaaggcagaattttcaaagttttttatttctattttttttatagttcgaaattttctgtaatttttagtaggctaatagagcctgtgaagagctttcgaatgatatcaagattgtttgattcggtcaaaaacttcaagagttatattgactcaaagttggctcagacggagttggccagacggagttggcccgttccgtactaagtaggccaagttttaccaagattttcttggtctcgggtcttgtccttattttttgggggctaccaaagattcaaagtctagatcaatcggaaccaagacgtatccctaacctgaactcaaaagaaaagcgaataatttatatacagaaatgttttttttgaatattatatactgtataatgtttaatattgcgtttttataaaaaaagtggaaacgcactaatgagactaattagcgggactcatttgtccgaaaagcactaaatgagattaattggcgggactcatctgtcccactccgcccttcctactcactttcgacaattttttgcagaagaataagctgttcgtcaacggacacttcaccaaggacctgagcgaggatgagcaggaggaattgaagcagtaccaggagcagctggatcagttcaaggcatgaacaactgggagggagtggaaattttcataagaaaaatactgaaatttccaaaaaaaaattcagtccgaagtcaagacctacttggaggagcgccagaaacagttccgcaaccaggtggcgcgccagggcggcgccgaggccaaggagggcggaactcagctgaagaagccggagccgccaaagaaggtgggcctcgttgcctagcgatggtgttcgagaatgccgagaatctcgacttatgaaaattttactctgttttttggacctgatcccggggcttggccgatttttttgaaattttggtccacattttcagcccagcttctgctcggacaaagccaccacacagtacgtgttcgacggctgcagcgttcaaggcgacaacgtgtacattggggatacttttgtacggaattttcaaaattttttaaaatttttcacccccccccctcataggtgcgcaagctgagcccggacgagcagaaggaattggcccagtttgaccagaaattcaccgcctaccagaaggcagtgacggccggcttccgcaaggtggaaaattgttttggcaaa

SEQ ID NO: 794 - DNA, 4434 bp, Heterodera glycines
  misc_feature (3595)..(3595): n is a, c, g, or t
caacaaattaaaatgaaaattagttaagaaatttcgtctttctttccccttctaaaggtttaatgaataattgctttttaattttcaaaaaaatttcatttaagtttttcgaaaaatgcatttttagttaaatattatttaaaaaaatttgtattttgtgaaaaaagaattattatttttatttcttcataatttcaataattttctgattaattaatttatgataaatgttttgtcagaatgttttgaaattttgcaggaaattacgtttggcataatgactatatcagcttggaaattttcaaatatttcgatcactagaaaatttcaaaaaatcctcctttgtataattttatttgtaaatgtttcacgtttaggcactgatcgtgaggtgcgcagcagttcgtccggacgcattttccaggtgcgtggaagcggtgccacgtcgctggtgcagtcgcctaccgcgcgggtaggcggtggcgcatgcaccatgctgacgcgccttcaacaacaacagcagcaaatgcgtcgttgcgtcggaggcgcgaccagtgcagcatcacctacgacagttgcaactgctgcagtgcgacaggattccgcggacgaggcaagcatgggcagtgtcagtacggtggcgagtggcggcgcggtggtgggtggtgtcgcaacgcaacacacaccgcaaatgcagcgtcgcgctgcgaccattgcgtcacagcagcaccaggtgggtgttgaaatttaaaaaattaaatttaaatttagagtttcatcaataaattccattaggtatatttggacactaattgatttttttaaatggattaattagttaaaagtgtttcgaagtaatttttttaataatttttagtaaaaaatcaaaatttcgttcatttttaattttttttttatattttaattaatgaaaaattaaaaagtgctgcaacaaaaaagatttcatttaaataaataaatattatttttaaatattttctaaaaatttaaaaaaaaaaatttaactattttttcaattttatttgaaatttaatttttctccttttatttctgcagcagcagcaacgcttcaaaatgcgtaggcccaaatccactggtcaaatcatcatccaacagcagcaacaaatggtggaggcacagaatcatcatcagaggaaaaaaatgtccgaaaatcatcagcaacacgctgttgtgatgcaggtgggaaaattgaattttcaaatatttatttatttttttaatttaaaatttatttttattaaattttttatttccggtttttggatacaaatgattgttccaaaaattcttcttttttttgtcaacaaagagggtaatatttttgattgaaaaattctcgaaaaaattttaaaattaaaaattgatttttcggtcttttttttttgttaattaaatctgttaattttttacttaattaatatttaaattttctttttctttttttgcttttttaaatattgcggttttgtaaaatgaaaaatttttactctgatgaaataaaacggagctcccgcggattttcgggctcgtggattacgaatttgacatacaaatctaccaattttgaattcctttacgaaatttgaatcaaaagtctaaaattccaaatatttatttttgaccatttgttcgaattcgggttcaaattgggatttttcaacacccttattcaattaacgatccctgaaaacccctttttcatgatataatatcactaccagggatggggaattccgaggcaccaaaaattttcggaagtcggaattccgaggcccaaaaatttttcttaagtctgaagcggaattccgaccccaaaaaatcggaacttggaagtcgaaattccgtaccatccctgatctctactatacatatggcaaataattaatttaatcaattaattatctttcaggatcgcggttcggttggcacggcaggcaccggacaatccggcggttccggctcgctatcgttggcaccggtcattgctggcgccggtgccgtacgtggcggcgcacacgcgcagcacaaccaccaatgcaacagcaacaacaataacaataatagcaacagcgtgtccgcgtacaacacggtgaacaccgcgtacgacccgtcgtacaccagcgcaaccgtttactcggactcaatcacgtgcctgcacgcgcctggcgtcctgcagtcgggtggcggcgtcattggggctggcggtggggcgagcagttgcgcggacggcatcacggaccagcggcgcgggtgagtggtgacggatgagtggattaagcaatcaattagattgataggcttaatggctttattggtttaattagatgcttgtgcgtttcttgaaatttgccattccccctcacttccgacatttttttaaaatcaattttataaaaagaattaaccaaaaattttatttttttttgaattttttaaaaaataagtttttttttttaaatttttaaaatcttttcttgaaattcttgttctcgaacaacatttaaacattcttgaaatttctgttaaaattatataaaaactttgaaaaatatagaaattaattaaagaaaagtttttgtttattcaaaaccctacaggcgaatttctttaaattttcaatatgaagtcaatgtttttttttcaaagttatttcattaaaaaaacagatgttaattaaaacaaagaaaaaaaattaaatttagaaaagcacaaaaaatttatcaaagcgaaatgaataaaaagaatcccaaaaaattagggtagagtcaactccgtctggccaactccgtctcagcaatgttcaaaaagctataacttttttctttgttggccaaacttcacaatcatggtatcattcgaaagccctagatgtttagaagatatttataagctatttctcagtgattaatcggctctcaaaaaaacttgtcagtttaaaaccgcaaaaaaggcagaattttcaaagttttttatttctatctttttttatagttcgaaattttctgtaatttttagtaggctaatagagcctgtgaagagctttcgaatgatatcaagattgtttgattcggtcaataacttcaagagttatattgactcaaagttggctcagacggagttggcccgttccgtagagcggccatcggtaattgtaaaaaaaatcggtaccggtaatttttgcagttgataaaccggtactttttggctgggaaaaccgggataaaaccgggacttttccctggtcaaaaccaggatttaggtactcagttgtacgcttttttcaacaccagatgccggtcccgtacaactctaattttgaccaattccaaaatactaaaaacaaattataaattaaatatgggattatagttacttttacatattggtggatcaatcattattttttaataaatttcattaatttggcgctttcattcgacgccattttttcttgaaattccttatttttctgacttaaatgtttttttttctttatttaacttatttgaataaaaaaaaaagattttaaattaaaacataaaaatgaaaaganaatttatatttacaaaaagcataaactttctcaaaaatttatcaaagcaaaaattaaaaaaaaatgaaaatggaaagaaaaaagacagaagcattgtgtgatatataggtgaagaaagaaaaccgaacaaggaaaaaataagaaatttttgacacaaaaagggaaatttggcgctatttaaaaagttagcgatttttaatctaagcctaactcgaacaaaaatcagttaggaagtctgagatggtcaaaatagatgccagattcgtggtcaacgaccctaaaaacctctcggtaactttttaaaaagtgccagaaattttttgagaaaatggcgatgaattgaaagtgccaaatttgtcatcatattcgttgttcaaatggcgtttttcatcttcattgtttgctgcatttttcaatgctttttccaattttgccttttcttttttggcattttcttttattttttggcacaatttttccattttttcttcaaattctatacgtaatttggtaatttccaacggatcattgaaatgttttattttttgttttttcgtttttatcattaatttttctccattttcttcacttttctcctcttttaattcgtaattcaattcctcctcatttactaactccatctcactgatatcatcatcaatcattttcaattcattttccccaattttccaaaaacatttcgaaatgtcattcagaatttggacaatattaatgaaatcgtcatggaagttttcttcattaaaaaatattggcttcaccaccgatggtaattgtttcgccactttcggacttttagctaaacagaattaattaattta

SEQ ID NO: 795 - DNA, 6205 bp, Heterodera glycines
agaccagagaatttcaataattattgccacttattctttccctgttaaataaaatttttttcatttttccctttcattattttttgttcattccattattatttattcgagttttttttctttattaatttttcagttaaaatgtactcgtttcaaaaatattttgaggaggctctcgaaaaagaagattttttctggcagaaaaacagagcagaagtggaggcattgttaattgaggcttcaaattataaaattataatacacagggacaacgaaagccgctattctgattatattgccacctatcgccgcaccccactcttctgtttctgcatgattgagagaaatttaagatttttttacgacacaggaaccgggacgcccataggaagggttacaaccgtgctacatgttaccgttgaggcgagctatacaggagagggattcatttcgcctatgttttccttttggttttattgggagggcaggagtcaaacaacaaacgaatctttcacgagccgtctttatttgtacactgtttcgatgctaagagcaatgggcaaagcctggggcagagaactacttttgaaccctgttgaagttttaattgatatgttctaccaacgaatagataggttggaacatggaaaaaagcaattaaaaaaaatttgtttagagatttggtcggatcatggtcattgttctatagactcccaccctcactttttgacacttcccgccgggtggttgctgagaataaactggaagaatttttaaaattaccatcattttttcgcatgcttttttataataaatattaaatgttcatgttgtttttaaagtgaaggttttgacccaagtatttaatcaattttaatttattatttttggtagaattccagaaaatgcaaacaatcgctgaaattaaaaatttcgagattattgaaggtggaagagtttttgttgtgagagcgagaattgagaatgtgatggaggcggagtacagggtttgtaataaaaatgaaaaaatatatcagtttgtttaggcatgcactttatgccgtaaaggggcttgttcttgcggggctgagaaaaagatgacatcttatttgaaggtgtctgtggcagatgatacagggcttttggaaaatgtgggatttttcggtgtgcgtgggaaacagaatgggacggtaacgcaacgcttttttaaaaatccatatacatttaaatttaggatgaggtcaaaagtttggcgggcgccgtgtgcaccatgaaaattggcgcgagggtgaaagaattcggagggaagaaggggatctattactctttgattgatattgtcagcctttaaatctataaataaacttgttaattttttcaaataaaaatgttttacttaaaattatttctagtttggttattgttggtcggaacggaaagttgttgcctttcaaaagaagaaaaagagcaatttaccaatgcccgaagaactgtagaaggtgtatttagagacataattaggttagataacgaagcaaaagaattttctttttctgcacataataccatggttgaagcccaaaatataaaaaataaaaaccctgataaacctggtgtaaatttttggcatagcaaattattagatggagttttaaaaattcatgccctatttgacaaaataaaaaaagaagaaaaaaatatgaaaaatattaaaaaaggtatggaaaaatgtctagacagaaaagatttaactatgtgtcaagaattagcagaagaggccaaacaatcaatcgaaattgccaaaaattatcggcaagaaattgggcatatttatcggaccgcttattcacagccagatttaggtattggagatttggcaaataaactaaaagaaacaatgcgcgaaaaccaaatacggtttgaaaggcaaagacctcaggaagaatttagggacgaatttattgcatataaaatataaaagaaaaatttaataaatgaaaaataaaaaaatgaattctgaaaaatcagaaaaagctaataccattttggtggaagctgcaaaaaaagagacagagagagcatggagggatgtagcggcgttagcagaagaagttggcgattttgccaagtcttctcgggaaacacttaatcaggcaataaaatctagagaaaaagctccttatgctaacggtgttcgagaattatatcttaaaatgtccgattcaatttgggaaattttcaaaatcgaggaccaaatcaatttggagtctgtaaaggctgaatctgcatggcgcgagttcgagagatgcaaaacttttgaccaggcaacaaaattcgaggaacaagcgcaaaattcgttaatggaagcccggagattacatttcgagtcccgaagggttcagagccaaatgttaaattatgaaaataggctcaaaacaattgtttgggagcacgttggtatataagaacaaaaaaataatgatataccaaaatggaaaattgtgccataattgagtcattatgtcataaggacttaaaatttggctttaaaaaatataaaaccaaattttattttaaaaatcctttcctaattaatgcggaggaaaattttaaaaatatcctcgcatcaataatcgtaaaaatttataaaaatgaacaaggaaaattcaaaagcattctgaagatttcttttggttttgaatcattttattgccctcttagataccctagcgaaaacaccgccgaggctttgttccaacatgtcctattaaaagaagaattatattcgcttttctatcctttggatgatgtcataacactagaagtaactataatcccagatgtcgacaatagaccaagaaattaattttataaaaaacaaaattacgagaaattggaaaatttctggaaaaatacttaaacgatcaattaatctcgaaatttttgcaaatatgctttttaaacgggtgaaaaatttctacataacagcatttagtgcacctggaatggaaaatttatatttttcattcttagaaatgctcgaaaaaattcaaaaactacctaaacttattatgcatgagtatagaaaccaagcattagctatgcaaaaaatagaaattggactcaaagaaataaatatatttaaatgtcaagaagcagagaatttatcggacctttctttttcaaagataaatgaattccgagaacaagtgctaaattatagatttgacacgagaatgttgtataataaaattaagataactgcactaagccatttgtttaaacccgaaaaggaaatatttctctcgccttttagaatttctccagggaaagaacttttttacaacatgttccgtacagaacccaaaaaagaaatttttaattctacattttacaattatatttagcacaacctatcttgcgtaatttgaagatcatttacaaataatcacaccatattcttttttgaaaattttttaatttctctttagaaggaataagtaatttatttaaaaaaattttccttggttatgtgctcccaacagcgataaaaaagaaaaaaacaatcgttccgcctaatgttattccgttgaaaaaatcttacgatttttttatatgccctgaggcattttgcgcaaattaaaaattgaaggacgaaagaatgggctgatgtgaaaaaaataaaaaacatgtttgaggcgcaaaaagaagttgcgttatgggtaatataatgatgaaaaaaaacgttaaaaaagagaatagtgtaaaaaattttcattataaataacggggaataaacataactgactatcacaaaaatggcatctttgagcgtgtcccattgctctgctcacccaaacggttattttttttaatttttataattggtttaataaaataaagatgtttgcacaatgtcatttgaaccaattggccaacttcctgagcttccaactgtgcgatactttgagtgtaaattgataggcaccgggtggttatataatttgtgattaataatttattatttctttagcgcgttcggaattggttttgcctccagaaaatatgccacccacgaatttgtggggtgggcttttgactcaataggctttgactcgatgggcgatgttttaggtagtatatgctttaaaattgtcgttttttaaccaaaattgccgtctttattattaatatcatttaggccttgaagaatttggcggaccttcggtgcttaaatggtggaccatgggggcggatgatgttgtgggcgcagggttttcgggcagttctccatttttcactttgaacggagagatattacgtaatatttcattcttttttaatgattttttttgtttgaaaggaattgatgatgttcgattggacgtcagccattttgcctttccaactgtttcgatgatcggcgcagacacttctgtgttggttaacacgggcccgatttttttatttgatataaaccaaatatttatgccataaaccaaataggcccgtaaccaaaaattttttagaagcctaaaaaatttctgaatttattttggaaaattgtcaattctaggagaaaaaatttgtttaaaaattagttaactgttgaattttttcctattcggagagaggtttgaggagaaatttcctccccttggtaactggcaaaaaccaaatattttattatttgttgttgttgaataaaaatgttgaactaccaatttttaattttaaccaaattacattaaaaaatgatcatactcaacaaaaaaaaacagattttttacacaactttcaaaccattgttctattctaaaattttttgtcataatatttatttaaaaactgattttatcaaacataaatatatagcttacaaatggctaacataatcttgttatataaaaatgctccacaataatgaaatttacttcccaaaattaaaatgattaatcgaataattattattgttattattatcataccattaacagatctcactcatcaaagtttggtttttttttgtgacggttatccctctttttactcggcttcgatctttgtgttttttatttaacaacagttcaatccaaaataaattaggatttaaatacattatcgataaatttttgtaatccgttaacggccttcctcttgattcgatcttccgtattagatacgaacgaaatgtcaagcttcatgatctttgtgtttttgagcccatatttttgacgaactaaagaatttgaaacacagtcattttaatggttttcgtcccgatttgtatctaccttggacatatttcggactggtttcgacaatcttagccaaatgacgcgcaattggtctatttaacatcaagtcgaagatagcttcaactgttaccaattccgtaaactcattagtttgctccaaattttcgcaatcttctgaaatcgtccattcttcatatccgggccaccctagaaaaatacaaatttgctctaataaacctttacacaataaaattattattaattttatgaataaattatttgttgttttttgaataaattcatatacaaaatcttaattatagtattaatattaaatataaaagagacatgatggcgatgggcgcccaaggttcagatatgaacccagggggaacccgatttcaccctgaaactccaagggtcatttcgttgtgacaacgaagcgaccccaggagtctcaggggcgagagtagacagaataaaagatatggtttattataaaattattttcattaaaacgtatataatttattttataattgattaattctcaaaatatatttttaattcataactttgattaataagaaattcaatagataaaaaacatgccatgaaatgaaagaaaatatgcttttctattattttggtgtacataaacggcatgaactttgctgatcaaatagcgaccgtgctcatccggtgcaattctgctgtccggatttccttcatcaatttggactgccaacttaaaaggcggattgataatttttattagagcccggtaaaaaaaatttccgaaggcgggagcaggagttaaaacttttctgggacgggagtcccgattggggatcccataaaaatcctgctgccgttacaatcccgttctccaaaaaaaacgggtgcgggaccggaaatatcgtaaaaatcccgcgggggtcccaatc

SEQ ID NO: 796 - DNA, 3998 bp, Heterodera glycines
atttttaattttaaccaaattacattaaaaaatgatcctattcaacaaaaaaaaacagatttttttacacaactttcaaaccattgttctattctaaaattttttgtcataatatttatttaaaaactgattttatcaaacataaatatatagcttacaaatggctaacataatcttgttatataaaaatgctccacaataatgaaatttacttcccaaaattaaaatgattaatcgaataattattattgttattattatcataccattaacagatctcactcatcaaagtttggtttttttgtgacggttatccctctttttactcggcttcgatctttatgttttttatttaacaacagttcaatccaaaataaattaggatttaaatacattatcgataaatttttgtaatccgttaacggccttcctcttgattcgatcttccgtattagatacgaacgaaatgtcaagctttttgatctttgtgtttttgagcccatgtttttggcgaactaaagaagcaacccaatcattttaatgggtttcattccgatttgtttctaccgtgatcatattttgggcaggcttcgacgattttagctaaatgacgcgcaatcggtctatttagcatcaagtcgaagatagcttcaactgttaccaattccgtaaactcattagtttgctccaaattttcgcaatcttctgaaatcgtccattcttcatatccgggccaccctagaaaaatacaaatttgctctaataaacctttacacaataaaattattattaattttatgaataaattatttgttgttttttgaataaatatacaaaatcttaattatagtattaatattaaatataaaagagacatgatggcgatgggcgcccaaggttcagatatgaacccagggtgaacccgatttcaccctgaaattccaagggtcatttcgttgtgacaacgaagcgaccccaggagtctcaggggcgagagtagacagaataaaagtgatgttttattataaaattattttcattaaaacgtatataatttattttataattgattaattctcaaaatatatttttatttcataactatgattaatcaaaaattcatttcttaaaaaacatgccgtgaaaggacaaaaaataggctcttctattgttttggtgtacataaacggcatgaactttgctgatcaaataccgcccgttttcgtcaggacctattctactgtccggaattccatgttcaatttgcactgcccgcttaaaaggtgcggattaatactttttattagagctcggtaaaaaatttccggaggcgggagcgggagataaaattttctgggacaggagtcccaatcggggatcccaaagaatcccgctgccgttacaatcccattcaccaaaaaaaaacggaggtgggactgggaatcccgtaaaaatcccgcgagggtcccaatcaccgggctctgataattatttattatacagaatttcccgattcaatttttatatttcgcttttctaccggcttcggcttattccgtttgtttgctcgttttcgttgttgttttgccgtgttttttgcccgcttggatgttgttgaagtggtggcgaaagtcgaacttctattctcatcgtcaatgtcggactcggcaccaacaatttccacagttgcaccaatgtcgagaaaggccgagttcacgtcatggcccaactcaatttgctcttccgtctcatcgatttgtaaatttgcagcaattgagtcccagtcattatcctgaacaaatttcaagctaacgactgagaatgaatgtcaatattttttgaaaatttgagtgtaatttgttaaccgattttctccaaaaaaatgctaatttattgttaaacccaatccatattttaagaaaaataaagaatttatggacgagcatgaaatttttggaattaaaaaagcaaattttagccgttctttctaccgtctcttcctacgattcgacaaattttcctcacaaatcgggattgatcgatcataatttgattaatgaaaatctaaaaaaaccaattgaattacctatgagaaattttgtataaaattttgttgaatttcttatttgcgacgctgactttttttcacgggcctgcccacctcccctcttacaaaattcttaaattttttgatactgtttaaaaattggacctaatctccaaaaaccggcagcgccttcggtcatccctataccaaatatatttaaattgacttagttttattaacactttgagatttgacctgttgtgtctacatggatttgttaaaatttgccacattaatatattttttgtcaattaattataatcattcagttttttgattctgaaaccaagaaatattcaccgttccaaaattggaatcgtttggccaaatttgctcatcgatcatgttgaagatgtcgttggctccatcaagacgagcaaaatttttgatggtcatgttggtgataccttggatgttgtcatagtctgcctgaaaaaatttaatgcgtttagttaatcattgctttaattttagaaaataactaatcgtttttaataattgtgaaatataacgaaacctgaaaattgactgaatatggataatttttgaaaaaattacgaaaaatggaaagtgagtcgaaaagaataacaaatattgtcaaaaatagtcatttttgttgaacaaaagaaaaaagtattcctgcccattttttggtaccgtatgaatttcatcgtagttcatgccgggaatgcgttttgcccctccacaacgcgccaatcggcggatgaccggcttggtgatgccttggatgttatgacgccctgtctaaaatatgaataggtaataattatatatgcactatttggaaaaacaacaaaaatttacacatttaaacaattaaaactttatcacaaatgcattagtggccctcgaaacaaaatttaaagttcataaaattttctcttaaattgttttaaatgaacgtggtttggaatagaagccgtaaattaagtacataaagtttttttgcaattattctatttttgctcactttacaaaagcctttcgcgcctccctttccgcgtctctttcctccattaatgcatccaaacatgttgaagacagttgggaattttaaaaagaattttagaaggtattgctaaaaataaaattatataaaacataatcataaaacgtaaaatgtaaacggagaattatctccgcaatttattgaagttgtaaaggaatttgcggatcgatttgtgcgcatttggattggtaggagtacgaccaagggggacaagaagagcgaagcgggcgaacgaagggagatggtgagggagggctgtcaattactgcgcggaatgttttgtgaaattagggggcagcagcaactgacgccgtttgcaactatgtaaagaaaggatgggaaatggaatattgaaaaacagaagaaaggatgtggaagggtggaggggatggggccaaattttggggccggaatttttcagggggtggtgggttttggtaaggcaaggcgggaaagcactaatagggtgtttgactcacttcaaaaaataattccttacacaaaagttttttacaaccacttattgccaatctaatttcttgcagattgaaagccatccattgcctgccggttctcggcacagcaaagcactaatagggtgtttgactcacttcaaaaaataattccttacacaaaagttttttacaaccacttattgccaatcaatttcttgcagatttaaagccatccattgcctgccggttctcggcacagcaaagcactaatagggtgttccactcacttcaaaaaataattccttacccaaaagttttttacaaccacatattgccaatctaatttcttgcagatttaaagccatccattgcctgccggttctcggcacagcaaagcactaatacg

SEQ ID NO: 797 - DNA, 5411 bp, Heterodera glycines
  misc_feature (1889)..(1889): n is a, c, g, or t
  misc_feature (5406)..(5406): n is a, c, g, or t
gtgagaaagagagagtgtgtgagagagagagagagaacgagagagggaggggagagagagaaagagagtgtgtgtgtgagaaagagagagtgtgtgagagagagagagagagaacgagagagggaggggagagagagaaagagagagggaggggagagagagaaagagagtagagagagagtgtatgagagagagagagaggagagagagagagaaagagagagggatggagagaattaataaaaaaaagataaattgatacagaaagaaaagaaaaacaaatagatgtgtgttacgaacacagagaaagaaggaactatagaatttaaaggacatgagagagagaggagaggagagaggaaaagagagagagaaaagaggcagaaagagaaaagtttttcaattcttaaggtttattttctgaacaattttcaggtcatttattaggggtgtattttccgattttattgcattttttatggttcttgaaaaaacgtcaaaaaggcagcaaaaaggaaaaatgccaaaaaaggcatttaaggcacgaaaatcccgtaaaaggcaaaaaaaggtataataaaagtcaatgtaggagcctcaaaccaagttgaaaatgcattatttatgcttaatataaagaaaatagtgcgcagaaaaaaaggcatatgcctaaaagtcggtctctactaatgagaaacaaaacaaaataaatagagatgtgtgttacgaatacagagaagaaggaactatagaatagggttgcaaccccgacgtcggggttggaaaattcggggtttggggttgtcagggttggaagcgtcggggttcggggtcggggttgacaaatcgttcggggtcggggtcggggtttttcaatttttgccttatgccatatagtcaaaaaattttatattattttagctttaatttttttattattaataataataattttatgtgctttttatcataaatatttttgtatagaattaattaaaaatgcataaggcattttaaaatggccaattttcagtgaaaatctgtaaaaataatcaaaattttaaatttttcatcctgcgcctgacccccaaataaaaatagtagattttattcaaaaaaaaatgccaaaaaatttctgcttattttttttttgtttttcaaatcatctattttttcgcggcgttctttttctatagacttttttttaggagaaaggggtccggcggttgccgatatgcgccgccggaaaaaatttgaaaatttggatggctttgttaacagattttgttcaaaaagtgataaattttttctattttgagtaaaatttttcaccaaaaaatttatgaatttctgataaatttttagttttttttattggttttttgtcaaaattattttgaaattcataatttttcatgatttagtcaaaaaattaaatttttaatttcaacgaaaggaaaattgggttcaatacgtcaataaattatgccaatgatgaccaatttttatgggtatttttgtttaaaaaccctataaattaaaaaagaagtcaaccaggatccgaactcatgacaaaagtagtgcatgtgctaacgcaattaccactacaccaatattacacatgaatggacaaaagcaaattactttatttaataaaaatttggcaaaatggttaaaaaaaattcaaatttgtataatttttttcttttctctcacgaaaataccattcttaggggtgtatatttaaccccgagccgagtcggggttaagggtcggggttcggggtcgtcggggttggaagcgtcggggttcgggtcggggttaaccccgaaaaatggccaaaattgtcggggttctgggtaggggcggggtcggggttgcaaccctanctatagaatttaaaggacatgagagagagaggagaggagataggaaaagagagagagagaagggtgaaagagagaggaagaaagagcgaattccggctttattgtttttaattaattattaattcaaagaccttatatttatatttgaaatttttggtaagtgtcaaaataatacaaataactaagatttaattgttcagtataataccaattaatcttgtatgctgcctccacatttccaatttccgtttataaacaaaatttattaatttattttttaaaatatacttactgtaatattttttgctttgttagatattattttccttttggtctcagtcgtgattctgctacattgatgtttttaagctatttaaattttaactttcattgaatataatttatctttattagttaaagaatattataagtttatacaaaaattgtttgtttcacatataatataatacatttttatatttattaatttaaattattcgagcttctttaataaaatataccatttttctcttcgggaaaaacaaaacaaaaaattattgcatttattttgacataatttttaatatttagaaatttctctttcattttttatttggatagtccaattaaatttcatttcttttactttttaaaagctttcattttaagattcatttcaattctttgttaaacatgatgttattttcgaaaattcagaatttatttgattattttttacatacaaattacataaatttatttccttattattggatatgtttaacatattattcatctttaaatatatatatatatatatattaattaatttaatcattctatttaattttaactcgtcgtttgcagcataatatggcgtacataatctgagtaggagaaaaatttgtaaaattttaaattttaaatagagatttaatgcacttatacatttgctcttgctctgcttgtaggatagccttttattattgattttgatatatgatttaatttttattaatcatttgatttttttatgattgtttgtgtcaatcaaagaactatttaaagaaattaaaatattgtaattagtttattaatcatttatattttaattatttttcacaataaataaaatttactgacttattttataattttttttattgcaaatataaatatattttttaaactcttgacgaaaaaaatcttttctgccatttttccaccgagagcaattcgttaccatcccattagatatataaattaaattactgatttaatactttattttttattataaatattaatatttttaattcttgtccacattcatgttatttaagtggtgaaatgttttgtggaatttagtaatttagaaaattagatttatgtaattgaagaaatattgtcctaaaatatttaaattacatctatgtttttaaatgtaggatctccgctctttttctcggcaataattttattgcctcgttgaatatatccttttaattaatctttgttaaatattaattatttccatttttttcaaataatagcaaaattttcaattatcttaaacatcgtaattgcttattacataatataattttatatgatttactcactttataacaattaaatttaattattttcattataactgatacttttttaggttcgtctcagcggggaccggtaaattggacaccggaaaattggacaccagaaaattggacaccggaaaattggacaccaagcggaaaaatggacaccgccggaattttggacactaaaggaaaattggacaccggaaaattggacactaagatttcctttttaaaaaaaatcaagaattaggtgaaaataaatttgagtagaataaatgggttaaatgagggatgattgatcaatgtgccacaaaatgcaccaaaaatgggtgacgattgatcaatgggccaaaaaatgaaccaaaaatgggtgacgattgatcaatgggccaaaaaatgaaccaaaaatgggtgacgattgatcaatgggccaaaaaatgaaccaaaaatgggtgacgattgatcaatgggccaaaaaatgaaccaaaaatgggtgacgattgatcaatgggccaaaaaatgaaccaaaaatgggtgacgattgatcaatgtgccaaaaaatgaaccagaaatgagtaataaaacttatttctttatgaatgatatgatgtttttcttctcctgaagttagaaagatatatatatttttactttgctgagacggaattggctcgacgagttcgcccctaccgcgataggcgccgcgttagaaaaaaaagaattttgaatatttttcatttgatttcactaataaatgggcaattttaggtccaagttttgaaatcttaaaggatttgtggcatggcgccgataggtgccgccggggaaaatttttatggatttttaatgaaatggtaagaaaatttgttcaaaattaaaataatttttcctcttttccactttcgctggcgacccactcccaaaaagggtcatcattaacagcgtaaaaatttctcggtttccgagactaaaaacccgagaaatttcccgagtcgggaaccgagaccgagaagcgaaaaacgcgagaaatttcccgagtcgggaaccgagaccgagaagcgaaaaacgcgagaaatttcccgagtcgggaaccgagaccgagaagcgaaaaacccgagaaatttcccgagtcgggaaccgagaccgagaagcgaaaaacgcgagaaatttcccgagtcgggaaccgagaaccgagactctcgcacagcactattatttatgttgctctcatctcatgtattcgaactcttgtcggattccaaaattcgttctctgtgcatttaaatattttttgtaattaatatttatttataaatataaaaataattttaaattaatattcttcatttaaatactattttatatcacaatgtcttactcatttttttactaaaataataataataattaatctcaacagtttaaaataaatctcttattggtctactgggatttacccttggtgtagttggatgtctacgtgatttatttgcattattttgtgagaatttcttatttaaagaatattataaatttattgtttttctatataatactaaacattttcttaaattgtattgtgtatatttttaatttttcttggtgagctgaaaatccaagtgtaattgttttcgttgcagcactacaatttgttttttgttaaaatgttttaatttatattatgtaatttcatattttaaaacaagaattcttttagcgttcttaattttttttttaatttaaaagtttgctttagaagggttttagttttatttaaaaatacatttcaaaaatgaatttattatatatttaataaattcttgtcattttatagtttaacaacttgtgatgtgtttggattgacaaactaatgtttttcatgtatattttctaattaaattatttttttaaanggact

SEQ ID NO: 798 - DNA, 1875 bp, Heterodera glycines
agagtgggtgatgaggataatgatgatgatgatgtatgtttgtggcacgtctcgccgtcctcaaaagtccattcacattcattttggggtgccaattctgcagatggtagccaccaccgccgccggcagtccgaaagggtttcgtcatcatcgcggtatcatcgcggcacagaaagggaatttatttcttcggctgggttggctaatccatggcttaatctcccagccgggccgcttttcggcaccgcaaagagaagcccttgggtcggcaaattgtatagcgaaatgtcgctcgccaaattattgagtggggtatcatcagtgagctgaagcaggagagaattggaacggaaattgggggggggggagcaaaatgagaatatatgtcttaattttgtgcttttaagagggtcaagaaatggtgaagaaagtgaaatgtcttcccaaaagatattttatttatttttatttctgaataattaatattttaatttacattaaaatcgagaaatattttttaaattaaattttattgaacaaatatttactttttgatatgacttcttaatttttaaaacaattatttaatttaatttatttttttgagttgagtaatatttattgttagtcttttgtttttgctgcttccttctcttttaaattttaagaattatataaatataaataaatctctataaagtggttaaattttaaattggtaatttttttttttacttttcaggtttcccgagaatcttatgaccaatgcatgcttcaaggtcagcttaatatttaatttaaaaattttgaaaaataaatccacttttttctatttcctccaaatttatttatccatttcaatcaaattattttcattaattaattagcgtaatgagtataaatttcctaattactatatttccaggcataggcacaaaacagctcggcgtttgctcgtcccctgaacgacaatcgtccattacgctggtgttccgcgatgtgtccccgctgccgtccgcgttcacttttaggccgggccaatcctacttcgttataagtgggataaatttaaaaattgattactgtattccctaaaatacagccccccccctaaattatagccccccccccccctgaaataaaagccctcttctgaggggggggggggcttgaaaaacaaaagcctccctgggctctatttaggaaaaacggtaatttaaattaaaaaattcttaatttttgaaaaataaaatttttctttaaaaacaaaataatatataataattataacattagaaataattatacatattaagttaaaatgattcaacctcaaaatatccagaaaaagctatataattgattttaaaaaattgcaataatttcaaaaaaattttaattttcttcgaatattctcaaataataaaagaggatcaatttgatgactacaaataattaaaaaataataattagatttatttatttttgactcaacatttttgttcagcaacctcaaacggcacattgatgggattgaacaacactgaaggtggactgtgtgccaccagaaatatgcggctcaaatttgacgttttgtccctggccgatgaagcggatgccaacaatggtacggtaccctaaggctatacctatcgccctggaatttaaaaattttcatgaaatttttgaaaatttcagatacaatgcttcaaattccgcagccacatcatgcacatgctcaccatcatcatcaccatcaccaacatcatcaccaacaacgctatcatcataaagcattggtgcacaagcagcaggagacgcacaggtaaagatggggcgggtcatttttttttattagcacaaaccttttttttt

SEQ ID NO: 799 - DNA, 5699 bp, Heterodera glycines
tgtacagatttttcaaatttaattctttccattcctcttattttgacatttttaaatccggttttggcattttgcaactgattattttgaaatcaaatcttcatacaaaatctcgattctgctaacaatttattgcttaaaaatggttaaaaaattgttattatttaatattttttggtgaaatttccgcatattctttttaatttttgtttaaaatttttaaataaatttttaattcattttaaatactcaaaatttttcaaattccaaaattcttcagttccatccaaaatgaaagcagcaattatccgccctttctctatgtgattcacacttcggaaatgtcttcctcaccacatggcgacgaggacgagggcgaagaagcggccgctgcatggggccaagactcatacgaaacgggggacgaaaatgaaatgagtgggaaattttgacaataaattaagcaatttcattgtgctttcattagtaaaaaaagtgttttgtggccattaaaatttcatttaatttatcataggtccaataatagaacccccgtaattctaaaaaataaaaaattttagcgggcgggggtggggttaagaacataaaccgagatgggagcaactcgtccccgaccgcgaaaaagaaaaatctttcaaaaaagaatattattaagataattacaagaaaaaaaaaatttttttttaaacaatttcaagggaatttttcaaaattttatgaagaattactaaatttttccaaaaaaaaaaatcgctgaaaattattaaccttgaattttcttatataaaagaatttgtaaggtttttttaaagtctataaattttcaaattataaaaaattttgtggtggggggggcgtagtacatacacccaaccgaatcagccttttatgtattcctttttctgcttttcgccccaaaaaattttttccgtgactattttcctcacgagtaaacgaagcatggaaaaaaggacaaaggctttatttaaaacttaatttcagtagtttttttcctctttttcagcttattattcatccgcttcatccacttttacattgatcagaaagcattgtggttgttgctgtttttgttgtgttgatcacttgctggaccaacaaaatcatctgctgcagatgatcccaaacacaatcgccggacagaaaaatgccaattaattttcccaatgataattaccaaaattaattaattatacattgatgatgctcagaaaaccggtttttcctttttacacatttttaaatttattcgaaaattttgtttttcctatattttaaatttgtattttttaaattaaattttgtacaatttttttttttgcgtaaattttgtttgaatttttgacgttaagccacattcattttttaaatttcccattttttcattgatcatttttatttgacgggcttcttcggtccaccgctgcctttttgtccaatatttattgccttgatccgcttcttcttctttttcatgaaacagaggaaaagcattcatttccctctccccaatctttccgccgttcatgacggaaatccccccgccccccaattcggcacctacgcacaaaacgtgccaaccgatcggggcccagcagctgttcatggaatttggtggggggaacatttgtgacttgaagcacatcccgaatcattattttgcctcagggcataagccaaaaacagtgccaccgcctaaggaagagctggcaataagcctttaagccggcccacccccggggggaaatgaaatcggcgccaccgtcgcctttctatcatcagcagaaagcacacatacatacaatacatacatttttcattcaccacacatttgttgagtaatcgaatgttttcttctgcggggcccaatcattctcactgctttagaagagagcatcacattgatcagtgctgactgatcagagcggaaatcacagtcagacacaaacatatgagtagggttgtggtgagagagtgtgctgatcggagagagccagggttaggcagcaatgttgaagttagagagcaaaagtcaatgctgatcacccaccgatgggaaatggctgcctttaaatctctgtgtgtgtagaaggggtgaggggagagagcatttttttctttactctctcactctctctcgcttccacctctctctctttctctctctctctgtctcctttctctctcctcgcaacttttttttgtggctctcaagttctcaagctaacactctcacacacctatagctgctttccgccagccgggataaagctgctgctgcccttgcctttgcttgctttgatcagtgagacgagagtgccagggagggggagggggaggatgaagcataagagaacaccgagaggaagtgtgagcaaaagccgagaatagacatgtgtgagtgagtgagtgagtgtatgtactttgtgtgatctctctgcctgcttctgatgctggtgggtggatcagcggatgaaaagccggggctaaagcagaggggacgaggacaacgacctctcaaccgcccgatcacttttcgggatcccctcagggcggagatgtgcttatcctaaacaatcggcttggccgcttgaaattttatgacccaatataccatccatccgccactaattgctgctcttaatgttaggtttatgggcataattaatgcgaaattttaccgtcatggtttcgagcagcaccatcaccccacttttccatgacaagctgacagtttgtttatttcatgtaataagagacatggtactcgagagtctcgagtcgagactaaaaagtgtaaaatgcgaaggtgtgccgaaaaatatttatgcccaatttttctaaattctttataccgagcacctcaataaatttttcaatttgtttttaaattttcaatggcttaagtttatatatttatttatctttcacattttttacacaattttgccacctaatgttttctctagttctctctaaatatcacacaaatgcacttttgcgcactttgatcctaaattcacaagcggcggatcatccgatcctctgctgctgggctagccagtagcagcgcatgcaccacacctgatgaaataatgatcagttttttagttcatcgcccaaagttgtttgtacctcgcgctatatcctctctatatccccctcccgcacaaaatcaccaaaacttggccaaacaatgatatttttgaaatgcacaacggggcgggccgagagtggggaggggggataaagccgccgcgcgagtttggtttggcccccgaggggagggcgaaaagccgcgcaaaattcgtccaacaagaaaacttttctgaaggaatgcttcatcccccaggccgcccatcgcataggacacaaaaatgaaaagccaagccgataagtgctttatggctgcgcaattttttatgtgttggtcaaccaacaaaaccaccgggagcattttttgtgtgtgtaaacaccgcgcgcgcttgatcagtttaacgaaaaaatgcgctgcttaagcattcatttttttggaaaattgttttttcaaaaacaaaaaaaaatatctctacttgttttttaggcatatgacacgaccctctcctccccaaaaaaatagggaaaatatttgcttaaaatttgctttttcgttaagcttgttttgtatttattatctgtgttatagggctattaaaagattaggcctttctttatgttgcccggcttaaaccttcaaagggtagagctcaaaatttttgtagaattcttttttaaaaaaaaccattaatacaacaacaagcttaatgtaccttaaatttgggttcttccccgaccgaattttaattggatgcgagtgttttttaaatgagttgctatgtaattgtaagttttttttattttagaaaaatttctatcattttttttcaactttttatgcaaatttcgtctccctgacgaagttgttgtccccgacttcctccatgatccccgaggagttgttctccccggggatcgggcagcaaccttactgaaaattttcaacctcgggcatcacttactcactcattttgtatatataataattttttcaccttttaaaattttgatcacatctcaacccattaccgttaaatattgatcaccaactgatcagagtttttgtctcccattttctcagggctaaagcgagagacaattaattgattgcttcgtccattgcgagagagagcacttcaagacgagagcgtaacagacgaacaaacaaaaatgccgggcgcgccccgtttcacgcagaagccgtccatacagcagaccgcgcagggcgacctgctgatggagtgcctgctggaagcggacccgccgccggaggtgcgttggcaacacgcgggcaccgccatcaacgcgtcaacgcgtgtccaactgacgctgatcaatgtgtcgggcaacatgtacagggccaaccttgtgatcaaggtgggggtaattagtgttaatgcggcgctaattggcaaagtcatatattttgaattttaaaatcaagagtggacccttgtggtttgcaaaatgtacaatataatttttgtttaatgtgtttgattttgcctatcaaaccatttattttaaaatttatttttaaaaatttatttcaccaatataaagcaaataaaagtgatcagcagaatcgcacatttttaatgacttttttgtaattaattatttttgttttatattttttaataaattttgggacccataataaaattgatctgaacagcaacaaatttttaaatgaacacaaaaaagacaagaaaaagcttatccaaaaatgtcacaattttgaattttatttatttatttttatgcattttttaataataattcatttttgaggtatttatttaggagtttgatcttttatatagtagtttttcaaaaaagtaagtaatcaaagcactacaaaatttaaagagatatatcccataaggataaagctaatatacaaaaggaaaagctacaaaatttgaattcttttttttttattttggaacccatattttttgtttggcatttttagcaaaatttcgacacccccgcattttgttaaattcgacaattatgttttaggagcccagcgcttcggacgggggcgcgtacaaatgcacggcagcaaacaagttcggagaatcaaatgcaaacatcaatttgaactttgccggcggggaggaacaaaagtcgaccagcagtgggtcggcaaaagggccaacatttgttggcaaaccgcgcattttgccacgcgacggtggtgcactgattttgatggagtgcaaagtgaaaagtggcacacggccaaccgtcaagtggagcaaggacggtgagttaattggtcaattaattaaaggattgattaataattaattaattcggtatttatgttgattacggtgggttaattgacaatttaatcgatgaacccttaactaattaattgattggttaacttaattgtgttaattaatttgctctaattctcataggtgctccactaagcatgggcagcctgtaccaagacgtgttcgccgaccttggggacggcacctatttatgccaactggagatcagggtaagtaaggtcatctgctgatgcacaagtttagaaagaa

SEQ ID NO: 800 - DNA, 1969 bp, Heterodera glycines
gaagaagcatcgcgaaggcacgccgggcgagcaacggcgacggcacaagtccaagtcgcgcgagggctcgccacgcaaacacatccggtcgagaacggcaacaccgacccaggagggggcgagtgagggcacgctgaaactgccgggcgaccagggcgagaagagtcgggagccaacacgtaaacaatggcacacttggcatggaagtggcggggccgggattagctttatgagcgagtgagagtgatcagagcatttgtttggcttaaacaatcttttttcggcggtttattccaaaataactttttggcattttgtcaaggtacggaatgacagtatttaaaataatagctataccgtacatattcccatgttttcctttaccgtatatcattccttaaaaggattttaagatagttttttttatcccaactaatatactgtaatcctgtgtgtgatataggacgctattaactgtatatcccctgtatggtgtctcaatatttggtcctgatcctgtaaccattacattttccaactcccgccttagggctgattgcatttaaaaataataataattcgtttaaaattttattaaatttagcaaaaaagagccgccgtgaagctggtgacaaagaaggcttgccgccggcagcgccgaaagagaaaagccgccggagcagaagcaaaagcccagcagttcaagtggcaggacctgaagcacacaagagaccaccggtggtcactgatccgctcaagtctcaggtacagtaaattctgatcactttttgagaacagcttttaaagtgattcaatttgaatggaattgcaaacttaaaatttgatcattgatcaaataatctgtcacctggaatataaattaatttgctttatttgatcactgatcaaaaaaacatataagtccaaaaactgaaggctcacccttgattaaattgaattgatttggcttatatccaacctgtataatgccaatgtgtattgattgacaaatcaaaaaattttgttccggtattttaaacctaaatttcagtttttaaaaagggttttccattaaaattaataaaaaaaagcatctgattcaatgatcagatcagatccaatttcactgatgaatctgatttccctcttttacatttgataaaccctcaagtttctccattttgagggcacctgtcctcctcggcatttttcgggccatcaattttgggggatcctgaagaaaattggatcaaatccctctgctgttcatcctagactttttattgtgaaccccttttcgtgtccattgtttgccaaatttcgagagccttgagggggttcagaaaaaaatggttttggcaatattgcagacagctgttttggcgatgtgtttgttgttgttcttccgggtccatgataaatcaaaacttttttttgagcgtgaaaatattgatggaaacaattaaaattgttgttaattagggaaaaataaaaaactgaattgataaataacaatattttttaaactgacattttcaaataatttttgttaattttatgagaaaattttaaagacatttcaactttattagttttttaaaaaataataataattttactttattttgaattattctatataattaataaagcaaataaattgttaagattgcgcacaccggtgaaggtgtgaaattagagtgcgaattgcaatgtcacacttcaacaaaaatcacctggtcaaagtgagttgtgctttaaagttgggcacggggctaagtcgttccacaaaaaactcagtgatcgataaaattaaataaataaatttaattattcaattcacaaaacacggtgccgtccggttaatactaatgtacggtgggacgcaagtcattttcaattttctcatttttgacatcacttctcgccaattttctccatttgtagtagacatagcctgacgccattg

SEQ ID NO: 801 - DNA, 4446 bp, Heterodera glycines
  misc_feature (4436)..(4436): n is a, c, g, or t
attaaaatttttattggatttttaaggctgaaaagatggaggtggacacgaatggaactgctgcgcagaagaagcggcgggtgccctcatccaaaaaggaagaggagaaggaagaagaccaactggtgccggagaagcgagtccaaatccatgtgaggcctgagggcaagggatgttgagggattttaaaaattaaaaaaaaaatacacatttttatattattttccaatttcttaattttaagagtccatccccttcggaaagcggtgccacaacgccaacaaaaaagggcggcaaaaaatattccggaagtcgccactcgacccaggaagatgtgggttactgtaattcactaaacaagtttactgtacaattctttaagcattaaaatagtcaaacagcgttttatgattttttaatagtctaattgatttcgaataaattagtcattgattaggggaggagggtaaatttaagaagcagactccataatgatttttctttttgaaaaatttaaaattaaatctttggtcccaaaaaataaacttcatatgattaggtaggtaggtaatttaaaaatagaaaagtttgtcgcggcgcgccaaatttttgcgattcaattagaaacagtcgtcacaacaattagactgaatgattgcgtgccttccttcttttatcacatcaggccagaacagctttgtcccaaaaatatatggtgttcttcttgtgttttatgcttttgtcgacgtgtcgccaaaaatattttgacgcgaacgccaaatcaaaaaaaaaaattttttttttgtcgccgccaaccgctcataatttgcacagcatcaaattacacacacacacacaccgcacatgaagtaaatgggggaattaggaccttagataagcggtctggggttaagcttttttgtggatacaatctgcgcgctgatttcggcggatttgcccctctgatcagacacattaaagcctctctcctctctgatcagcgttcggccgctgaaaaatcgttgttttgggttgggcagaggagagattagttcgacgaaacgcgagaagacgcaacaaattttgtcgaaaagcattgatcgaagcaccaccaccaccacaaattcgagagtggattaagcagcattttttctcgagagtgactctcgacggcaaaataaaaaaaatgtcatggaaaaacgcggacagcagagagtcattttcgtccgcctctgactcaccattgtcccacccgttggacatcattcacgaggaggcagctggcccgtcaagtccgagcagtacaacaggcggcggcgtggaaagtcatgcggaatcgttgtcctcagtttctcccgcattccgaagcccaacaccaagccatgatcatgatgtcattgcacatggaggacatgccaagacaacaatcagcaacaattggacaacactccgaaatcatacaaagaccacaacggcgccaagcagtacaacggcggctacacggaatgggaccaataacaatacgctcgtcaagccagctgcagctgcgccaagcttccggagcgccacccgggccaagcagttgcgtgaagaggcggaagaggaggcacaacggaaccgcgcagttgcgcaacgccggatcagcgcggtgcatgagttcgtgctgaaccggctgccacgccgttcggtggccagcaacgcaattttggacaacatcattgacttccatgctgcgcaaccggcactgccaacggtggaggtggagcgggcaaggagtaccgctgagccggacgtgccatgggcggctaagcgccggaacagctccgtgtttaacgcggtcggtccacacattcgactaaagtgccaaaaactgtcatcaactaatcacggcacgacttcaaccgaatcacacctaacacgcccaggcacttgagaaacttttgccacactaatttattcgaaatcatttcctcgtttttacaactcgagaatcttgggcgataatgtgggaatatttaatattaagttaaacgaatttttaacttgaattaattcgttataaaaaataaaattaatcaaataatttattcattttaattatataatttgtttccctatattaatccgagtataaaaaataattttttaaattaatcaaaaattcttttaacatgtttttaatccgactatattaaaaatgactttcaaaaatttttttaattttgtttgttttttaaaacgccgaacaatgatcttccaaaaattaacatttaatattggattttaatgtttgtatttatattttcaaaatcattttacccgcgctaagccttaacaaacattgtactaagaaagtcttaatttaaatttaaaatatttctaatcataataataactgttttaaaacacacttccccaaatttaatttaaaatatttataaaaaccaaaataactgattttttaaataattttttcacccaatttcagatttcacaagtcagcgacgacattccggccagcggactgaaaattccgccggagcgtcgccgtgaactgctcgcgctctccggcgggggtggcgaatcggaggacgagcgaacgtcgtccatttctgaacaaccaccagcaaaaaaagcgacgacaacaatgaaaaagccatcagtgaccatccaaaaagaggaggaaaagcagccagcacaagccaaatcaaaatcgccatctccgcgaccagcaaagtcaccgtcaccgaatccgaaagaggtgggtactgtacaaatggtaccggtgccgtccgcgtgcatcattaccatattccctccggcgggtcgccgggaagtggtcgaccaattcggcatttgcttctactcttttaaatgcattttcagtgtgtgctaattagccacttaagtattcatgatacggtgtcctgaatttgatgagaccgtaatcatcgaaaattccgtaaatttatgagccgacaattccaacgcctaatttttgcagttttttccgtttattttcattttgaagcttttttgaattaaattgcatatattttggcagttattccgttgcaactaacaaagctaatcaacaaaatgccaagtcaacagccgcggcgcgtaattttgaaaaaaaaacgaatcgcattttttggatggaataaatttattgcgatcagttgccctcacataatttattggcggtgaaattgggtgcttttgtttacttatcccctccggggtgcctttcatttcatatcccccccccccctagggggaatgcctttcctcccgctgcattttgtgctttttctttttcattgagcgaaatcaacgcttcaagacccgactctccccctcacccccgcccattcgtcgatccatttttttcgcactttttgccactccaagcccgatcatttgatgaagccgccactgatcggtggaagcacaacagctccagcagcagcagacggacgacgacccgcggatgaatgaatgaattcgttcagcaaaattcacatcctctcatctccattcatcaactggcattcttccggtccgcatggcccatctgttccggccgacggacgcttttcatcatcactatctcttctgtccctccccccacctccacgtccgccgccgccctccgcggtggcacgacgacgacgtgccttcctttccccatcccccatcatttcatttttgaagcaattcgatatcttagctaggtcactgctggtggcaccaatcagttagttagttagctaggccacaagcaatggcggcaaggcttttaccatggagaggaaaagcattggtgcattaaagcatgagagaagcagagagagaaaagagagatagggagaaagagagagaaagcagagaaacagacggagaaagagaaagagggaagagagagggggagagagagagaaagagagagagagagagtggagagagagagagagaggggagagagagagataagagtgtgctccaataaaatttagggaaacaaagatagagaaagcgagtgataagagtgcaacaacaaaatcagcgaccgctgcttgcaaacacaattgggtcgaatttttgaggtggcatgggcccggtctgagcggggaatcaacggatgagaaatgttccgatcggtgtccgatcccgatcgatctgactgatccaatcgttcccctccccaatctaccatcaacccatcatcatcagcacttgatgatttttgttgtcccaacaaaattttcccgattcaagtgcctttttcaaaaacattcgatggccaccgttcttttccctttagttaatttaatgttctgttctcatcaaataatccttcattcattcattaattcattttggattaatgaaatctttttcggaaaaggtctaatcacttttactaatctcangatacatcca

SEQ ID NO: 802 - DNA, 1429 bp, Heterodera glycines
aattttcccgattcaagtgccttttcaaaaaacattcgatggccacgttcttttccctttagttatttaatgttctgttctcatcaaataatccttcattcattcattaattaattttggattaatgaaatcttttacggaggaaatctaatcacttttactaatctcagatacatccataccaaaaaattgatcttttttgttcgagatcccttattaagggggttgtgacttgaaaaaaccggggattaaaaattttttggaatcagaaacaagaaaattgcaaaaaatcgggaaaactttattctaataatataagtaaggcccattaaaaacaatcaatcaatcaatcttaatcactgatcaatcttttacgaatcagactcaaatcacacctaataatacactggattaaaaaaaatcccgcaaaattatggttcaataaatgtcgggtcagcaccatgttccgcgcacccatttccacgtaaagcagcgagacaacaatggcattgcggtaacgaaaaagaaacaaaaatggcaaaaaaaattttaccaattttaattgaatgccaaaaatgaatgaatgaaagttcggtccttttttttggttagggtagcatcagagaaaggggcaaaaacgagccgagaatggccacttccatcagcaccacatccggcattaacggggacgaaagtgggccttccaagccggccaaaacggcacggtactcaccagttggaagcgtggccaaccgttttgagtcgcgcggtgccaaatcatccgtgctcaccgaaatcaatcaaacctcgttgcgggtgaccagcccacagcgcaaaaacgcttttccactacaagctgctgctgctgctgatcaacaagccgaaacttctccaacaccagaatatgtgcccatggaggaggttgagttgttgatacagtaatttgaatcatgggttttcgcgcgcgcggtaaaatttaaattcgaatgaacggcgcaagaaattttttaaatgctttcctatggcacagcgtttttctttttgccaaatttacgcgcaaaaaaagcattttgataaagcaaaggcatgcacttgttgagtgagcaattttcttgtcgtattattgcgtttgttctttgtccacagtgacactcacttacagtatactgttgtgtctaccgtatgcaattttttgtttgaaaaaataccctcgttgcttgccttaccacctccgtgctcaattttttggtttgattccaggccaacggtcgtaccccaacaatgatccaggttggccgtaaaaagactggccaagcactgatcagcgagccgacggatgagtaccgggaaagctaaaataaaaaaaacgctctcaaaaaagccttacaatcgatcaacaatttggatttgtattgtgaatggaatgtga

SEQ ID NO: 803 - DNA, 1969 bp, Heterodera glycines
  misc_feature (1894)..(1894): n is a, c, g, or t
  misc_feature (1899)..(1899): n is a, c, g, or t
  misc_feature (1932)..(1932): n is a, c, g, or t
tcccctaggccattaattaaaatcagaaaaacggggtttttgagaattaaaaaaatttttttttctcttttactatctatcacacggaagaaaattattcattttccctaaaattattgcaaaattgcccctccctcactttattaccattgagttaagtttgcttgaattaggctcatttaaattagcgaaatttttttgaaattgaaatttccgatcgatcgaaagcttttttcgtgttttatcgtcgtatcgtcttatttgccatttttttcctttttgcctttttttaaatttttgctcttcaaaagcatcccaattttgtaatcttcatcttcttcatcttactcatttcgtccttcttgatgaagaagcacttcttctaattttgtgtttatctgctgcttttccccttgttctccctttgtttgctcaattttaaatgtttccccacttaattaattaatttttatttaattacaaatgtttattttttgttgccaaacttcatcattataatttataataatttttattttacattttattttttggttgaaaccctttaccctattctgttcaaataattcaacatgtgctactaataattcccaataatgatatgatgtcggaacaggtgataagataatgattctggtaaaatcttaattagttaattggacagtaatttttcgactaaatttgccataacttttcttaaaagcattgtgccgggattaaaaaattaaaccataaaataaatttttcgtaaattagggttactcaccgaaccatcgggatagaaatgtggcgggaccaggacaaaatcccccccccccaatcatttgtcgagtttaggttgagaaaattccgggaaactccctcatcgggaattattcgtaaaaataaaaaaattaaaaaaaaattaaaatccatgttcctcatccccatgccaaaaatccatcccacccacccacccacctaaaacccatacaatctcccaaatgcacacacacacacaccacaaccacaaatctcacccaggatggcacacagttgaagcgcaactcaatgcaacgcctgcaaggcgtccaagtgggcaagaagcgggtggagcacgagttcctccaggtgcagctgaagaaaacggccaaaaccaagaaggaggaccaaaaggaggggctggaagcggtagacttgaagcaccgcttgtctgagccgcggcacagtctgtcaccgcgtccggaagaggtgcaggcgctgaagcgcgcctcgttgcggccagagagcgcggaggcgcgcgaggccacccagctggagcagtacaggcgggccagcatgagggtacagtttggctagacgctaccatactcaattatagttcattccattttttctgctttcgcactctctgcacaatatgtaccgtacgtaccatcacaccccctctttaatgggtcgatactgtagaatcacagggaaattcgcaaatattcacaaaaaaattcatttgttatgtcaaaagaaattcttcagccattaaactcgaggaagctttccccgattccgccatttttggcatttcgaatttttaaatattgccaaattaattttgcgagtttttctaagttccttgctgtatgtaagtgtcaaatacaataatacatacaaggtatgtagagaataattaataattacaataaatatgacttttgcacattgaaatatataccctattttacctaatcaaatcatatatttatttttcattttcttcatacttttcatgaagcatttatatcttcttccctcttttttccttgttatttatttttcaaattttcaaaaaaatttcattttctgcacccttttttcttgttttattgtgccttanaattntcgttctatctttatgataattttcttgaaccnagactctttgatatcgcaaaaatatttcagagtctcg

SEQ ID NO: 804 - DNA, 804 bp, Heterodera glycines
gaagaagggcggccgagaagtgccattgacgggccgagtgcggtgccaaacggacgggtgacacaggacaagtaagtggcaatgaaagccaaattttgaaaattttcgcgaatttttttaaataaaatttttaaacacaaatttttcaaaaaaggttgctgtttttggaaaaaaattcttgaaaacacagtcatttatcataaaattttgaaaaaatcactagaaaatttcaatttttttcttgaaaaaattttctaaaattttttgaacaattttagttttaaattcattaaaattttacattttttaataccgtaaccccactcaaatggagtacaagaaaaacttattactgtagcacatttatttctaatcttagaagggacatttacggcactcaattaattaattaattatatagctcatttatttttaaactaacttcaaaacttagcattaaatttaattaattttttaaattaaatttcaaataatatatatttttttaattttcaggtttctctgattatttccaaatgtcgaccacaagacgaggacgagtacacattgatggtgaagaatgcgcatggcaaggacgaagttggcgccaaactgcttgtcacgccagcagctgaagtgaaagaaaaaattgccctaatttaaatttaaataataattttttttttaatttttaattttcagtcaaatttggacttccgggccaagttgaaaaaacgtgacacgagcattagcatttcggaacaagaaaaacagcgtcaacggagtgatgccgagcccaaaagc

SEQ ID NO: 805 - DNA, 4317 bp, Heterodera glycines
  misc_feature (41)..(41): n is a, c, g, or t
aaaattgtttaaaaaatcgaaaaaaattcacccccaagatncggggttctgcaaaagtgcatagtagtagtttggttcaacatgtatttatattattggaatgaacgtagggcgtcttaactcattattttaagactttctatcgaaaaaaaatatagaaaattactcaattaaattatcattgctctgaatagttttttaaatttgtaccaaagttgttagagatttgatgtaaaagttgtgcaagagttgtaaagttgtttaaaaagttgtaaaatttgttcagcttttgatgtcatttttttcggaacacagtagtttggtcagggatgaacttataatgccggaatgcacgtagggcacaataacaacttattttaagtacttctatcacgaaaaatttctgaaaaattcaaaaaaatttttcacccccagaatccggcattatgccaaaagtgcatagtagtactttggtgaaacttaaatttatatgttggaatgcacgtagggcgtgtttacacataattttaagtatttctatcacaaaaaaattgttagaaatacttaacaacccctcagaatccctgcgtatctggtcaattttcagaattactgggatatttgtgccgtttccagaaatattttggtaatctatttgcagaaggataaagttcttctggttttttccccttatatgtatacggaatgtgcaactggagccggttccgtgactttgaaactaacgcctttcccgtaattctaatgcagaaaaacaatgtccgtgagtggcgaaaaaaataattttagtaccaaagttgttagggatttgatgcaaaagttgtgcaggagttgtaaagttgtttaaaagttgtaaaatttgttcagctttaatgtcattttttcggaacacagtagtttggtcagggatgaacttataatgctggaatgcacgtagggcgtaataacaccttattttaagcatttctatcaggaaaaatttctgaaaaattcaaaaagatttttcacccccagaatccggcattatgccaaaagtgcatagtagtactttggtgaaacttaaatttatatgttggaatgcacgtagggcgtgtttacacataattttaagtatttctatcacaaaaaaattgttagaaatacttaacaacctctcagaatccctgcgtaccacccctaatgcttcaggcaaaaattttttcgaaatttttgagttcgactccagagcataactcaatttaaatttgtgctaaaagcatgcttaatagctcattagaaccgccaaaatgtgaaggtgtgccctttctccaagcccaagacgctatctttaacatccatcgcgctagaggccgacgaccgcgacccgttcaaaaaacttccgaaaattttcaaaaattttttgaagaaacttttttttacgtgaaaatttcaaaaaacgctttacaccattcgatccgcaatcgaaaagtgccggaaggatgcgcaaaccgcatcccgctatgagcaaccgctcgcttatttttttagcaaacgtcatttcaggctacatttttctcttatagagggaaccagggccccaaggggccctgtgaaagcgccacgggcgctttcaacaccggggccagccgggaacagttgaagctaagtattttaaaattagccgagtgagtacgtcaagcgtttgaataatagcaaaaaggtggtgtacttaaaactaaaggttaactaagaattacacataaaatttttcagacaaaaatttattaacaataaagcaaaaaaagcaaaaatcagcaaaataaattaaaaaataatcaatcaaaaaaatcatcaaaagaactatcaagatcatttggttcttgatggttcgcacccgctgcgtgtccattatctcgttccacgtccgggtcattggccacgtccggtactcttgggcccacgtccggtattgctgcgtccgggtcattgtccacgtccatcagtccacgattcggtatcctcgactgctgcgtctccaagtccaacagttcgtggtaaaccacgttctcgatgtgcgttccgtacccactttggcagaacggcgcgtacaccctgatgccgtccatctgcgtgaccctggacatggcgacgtacacttggccatgcgaaaagcattgacggccgttgagtacgagcgccatccgctgcagcgtctgtccttgtgcctttaattttttgtgcttatatatttcaatccttaaataatctgtatttcaccttgtttatggtcatagcaaagcaaaggcggacgggaaactgcagacggcggaagcgtagcccacggtggtgtcgtgcgcggccatattcgaattgaatttgtggaatggcgatgatgttctgcgcacccgctcgtggtccggtgagaatccggcagaacaggttgttctccgaagtgcgcatcacttgaagtcgtgttccgttgcacagtccctgggtgacgtccaaattgcggatcagcatcacgggcgtacccacctggattaattggttaaaaatgatcaaaacaaaaaatagttcactttgatggtcaatttgtgcggcggcattccggatggcatttcattgtgcaccgcctccatgttgaagtcggtgcggaaattgtgcatctcttcgttaggctccagaggttcgtcgatggacaggaattcccttccgcacccgctcattctgccaagcgccacctcattgatgtgctgcacgtcgttgttggtcggacagaggatggcattgtgggcaattgcgtccgcgttggccagcgggtcgtcaaacagtgcttctgggaagcagaagtgaatggtgtggtcgaggtcgtccacgagaagttcgggcggaatgcgcagttggttggtgaagccttggctgtccgtacccacgcggtgcattccattgccgatttcttgcagccaatcgcgcaacgattgttctcctggtgcggtccgcatgttgatcgttaggctaataacataaatatgtttgtaaaaacaaagttgacaaattacctgatttttttgaacagacgaaagagcgctcccatcttgatcgacgtacccacttggtcctcacgagttccatgctcgactacgggagtcagttgccgccagtcgccgctcaacaccaccactttgttgccgaacggtgtggcatttgcacaaacgtctcgcaacagccggtcgatgtagtcgagcacggtgttggacaacatactgatctcctaaaattgttattatgaacgaaaagcaaacttatatttttgtttacatcaatgatgatcagttgtgcgtggcgcagttgctccgcttttgccgactcgaagttcagcatcggcggcgtctcctgcgacacgtcgtttggcacgtagaagtgcctgtgtgccgttccaccgcctatcagcaacagagccgcgatgccggtgctggcggcggcaacaactgagttccgctgcagttcttggttgcgtacccactgtgcgttggcgtttccatccaaggagggcttgcctgcgatgcaccacttgatcagcgtgttgtaaaagtacgtcttgcctaaattaactttagcaattaattatgcttttgaaaaataaggaagccgttattaccgcatccgcccgcgccttcgaggaagaagagcttctggtcgcacccgccaagaattgatgttgatatctcatcaaaggcggcccgttgatctgggttgaggcgtccaatctgctcgatggcaacttgctgcggtggtttgcagcgttgccgagcatcctccccatagaagctgtccaagatgttgtcctcctccaggagctgcgcctgatgttgaaagtcgtagcccactggcagtccttgcagcccaacatctcttaaaaataatgattatatggacaatattatgccagctttactcacttggtgttcgtccccatgcagttgaggtaatactcaaggttgagcatcacctcagccgcgcggacttcagctggcttcggcacagctcctgggtggttggcggcaacaggcgggttcatctcgtcgaggaactcgtcgaacagcgcctgagggttggacggatgggcgtgcgcaagcagcatggcagagatagagctgtagccgcttgagggagggcatttctgcacaggcttcttgcatggttcggcggaagagttcgtcgctcacttgaaaacgcgaatggtgacacgtacccacgaatgcggcgaattggatgccatccatggtgcgaacgtcggacaagttcttgtgacgcggacgg

SEQ ID NO: 806 - DNA, 5718 bp, Heterodera glycines
gtcgctcactgaagacccaatgtttggcacgtacccacgaatgtgtcaaattggatgccatcaatggtgcgaaggtcggcaaagctcttgggtcccggacggtggagaagcagtgttctatttgatagctttattaacttttcattttaatttattacctcaaggcaaatagctcatgcttgcgcggtgacacggtgtacacacgcacaaacatttttgccttgtccgggtcttcttccagtggacgcacccgcttcttccatgaccgcgacctgaagtcccacctaaatagcacaaaatatttactaattaaatttataatatttatttcaactcacgagtaacgatatggcactaggtcgtacgtcaggtgcgctgcctcctggtcccttgcgcagagtgcgaagaacgctgtaagccgggtgttctcgcgaaccctccaccgtccttcctcttcatgtccttcttccacaacaatcgtttgtccgagttcgtcgtgcacgctgagtgtgtagatttggtgcgacgtacccacgattttgtacgagttcaggcgcaggtaggcctccatggcggtcatgtatcgcactttgaacgtggcggcaatttcgtcgtagtcgtacacttcgtccgcacccgcagttccatcgtttctgccctgttgcgccggtcttcgtggctgtgcaacgcggacataggccttttcaaaccctgaatgttcttgaattattgaaaaaaatcaaaattaataaaataacaaccttttaacaggtatttgaagatatacttgcaggccttctgtccgaacacgtactccacattgatgtggcatccgtatttgagcagaagaaacggattgtatgggatgacgcggctgtcgtccatcagaatagcgctccggaccccccttttcttcttgtaatgcgtctgaccgtgttctccctgaataattatatattgaatttagtatcaattcaaataattggtacatgctgccgctccggtatcctcccttggtgtgggatgcgctggtagcgcacttcagcccagtctcgttcagggtcagcagcaggatcgtggtggtcgtcgtcatgttggttgtcgtacccaccggctcttccaaagcatgtgtcactctcgtcgggcggtatgcggacgtaattcgtgtagcggacctcttaaaggaattttatatttttaaaatgaacaatatcctttacccgataattcggtccggtcagagtacggcttcggaaaatgtttgcggcatcgcgaaccctccagacatgccgcattgcagtcgtgcaacatcattgttgtcgcgtagtgccagaggcgacgctgttggtgtgcctctggcgattggtccgatgagggcggaagggcagggatgcgcgcgcagacatattcgtccacgtgctgcggagtgtcgatgcggaccccccgttcaagaatcaggagcatgtgtatgtgtggcatgccttaatttatttttcttttcatataatataatttaaattttacctcgcttctggtgttccacactgtaacaccatccggcaactttgcccagcacaccacgctccgtcacgtccttgatgaattcagctgccttgtccatgaagatgcggcatacaatgtcgggccggtgggcatagttttgacgcacccgcaatgcttcgtcgatctcaggccactttggattgccagtgaaggtcacaaacctaaaaaattgatagcatcaattatgaattaaggtaatgcatttatgttaccaagtcggagcccccaggtgtcgaaccatcgtcatcaggtcggcatacttcccttggtagtattgccgtgacccggcaaatgtttgtggcatgaggaagacacggccgagctttgcatttggtccttgctgtcggacccccttctccatggcggtgatgtactcacgggccataagttgacggtagttcttctttgcctggattgacttcagatggtccagttcgttgcgctcaattcggttgagaaccgaaatggtgaagtactcggcgaggcgacgtgcaaaccacagccaatggaagtcgtatttgccggacccccgaagtgccattcgatagcggtagaactgccgttccgaaatgttgcttcggcctccgcgagtctccacttcatggtcgaagaggacgtcctcattttcatctctttctccgcaaattggttgggccgttgacgtacccactgcatttatttcgggttcctcaagctcctcgggaacatcggtgtccaattcgagttcgggctccggcattacgtcaatttcctcctcattcagctgcgtaaccacaatgtcgtcaattgcaatttcatcgcccaattcgtcgtcggaaatttgttcacgttcttgttcctcctggtgcacttcgggtcgggcattctttatcaaaccaatgtattttgagttcatttttattttatacctcgaacccacgtttcttcatgaaccaccgccatccaagcgtgccgcgtggatggatcaaagggaagcagcacgggtcgatttgcggcattccgctcttcagctcgcgcatcttcccggccttgtcggacagccagaatgctgaaaatttgatatttgtgcttttatagtgttttttattaccgctgatttgtggcggaaggccatcctcttgcacccaaatcacagccacttgcttggctgtgggtgcatccgctcgttcaataacggtgacatcagtacgcccgtgaagcggaccgcctttcaagtctcgatccgtcagcagcgcaatctttattatcaaaatttattatcatatatttttttattttttactctgaaatgcgggactacgccagtagctgctcgagcagcatcgatcttcgtacccacagtttggaatgtctggccaaatggattttgccgcatcaacgcctcaagtctctccatgattgtttgtttaataagtggcgcaacagcggtgtccaatgcttcctgacgaacattcaatgcgtcttccggcggcaaggtgtacacttgagcaaatgatgggagacggacccccggtgcaattaaatcgctgaacaggaaggagaactgtcctaaaataattatttttttatagaaatcagattttaattcttaaccattatatttgcacgtgtccaggcgaccccccatctgctcaggtggggccttttcgccatgtgtagatgcgaaggcgaacaggttgttgaacgccattatgttgttcagaaatgcctctcgaaccctctcgtcaacagcatcgaccaagccatgcacgtaggcaggaggtggcagtttgagttcatccaattcggtgatcatttgttcagtgtgtgtggcgccatttccacagcaaggtgtttgccttcgtgcccgcttgatgttgttgaattcgccaaggagcagacgagcaccgcaatgtccacaaaatgcatcaccaaattgaccgcaatcataatagtccacctaaattgttttaattaatgtttaaaaaaagacagtccaactctgtgtgaagacgagcgtgccgcgcatttatattcagtattttgatgacatctttccgtaggacggacccccttatttcttgctgatatttgtttaaatacgggtgctggtttgattccatgctcgtactgcttcaaatatttttgtgaagacaaaaaagacgatgcattctgttggcattgcgcataagaggggcaatcacatgcgtacccacaccgtgtataattagcagctgtaaataaaaatttcaattaggctaacaaatgtcagtaaaaaggcaaacttgttaaattcctccggcgtggtcgttgtgcagctattgggttgggccaatcacgagccatgtaatcacggaccaccttctccattttttcttcaatttgcttggcatgaatctcatttaactgaaaaaggaaataacacaaaaaaaagaatccaaaacctttgtgcgcctagcgcttgtataacgtggagtgttcgcacccgcagcaagaagagtggatgctgacttccgacgccgagtatctgtgattttttgttgaaaaattatggaaaaatgaactcaaaatacctgcaacgctttcaacgtcgcttgtatccgatcggtgctgttcagaacttagggctgcattgtttggcgtacccacgtttccattgtgacgggttcttttacttgcggaacctgttacttgtgtaataaatatagcttgttattagcttaaattaagacctccagcaatagtcaaagcccgtaatccgacagtggtcggagtcgaaacaacgctggtgtccagttgcagtgccgacgtacccacaatagcttgtccatcatttcgttgttgtctgatttgggcacgaattccagtcgacgttgaaggttctacaaatagattttaattctcatatgaaaagcaacaaaaaccctgatctatgccaaaaggttgctgaccacttgtattcggacccccaagagcattggccacgtcaggtgtctgaatggccgctcgccagcgtaaacgatctgcttcttttcttcttcgatcctttgaaggcattaatttaaaataatggcaaaataaatcaataaaatattaaactaaaaaacatatttagttttagataacagtaaaaatataaaataacatttatttaagcactggaactcaaaattaaaagaacacattacttttgttaggacagacggtactaaaaagcgaagcaaaggagtgtgcttttaaactatttttgtgcaaaaggtacgccagtggaagtgtaggcacgcagggacctctttcatgcattatgctgggactggaccgctaagatacatgcacgcagggacttctataggcaatggaagtttacaggcacgcagggacctctaacgaaagagagaattcaaaatgtatccagatggtaaaattgaattgcttggataacatgtacaaaattccatcaatcaaaaataattgaattatttaatcatacataaattgcaagttttatcttgattaaacaaaaattagaatagtttttttaattttgtgccaaagttgttaggaatttgatacaaaagttgtgcaggagttgtaaagttgttcaaaaagttgtaaaatttgttcagcttttgttgtcatttttttcggaacacagtagtttggtcagggatgaatttataatgccggaatgcacgtagggcgtaataacaccttattttaagcatttctatcaggaaaaatttgttaaaaaaattcaaaaaaatttcacccccagaatccggggttctgacaaaagtgcatagtagtagtttggttcaacatgtatttatattattggaatgaacgtagggcgtcttaactcattattttaagactttctatcgaaaaagaatatagaaaattactcaattaaattatcattgctctgaatagttttttaaatttgtaccaaagttgttagagatttgatgcaaaagttgtgcaggagttgtaaagttgtttaaaaagttgtaaaatttgttcagcttttgatgtcattttttcggaacgcagtagtttggtcagggatgaacttataatgccggaacgcacgtagggcgtgataacaccttaatttaagtatttctatcacgaaaaatttctaaaaattcaaaaaaaattttcactcccagaatc

SEQ ID NO: 807 - DNA, 3196 bp, Heterodera glycines
  misc_feature (536)..(536): n is a, c, g, or t
aatttgacatcatacctcagagaggggacttcgccaccattcccagcgacgacaacgacatcgacaaacgaaacaatttgccctcctccctctcccattcaatcatcacactccattttgctgttcatcctcacatttttcatcttcttggtgttcatcgcgcaggtagcccccccccccctcaatcaatttggacttgcccctctttaggctgttcaagttggagcgcttttgcgacgaatggtcaaaaatcgtatcatccaacggaaattgcaaaaacgtcagaagagtgagtgtttttttttttgaaccaaaccaataaaaatttcaaacaattttaaggaatgaaaactcttcgcagtcaagcgggccgccaatcaatgccaatggtggtgaattttggccgggtaaaaactcaaattttttttttcatattttaaattttaaaattatttcagactggggacgggcaaatgtttggacaagtcgggggccgccaatcgtcgatgtcaccacctgttgtgccggtgaatttngggcggcgtgccgccgtaccaggtacaacaaaaacaaataccttcgcttccatcgcttccatttcttacagccattttttttttgaaaagggcctgcaaacgcaacagcgcgaggtgatttacgatgtgccgacggatggtggtggacatgaacacgcggaagatgatgaggacgacgacagtttttgaacgatgagccgatacaacaatgagctttaattcctcataaatttttataaaatttgggaattttcatttcacatttaacaaaatttggctaataaatgtaactcaaaatgattaattggcaatttataggagaccactaaataggagaaatttcaaatgttttgatgtatgggtaatcagatcattaggcgagattaaaaaattttgaattttaaacatgtgatataatctttttgaatgattaatgtgtgatatagtggagtaaatctgtcggtacatcaaatgagcaatttgtttaaaaatgggtcacatccattatcgggaattcgggatgcgttggtgcataataaagctgcctcccatttggagaataataataaagccgttgtgcaaggtcaacagcgcaccatttaaatgcatccctcccgtctcgctctcattatttcttcacatcacttgctcaatattttcacatttatttatccgctttacattttgctatatcccaaatcatatcatttaagcacacaaaatttacttcatatttttttttaaaaaatgtccgacagtccaacgcccgaaaccgaaataagcattgcatgggacatcctcgaaaatgataaagatgtagtaaatttttttctttaatttgaattcaaatcttatttatcatttttgcagtggtacaactggttcactccaacgaccgccaaacaagcgtgcgtcgaggcattggcattcgcgcgagaagggggactaaagcacgagaacattctgaaaataatgaagacgcttgaggagagagaaaagcgtgacaagaaatgaaatgtcgatcgatgaccgatttgttgatagtgatgtggatatatgatcatttttttttgggacatttaaaaaattggtgatgaattttgtcaaataaatggtggtgaatattttgaaagggcagaatttaaaattgatttaaataatagttaaatatggcggtgttctcatgttctacaattttattgattggctctaaacactcagtgaggtggggatgaggcctataaaaataaactgaaattgacttccgctcattttccgttttcattcttgaaattttccgctaaaatggccattaatatttcggacaccaaatcgcttttcaatcaaatcctcgcccagtccgatatcaccataaccacaagcggcataactgtcagtggtccacgcctatcgaccccccgttttttaccgtttgacgattgtggacgctgccgcgtttgcaaagcaaccgaggccgaggtggacacaatggtgaccaaagagggggtcacattgtggtgcactcgtatcaacaaaccccaatttgtgccgttcgatgtcgtctacgacctgccagggcactgctttttccgcgtgaagaacaaagcgagggtgttcaatgtcccctacggagacctgccctccgggacgtgtgccaaaagcaaaccgactgaccaccaacaacaacaacaacaacaacaggacttgaagcgcaaggcaaaggtagcacttgacttggtggaggctggactaatggccgatgctatgcaggacggcgcacggtggaagaaggccaaaaccgctatcaatgtgcttggcaatctcctattggctgaatcgttggacaatacttccgctcctccgctgaaaaatgatgccgtggacatcaaaaaagaagaagaagaagcaaatgtggcggaagaacacaaagaagatgaccaacaaaaagaagacctcggagacattgacaaaactcttgacgacttctttaaaagccttaatgcttcaacctcaaatgtgcctatttaagtgaataatttaacacacatcattttctcaaaaatgttaaacacacaagcattcaccaataaagatatttgttttaaattgccatttggcctaatcatttcggggccttcatcatcgggcaaaactgaatttttactgaaattcattgccgaatcggaccaattaatcacaccaaagcctgtgtccatgctctactgttttggtgaaatgaatgcagcggtgcctgtgcttcaaaaggcgggagtcgatgtgtatgcgggagtgccatctgaagaattaatcaagcgtcttcccaagcccctattgctgatactcgatgatctgatgctgtccgtcgacgagcgatacttgtcagatctgttcaccaaaaaggctcaccatcaccagtttgctgttgtgtttgtcactcaaaatttgtttgagcgcaagatcaaagtggcccgcctgtccgcccagtacctggtactgatgcgggccccaaattcactgctgtccattctttcttgacgcctatcgaaaagcgaccgcccgtccctatggctatttgttgattgatatgcatgcatcgtcggacccatcattgaggctgcgaaccaacatatttaaggatgagcaggaggaagatgaaggga

SEQ ID NO: 808 - DNA, 6189 bp, Heterodera glycines
  misc_feature (238)..(239): n is a, c, g, or t
  misc_feature (6170)..(6170): n is a, c, g, or t
gacaacgcggacgaaatgaggagatgacaccgcacagcgcaggatgcaaccagaagaaaataaaaaaggatgaagcagaagatgatgatgatgatgatgttttgcatcacaaaaaatacaggatttatcagcgttcacctccacggctcccttccccacctcgagcgaaaccaaaaccaccaccacgccatccgaccacaaagagagagcaacacaagccaaaaaagttggaattaannccaccaaaaatagagccaaaatttgaacccgattcacgaccatcgacatcaaaagtcgcgcctcggtcgaaaaaagagcctgaattcccgcttgaccctcgaccatccacatccaggcaagccggatacattcctcctccggcacccaaaattgtaccaaaacatgagccgacaaagagacccgtgccataccgtatcccgaaaagagaacccaaaattgttgaagaaacgccacagaggcaacagcaaccacttcctgctgctgtcgtcgaagaaatgcctcctgttcctccgcctaggagggggaccaaacgccgccaccccgtaaatggtgagaatgatggtgaggtgcgcataagaaaacgcgtgaggcaagcgaggagggtgcgagtacagtactcacccgagccgggtccatcaacatctgcacaaagtgatgaacaacaacaacatcgagaactgtttaccatcccgtcaaatcagctgaccatgaatcagcgggttgaacgactgtacatcaaatgcaaccgttatgcggatcgtatgggtgtccgtggcaatacaattaacaccgcaaacggcaaaccgttggcgcatagcaatttgcgaatggccatcaggtatataattgacaggagagcgggccgccctaccattaagccacctggagcggccatatttgaagagaggcttaggcaagatccaattttgtattcatggacggctcctccaaagaaaacagcacagagcacaaccaccaggacggcaccgaaaatcaagaaggaatttcgcccgaaaaagtggagttgatcaactccacgcttgacaagctgtacaacgacccatcctccccagcggcgttcgcaggtgttacagcgctgtggaaagaggcgcgaaaaaagttgaaaaatttacggaagagggatgtgcagcattatttggaggggcaccgcacctacactctgatgcgcccccgaagggtgcgctttccaagagccaaaactgttgcggctgggttcatgaccgatgttcaagtggatttggccgattttcaggcgctttcgcgccacaatcggggtcaccgatacctgcttgttgcggttgatgtgctgtccaaacgcctgtttgttgtaccgctgaaaaacaagagagccgaggagatgttggaggcattcagacaactcatcgaccaaatgccaatggtcccacatcgcatcttctccgacaaaggcaccgaattcaagaacagattgttgaaggaattctttgatgagcaggaaattgagaagcatgagccagtgcattcatcagtcaaggcgtcggttgctgagcgggccatccggaatgtgaagcagcgactgtaccggtattttgctgaaaaggagacgttgaattgggtggatgcagtacagaaaattgtggacggaattaacagcgctccaactcgtgttcacgggatgcgccccattgatgttgacttttcaaatgcgcagaaagtgtggaagcgattgtacggacaccctgcccttcaaaagcggacgccacgcttccgtaaagatgaatttgtgcgcatgagcagagagaaagggcaatttgagaagggatatttaccaaattatggagacgaaatcctggagattgatgatgtgttgaaagcggtgcgcccaattcggtacaaactgcgggatgagcacggtgagaaattcaagggcagcttttatgagcaggagctggcgcgcgtaagaaaagatgcaaacacaagctaccgcatcgagaaggtgtacagaaagaggaaaagagcggatggatccacagagatgcttgtcaaatttataggatatcccaatcgggaatggattaatgagtctcagcttgtataaaagcatgtgcatttttcatttttgttgtgataataaacaagcatgtcaaacagtttctttgtgtttttgcccagcaatgtaacggattacccggacaatcagcccaacaaatttcgtgtccgactcccaaagcctttgcattttaacggctcgtgggtgtgtggactgcacagtatcagttacccctattcgtggtccaccatcggtacattggatgagcagtggattgacattcatttcacagaccgaagcactatcgatgaggaccgacagcgggtaatccgagtgccagtgcccaaggcatcggttaacagggttgaccagctcagagactttttggcagtcacattgcggaaccgtagcggagcaaagctgttgccactcccacgtgaggtggaagaggatcgaaatcgtactaaaccccttcactctccgccaccactaaagagaaacaaaagggatgcgtcaccgataccaccaccaccaccagacgagagtgaaaaaatcgaagactctcccccattgtacgatggaaatgatgaggacctgattgaggactctcccccattgtacgatggaaatgatgaaggggttattgaggagtcaccgccccattatgaagaaacaccaaaagaaactgtgaaaacgacgccaaaagtgtcgacaccaccgcctgtctcaagccctgctaaaccaacaactgtaaaaccgtcagctcctcctccatctgtcacaacaccagcgcctcccacaattgcaaagccaccagtaaccacccctcctacaaccacaaaaccaacaacaccgatccctccaccagccgtacaaacaacaacaccggtccctccaccagtcgtacaaccaacaaacatccctaaacctgcaaagccacaagcaaccgtcactgccctgaccgtaaagcccacaacaccggtccctccaccggtcgtacaatcaacaaccacccctcaaccgacaaagacaccagtaaccgtccctcccccggtcacaacaccggtgcctccaccaccaaagacaacaactacgccaacaataagtaaggttccgagcccatctgttacaattccggcaccgccagcgcaactaaagagttcggcactgtctccgaaagcacccatttctactgttaaaccgccacctccagtttcgctttctgctaaatctaaatcgccgccatctcctccggaagaatctccaccacactatgatgaagaaaaagacataaccgtaaagccaacatcgcctgtaaaaccaacaattactgcgcctccagcacagttaaaaagtccggcagcaactcaagtcatcaaacctcctcaacagccaactaaaccgttggctccgcctccaggcgctccacctcgttttccagctgctgcggtgtcaccacccccgccgacgtcagcagctcaaattgacccgtcgcgtttgattcacacactcgatccaccaaaaatttatttcaaaactcctccggccaacgttgaccccctgacatatgtgccacattcggtgtttattttatatgaaaacaacatggaacgattcaaggtggtgttcaatgaggagatcatcagccatttatccttctcacctcagctgggctatgtgcttggctttgaaaacccgcaacatgtggtgtcaaatgaagttgccaaatacgggtatgacttgcgcggcggcatctcaagttttgcagtttactcaaaaggattaactgagaacatgataattggcaattcactgagttccttgctccgagttgtgtccattagcggtgccacccccggcgactacactgagaagatttatgactcgccaatatttgcgagagtgttgccacgggagataaacgagattgagattgagctgcgcacaatggacaagggccgcctcgtgccgttcgcctatgggacaacgatgatcgtattgatatttaagaaagtgataaatttttgatttcatcattcattttgtttttgatttaacatttttataaatggttcatattgtgtttgacccaagcattgccgggtatgatgagtacgtgcagtacggtagtggcttagaaaaggaggaattcgactacttccgcgggtccagcccctttcaacgggggtacggcattcaacgcggggcgggcgttggggatgtgtttcgtggactttggcgctttttcctgcccattcttcgtcgtgttggaactacggtaggctcagaggcactgagcactggccaacgggtgttggaacgagtcgggcacgagggggtgccgctcaaggaggcgctggtcagtgagggaaagcgtggaattgatactgtgctggagaaaggcggcctgcccaaacagtttggaagcggaagaacgggtataaaaagaaagagaacacatgtgcctggtcatcaaaccataattggacgaacagtatcaaagccagcaaggaagcgcattcgctcggacgcatttggactttattaatcaatggcatttcacaaaattgacactgactccgtgaactcaatcaccaatgctttggactttttccgcattcccccgaccaatgtgagcgtctcttcgtccaaagtgtttgagctgctgcctagcaaccctctgaccgacacaccataccacttcaaactgcactcaagccaaaactacattgatctttccaaatgctatttgctcaccgagtttcgaatccataaggaaaatgctaatggacaacttgttaacctaaccattgatgatataaacattgcaccaatccaaatgattggccaaactttcatccgtaacataaaaatgagcatcaatgggcgcgaaatatttaatgccaatgcactgatggcctacaaaacatatttttcacatgagctttcctattcaacaacggcaaaggactcccatctgaatgcatctgggtactaccgagacacgggcgactcactggaaatgggagacggatgcacagcgcgacgtgatttgtttgcgaatagtaatgtagcccaattcattgccaaaattgacaccgacctgttcaatcagccgctgtatctgatcaatttttgtgagctggacattgaaatattgcccaatgacaacgagtttgtgttaatcgcgccgaccggtggtcggtaccgtttcgaggttgtgggactgaaattatatgtgaaaaaggtgtctctgatggacgggttggcattggacattgcacgaaagttagaggtgaagcctgcccgttatgcagtgaggaagacaatgatgaagtctgtgttcatcagtccgggtcggtatgagttcacagccaatctgttcatggaccaaattccccgtcgtgttacaatggggctggtggcgaatactgactatgtcggctcaattaggcgcagcccattcaactttcaaccatttaatgtgcgcgagatttccattgttgccaatggtcgatcttacccacaagcaccctatgacttgtactacccgaacggaaagtatgttcgtccattcaatgatatgaacgaagcggtgggattcgcaaattcatctgagagcaatggcataacttttgcccaatacggcaaaacccattgcatttacgtgttcaatttgaccaacagcggggatgatcaagcggcactgtttgatttgataaagaatgggaccacagcggtgagcattaaatttaaccatccagtgcccgagggaggaataatgttggtggtgatgggcgaatgtgactctcttgtgatgttggacaaaaatcgatcgataagcaccgataccactatttaaacgcgcatcacattgtgccatttcatttgcataaaatgtattcaaaaaaattgggtatcattttgttcttgctccgcgtttctattcctgttgtttcaacattccatgaacaaccgcaaaagccaccgccagagaatacatattctgcttatttaaaaaatttgactttgtctcggcaacaacagcacccagaatattcctacactgaatatctgagaagctttaagggtgtcaaangattactacgacaacaaca

SEQ ID NO: 809 - DNA, 1909 bp, Heterodera glycines
ttcaaggggggtcgggcatttaacgaggggcggggcgtggggatgttgtttcggggacttttggcctttttcccggcccatttttcttcgtgttggaagtacggtaggtcagagggctctgagcgctgtccagcgggtgttggaacgagtcggccacgaggggggtgccgctcaaggaggcgctggtcagtgagggaaagcgtggaattgatactgtgctggagaaaggcgtcctgcccaaacagtttggaagcgggaagaacgggtataaaaagaaagagaacacatgtgcctggtcatcaaaccataattgggcgaacagtatcaaagccagcaaggaagcgcattcgctcggacgcatttggactttattaatcaatggcatttcacaaaattgacactgactccgtgaactcaatcaccaatgctttggactttttccgcattcccccgaccaatgtgagcgtctcttcgtccaaagtgtttgagcttctgcccagcaaccctctgaccgacacaccataccacttcaaactccactcaagccaaaactacattgatctttccaaatgctatttgctcaccgagtttcgaatccataaggaaaatgctaatggacaacttgttaacctaaccattgatgatataaacattgcaccaatccaaatgattggccaaactttcatccgcaacataaaaatgagcatcaatgggcgcgaaatattcaatgccaatgcactgatggcctacaaaacatatttttcacatgagctttcctattcaacaacggcaaaggactcccatctgaatgccgcggggtactaccgagacacgggcgactcactggaaatgggagacggatgcacagcgcgacgtgatttgtttgcgaatagtaatgtagcccaattcattgccaaaattgacaccgacctgttcaatcagccgctgtatctgatcaacttttgtgagctggacattgaaatattacccaacgacaacgaatttgtgttaattgcgccgaccgggggtcggtaccgtttcgaggttgtgggactgaaattatatgtgaaaaaggtgtctctgatggacgggttggcattggacattgcacgaaaattggaggtgaagcctgcccgttatgcagtgaggaagacaatgatgaagtctgtgttcatcagtccgggtcggtatgagttcacagccaatctgttcatggaccaaattccccgtcgtgttacaatggggctggtggcgaatactgactatgtcggctcaattaggcgcagcccattcaactttcaaccatttaatgtgcgcgagatttccattgttgccaatggtcgatcttacccacaagcaccctatgacttggactacccgaacggaaagtatgttcgtccattcaatgatatgaacgaagcggtgggattcgcaaattcatctgagagcaatggcataacttttgcccaatacggtaaaacccattgcatttacgtgttcaatttgaccaacagcggggatgatcaagcggcactgtttgatttgataaagaatgggaccacagcggtgagcatcaaatttaaccatccagtgcccgagggaggaataatgttggtggtgatgggcgaatgtgactctcttgtgatgttggacaaaaaccgatcgataagcaccgatatcactatttaaacgcgcatcacattgtgccatttcatttgcataaaatgtattcaaaaaaaattggtgtcattttattcttgctccgcgtttctattcctgttgtttcaacattccatgaacaaccgcaaaagccaccgccagagaatacctattctgcttatttgaaaaatttgactttgtctcggcaacaacaccagccagaatattcctacactgaatatctgagaag

SEQ ID NO: 810 - DNA, 4496 bp, Heterodera glycines
  misc_feature (7)..(7): n is a, c, g, or t
  misc_feature (4477)..(4477): n is a, c, g, or t
atgactntggactaccccagcggaaggtatgttcgcccactttatgacatgaacgaagcggtgggattcgcaaactcatcggagagcaacggggtaacttttgcccaatacggataaacccattgcatttacgtgttcaatttggccaacagcggggatgatcaagcggcattgtttgatttgataaagaatgggaccacagcggtgagcatcaaatttaaccatccagtgcccgagggaggaataatgttggtggtgatgggcgaatgtgactctcttgtgatgttggacaaaaatcgatcgataagcaccgataccactatttaaatgcgcatcacattgtgccatttcatttgcataaaatgtattcaaaaaaattgggtatcattttgttcttgctccgcgtttctattcctgttgtttcaacattccatgaacaaccgcaaaagtcaccgccagagaatacatattctgcttatttgaaaaatttgactttgtctcggcaacaacaccacccagaatattcctacactgaatatctgagaagattgtctttgtcaaagattgctacgacaaccacatttaaacccaacataacggccaccccgaaaagcgacaagttaattgatgagcatttctctgctgttcttccaccgcttatccaactgtgtaaggatctaccagcggaaagcaactttgcgcagaaagccatttgcggggcattgttcgccctttatttaatgctcatcctcagtctgattcttcatcaactttgttcaattttttggctaaagaatggacagcctccaaattataaagatattgagcgaaaatcggcagaccgagcgagtgtttcggggctgcttcgccagtgaccaattgccgcctcccttcacactacagtaccccacagcgctcgtcgtcaacagggacgcccaccacaaggagggctctcattggtgcgccatttatgcgaagggaatggatacgccagtgctctactatgacagtcttgctcagccaatcccgcccaccattacgtcatcatttttgtgccaattccccaagggattaacgaagaattcacacccataccagtccccccttgtctccacttgtgccgcccactgcattgtttttatttaccatttgtccctcggagacacatttaatcaatttctcaaccgacttgagtcttgttcaaacccagatttatatgccacggttgtactccataaaattttaaataaataaattaaatggttgaaaaaaagaaaaaataaaagcccgatgattgagcataaacatcaagatagccaatttcatcatcaaaatgcgggttcttcaaaatgtatgcctgatcatcatcattggccgacaaaggctcagttggctcaatcccgcatgctaccatttcgctcggtgttgccttcaaaattgccggaaaattgtcgcggtgcacaagatcgatggatgtgcactttttcattgagaacgggtttgcactttttgtgatgtgcttgagcaccacattgcaaagtgcaccattttccttaacatttttttaccataaattgaaaaacaaaaacagttcaaaaattttacgagcgaattgtgcgagttgaccaaaattcgggagcagaaaatgcgcccagatttgccgaagcaaacatatcgggcgaactcattgaaaaagcccgggtcacacagctcattgttgttgaaactgaaatgcaggtagagctgtccgtctgacatccatccttttgcactgatcatgtcaaagtcgagagcaagccgtttctgagtttacaaattaacaaaatatacaaaattaaattaaattattattacaatttgggtgaagtttgggtgacgcttcgcccgaaatatctcaataatccgattgaccactgcgataccggatggtggacggccttaaattttgcgaaaaatttgaaatttgaatttttttttcccacctggcttgggtgttaccccgccaaataagcacattatgggcagtgagtagataatttcgaagagaagctcggctggtaatcgcttgggcatcatattggtcatgaaatttgaatgaatgaatgaagagtgaattaaaatatttttgtgcccggttctcatgggctcattaattattcaatagttaatattgacttcaaaagacatttgaatttgccgacaatagtgaaggagataacttcaaaggaaatttgaatttgccgacaataaggaaggagagttcgagaaaattaattggtattcggatggggacaccccgcccctaggcttcataaatactcagtccaaatcacatttcattcatatctgctcatgtctttttactcactttaataataataaaatttgtaaaaataattaaattataataaaatttttattttctgctttaaccagagcggttgcccaattattaggctccgtttatcctggcagcatttgtgtgtcttttagggcttgggattgtacgcgtgacctttactaattacccgagccgtttaggtgccctgtcgtcttgtgcttcatgggtggcagtgtgctgctcttcagggcatagttggtttaaaaaatctttaaattattattattattatccattaatttgcattcacaacgacaatttccatgcctcaaaaattcgcggctttctcatcaatgaattgcttggagaggtgcttcaagagggcggcggcggcagttcatcatcatcaaaatctgcaaaggactacgtcaaaaagctggacagcaccattgagcatgtgccccgcttccagtacagcaaagtcaagtcgcgattcagcattgaggatgtgccagcagcaaatcctgaggggctcctggccggcatcttccagtactgccttgacgcagcgatggaggagagtcgtggacgtggaattgaacccacgcatctcggctgcatgatcagcagtccgttgctcaccggcggggacatccccatcccggttcgacaaatcacagacaacaccatcaataccatcctcaaccagttcaccaaagtggcacagagcaagcagcagcaaaacgtcacactgtggggcgagccattcactgtggtggtgaccacagttgaccgttctggactgcccggccgaagggtgctgaagggcggtgctcggcgaagtctagcaccagtgcatcatcgggtgacggaaacttgtttgattaaggtccaacatcacaataaaaaataaatttggtgacaattttgttaagatttgcaaccccgacggacactgcctcttctacgccttgcaggcgacaatggtggccaaaacgtgcggttggccccgttggagattttacgactacttgcacagtcggaggggacagcagggatgccttcggcgggacgctttacaattgatgcaggaaattggtgttcgtctcggtcggaacacttatgatgctgagatttgtgtgccgcgtgtggtcgaccactggaacaacacgcaacagcagcatcgatttgcagtgttcatctttggatcatcgggacaatacaaacccttgtacaaatacatcaacgatcattacgacactcccattgtgctctatttgaacaaccagcattttgatggtgtgcagaaattgcatggcttgtttggacaacactactgcctcgactgcgaaaagccttatgagcgtccgtcaaggcacctcaattcctgcaaggcgcgctgtatgctttgctcacgcgtcggaccagcattcccgtgtgtcccatcgggcggatttttccatcaatgcgcgggctgcaacaaaatgtttcgcaataacgggtgcctccaacaccatttggcatccaacttttgcgcccagtcaaagcagtgcaaggactgcggcgttatatgggacacacgagtacataacagagatgggagaaaagtaaacataaaaataaaataaaattttcatttcttgctggatttagggtcacaaatgccacgagacctattgtcagttgtgcaacacgtttcacaatcccgagcgcggatgcttcattcagcccattgagccaaaggagcacgacccgtaccgcattgtggccttcgacttggaaacaatgcagcatcagccagtggacccccagcagccagagatgagagagcaccagcccaacttcatcgctgcccgagtcgcgtgccctgagtgcattgagagcggaaattggcggagggcaacagcgggctgcagaatctgtggtccgcatcgaactgtcgctttctgccatcggccctttgaggacactcgtgtggacaaacgtgttgtggcggacaacccactgcaggcatttgtggattggctcatcttacaactaccagccaaatacgacacatatgcctactcacactttggcggacggttcgacatggttctggtctttcgcgagctattccggattgggttcaacccnggagatgcttcgacgggta

SEQ ID NO: 811 - DNA, 5590 bp, Heterodera glycines
attgcctttgatgtttgcgtcaaagccggttgcttgtattttttgtgccatgaattcacggatgtacgatttgaagagttgatcatcactgctctcgtactgcaacacccggaacaatttggtgacgtggtacccttcgtcgagtgctgcgttcaactccaatgatgtacatgtcgaaacccatcctctctgctgatcattgtgggtgcagctgtactcgttgtcaacgcctccgtttgggtagtcaacagcacacttgatgcagagagggaaacacagccgatcgcccactttaacaggaagaactggcacatcgcagcgccgcgggggcaccacccacactttgagaagtgacagatcgtacggattgtcggtagcgcaacgccagtccacttgttggttgagaacatggacttttggatggccggttgggtagcgggtctcaaaacttaaatgtcaaattaatgcaaaaatttgcacaaatatggcaacaaacttgacaaaggggtacagtgacgtgaagtcaaagtacgatatcttctcgccctccttcgccttgtggaaaagtttgcgtggccccgttcgcccacccatgaaggacgctcggatctcaagtgggccgtcgtccacatagctgccaaacatttgtcgcatctcagggtctgctgccaacatttggttaatttcacattcccagtacacatccacgcggccaatttgattgcgcagaaagtccagccgcttcgcgtcccggtctcgcacttcgccggctgattttccattgggcaacagcatattgtcttccgggaaacatttgatgcacccatgccacacgcaacctacaaattttatgtcctgtcaaagttttttaagatcaaaaataccattcacttcgatggccctcttctcagcctcaatccatgcgtcaagagagtagttggcaactcgcttttctccaccagctgagtgggccgtctgcaacttgacgccgtgtttttcctcgtaccacttgaagaaacgaagggcaagcaggctctggttttgcgcgttgtcatagcctctttcaggtacgatggccaagtgatcggcagggaggtggttgctgcgaaagtgtttcatgcaggcgcttgcgatagtcatgcactcccgcaaaacgtcaatgccggcgttgctttcttggtcgtctgtctcatttacagcctgcctctttgttatctcaaaaaattcacggcggaaagcgacgagcgctgccgtgaggatgtcgacgtcgtttttacagtagctggccaatgcctcgtcaagcaaaaatggttcgtggcggtgttgttcgtaccattggtcgaattggcgccgcttttcaggcatcattccttgtgccagatagtcgtccggtgtcgggtagatttgtcgtccgtagttgtccggccgattggccatgtgcgggaagaacggtttttcttccacatccaatccataggcaggcaccagctgtccgagcgcacaaggcataaggttgaaggagtcgcggaacacaaccttcgggttctttttcctctgcgcctggacattcatctcgtacattttatttccctaaattaaatgagcgaaatgaaagtatgtttcaaaaaattctcacctgacggatcatctccgggttaaatccccgtcggaagagctcgcggaaggtgatcaccatgtcgaatcgcccaccaaagtgactgtaggcgtatgtgtcgtacttgatcggtagtttgaagaccaaccagtcgacaaatgcctccattggattgtctgtcacaacctttttgtcaacggttgtgccgttgaaaggccgttggcagaacactgcagtgcgataagggccgcaaaccgaacagcctgcagttgcgctccgccacttgttgttgtctatgcaccccgagcacaccactcttgctgcaatgaagttgggctcgtgatttcttcgctctggttgcagtggatcggctggcagatgctgcattgtttccaagtcgaaagctacaatgcgatatggtggctgcattcttggctcgagttgttgtatgaagcaacctctctcggtgctgtggaaattgttgcagagagtgcagaacttttctccgcatacatgcccctcacgcccttttcttttgttgtcattcacattccaaatgacaccgcaatctttacatttctttgatcgattgcagaaattggattttaagtgatgttgatgacaatcgttgttccgaaagactttgttgcatccatcgcattttttgaaaaagccagctggtgatgcagaacatgggaatgcagggcctactcgagagcacatcatgcagtgcgctttgcatgattgatcatgcagcgacggtctcgagtaaggtcgctcacaagcgaggcagtacttttttcccgcgaatagcccgctgatgaactgaacaccgtcaaaatgattgttgctgaagtagagaattaagggcgtgtcatagtcgtcgttgccatatttgtacaacggcttgtagtgtccggatgcaccaaaaatgaacactgcaagccggtgctgctgctgctcgttgttccaatgatcaataatgagtggcacataggtgtctgcatcataggtgtccaagtcgaaaggtgctcggatctgtcgcatcaattgtcgtgtttcctcttgaaattttccgcgttgtccgtaccgaccatggatgtactcataaaatgcagaacgtgacagcccgcgcgttttggacaccattgtcgcttgaagagcataaaataaacaaaagttgtccgagttgtgaatcttaaacttttaaatattgagatgatatatgtgtgggaggggtaccaccttaatcagacacttttcggtgatttggtgacgcactggagccagacgacgtcttgctccccctttcagatgtctttttgttgggagacggcttcggtcaacagttgttatggtaatggtgaatggttccccccacagcgtcacaccattctgctgtttcgactgtgcaactttggtgaacaaattcaggatggcgtcaattgtgttggcagttatttggcgcacgggtacgaacacatcaccgccgtctaacaatgcactgctgatcagacacccaaggtgtgttggttcgctgctcttctcacgactgtcgctctttgcctcatcaatgcagtgtttgaatatggcggaaagaaggccttcgggatcggctggcacatcccggatgacgaagcgcgatttcactttggtgtagtgaaatttggcaatgtgttcgacgttgcaatccaacttttcgacaaattcgctgggtatttttttggacgacgttgtctgtgttgctccttctccctcctgaacggtcagaccaagtagctgattgatgaggaagccttgccgcaattttttgggtggcggtgtggtgagaatatcattaatagtgaatgggaatgggcgttttggacggttttccattttttgttttgatctaatatgaagaaagagagatgaatattgattaagtgataaaaagaagcaaaaaaatgcgaatttatggggcgaaataatgacgatggaaaatcgacaatacggaagggttgaatgtatggtaataagtgagggaggaacgggtgtggatacgataatagttatatgagcaggcgaatttaatcacaccacaaaatgttaatataatttgtcagcatttttataattggtaaggtaagcattttaaaccaatcttggcctgaagagcagcacactgccacccatgaagcacaagacgacagggcacctaaacagctcggaatattagttatgtaaaagcacaagacctcaagttctaaaaggcaattaaatttgctgccaggataaacggtgctttgcgtaattaaaacaaccgccctggttaacagcaaattaaaactttttatttgagcgaaaaatgtgaggagagaaaggaacaaaaaaagaaaaggcgtgccaaaaataataaaatattacaaatgatttgccaaatcggtcgggtgttagaaccagttgaattttccggttattggtaataggccacgcccatttttcgacttgaggtccctgcgtgcttgcacaaccaaaatttgcataatcgaaattccagctgaaattcggattcattttttataattttcattacaaaaaaatctcgaaaaatggagtgtgttgttcatgtcaaaaaacccaaaattacaagaccactcccaactgagctgctttgggagcagatcatgttcatcccactcatgcgcctgttctactcaaatggttgtaatcagtggtaataatcgaatttaaattttatgttgtttagcatccaaatcaacgatcagcgcaattaattggaaatttgaggttttacgaaatggacgaaagaatgcacatacaaaagctgaaaaagcaattgtatttttgtttttagtttttattattattaattctcatttaaaattaagaacgaaattgtgaagaaatttaacatggcaagcagggcgcgaaaaatgcagtttgaggggggcaatttggacttcagttcgcttcgcgaagaaaacggattggcgaaggatgacttccgaaaaggagtcctactgtatttgtgctatgggggaaatgaaacagcaatgttgttgaataacgttgcgatttccgttcccattctgaacgtaatattttattttttatttgcatttaaactttatattttagtgtatttttattcgtccacttttggagcaactatttgagttcatcctggaatcaccaaacccgttcaccatgcaaaaacggatatgcgtgggagggcatcatccgattcatttgcccaagtccctaagtctgccagcacgcgtcatggttagcaaaggaattcagccccaggtgcgctctgatgacaaagaaatttacaactttttcaatgtacacctaaaaagagtggttggacgggtcacgattttttaccatcttcgatttgatgagacattttccgttatgagcagccatttcgtgttggaatcctaatctaatgaaaattcacactttgtattttggtccgataaataattgcaagaatttgtgtcggaaagttcaaaggataattatagtatacgataatcaatcattttaatttaagttgtaaatttttaaaattggcggcaactttaaaggattttttttgcaaaacgaaaaaataatcaatcatttgaataatttttattttaagttgtaaaatatttttaaaaagtcggtatgataaaaagaaatattttttaagcattaaataataatcaatcatcatattgaattaaccttttaatccaaaaattcatttttgttcgctttaaactatgccgcgtttcgacaaaaaagtgccaaattcattgtattcaagagtattgtaatcaatcatcagaatgcgcagaacgggagggcggggcaggcagtggaacggaagaagggaggcgttattttttgctaacatatgtgccaaagatgcctttccgacggaatgccatttattttttgcatttcgttttttttttt

SEQ ID NO: 812 - DNA, 3739 bp, Heterodera glycines
aatgttggaaaaaatgatgctcatgaaggtggagccgatgactactcctccacggctgagctacccggaattcaaggaggagcgaattggcctatcgactttgatgtcgcgttctccctggagcgcatgtgcttggaatgattggagagggacacgaaacaattccaaatgaatacgtaaattccatttttttttggtccgtcatttcagcaataattttcataaaaagcttttgaaaacaatgttttttttaatataattttttgagtttgtgaattatttaagctggttccaatctcccccataaaaaataatgcaaaatttttattataattgcaaaatgagaattaaaaaaaggtggaaatatttccgtcaagacttgacgaaatgaccattcttgcatcttccgaaaatgcaacccccgtaatttcctgggtatgggctttcatttccaaaatttgcttccattcttcgactccataaactttgacactctctcctccgattgccaaatatttgccggactggtcgaacgtgaggcagttaatctttgaagataaaaaataaaaattttgattttaaaagtcattcaccgattttttaacatcgtaaggcgcaaaacaggttacagttttttgattccgcaaatcccaaattttcacttcgccgtccgttgacccggtagccaaataatatccgttttcggaaaaagaaatggcccccaccgcctccttgtgaccctcgaactggaccaagctggtctgctctttgatgttccaaattttgacgatggcattttttcctccagttccaaagatgagtccgtcggggtgaatttgaccacagcaaatgcccagcaaatcatcattagatttgacctgagaaaatttttttaaattcgagtaatgtggttagcaaaggtgaagaacgattgttgactttgaccagtggacgtccagcgtggagatcaataaacgaccagtgtgagtcttctgaggaacagagcacgtaatcgccagtcggatgcagggatacgtctgtgacggcttttccatgaatagcaattgtatgaagtgcattgggttgttcagtgctccagattttgacctgaatgaaacaaaaaaaaattttttttggggggggggggacgtaattgaaaattagcagaaatattttaacaagatgaaccagcctttgaatcaaatgagccagagacaaatgtctctaagttttggtgtaggtggactttagaaattttagacgaatgccccaaaaaagttctccgttgggtatcagcatcaaatctaataaaagcaattgttttgtcgacaccaccgcttaaaatgtaatttttctgaaaataagcgacgaaaattaaaaacacaattatatttgttttaaaaatgcctgaaaatgcacagcagtaactgagccattgtgtaccccttgaaatgttatgccctccgtaaaattttgaatttgttccactgatgccaacccctcggacaccgggcgttgaaggcgtgcagtggagtactcataatgttttagggtaaacaactgcaaattcgtttgatttagtataaattttgtgatttagatttctgctaaataatcatattttataattctttaaaggagatttatacttttgaattttatactaaatattattttaattttaaaattcttttattattttatttaaaacccacaacccattctcacattgaccaactcctcactgatacccggtaatttcttttttcggtgttcacgcagctgggcaactcttcgtgcatactctatcgacatttttttgaacatcgaggtattaacggatgaggaagatgacaatgttgatgctgcttcagtggcagtgttacgcagtgcttgggctttctccctcaaagcccgatacttttttccacctcgttttgtactcttttttggcggcccggttgccttgaaaaaatagtaaaaattcaaaaaaaatttgattacatcctctcccgctattataagagcatcatcaacgtcgtcatcaccaccaccaccaccaccatcaactgcagctgctgcaagtgcacttcctaataaaaacggctcattgagtatttggtcaacggcatccaattcagcgtgggcctcttcattttttgcaatgtaaaatttttccaaggactccgcgtccttaattttgcacaatcgatataatttataaaaattgaaataccaaacaatcttcaccaatccaggaaattcctggaccccatccacagtcaagactctctgagcaactccataagactttataataagcaaagtcatttttacactcattacaatgtacaacagatgggccttaaaattttttttaaatattacgatggatggggggggggggggtaccttgcaaaactttttccaacactccatccccatcggtatataatttttgaaaatcggatgggtgagccttttttgcattaattataatgtcagggagatgctctccccgacatttgccggccttttctttttcttttttaatttcggccataaggcgcatctcacggcacctttcacattttttgcacgccctctttgggtttacaaaacattttggggggagggttttttttggctggggccattgagaatgaatgaatgatggagttggtatctgaataaatttatgtgcttcaaatataaaattttttttcatcccctttcaaaagctccctaactggtttactcataattagtcagcggggtgcaaattaatgcaccaattgcctcaaatcctgtgctagcacagaaccgggttgctagttaaagcaacacaacaacacagctgactaaaacaaataaaacagaagagaaattatgaaaggaggttaaatgccgaaaagcaattacataaatttttcaaatttggggaaaattttcgacagttttttacaccctcactcaaatttttctaacaatcttactcataattagtcagcggggtgcaaattaatgcacctattgcctcgaatcctgtgctggcacaggatcgggttgctagttaaagcaacacggcaacacaaccgactaacaacaaataaaattgaagaaaaaatttgtggagggggtgggggattgtaaaaatttgagagaaaacaaagttacaaagaattgaaaaaaaataaaaattggagaaaaaaaattgtgaggggggaggggattgtagaaatttgagaagaaaaaattattagaattgagaaataaatatataaaatggagtaaaaaattgtggggggggggggggggattgtatagaaaatgtaatatggattgagtgaccattgcagtggtgcgtccatctgtcgttggactggacatctctgacctattaaatacgttgagggcaaaaaaaaagtcaatatgccccgtctctctcagattaattctccctcccttcgccccgcatacatttatcaaagcgaattttttgaatttttgcttgggaaaaatatgaacatagttgtcggggcaaattacaccccccccccctccccacaactccgtacaatgaccaaagttcacctttcttgtcggggttgcccccgacaactcccgaaaaatgcgcgaatttagtgaaccccggcatctcggaaatttttcccacatttgcagagatgtcggggcccggaagttaatcaatcaaaaaattacccgcgattagcacacc

SEQ ID NO: 813 - DNA, 1871 bp, Heterodera glycines
gagtgggtggatttcggggacgaagttagggcatgtataatcaaaaccattttcttcagaccatccgaattttatggatgtccgaccaaaatggccaccgacacggttcggtgggggtcaattacgagagtctttccagcgattccttcccccggttattacaattgcctcggaggcaaattgtggcagataaaaataattgggttggcattttataaaatttgaaaaagtttaaaaatgaaaaaatttagaaaaaggcgtcattcgtttttgagcagacttcgccggcgaatatggacagtgtggggcgattggtgaacaaactacaccactattacagcaatggaaacggacagctgaacgaaccgccgccttttctctcgcttcgattgtccaagtccatgcgtaacggtcccaataaattacataaatatatcaatcaattactcccccccccccccccccgaaaccgcccaatacccttgggatggcggcaccctcaaagggaatcccgccgccggcggcaacattaaagcccaaaaacgccccacaccctggcgtttgtgcgggaaaaccgccccgacacccccgacaaatcagtatggttaactacttttaaccattctaaaatggatgatagatattcaaattcatctttgtttttcaatcttttggattgaatcaaatcaatgaacttttcatcagttacctccgttcaaaagcgtgctgggtgagttgttccattaaactttttgttaacctttctcttctcagtggtaaggcttggggcatcgctgctgttctcttcttcacttgtatctgtatctttctggcgtaaacctttgtttttggcttttcagttggaacatcgcttactttctttctccttttagttggctgccgttctgcctggactcgtgcctcgattcttaccacttttgtaatgcctttttcccctcctccgttctccgttatataatttttcctcttattttaaggcccttcttgcaaacagctcctcgggcgattcactcactgctgataaatccttgaggaacatgtacaaacaaaacaataaacaaatatttccgaaacattgtccaaagagtaattaattaattacgtaatgccattaaatgtgtttgcttcacattcatttcattgttcccttgtttaaataaagctgaatttcttacatgtcacctcatcttgctcttttctttggatgttcgtttttagattcaaatatagggttacgggcggtacggagtcccggacttatgaggaggctaaataatacgtataggtcggaaaataggctacgggcttcaggcccgtatacgggtccagcccatattctatttcgagtagtaacttagtcatggtcaaaaatgttgtcccatccttccttgaaagatatcataggaaataaaattgtaatttttgcattctacaaaaaaagaagcgaactttctgatagcatttttcatgggctttctaacgataccaatcattaggcaatataagattgccagaattcaattcaattttttgtgccacacatcgatttcttcttttgctgtttgattttgctttcaaatacttttttgaatttaaaaggtgtaaaataattattggcattttttcatatttgtttcaaatgattttttgccaaaataaaattgcttttcaattctcatgattttaagaaccgcctttaggcagtgaaaattccaaaatttgttccatgccacagatgtttttaggggttttcagggtcggagaaaccgattctggcatctgttttgacccaattcgaaccccaaacccggattcgaacaaaaaagtcaaaatacagttttcaaaaaaat

SEQ ID NO: 814 - DNA, 3157 bp, Heterodera glycines
atttttatttttgtttttaattagtgctttttaattataccaaaaacataggatttgttcgaacttgaacgaagttttagtattaaaaaaaccaagtgcggtttagtttattaggcttataaaactctgctgattggactcaaaaaagccattaatgcattaaactacatgattttacggacataatccgttcatttgttttccttggctataaattaaaatctttactaactgaaaattctcaaatgctctctacctaacatttcaaaaaaattaaaaaaaaaattttcttgtaaaaaaaggcctcgggtcgccctgctcttccgccagtctgccagcccattttcccgctgctgctgttgctgccacctcaacagtgctgaagagtgatcagatcagtcccatcgcccgcttcgcgttcagtgatctggtgatcactgtgttgcgtttggatttctacaggacaggcgacccggaagcgatgtgcgcgagaggggggggggggtcaattttatgtaaagcaccgctttttgaatgcttggcaaattttggaccggaatgcacattttaagtttactgacagtgcctgaatttcaattagcaccgatttttggatacatgcaaaaatagggccgaaatgccattcttagtccggtatttaacgcgtttttaagttgtgattcggtttcaaaaataaaaaccatacaatttgaatgccaattatttttgaaccgttattacaaaggccaaaagacgatttaaacgtttataatctcactgatttatgagttttcaatattctaaccgtgcattatgagtttttttttaaattaatttccaaaataaaaattatttcttttttagcaaattttgcaaacactcattggacattttgctgaaatggggtgaactgccggcaaaaacccagcaatcgttgcggcatcgaatcgaagtgatgatttgtgccgaacaaataccatttaacaattgttagcccatttttgatcctttaaggagaaccatcctttcaatgaagacatcggcgcattgataactggtccgactttatctgtttaaaggagctctaaaaatgctaaaatcccaccgatttcataaattttccaaatcattttaaatgtacagaaaaatttaagcgaaattctgcggaaattaagttatcaatcacttgctttgggccagcttctttcctgtacatgctgctatctttttcaaatccgagctaaattcgcggatattttgaatttatcggggtccgatatttaattaatatttactcatctgacggcagttcattttgggttcaaattttcctttatctattgccaatgccattataaaaaaaatgccaaaattttctgttgacagccgtcaagttggaccccgaattgtgccagccccaaggactgctccatctgctcggctcgctgctcctctgtgttctcgttgacggcgactacgacgcgcgtttccgggtgctgctacggcacatttccgcactgcttggcatccactgggacttatttgaggaggtgccaaaagagactgatctaaacaaatttacaaatttccgaatttttccaattaatacatatacatagaaatatacaaaattaaattttctcaaaatgctgggcactcatctttctgcaagtttggcactttcttttttcagttcgagtcaacgctttgtgatcggctgatcgacgaatacaatgaaacagtgtgagaaggaatatttttaaaaaattttctatcaattaatctttaagctcacaaaatttcttttttgaatcatttttacagtgattgatttaattttttgcggggttttcgcttttattttattatattttaacaaataattttttcaaatttatttttattttcattactcagtgacaatcaaaaggtgcgcgagagcaaaagccgtctgaagaagcttaaacggtacgcaatgatcggcgcggcttcgggcctcggtggcattttgatcggtgatcagaaaataggaattttccttttttataattatatttttcaattttccaaggtgtcaccggtggtcttgcggcgccagtgattctgacgagcatttcggcgctcactgccaccacaattttgctgccagccgccgcttcggccgctatttttgggtccgcaattttgaattacaattaaaaaattaacttaaatatgttaattgatatttgaaattaatataaaatggaacaacaaaatttttggaattttttaatgttttaaaaaggtcaatttttaggggaggggggtgggagtgtttcttgggtttttttgtcatttaaatgagcttaagtttgcagacaaaacattaggccggtaaaataagggggtgggtgatctgccgttcattttgagttgtttgagcgtactgtattcttttcaactgtacagttctgtgtttggagctgctggcgccggcctcaccggctaccgtatgcagaaacgggtgggcgacattgaggaatttcgcatcgaacggctgacggagcaggacaatcaggtggagttaattatgaaataaataaaatattttaatataaaaaattggaactccaaatgctgaattttaaacctaaatccggcatttaggaacttcactgtgttctctgcgtgtcaggatggattgaggaccgggaggagagcgcttttcggcaccactggcgccacctttggatgagcaaggagcagtacacgctgcgatgggagagcaaagtgagttttatgtgggtgatcagtgatcagcagagattataatggttcgatcaacgctttttaagatagcaaaatgagtgatcatttggtagctaaaatgctgatcagtcattaaataagtgatcaggaaacaatgctggattcggccctcaaaacttcataacagactaaaagaccataaaaaacaactgctgactggcacttaagacgcagttgttctgatcattgtaattatgcactggacaggacaaatgagtaactgattgatcaaggataaaatcgatattcatttttttcattttatctctgatcaaaaattacaatagtataaactaaaagtcatcgccaactttcccaagcagtacttggaggaattgggccgcag

SEQ ID NO: 815 - DNA, 3047 bp, Heterodera glycines
  misc_feature (98)..(98): n is a, c, g, or t
tctcctttgttgtttcctatgccatccaacgttcactgatggaaacaatgttggccagcctcgtgtccgccatcgcatggcctttggtgtgtaaaatntaaaaataaaattttttatttttttgaaaattttcactgccaggtgctgcttggttcctcctgtgtcatagacaacccgtggaatatttgcactcgacgtgctcgtcaggtaattaagtgccattttcgggcatttacggccaacaattgtatggaattttgttgcctaaccgaaaacggacattttgcattctgctccctaattaatacaccatcatcagtggaagaagaatgggtttaggtgaaaatgctgtaaaattatatactgggaattacagcttctagaaatctcattttacgatgcttaaagaaaattaattatcatacctgtgaactgattattagggatgcgatttttaggtacaaaaaatcgcgaaataggcacctaaaaaggcagaaaaaaatcgcaaaataggcattaaataggcacaaaaaagcccgaataggcacaaaataggcaaataaaattttttattaacgctttttaagtaacaaagcacgttaaaactttaaatatttcaattgtaaatgaaattattaaatgttttaaagttttttttcgaatatgaacaaatttttaaaccaaaaaatttttattaagaaaaaaatattaaatttagggataatttttttgaaaaattttacaattcttaggggggtattttctgaaattttttttgggtcatttcttaggggtgtattttttgtttttattgcatttttgttaaggattttttcaaaaaccctaaaataggcactttaggcacaaaaaccccgaaataggcaaagttaggcattataaaagtcatcgtagacaccccaaaccatgcggaaagggcttttttcgtgcttatctgtgcgtattaagtgcgcaaaaattttaggcatttgcctaaaaatcgcatccctactgattattaatttttggaatataaaaatgatttatttgatcacatgttttgttcatcaaaaattgaaaatataatttaatggaaaatttttatgttccgcaaaagccctactttttttgggccgcaaattttatgatataagcatccaatccactcgtttattgaatgcgcttaaacccattgctaatttctttcaggtgggtgaacacctcgccgaagtgttgctgacccggcagcacggtcggcgtccgatcactctgatcggcttttcgcttggcgcccgcgtgctttaccattgtgagtgataaaaaaataaataaagaatgttgtagagaaagggacaaactgatcatttttcagtgtttgtcttgaacctaatccaaacacacacattaaatttaggccttttggagatgagcaaacgcatgcctgaatcattgggtagaaataaatcaaataattttaatgaaatttcgttttgcccagcaggcattgttcaggatgtaattctgttgggtgcacctgtttcagcttcgcctcgtcaatggcgtcaactttgttcagtaaatttattttaattatcccattggattattgattgaaattatatttaattttactcacattaatgttatatttgaaatatctttcgtgcggctttttcgttggatataatttttcacaattttcatgttgtcgccggcagagtgatcaatggttactgtaaaagtgattggctgctgcgcttcctttaccgtaccatgagcgtccaatttatcatcgccggcacgggtccggtggacaatcgaacggagcgcaaaattgtcaacttcaacctgtcgcacattgtgcgtttgtcatttttttgcaaactttttgaaaattatataattttcttatcacatatttcataaaatttctaaaatttcccggcggcgcctatcttcaccgcccgactctattgtatcacattttgattttacccctttttggcgcaaaacgatgcaaattcttgtttttcaccctggcgctgaaaattttgaaaataacatttgagataacattttgttggccgaagagcaaaaaaaaaaagaagcttaaacacgggaaaatgagactcgaagacaattttttcactaataaataaaaacctaagaaaattctatgaaaaaaattgaaaaaatttaatgacgaattctaagaaatttcaaaaaataaaaaaaaaatcgctgaaaattttttttctcatagaattttaaagaaaatttttctaggattttttttcttgaaaatttcgaagtttgaatatttaaaaaaaatttattcccggctgtgttatgaatttggactgaaactaaagcggggtttttttcaaattgaaacattcaagttttttaaaaattaaatttgggacaattctttttatcattttaaatgaatatttctgaaaaggtcaaaggccatttggactacgcgaaaaagatgacgcaagtgctggaggccgtgggcgtccgttgcacgccgctttcgcgcgcgtcgtgcgccaatttgtccgaggacgcaccaatgcacgcagaagcagaggaagcgactgaacggcaaacagtacaggaggaggagaagcagagacgggtcagagaacaatgaaaaatattgccggcggggggggagaggaaggccaattcagtctgtgccaatttgagatgatataactttttttaagttatggaccgaatccaacaatttttgcataatttaaaactcttggcagtttttgttagcctattaataattaaaaagaatgtcaaactgtgaaaaaattgtagataaaaaacggtgctaggtcgttatttaaaaaagcatcattatgattttatgtaaaattatttataacttagcttaaaagcaatcaaatttttattttttcatatcattcggtagccctaagtatgctctacaagtttacaaattttagaaaatttcatcaagtttcaaaaatgttagggccaaaaatgctcgaaaaatactcgaaaaacaa

SEQ ID NO: 816 - DNA, 3568 bp, Heterodera glycines
caaaaggttgtcgggcccttcactgggcactgcctcaaaaacaaaatttatcgatgctaatgcaaacggagatgttcctgcagaaacaaggagcgcgagacgaacaaactctggtgacagcaccgatacatttttgtccgcagtgtccaccaataatggcacaacataagataaattcgtttcggctttttgtgccggtgatcattcaggggcatggtccgggtcaaatttcaaaaagcattgtattgtataaattaatgaatcatttcatcactcattcgatgtgctcattttgtttttttcagttttttttattattcctaaacatatcctaacgatgaaaatcgaaaaaaattttttcttcatttttacttttgttcgaattttgttgtgttttaaagtaggtaatgttaataacccggatttacctatatcagctaaaattccggaataaatttatacccgcaaacaataaaaaagctagaattgctcattgaaaaataaagaaatgcatttaatttttccgtggtaataaaatttttataaaacaactgaattcctcttattttaagtaaggcaatttccattttgatagatttattttgaatttctttttagtttaatttcgatcaaatgatttaaaaaaattttggtttcaaaattttttttttttattaaagcatgaatagacgacaactgaaactcatcttttttcattttcaaattgccatgtgaaaatatcgcccgtcatccgcattttacgttgcttctttcaaattattcccagtcaccatcgccgccgtatgcgcttgccaagttggccaacattagttttgtggccaattcagtctcggaaacaatctgtaccgtcagcggaacgccattcactctttcgaactcggctccaactgtggacatgtcgccagactccgcacgggtgatcaccagtcgaatcagatcacgttcattttggctctgaaaaatgtcacaaattctcgttttaattaaagcaaaaattcattaatcttatgaatgctttgttttcaaatatcaatttccttgattgcggtgctcaaacggtccgcaaaatatcgtgccggattgcgcgcgtgttgtacgatggcatttaatgcttgcaaaacatcaccaccaaattccgcagcaaatttcttaacaatacaagtctttaaaatatgcattttttaatattttcataattatttaatattctttttgtaaaaattaaaaaaaaaataaatttcggcgaagcaaattctatcatttcgcatcaaatcaaaatacctgttcaatggtatcatcataaaaacgatcatagcttctgaatgtctcgttcagttgtttttgactttcaattgtcaattttgtaaaaaatgtttcttcgtcgactccatgtttgtgcactgcaaacaaaatcgttgcgtcctaaataaaacaaaaatggaatttctattatataaaattattaagagtaattgaaaaccccaaaaaggcggaggcggcaaactttggttcgcaaaattttttagatgatgttcagccgtggaaatgaattttgactaggactcagaagcaggtccaagctcggtttttaatgattttcgccataatcactgacctccactaaggtcggagtattaaaaaacaaaataccacctgaaatgctttgtcaatgtttactgtagcagattcatttcggtttgcagcaattaatttggtcagaagcaagttgtaagcaccactcgtgtcaccgtcaatgtgctttttcaactcctcgtggtacagctcgacgtatgcctatggataacaaaaaatgaaatttatagtgactaatttatgacatgtacttaatgtacaaccttgcggatggcacggatctgtgcattgcttcgtgagattaaaatctcagtcaggacttcttcatcagttccgattcccttaaatcaaagaaatgatccgaaaataataataattacccccctaagaattttaaaggattgccaactttatttattttttcttataaaaaatttatgtttaaaaattttccttaatcgaaaaatataaagtatttaataatctttttaatcggtctctaaatagcagaaatcaatttttagtttaaactgccgcacattattcattaaaggtaaattaaatctttttaataaaatttcacaaaaatagttgtttaacttaccatcattgcattataaagacttgctgcgtcgtaaatggcactctcataaagcagcgacaaaatgagctcttttggcccaccatttggcaatttctttcggatgctctcaatgagactctcattgtgatgctgcacttgaccaattaggcgacactgaaattacaaataatattactgagtaataaattattatagaattattaaggatgcaatttttatgttttagtcaatttttttttactgagctctctatgatctgaaatgcttgaaaaacatttttttttttggcggttgttgagctacttttacgattgtattatttttcaagaatacactcctaagaatcgagccgaaaattttaaaaaatatacccctaagaattgaaattttctcaaaaattcaccttcaaaattatttatctatttcttcacaagaattttacgatttttaactgaattatttatctcaatattggtttgatctattataataaaattttgtcatttacagccctaaaaatgaggtttttagtgcttgttttgcatttttagagcctattttgagggttttttagagctctgagctacctattttggcagttttttgagcctaaaaattgcatccctaataatcatattcagatttgaaaataaatattcaaataatttttaaaattgaaaatataacaattttaccgtggaaaaattcaatgaaataagaatgtccaatatttgataagccgtgtagacgttgtcttcactgccctctctttcgagcaatttgaaaattctttctgcatacttttcagcaggattttcagcttgaataaagataaaaaccataaattttattaatataatattatatttttttgtaaattgtcgctggtgcagtttttgctaatttataaaattgtcactttgattggccgagtagccgttgctgctttcatccgctgaaataaagaaaagttaatattttaaaaattcattccttataaaaaataatttatatctaagggagagtaaaaggtatcccaaaaatattctaatataaatttatagaattggtggttaaagaatttctgtttaaacaattgaaaaaaatctttaaaataatcattttgattagaatctgttaaaattatccacagcgttgtttatcgacctttgtagtgatttagctttgtcctgaattccgaccccaaatttgtgaccgtcccgacccaaatcccggtgtttgccaatttagatacctgaaaatttgtttttgcattgaactgctccgcatgccttgtttgcgagattaatgcggtgttcgctcaacaattgagtaacactcatatatcaa

SEQ ID NO: 817 - DNA, 1676 bp, Heterodera glycines
gaaacttcgatgacgagtgcagaaccggagtctccctgaattttacaataggccggaatataatcagaattttcaaattttgtaaaataaaaaattcttgttcttcttttgtcagagaagtgccccaggactgacaattaccgggacttgcttgaacctgaaaacggtctggcgaatcgggacctggattttaacccgtaccggaaccggaaataacgggaattattcaattttaaaaaaatatagttataattatttcgttcaagcaaaaatattaaataaattagattatgaaatgtttcgaatgaaataataagaaaatgaattctaataatctcttttaataattatttttaattaaatttaaataattgtgattctttttgtggaactaccggtaatccgccttgggatcgccctccagcgcacatatggaatttctggtcaaaactgatttttttcagtccctctcggctaaaagtattgctaataattatattaaataataaatttatttttcaattgactcaacctggagcattcttccgtttcttgaattgggacggtgaggagctggagtttgttgggaacagatgcttcattcttttcattcaaaatttgcccccatcctgccatttggccaagacgatgtgacaaatcaagcgttcggcttgaaagacaaattggccttatgtaggcccccaaggacaacgggttgaccagctaaacaagtaaaaataaaaatgaaagtaagactaatttataatgcgctttaacaatttttccacattaaaaagaaacgtatttttaaattatttccttataaattaactgaaaaaatcacattttttgaaattgataatatataattttctattttgaagtttccgtgcctgttttagggttactgcttaactaattcgtgaaattctcagaaaaacctttttatctttgcttaacacatttgctaattaaaataatttcaatgcttttagttccctaagatacagtcatggtcatatgtttagcatcagtgctaataattggctaataaaatcttttaacaaagagcaaatgccaagtatattctaccgatcaatagcatattcaatgggctttcaaatgagaccaaaaggtctactaaatccattaatcaaaactcaattttaaatataggaaatattctgaaaaaattactctatgttatcttttgatgctgaccaaaaaatatattacaccaacttgatcagaccactccttaatagtgatctggacaccccaaaatactgtgcagatcggaaaatttttggaaaaaaattcctaggtgctttggaaaatttttaggtaattttgagtagacccattggaaagagcagaaatctctctacaatattcaaaaaaccgcaagtctctgcgatttacattcgccaacgtgtgtgggcacttcaatttcatgctgatcatttatctgtaaaatgcactatttccttaagaaatacagtactttttgtagacaccgaaattgaagtgcccatcctcagcgggtataagtcgtagaccgaacattcaaaaatcaattcggtagacaattcagtgctctttcttttttgatcagcatcaaaagttagcaagcagtaattttttcagaatatttcctataattaaaattgagtttt

SEQ ID NO: 818 - DNA, 1942 bp, Heterodera glycines
  misc_feature (1821)..(1821): n is a, c, g, or t
  misc_feature (1924)..(1924): n is a, c, g, or t
ataattatcagggaacggattttaggttttcacctatttttttgcggatagcatatgctgagataagcgcaaaaaacacattttcttcgatcacttttcaatttagagcgactttttagcaactattttcgcttgtgaaattttaacaacttttttgactgtgaaattaaaaaaaactattttttcaactatttatgcttttcaagaaaaaaaatattatgaaaaatgcaataaaaaaaataaaatgcacctctaagaatcgacgttaatttttttcaaaaaatgcaaccctaggaatcgatttttcaaaaaacaaaaatcctgcccatgatttggcgaatgatcgaaaactttttacacttgaaatcttcaaatgtgtttgatttacaattgtgcaaccaaaaaagataaagatgaggaaattttggaaaattcgcacatttattgacatgtttttccaatttttggcaactttttagcaactatttcggggtttccttcagcaataaaaatactctaattaggggatttgtttttatagaaatcagcttggttagcgtttagccctgattattgtatctcattaaaatttaaattccttttttataccactgagagtggaaattttcatgcatttcctctgcaaaattgcatctcaagagcatgtcggtgtaattcaaaaaggcacagtgagcggcagtgagtagaagagtcgaggaaacaacgaatccagtgcaacggtccacaatgtgttcgttattcgggcattttgtttcgaagaacagcagcgcagtccatggcgaataatgagcgggagaccccgatccgcccatggactaaaaaatcggaggaatgagaggtcgtgccgcgcattcaaaaaatcctaataaaatatcttctgactcactcgggtttcttcaatttcgggcactgggtcatgcattacaccgcacttgcttaagcaattgttaagctgaactgccgaaaacgttgcatggataaaatgagggataactagccaaatcagaataattaaatgcattttctgaaggatgcgttaaattgaatttaattaattatgattttcaaaaatcaaattttgtgcaacttattttctaaaatactaataccggaagcataatgatgtatagaacaaacaatcagtaaaaataaatactaataaggttaatcgaaaacaggatgtgtagtaataatgtaaagaatgatgcgcaaagaatgagagaatatttgaaagctgattctgtgtaattcatggtgaccttcccccagggatattttagcgaattgcgcagatggagcgacttgaattgttgcaaatttcaggcttttgattgcccaattaagcgccgcaattccaaggttgtccaacctattaatgaccttctcattctaattatttcttacgtgaaaaaatgaaaatcattgtttcttttcctttcataatttgctcgctttcaaaaatcattagaaaagacggacaactaaaagaaactttttttcggtagccctaaatgttataatttatctgaatttaaaaaaatgcccaaaaattattaatttaaagaattttttgaaattcgcgtggtaatagagaataattatttgttagggctattgaattacagtaagagacttaagtatatggccaaacagtgtcgttgaatatattattgtgtaaaatcccgaaaataacattagccgaaaaacgttcttcatacaaatttagccttattcttgagctttcaggagaacccaatttcacttccctttcatcgctctacaaatagttcatccactctngaaatgttggctcaaaaatttgtggccaaaaaagtatatggtcaaaaatttataatttttttactcacggctaagctaatggaaaaatctgaaatattcctgntatctaaattttttgctg

SEQ ID NO: 819 - DNA, 5396 bp, Heterodera glycines
cacttttacgaaacgaccatactgcgtacatatttttgattaatgtttagcttttgaatttaaaaatatacttttatgtgcaagaaaatcaagtaaaatggattttttgggttaataatggtatttttcagatcatctatgaatgtttttcaaatcttacgaattttaactatattaattgtcatttttaaaattttaaagtatgcattaaaagaaacgaaaactagaataaaaaaattacttgttctctgataatgaattatagagaccgggctaaaacgggctaaattttgccagtgaaactgcccaaatttgaaacatttaataaattttttggcgaatattttagttcagaattttgaagaaagaacttcgagatttttggaaaattcgtacatttcaactgttaaaaagatcactccacctaaaattttcaaaatttgttcttttatgggaccttaaaacaaaaaagtgccaagtttggtaatttttaacaaaattctgttgaggaatcggttattttcaaaaaaaatttcccggccgcgcctatcggcaccgcctaaccttcctcccatgtccctcaaaaattttggaaagtgcgctgcaaaaaaacttaatggcgccaaaaaatacatttaaaaagcgaattttaaacagacgtcaaaaaagaaagaaatgattcgaacaaaagaatcaacaaaagcatttgtgagaaaatgagagcttatgatcaatttccaattggtctcaaatataattattaattaattcacttcggcgcagtcagacgaagacattttcaaaataattattcattccgctgatcactgggcccgggagtcggcgagaacacttttcgttgctttgacgcgcttcttccgttggagtcggagacaatggccttaattggtgctgagccgtataaaaaacaaaaatggaaattttcaacaaaaaactggccataaaattttgtatacccatgcaaatcacataaatcggtattttctcaggttattaatgcattttacgcgtaaaattctgcgaatattagcctaaaattattcgatgtttcgtcattaaatgaggtttttacattttaaaatacgcatcaaaggaaaacaaaatttaaaataaaaaattattccctattttatttcgtcatttatcgaaaaggacctaaatgatttgttggatattagacctttttatattttaataaaatttataaagcatgtgaccttaatgcatggaaatgatgttcattacatctcaaattcaaaaagctctacaatgaaaaagtgattttctacgggctttccgataaatgccttaatatgaaagagatcaatttttttattcaaattttggtgccctggaaaacaaatttataaaattaaaaaaccaaagatttacaagaatatgcttaaggtgcttttcttaatatgataaagcgcagaagaatgaaaagcagaacatttttagttttttcgcggcatgctttttccaaaaaaactggggaacatggaggtgtcaggtggcgccgaaaggcgccgccgggaaaaaaatgaaaatttctatgaaattttgctaaaagtttttgtctaaaaatgactaagatttggagctaatatttaaaaataataagtttttggagcgggcggtgccgataagcgctgccgaggaaaaatttcagaatttttaacgtgttttgttaaaaaatagccaaatttttagacatttcctcttttctcctttgctagcctcccccctctttatgtctgttaataatactacaaattaccaagaataagtcagatcaaaccgaaatatgggtacatagccttttaattaaaaaaaaattcattttataaaaaataatcttgcaagaaatcgtctcgaaaaataatccaaaagtcaaattactgatcaaaataagcggaaaaatcccaaaaatccgtaatccgccaaaagtcaaataactgaccaaaatagcggaaaaatcccaaaaatccgtaatccgcaatccataactccaaaaagcccgcaatttccgtaacccccaatcagcaattgcgtgcagccatgattgaaagtcaaatttttgtgaaaataaaaggaaccttttacttcttaatgtgaattcaccagtttgaaataaatttttattgacacatgataaaattgtttttacaacctttttttgaaattttattttattgaaattttttgctccgctaatatccattttccattgtccgtaaaccgcggtccgcaaacgacccgtcccgttcacttatttttttccaaaattgttaaaagagataatgggcggcgaaaaatataaatattttgatcgaatagattgtaaaaataactgatttgaagcaatttcgagaaaaattctaattttcggccccaaaatctattttttgagcctgagttctgattttgaaaaaaattttcgatcatatccctgatttaaatatgaatttttaaaatttatttcgtgataatatttgtgaatattttttccggggatgacctttttgttatttgatttaacatttgttccaaaatgtccccaaatatatattatctattagttattattagctaaataaaataaagtcatatttaaacaatttagcacatttagcttcttcctttttttcttatacataattttaaagaaagttaaagcattttaaaatcattttacaaaataaaaatgcaaactttgccagtgctttttaatttcctttttccaacaaaacgtacaattgattttacgatatctctgctgctgacattaattagcatttgcaaatgcattcacaacccattcaaccatcacaacacatcaaatgatccacaccatcattttgtgatgaataaaccaaaatataataaattctcaaataagttttttgaattaatgagctttgccttttagttccattcttctctcttcagccattttggatggaattcgatttaattacctaatttgttttattatttatttttttaattttcatattttgaatattcagcaaaatttaagagaagtttttagtttgattttattcataaaaatggctgcctggatgttgcttggtgccaaggttgttctgtttgtagcggtcgtcgttgttgctgtggttgtcataaattatgcatccgaacagaaggcaaaagtaaaaaataaattattattattttgagaaaaacaaaattgaccaaaataaatagcacattaatgattgatccaaccttaaaacaccgactttatatttcaaaaataattttcgattatttgtgttaatatctgtgtataagctagtcaagttttcgactttaatttaagaaaattaaattggttccgcattcgatgggatattccgttcccatagcaaaaaactgataagcacttatttacattctcgttttccctaggtcacagagattatttttataattttttagagataattaaaaaggaaacacaaataaatatgaatatcatatgcctgtcgtagatcatttttatgacaataaaaaatttaatttcaataacttcagtaatgcaatttttattataagtatgcatttctattattgacacaaataatcgaaagttatttttaaaatttaaagtcagtgtcggattttcctagagcccttttaagacatttgctcgagttcctgaaacggaaattattattttggcaaaatccgttaaaataaatcaagtgcattttcaaggaaacctgtgccaaataatcctcaaaactggcacttattttgacaaaatctactacaattctcttaaatcttttagcataaaaataaaatgttttaaaaatagcaaaagttaaatttaaaaaataagtggcgtgttttttcggaatccaacgcaatttacataccaatgctagcaatctcaaagcttaattccctgtatttttcagtatgaaaagcagtaccagagtgaacaatgggcggaatgggaaagcgaaagtgatggaggaaacaatggaaaggagggaaagaagaagggaatgtttggaaaattcaaggacaatgtgaagggaaagaaggacaaagccaagaagaagatgaaggaaaaagccaaggaaaagaagaagaaactcgagaacagagtcttcgaagaagcagttgtgtacggagtgcgccgcggctttcgtcgtttcatgaaagaatgagagccaaaacttcactataatgcgtagggccgcaaccttgagtgacgaaaaatctcgaaatagccaactaaaatagagacaaaaagtgccaaaatggtgacaaagtagtgaaaaaatccgaaatagtgacgttatagtcacataattttcagccaaaattgagcaaaaattttttattcgctgaatagttgcaaatgaggtacatttcttttctaatcttttattagcaaatattggactttttaaatcaaaattttgtcaagaaaaaaaaatttggtagatgcattttttgagaaaattttccaaacaatttttaggtcgattattagtggttatttttgaatttttttaaagttgattcttataggtgtattttttggtttcattgcatttttgttaaggaattttccaaaaaatgtcgaaaatgacaaaacgccaaaatagtgatttatagtaacgaaaaatgacgttcaaatgaaaaaattttaactcaaaaatgcatttttgagctcctttcttcaaacaattgagcaaaaaaaaaagaagttttttttactaaaagttgcggccctaataatgaggcttatgtttttatgatacatttgatggattttttaaattttgtcagaaataaacctatctaaccctagagattgaattgcattcgataagattcttcttaaaataattttttctgcaaatattgatgctggtggttacagcacaagtgatgttcgagagtcccggcctcgactcgagaaaagtcttgggtttttttggtctcgaacagcactcacagcgggaaagggtcgtttcggcgccagccagagtttttgggggaagaagcatttcattgttggaagtgtggagaaatgtggcgacgatggaggaggagaagaagcgaatatttgggatggagacgaatcggacggcgatggggagaaggggacggaggaagaggaggtggtgaaccactgcagacacagaaacgggaaataaattctaaaaattgacaaatcccaaaagatcgtccctcactcgttcaggacagcttgagaatcacggacggtctaataggtctcccgggtcctttcccgagtctcggaaacttctcatgtattaacataaatatgggtactacctacccccagggaccgtcccagggggggg

SEQ ID NO: 820 - DNA, 7529 bp, Heterodera glycines
attgactacatactacaatttagagtcatggcactgttagttactgttttttcaaaaaatttatgggtttttaaacgcgtcagtgcttctcagatttacatccaaattaaaaattttcttgcaattccattttacaaaaagatccctccctcctctctatttgccgaaaacaaatttcaaaatcattcattcatttatggcacttatggataaattttttggattttttttttgccaaaaatggcgcctgaatatatttggcccctcaatcagcaaaactgttttttaatcatttcatttgccatttttttttaaacagagaactaaaatgtatgccaattttccgatcacttgccgtgccgcttcatcatcatcaccattttcggcacaccgtcgtcgtctgcttctgctgctgattgtgctgctggttgtgctatcagtcgacgtggatgttgcccatgggatgtttaaaggcatcttaaataaagcatcatcatcatcatcaacatccctcatggatgttgcccatgggatgtttaaaggcatcttaaataaagcatcatcatcatcatcaacatccctcatggatgttgcccatgggatgtttaaaggcatcttaaataaagcatcatcatcatcattaacatccctcatggatgttgcccatgggatgtttaaaggcatcttaaataaagcatcatcatcatcatcaacatccctcatggatgttgcccatgggatgtttaaaggcatcttaaataaagcatcatcatcatcatcaacatccctcatggatgttgcccatgggatgtttaaaggcatcttaaataaagcatcatcatcaacatccctcatggatgttgcccatgggatgtttaaaggcatcttaaataaagcatcatcatcatcatcaacatccctcatggatgttgcccatgggatgtttaaaggcatcttaaataaagcatcatcatcatcatcaacatccctcatggatgttgcccatgggatgtttaaaggcatcttaaataaagcatcatcatcatcatcaacatcccgcaacgaaagttgtcctgatcctcctagtgtagaacaattgccccatataacgtccgaagacgaagggtggaaagattgtgtgaagcagtgcgaacgatacaatgacaagctgtttttttgtacagcaacatccctcgattttattataaaaagaaacgggaaacaatgtcggtgcaaagcagggctgcacgcaactggatttgcaattacggaaatccgtaatccgtaattacggcgattttctcagttacggaaatccgtaatccgtaattacgggggtccaaaaaccccgtaatttcccgtaatccgcaatccgtaatccgtaatttttaaaaatcaatttttgtcagaattttagaaaaaaatttttaaatagtgattaataaaaatcaaaaaactgattttcttgatggagtttcttcattttttatttaaattttacaaataatttataattttgtgtctgatcaaatcattctttttgaatttatgggttgatttttgaaaattttttgaaagtctgatcattataatcggatttatgtatatgtatataattatttcaacattttaatagccagaaaaaaattacgggggggggggggggggggaatccgaagaatttttttggtaaaatttatttagtgttatttaaaaaagttcagcgccgaagagcaaaaacaggaattttaaccatttttagccaaaaaagactaatttttgccattttggagtcaacatttaaaaaataaggtaaaatcgagtaaatcgtggtcaggcggtgccgataggtgccgtcgggcaaatttttttttaaattttaatgattttattaagaaaaatcgacaaaaaaaatttaaaagtcccaatttttcctgtaaaatttttaatttttcatttcgggcgggggaaggggggggggggaattcctccccttacctggctaaggttttatgaattttcataaaatgcgtgaaaaataggtgtgacaaaaaagtgatgcctctattttctaggcgaactacccaaataaccttaacaacaacaaataagaaattataaatctattttaattcttaaataaatcgaaatacgggtagccctttaaataaaaaatagaataatttgttttttataaaaataatcttacaagaaatcgtctcgaaaaaataatccaaaagtaaaattacggatcaaattacggaaaaatcccaaaaatccgtaacccgtaatccgtaatccgtaactcccaaaaccccgtaatttccgtaatccgcaatccgtaatccgtaattgcgtgcagccctgctgcaaatgcttgacggaaggcaacggcgacaacgacaaaaagggcgacaacaaagaaaaatgcgattgcaagccatatacatttgatgaatcagctcagccaaagccggatcagcgtgatctgcctcataccagtggacaattgatgactgattgattgattgatctgttgggtgattgaagatttgtagtgtgattacccaaattttcattatccatccaatcatcatcatcatcatcatcattaagcaaaagttatgaacatattagctctgctgctcgcagtatttatttagtctcaggcccatattaccagaaaaaaaagtttcaaagtgggaaaactgaaaaaagatgctttaaaatgttttttccggtgcaaatttccaaaaaagtttgggcgccaacgaaatgtgcgaatttttctacccccccccccctgattatgggcctgataaaatgccatttttatgtattgtttgttgcattgtttttttgttgtttttattgctgcaattcataaaaattggctggtaaattgaaaaactgctgatcattgagggaagaaaaatgaaaaattttgttttttatgttttaagtaaattcaataaaatatattttacttaaaaataaaaataaagaattatttttccaatttactctttttaaaataggtttttgtcaattttattataatcaaaaaatgttttgtttaatattttagtaaaaaaatcaataaaatgtttgatagaaatatatttttgtccgaatccaagtaattttttgaatttttttttaaaccaaaaaaattaaacgaacatttgtggcagatgaaaatgaaaatcaaaaaatgccggaaaaggtgttgggcggcgaacgaagttggcactgttttttgcgctgcatttcatatttattgttgactttttgcaacttataggctgataaattgaaaaactgatcaaagatggaagaaaatgaatattttttaaaaattttactgtattattcccataaattaggcttactaaattctggtccaatttcttcaactaattgacaaattatggtgtttttctgttacttatgcttcacatttaccattacgctttgttgatttaattattcttaaattaattgccgattaatggactaattcattcaataatttttggtccaggcctccatctgcaagtctggccgagtggtctaaggcgctgcgttcaggtcgcagtcctcttcggagggcgcaggttcgaatcctgcggcttgcagttaactttttaacaattttaaattaacaaaaagaattttgctaaaaaaatattaaatatacaaaaataaatgtaaaacataaaatattttgcatttttttaattttcaaatgctttttaaatggtttattttattaaatttagctgcaaaatatagttttacatcggaaggggctctcctggaaaatcaatttaagttttgttaatttttaattatttttttttaaattttttttttgcttcacattcacaggcaaatggccaactaaaaaaactttgcaaattgttgccaaatttgaatatgccaaactgaacatagcccaaataatgccatgcccattgaatttttcctcaaaattgccctgtgggagaaaattggccacaacacctaaaattgcttacaattatttagcagcagtcaaatatcgacatttcttctttttgcgctttttcgaaattttgcttttttgccaaatttctttcatttcaaaaaaggaaaaatttgaaacgcattttcccctaaaaaatattcgtgaatttcccaaaatttcaaaatcgaactagcaattagcactagctactatgacgttagtcagaaaacgaaaaaaaaattttttaatttgtttatcctttgctaacaacaccctattatagtctctgttaacctacaaaatttcaaaaaaaaatttccttaactctcaaaaatattgtggccaaaaaacctttgaaaccccctgggttttttgatcatcttttaggcataacttatttgaaactatacaaaatttgaaattctcaggcaaaaagagaaaatttagggctatcaaaaatctgcaattagttttctatacctccctaaattcgaaattttttttcgaaaaaactccctggttttcctcaccactttattttattaacccaccgtccgtctgtctctatccccattccgataattattaatttttttttctaattttttaattaaaaaggattatccccctgttattgcccaaccgacggagtgccaaccctcaatttgtactttccttgccactttgttaccttatttagtattattattttaatttttgtcaccccctccgccccccccccattttcccattaaaaacgtgggaaaactgacaattagcaaaattgtttcccctggagccaatgcgcgaaaacgacttcaaagcgcctttgccgacattacgcctgaggccttttggccctcacttcaaaatgccattcagtcaagtgccgtccgcctcttgcgcaacgccgctgacttttcacgcctttttgttttctaatccaattagcggcggcatggcgccgtaaaaaggcacaagccctcgcttatacaatgtgacacttttttcggggatgctaaaaagtggcttaattaacggaagaaggaaaatatttttttactagaatttgttcgggagtttgttttttcgggaaattcttcaacatactatatatttgtatttttttcaaacattaatttaaaattgttatttttttagctttttatattgaaatatttttaaattatttaacataattgtttggaaattgattcttttatatattttttaaatataaatttaaaatataattatttttttatttgttatttttaaataaactttatcctaaaaattatatatccttgttcatttcaatgtttaattatttttaaatttaaattattttttaaaccttccctttttaaaagaatgtaaaaatagatttaaataaaaatagacaactttcattataatgaactaattcataatttgcctataatgctacttaatttaaaaaatctcgctcgaaaaatcgcaaaattttatattttattcattttaaattacactaatctccaataaaaattcatttccattttcaaaatggcatttttcctcaagggttgtcactggcattttggcacaacgccccgcggcgcacttcacacaaaacacacatcacatattgccgcaccgtgccatttaagtgtgcctgctgaagtgccgtgccagagcacattgttttcccgcaaaattagggtgccgaagatggtcccctccagcagggctcacaaattttgccctggggcaataggggatcaaattctttgccctggcgttgcgggcggcggactggcggcattcatttcatttcccgcaataatccctgccggggggaaaagggtcaaaatgccaatgccaatgatggctcacaccgaaaatggactcattggcgttgtgtcggtgccgatgccgtccttgtccgtcgttgtcagtttgatggtgtgccctgaggcactttttgtggtgcatttagaagatggaatgaatgactaatgccacccgcccccccccacctctcatccccgcggggggtgccatttgggggctatcatttttgctttgggatagttaaatgagcaaattggttttgacttttttaaagcattttgccaaatttggcatgaaaaaattaatagcatttatcaagcaatttttgaaaatttagtgaaattctatttatggtgctccatatttttttaaattttttaaatctaaacacgtgaagaacaatttttataataaaattaagcaaaattattaacccattttggcacatattctcatttatccacttttttaaaaccttttctcaattttttaagcctaatttgcccttttcaagtcttaaataattagatatttctaataatcaaaatgaatttaaatatgttcaattttttgtgttaatttcggaattttatatttttaagcagaatttatatatttttccgccttttcatggtaaattttaaagaaatgagcatccctaattattggcactattaaaattatatttttcattttttttttttgtaaattttgaattcttatatatttttaattggatttacggtttacctcagttgggccccggcacgtttgggcccagaatgttttagactataaattctttctttgtcaaccaaatccaacaatcttaggtatcattcgagagcccttcacatgccctattagcatgcaaaattccaaaaaatttcgtcaattttgaacaaacttatgaccaaaagtacatcagaaaccagtttttcagtcattttaggccataagtttgttcaaaattgacggagatttacgagattttgcaggcttatagaggacactttgggatatcgaatgatatcaataacattggatttggttgacaaacaaaaaagttacagccaaaaacatggtggggggcccaaacgtgccggggctcaactgagcgagtccggtagatttaatatttttctcccttttcatagaaaaatttaagaaaattcgtatccataattattggcactgttgctcgccgcgcccctccccagaaaatgccgttgctgccggacacttcggcaccgatcattttcctccattttccgtccacactgattttgctgtgctcaacttgtgccgtcaccgggggccacgcgctgctgctcaacggagaatacccgtggacatatgacaacgatttgttcggcggtgagttggccatattttaaaaaatcggcgtcgattgaaattaaattgtgcgacatttggcaaactttgggctacggtaattttgtagcgattgcctttctaattccttaaaaattgcttgtttaacccacaaattgatgtcttataaatgaaatttgtttttgaaaattcgggatttgttcaagaattttcttggtcggaaaaatggatgggtaccagggctggacgcaattgcggattgcggattacggaaattgcggggtttttggacccccgtaatagcggattacggaaattgcggggtttt

SEQ ID NO: 821 - DNA, 3156 bp, Heterodera glycines
  misc_feature (20)..(20): n is a, c, g, or t
  misc_feature (30)..(30): n is a, c, g, or t
  misc_feature (79)..(80): n is a, c, g, or t
  misc_feature (164)..(164): n is a, c, g, or t
aattttaaaaatataatttnaatgtattantcactttatatattaaaaatctatacattctctcacccttcaaatgttnngagcgaaatttcatagtaaaaaatacgagaggaattgttgttcaacaaaatcgaatacattgcgaagatggaacgaaaaacttntaaaataaaactattaattttatattaaataattaaaaaattaccccaagcatttcccgtgcaatggaccgtcaaacttttgccatctttgattttgatatcattttgataagagttttcttcccaacaattttgacggaaattcgaatgcaccttaaaacagatttttttaaaaaatttatatgcttaattgtcagaaatgttatgaatctgttacattttttttaattgtctccagcggagcctatttatatgttaattaactgttcttatacacaccgtttcaattttggcctcccagttctaaaaagatttgcatgtgtggctcagtggtttttgtaagatagtaaagggacaaagggtgttggttcgaatccgttgtgcaacatgaatatttttatttatttttgtgcaaaaaattaaaaaatgaccatttttgggaattatttttggaggtttttaccaaccaaattgtacaatcttgacatcattcgaaagcccttgatggggagaagctttttctaagcaaatgctaagcaattggattgattaggaaaaagatatgagggttcgaaattttgtttctcgaataactttttagttaaccctttttttgcttttaaaaacccttacattttgttcgtaatttttttctctatcgacatgcaaaatttggtgtaaattgtatgagtagaaaaaaagttatatgtggcgaagtaaattcagtttttctctattaacagagataaagaaatagtacgccaaaaagagagatgttttttttctctgcgctctctctttattggttcatgtctcgttttttgaaacggtgtatatatacagtagataaaataacattaggaaaaagaatatgaggcaattaatgctgatcaatcgttaaatgttatcagattgcatcttttcggctcattacaatattttagcgtagttttagaatttttggaaattaccctttaaagttttagtctatttttaattaaagagtcaacaattacataatttattttatgttttcttaaatttcggtgtggtccagtggttaattgtgctgtgaccggtcgtgggttcaactccctccgggtgccatccaatttttttcaatttaaatttgtagtcaactttgttctcccacaatttttcctattttcttttttttgcggagaataaattggaaaatgaaatgtgccatcctattattcccatgggcaacatttttattcttcaaccgcattttttggcatttttttttttggaatgccacacggaacatcacaaaaatattattttggaatcacccaaaatttattaatttaaattttttaatttggcattttattttcagtaggatattttctttaaattttattctataaaatttatacaaactttaaatttttccaaaaatattatcttggtttaattttacaatttttaattctcttaaaaatatttggcattttgttgaaaaattccaaaaataatttttcgcctaattctctcaaaatttggaaattaaattttctaattaactcaattgatgcccctttttagtccattttcttccattttttggtcccatctgtgccggagtatggatggcatcactaaaaatggtggcggcacacattttaagagaaattttcctcagatcgtttacaaaattcaatttttaaaaatcaaaatggcattttaatatggcaacaattatgtaaaaaaatattattatttctttttacgttcatcttttcatttttaaatttaattttatttagttaattttaaaaataatttaaaaaacaaaaaatacattttaattttaatgattttataaataacattttttaaatttaaactttcaaattcattttaagaataaattaattactaaaaattacggcatttaaaaatattgcccttaagatggtcgaattctcctcatcaaattgtaattcaaaattttttttttggaattttggttcatttctgtgccattgtttaccacccgccgccaaaatgtggcacaaatttccgctcatttgcgcaccgcggcagaccgcgtgccgtgccatcgtctacggcacaaattggccattatgcgcctccctcgggcgcctgctcaaaaagtgccatttttcatattttctcccacggcacagccccagcggaaaagaatgggtggtgtgaaaaatgcttaaatgcgctgcttcgttctccacgatggcacacatgctgatgtttcatttctcttccagaggctcctaattaaaaagaaaatccattaaatctcaattttttgtttcatcttcgaggcatgccgagccgagatttttctgtgttatttctaaatttttagcgccgggagaaaaattagaaatttgtagccgttttttgtaagaaaaaaaagactaacttttgccattttggagttaaattctctaaaaaaactggtaaaatggggatccaatggtgcctaaggcaccgccggaaaatttttagagatagcaattttaaaaaaattgctaaaattttcaaaatttattatttttttattctttaattagcactttggttgacttccaaagccttcgctctcaaaaaaaaaatagaaatgttaaaacccaaaaactgtctttcattacttcgagagtcttgataccgtatttgctttatttgtcagcccccaaaaattacagtacccattggcttgaattttgtatgaaaatcggtccaatgtcgtgctgctgttggtggcttgtcacctgcttctgttttattcttctgtccaccactcagtggaccagtttgattggtcaacggataggtcaatggaaattttagaaaattcctaggccttgtacaattattttcaaaaattttaaagacaggcctcgaaaaattgtgatttttttttaaattttagggcccgacttttggggactgatgcacaatcattggcgaatgtgcaagtaag

SEQ ID NO: 822 - DNA, 4769 bp, Heterodera glycines
  misc_feature (51)..(52): n is a, c, g, or t
  misc_feature (55)..(56): n is a, c, g, or t
  misc_feature (59)..(59): n is a, c, g, or t
  misc_feature (61)..(61): n is a, c, g, or t
  misc_feature (63)..(63): n is a, c, g, or t
  misc_feature (68)..(68): n is a, c, g, or t
  misc_feature (89)..(89): n is a, c, g, or t
  misc_feature (98)..(98): n is a, c, g, or t
  misc_feature (114)..(114): n is a, c, g, or t
  misc_feature (116)..(118): n is a, c, g, or t
  misc_feature (121)..(122): n is a, c, g, or t
  misc_feature (125)..(126): n is a, c, g, or t
  misc_feature (133)..(133): n is a, c, g, or t
  misc_feature (135)..(136): n is a, c, g, or t
  misc_feature (139)..(139): n is a, c, g, or t
  misc_feature (144)..(144): n is a, c, g, or t
  misc_feature (146)..(148): n is a, c, g, or t
  misc_feature (151)..(153): n is a, c, g, or t
  misc_feature (159)..(159): n is a, c, g, or t
  misc_feature (173)..(174): n is a, c, g, or t
  misc_feature (179)..(179): n is a, c, g, or t
  misc_feature (185)..(186): n is a, c, g, or t
  misc_feature (190)..(191): n is a, c, g, or t
  misc_feature (195)..(198): n is a, c, g, or t
  misc_feature (200)..(200): n is a, c, g, or t
  misc_feature (202)..(202): n is a, c, g, or t
  misc_feature (208)..(208): n is a, c, g, or t
  misc_feature (212)..(212): n is a, c, g, or t
  misc_feature (225)..(225): n is a, c, g, or t
  misc_feature (231)..(231): n is a, c, g, or t
  misc_feature (250)..(250): n is a, c, g, or t
  misc_feature (259)..(259): n is a, c, g, or t
  misc_feature (265)..(265): n is a, c, g, or t
  misc_feature (275)..(275): n is a, c, g, or t
  misc_feature (288)..(289): n is a, c, g, or t
  misc_feature (292)..(292): n is a, c, g, or t
  misc_feature (296)..(296): n is a, c, g, or t
  misc_feature (304)..(304): n is a, c, g, or t
  misc_feature (308)..(308): n is a, c, g, or t
  misc_feature (318)..(321): n is a, c, g, or t
  misc_feature (328)..(329): n is a, c, g, or t
  misc_feature (338)..(339): n is a, c, g, or t
  misc_feature (341)..(341): n is a, c, g, or t
  misc_feature (346)..(347): n is a, c, g, or t
  misc_feature (349)..(352): n is a, c, g, or t
  misc_feature (359)..(362): n is a, c, g, or t
  misc_feature (374)..(374): n is a, c, g, or t
  misc_feature (382)..(383): n is a, c, g, or t
  misc_feature (385)..(385): n is a, c, g, or t
  misc_feature (388)..(396): n is a, c, g, or t
  misc_feature (400)..(403): n is a, c, g, or t
  misc_feature (415)..(417): n is a, c, g, or t
  misc_feature (427)..(427): n is a, c, g, or t
  misc_feature (434)..(434): n is a, c, g, or t
  misc_feature (437)..(438): n is a, c, g, or t
  misc_feature (453)..(453): n is a, c, g, or t
  misc_feature (463)..(463): n is a, c, g, or t
  misc_feature (471)..(471): n is a, c, g, or t
  misc_feature (476)..(476): n is a, c, g, or t
  misc_feature (484)..(484): n is a, c, g, or t
  misc_feature (3072)..(3072): n is a, c, g, or t
  misc_feature (3087)..(3087): n is a, c, g, or t
  misc_feature (4694)..(4694): n is a, c, g, or t
attgctaaaattttcaaaatttattatttttttattcccttttaagcactnnggnngantncnaaagncggcgggcccccataaaaaanagaaaaggnaaaacccaaaaacggncnnncannacnncgagagncnnganaccgnannngcnnnacccgncagcccccaaaaannacagnacccannggcnngaannnngnangaaaancggnccaacggcgggcngcaggnggaggcaagacaccagcancagaaaaanacaacngaccaccacncagaggaccaganngangggncaacgganaggncaaaggaaannnnagaaaannccaaggccnngnacaannannnncaaaaannnnaaagacaggccncgaaaaanngngannnnnnnnnaaannnnagggcccgactnnnggggacggangcacaancannggcgaacgggcaagnaagctgcgancaggacgngaccngcgctgancaaacattgattaaattttcaaaaaattttcgtgaaaacagaaaaaaatttttgttaggcttggcgcactgcaatcgccgatcaacattgatccggccaaattgatcttcgacccccaacttggcaaacttcggatttcacagtgcgtcgtttgcattgcgattttttggaaattttaatttttttttattctgatggagggttataattttaaaaattttaattttatttttcatttcatttttatataaataattgaaattcttacggacaacaaattggtttctttttgacaaattagagttgcaagaataaatttttgcagcaacaagtggaaaattaaattttcattctccaataaatataattatattgaaaattattttttttacatattttggcagtaatatttaatatatatttttttttaaatatttttaatgtaatttaataaattgaagaaagttttctaaattttacactcaatttaatataagaattgctgtaatgttcatatttttgcattatgactttatttcgcgatttaataaccaaaaaattagatgctattttttgcactttttattttccaatttttaattacgttttgtaatattttccaataaatttgaaattttttaaattttacaaaattcacagtttttttttcttggcagaagccatgttgaagccgaactgtggaacatgggccaatttccactgctgacattggccaccaaaaacgccacgacggcggacaccactggtggtggtggcggtgagaagagggaggagcagaagcagcaacaaccggtgctgaacattgctggcgggccggcacatccgtacacataccaaatgcaacaaattgtgggcattaattaattaattaataatgcgaaaattaccaaattaatcaattttgggcgcgctataactaaacgaaaatattattgaattaagataatgtattgttagtgaaacacttaccaaatgcaaccatattgtaggcattactctcaattaaagaaatcattaatcaattactaattaattttaattaatgagacaattagcaaattaataaaattaagggctcctttcattaaaccaaacattaattaattaacgttagttaatgcaacaattaccaaataatacaagcacaaacccaacaaattgtatcaaatcggattaatttagtaacatttgtgccaattaggtggtccattttggcgatgtgcggcggggcgaacgcggctctgaacacaccatagaccgtgtccgatttccggctgaagtaataccatgtttataaaaaaatttacagaattttttttttcgaaatacggattttcctagccccgaaaaaattgggattctaaatttattaaaatttatgtgttagctgcaaattttggcattcaattccgacctgtatgacaacttcacacaagcacaatcgcagccacggggtctgcttggcatcgccatcatcattgatgtcagttattttttgcatttttttttaatttttaaaaatttttacgaattttaaagcaatttaaaatgataaaaaaaagtttttggctaaacaaattcaaaagttcatgccctaatttgtatcagataagttcattttttattcagattttactggaaaacacttggaaattttcggtcacaatttcgggatttagtcctaaaaatacaaattattattttgaaatttattgcccattaaatcgacccaaaaacgaaattttttccacttattgaaatccgttaggggtagagtttcaaaaacaaattttaccctaagattggagacaggacaaacgcggaattgcacagattgtcccaggcgaccaagcacatcaaacatcgaagtgggaaatctatttgaattttaaaatttcatttttttaaattttaaaattccaaaccttcattttttaatttttagaccaaatggtccgcattaaacgcttccaaccggctgccctggtgccgtccactgaacattatgtgacctatgatgggtcaatgacctatccgggatgtttcgagacggtcacatggtagggaaaattaagtttagaaaaaaaaattctgcggtataattgcgttaattagtgccaattacggaataaggaatgcaatggctaattatgtaattagtcacgagtcatcccaacaccatggcggtcaacagctcaagattaccttaattgatgaatcaaaatgttaattattactcaagttttccattggttaatttatgatccactgagcaatgactaattaataatgtttaattagttgttaattgcttttaattgcattttgccaagtcccctattggcaaattgattttttagtgttccataattaacgctaattaattaccgcttaataatgagttccaagcattaattaattaattaagtctccatttttcctctggccaaaatttatgccccaaatttcaggctagtattcaattcgcccatttacatcagcattgaagacgtatgataatcaccaatatatagtttaaaataaatataaaattttgcaatttttcncgcgctcagttggcncaatggggtgagctggttcagagcgaagtggccgagtccgaggccaaaacggagacgggcgcgcctccgcccgtgccgctcagctccaactatcggccgctgaaggcgtccaacggtcgcgcattgcgcacaaacatcaacacgagactgaaggtgtggcgacgggttggtcggtccgatcgagaatgtgccacaatttgtatcgagactctcgagattcggagcttcaatatttattgctactaattagcccgggttagaattgccgaaacttccggggtgagagcgagtgagtatgagaaacagaatgaaagagagtgaatgagagagaaggaaagaatgagagagacaatgagagacatagaacggacgaatgagagagagaatgaagaggcagagagagagcgagagagagagagcgagggagagtaataaccctctaagtatcccgttcatttgatggcactaattaactaaatcggcagcctttgaaaatgccatcacaaaactgagagttgaaagaagcaatcagtttcttatattgtttaagaatttcgattcttaaacccacttcctcagttttttaatttgtagtaaaatggtcaggttttatttacctaattagtattaatgggccagtcaattttgaaatattcgaactcggtccttttatttgtcttgtcgccatttttttttgatcgtcaacttatcccagagcgtgtccgacggtggccaatgtcccagccgaatgtacgtggacatgggctaccggacgaacccggcacggactgacaccaaagtgccgtcctcgccatattcattatcaagacaagaaaaggcggcagatacgcgaaccaagcgggatcagcagcagcttaagccgaatagagaaaggtgggacatattttatagaattgggaaatatttaatcaaatgccaaaaaactgatcagcgggcgggggagggaatgatcattgctgtcaatcgatatgaggatgatcaactgacttttgatctgatcagcggtgaccacgataatcatttgaccattgttgatcaactggcactatcaaaatagtgaccaagatgttcaattggtaccaagatcggtcaattgaatctccattaacttatcaatctaacacggtcaattggtctgatcatgttttaccaaactgatcagtgggaaggaagtatttgtcattttctgatcataattttgtatttttttaattccaggataaccgaggaggaagtgcggatgttcggcatggatgtgactgatcagatggacagtggtgatccgacggagagtgatcaggaggggaaagccgcggatttattgcccaagactggagttgaaaatcatcctaatttggcggtgaataattgcgccgttccgtcaatggcattcgatgaatgttcacttttgtaattattgtagtttttttttcaaatttttatattgaaataataaattttatttcgcgcccttttctcgaaataaaaaaagctcggattcgtacttgaaatcgactctcatgcgagaaaattcaaaatttctatgttcaagaataactatatatttcgagatttttcttcattanaaatcgcgattctatagataaccgttgcattgataataaagaattgcgaataaaaaaacaaagaaaataaatgtt

SEQ ID NO: 823 - DNA, 8979 bp, Heterodera glycines
  misc_feature (8877)..(8877): n is a, c, g, or t
  misc_feature (8921)..(8921): n is a, c, g, or t
tcacatgaactctcctactcaacaacagcaaaggactcgcacttgaatgctgcaggctattaccgggatacgggcgagacactggagacggggccgggctgcattcaacgcagggatttgtttgccgaaagcaaaacagcccaatttattgccaaaattgataccgacctattcaatcagccgctgtacttgattaacttttgtgaattggatgtcgaaattttgccaaatgacaacgattttgtgctaattgcacccgccatcggcggtgttgttcctcgttaccgtttcgaggtgatggggctcaaaatgtatgtgaagaaggtgtcattaatggacggattagcgctggacattgcgcgaaagcttgagataaagcctgcacgttatgcagtaaggaaaactatgatgaaatcgatgttcatcagtcagggtcggttcgagtttaccgccaatctgttcatggaccaaattccccgccgcatcacaatggggcttgtttcaaatgccgactactcgggcacaatcacgcggagcccgttcaatttccaaccttttaatgtgcgggaaattgcgatcatcgccaacggccgttcctacccccaggccccttacgatttggactacccgcatggcaaatatgtgcgcgctttcaacgatataaatgaggcggttgggttcgcaaactcgtcggaaagcaacggaataacctttccccaattcgggaaaacgcattgtatctacgtgttcaacttgacaagcagcggtgacgaccaggccgcgctctttgacctgataaagaacggaacaaccgcggtgagcataaaattcaatcgtgcggtaccggtcgggggactgatgctggtcgtaatgggcgaatgcgactcgctggtaatgctggacaagaaccgatcgataagcaccgataccactatataaaaggcgccgatttagtgtatttctctcacatttgttacattcgctgttcaccagtaataaaaatgtattttaaaagcgctactgctattttattctttttgattgtttttattggtattggaaaatgtgcatcggctaatgcaaacaaaaccaaatcccgaggggcagtaagcaccaccaccaccgccatcaccaccaccacaactgtcaatccgcagaagattggtgtacctcgtttggcatcatctactcgtatggggaaaggcagcgtgactggcaaaccactaaaaattgtcaccgccaacaccaataccaacaggaacataaccaccgccaacaccaataccaacaggaacataaccaccgccaaaaacaacaaaaacagcagcagcaaaatcaccacccctacaacaaaaactgcaaaattggttgtggatgagcagttgccagtcgcaacactcctcccaacattgattcaccaaatgtgcaaggatcgccccggtgaggaaaacttttatcagcaagccgtttgctgggcactttttgcgctctatttaatggtgtttgtcagtctggtacttcatcagctttgttctatctgttggttaaagaagaaaaaggagtatggacagcgcgcagatttcgactattttgaggcaaagtcgggaaaccgcacgagttttccggggctgtttcccaagtgaccagctcccggcgccggacacgctacggtacccagcggcgctagttgtgaacaacgacccacattacaaacaaggatcccattggtgcgcgatttatgccccttcaaagatggaggaagcggtcatttactttgatagtctcacaaaaacaattcctcctattgtaaagacatcatttatggataaatttccaaaaggttttgttacaaataagcacccgtaccagtccccgctgactaccacatgtgcaattcactgtattgtgttcatttatcatatggccttaggtcacccatttgatgcatttctgcgcatattagacgctagtgaaagtcccgacatgtattcattgtgcgttctgaataaaatgattaatccgtatttgtgtgcgcgcgtgccaattttaccaccctttgggaaagggcatagggaatgattgattattttattataccacggcgcacgttgcgcgcgctgttggtgctgcgcatatatacagcgagctcacgcgggaaaggctcacttttttcgcaaaaataaattaaatatattaataaataataatgtcgttggaagaccacaattattgcggcgagttgggcggcaacgaaacgcccacaaagagaagaaggagaaatgacgatgatgatggggagggagaaccgaaatttcaaaaaaactgcattcgcactctgagcgccgacaaacagtacagccaaaagttcaaagtgcagagtgtaaagtcgacttttatcattgaaaatctgcccgccaaccccgagtcaatgctgcgcgcattgttcgctcactgcatgtcaaccgccctggacgagtcacagcagaacgggatcacaccggatcaattgggcgctacaatctcttcagatctgctaaatccgagcatatggattcccatacgccgcatttccgacaacaccgccgactcaatcatgaaccgcttccttgaggtggcacagtcaaaatcacgggagggctctctgtggggctcgccgttcactgtgaccatcacaacgcttgatgttgcgcagctacctcagcggcaacaggtgcgtggcagtgggaaaaggacaacaaattcagtgcaacatatcgtcaaagagagtgcactcctgcgaatcaacaacagtgatgatgcctattgccttttttacgctttggaggcaagcagaaaataccacatcaaagagatgagccgaagaaatttctgttattatattaaccatcagaacgggcgacgactggaagacgtgtttggactgatgagcagcgcaaacattcgcaccgatctgagagaatatgacgcggttgtctatgtgccgattgtcgtggactattggaatcgaaaatacgccacagcaaaccagcgatttaaagtgttcatttttggcgccacaggcacctatcggccaaaatttcaatacgggccggacaattacaacgtcgaaatcccgctctaccatcacaacggccatttcgacggaattcgatgcggggtgggcaaagcggtgtttgggcgtgactactactgcttttcgtgtgagtgcccctacgataatgctaatggtcacacgctacaatgcaaagcaaagtgcataaactgcggtcgcataggagcggggcgacaacaacgacaattattacagagaatgcacagcatgtggcaaggatttcatgagccaagactgtttcagtcatcatttgtcgagcaatgtgtgtcaacagttcaaaaaatgcaaacagtgcggagttgtgtggaatgtcagacaaaaccgacgaaaaggacgcagcggacacgtttgcggtgagaaattctgctacacctgcaaatgttaccataagccggagcggggctgcttcatacagcagttgaaggcgcgccgccccaaaaagtacaggctgatcgcctttgactgcgaaacaacacaaaacacgcgaattgagggcgaccgcagacttcattccgtcaacttcatctcatgctatgtcgtctgcaccaagtgcataaacgaaaatttatggcgaaattctctacaagcgccatgtggcatttgtgggcggctgcgcaccgtcacattctcccaccgcgtctatgaacgcacccaaaccgatgcccaattcatcactccgtgtccaatggcggcctttgctcaatggctgctcagcgaattcgatccgcgctatcccacaatgctcttcgcccatttcggtggtcgctttgacaacattatcgctcgtttcggcagttcttcctcaacgggttttgtccacagatgatccgtcggggtaacaaattatacgaaatgaaaattgcgaggggcgaaaaaaatccggaaatcatcgtaagagacagctggaaccttatgccggtgccgctcggcgctctgcccggagcgtttggactcaatgtgcaggataaggagttcttccctcatttggcgaatgttgaggcgaattatgggcacattctgcagtcgctaccgccaaaagctgactacttatacggtggaatgacgcccgaccgacagcgcagattcgaccagtggtacgcggaacaccgccatcagcagttcgacctatgtgaacagctcgcagcctactgcaccaacgacacgcgcatactaattgaggcgttggtcgcttttcgcacggagttcttgacgatcagtgacccgctggagcggcatggatgcttggatgacgacaacgacgacgaagatgaagaggaggaggtggatgacgacaatgcatttgaagtgatcggcggtggcattgacataacgtgggagccgatgaccatcgccagtgcctcaatgagacactttcgactcaatcacctcaagcgggatcagctcgccattgtgcccgagtgcggctacgacactacaaacacgcaaagccttgtagcgctcaaattcatggactggtacgccaaaaagaacggggtgagcattcagacggcacactcgcccggcggagagaaaaaaattggccagtacactgtggacagatacatcacggcgaccgacaccgtgattgaggtcaacggctgccactggcacgcgcacgaccatccacgtcaccgctttcagccccaaacagtgatggcgaatgggaaaacggcgcagcggatacgggaggacgatgcgcgacggatggccttcatcacatctcaggtacaacaagtgcgcgtattttgggagtgtgaaattaacgcggagaagcgcaacaacgacgaaatgaagcgcgcctttgcgcagtacaaggacagcggcccaattcgtttgaaggactgctaccatggaggacgtgtgggtccacaacgactacactacgaggtgccagaggggtggcggatgaaatattacgacgttcgttcacttacccccacacgaatgccgtgacagcataccccgtgggtcacccaacacgagtgaacatcattggtgaggcagagcaggcggttcactggcgacgcgccgaccaggtgccggtccgaggcattctcaaagtgttcgttgtgccgccccatcacgttgatgtgcctgtactgcccgtgaaatttgatcagcggcttcttttcccgctgtgccgtacgtgcgctctgcaacatccgcatggagcggtcaatgaagactacgagtgcacgcatcgcgaggatgatgagcgggggtgggtgtccactgtgacgtcaatcgagttggaggaggcgcttcgcaacgggtaccggtgtacggcctactatcgctccgtcgagtgggacgatacgcggtggagcgaccgcgtttttcgaggctacgttgcagaattcatggccatgaaaacacatgccagcggcttcccggatgaaattggcacaaccgaggaagatcagcagcaattcatagaggaatgtgaggaaaaattcggaatccgaatcgagcgggaaaatatggtgcacaacaaggccaagcggaccatcgcaaaactgtgcaacaactccctgtgggggcgcttctctttgcgcaatgggttgtccaaaacgattgtgaccgactcgcccgcggaactgcgcgctctgcttgacaacccagcggtggaggtcagctccgttgaccagctcaccgacgaatgcgtactggtcacctatgcggccggaaacgaatgggtggaggaacacgagtgctcaaacattgtgctttctctttggacaacatcggtggcacgcctccacttgttgcggctaatgcagactgttgctcgcgcaccaaactcggtgctcatctacaccgatacggacagtgtgtgtttcgcccatcgtgaggcggacgggtgccctctggagacgggaccccacctaggtgacctttcggatgaatggccggaccacgaactcgtggaatttgtttccggcgggtgcaaacagtacgccctgcggatgcggcaccgccaaagcggggaggagaaaacggtgctcaaagtacggggcataacactgagcgccgatgcctgtcagcttctccactttgacacattcaagaggagtgtcctacgctacgcaatgtgccattcaaatgaggatgatgacgaagaaggagatgacattttttcaattttgattgagtaccccaatttcctgagacccaacattaaggacgggacggttatttctgtcaagttgtcgaagcggtatcgccctattgtaactaagggggttgtggggatgaatgctattgtacatgattttggttttataaaggcgtaatttatactgaattgtactttttaaaaatgcataattaacaaatggaagattacaatttaaaataatgaagcgtgagaagttgcaaattttaggtagaaaaatgcataatttagtaagagaagtagcagttttggaatattaaaaagattcatcatcatctgagttacagagtttatgtttttaggtagaaaaatgcacaattagtcatgtttaactgcttgactgagaatatttttgatttgctctttttcaatccatatgattcctttcacaaaaccacaagacggaggaggtggtgtttccgcaacactgttttgtgtgggcatcgagccaaaccagagaccatggtcgtcataatcagcatcatcggacgaaggtgatggcaaatttcgcagcaatgatgacgaggatgatgatgatgacgatgatgcgccgtcacgcttttgagacagcgaattaacgtacacaggcggaaagcagtcatcgacgacttttaccagttcaagcgggtaatatttgtgcaagggtccgtcatccctttgaccaaaacatttctcgataacgcatggataatgcgggtattttagcataatgcggtgccgcgagtaataatgggccgcaacgcaaacattgtaggggcgcctcaggttaccataagcaagcactgagttggcgccctcttcagtgagtccagcaaagaagagcgtgtgggtgaagccattacggtcgtagtatgtagtgatgagcttacgatgtgcaaattccttcaacaatttttctcgatccgcaacgctacagcaaattcgcgcgcccacttcgtcaggggaacagtccaaaatgcgcgagaatgcgataagcaaatgcattgcgcgcaagtgagattttgtgcacattcaagcgcttttatatgtgcgtaggagcaccgtaactttgtctttcacgtagcgcgcatcactgtaccttttcgctatataaaagcacgcaaatatgacgcaaaacttcattttaatcacaagattttttttgcaaaataaaaatgaatacttttaataatgttcagcaaaacatgccggaagaatctaacaacaacagcacaaactacaacaacaataacatcagcaacatcaactataacaatgagaatgctcaattatggaagcttgtacgtaagaaatatattctgaccttcaatctttgttacggctgttctcaaaaacttttcgagtccactaaaaacaacaacaacatcagcaacaacaacaattatgcttttgaaactgatcagtttggaggcgttaaggtgcaatttcacatgtgtaagggatgtgtttggttgaacatgaagctgagcgatttaaatagtgcacccaaaagtggtaataatcatatgaaaacaactcgcaactttccaaacacaaacaatgcaacttactctactgacaataattttggctccttcttcaataacaccaacccgcagaataatgcaaatgaatggatttgacaaaattttgagcagatcaaaattgtaacaattaaaatatttattaattgtatggaattaattttattaaatattttgtttcattcaaattcttgtgtcataaatatgacaaacctatttgcccaggaaaaatgattgatttcattcaatgatattaaccttttgagtcggcggataagccgcataaccgctattgtacgttttttggatctcctagcgcacccatacgccctaacagatggtcatgctgtcttataaaaaggcaacggaaaatgccggccacctttttcctgtgccccatttttcgtccaaaaatgaactctcagcagcgccaaattgaacgagagcagctccgcgccaggcttaatttgttggtcgacgaggtagatatggtcgtccaaggccttatcaacaactacaggagcgatggactgataaatgaagtgagtttaggaatgcatgcccaaccagggactaggatttcaatgtagggaggcataacgattttctcgtcctctgtttaattttataaaactaaactttgatcaggaagcggccattggacaggcaccagaaactgtggaactacagaacgtgaccattgggtcacaccttcccgcgcaacaaggcgaggaatgggaaattgggccacacatgcccctacaacagcattatgagcatcagccttgggaactggacccaccgatgcccgaacagcatttggaaattgggccacagctcccggatgcgtgggaactggttccctatcagccaccaccacaatgggaccaagttgtgcatgtggaacaacagcagcaacaacaacaacaccaccagcaacaacaacagcatcagcaaggcgcgtgggacgagggatgggaggagcagctttcgccaaatgcaatagcgcagatccaggacgaggcggatgggtgcgccagagattgagtaagaatttgggtcagggntacataaaggaaaattaagtgattgagagattttctcgtgtggngcagcctcagcctacgtggcccgggtaccaaagacgtccgaaaaatttatatgcatta

SEQ ID NO: 824 - DNA, 864 bp, Heterodera glycines
  misc_feature (59)..(59): n is a, c, g, or t
ctaataataatgggttcaactttttggcaatttccggaatcatttgcacgaactttgancactgggaataaccaaaacaacgcatacaacaatgctaatgaaagtgggcaaatggtaaataacaatgtcggatggatggattgatcacaaactttaatcaattttgcaaaatagttcatgtatttgaatcatcatttcataataaatttaaatattaatcattataaatttctttaatcccctttggtgtttgaatacacccgtaaatgtgacaagcgcatcgccggttagcggcatgatgcattagtttctcttttgtgccggttcagaaatgccgcacatccctttgttatttgaatttgaccccgttcgcatcggtcaccgaagcgtcggaccttggctacacagatggccacgatcccgcctcatataaaagggcacatgggaaagtcgccctcttttttttcctccattcaccaccaaaaatgaactccgaaagacgtcgcaatgaacgtgagcaattgcgcgcccgtttaagtttgttggtcgatgagattgatacggtcgtccaggggttgatcaccaactaccaggacgacggattgatcaatggggtaagttttcttttcttttttttgctgtctttttgtttttgcttcttttttttgaattttaattctcgattgaacaggcgccggatgatgtacagctaatggacatggaccatggccaaggagtacagcatgagcaacagcagcagccgtgggaactggatccaccaatgcccgagcagcatctggaaattgggccacagcttccggacgcatgggaactggctccctatcagccaccgcaatgggacca

SEQ ID NO: 825 - DNA, 3087 bp, Heterodera glycines
  misc_feature (3009)..(3009): n is a, c, g, or t
aacagcatccgatgcaggggtgggaaaccccccgcacgcactttgagcggcccgtgccgcagcggacgccaagcccttcgggggatgcgccgggggcactgatcggagaattaaatttttccgatcagtgccttctgtgcatgggcagccatggagtggactgcacagtgacagtccgcggcaacaattgcggctgtgtcacaatttgcgacacatgctgcgataacggctggtggcagcgttatgcggatgcggcgcgcgatcaggccgcgcggcaggtcgaagacagcatcgacccgtggacaggactcgtgcggggggatgaggccagccaaaggctttgggtacacagaacacattttttttttttgataaatttaattcagtttatattttcaggtcgaggggcacgatgcgcgccccaaatgtctgggctgtcagtcgaggcggatcgactacctgatcggggtgacgcggccgcgccgctcgcagcgcacgcgcaaggccacccgctgcgcattttgccactgatggatggtgatcgatttttgtaagatcacacaattgataatatttggtgatttaaaaataaaatttaaaaaacatcttacgggagccaaaagagtagggaaacttttggataaattaggtaagtaagcatatttggattagacttgaaatagaaataaaagcaaagaacatatacacgatactatatttttcattttctcagattgtatagtaaaagtgctttaaagattagttcaatcataattgaaatagttggacttatggtagctaaggagtacctagctttaccctaccgcaccaatcattcattaatgaggcaactgcaagcgcagcgaacggggttagtagggggtccgtgttatttggccacaaagtgatgcgacaaaggccacaaaacaatgcgacggtggaggaaggggatgaatgattggcgaggtggggtaaagctaggtactccttagttaacataagtccagctatttcaattttggttgaactaatctttaaagcacttttactatacaatctgagaaaatgaaaaaataaagtatcatgtatattttttgatttttgaagattattaaaaaataatgtcaaattcatgatcaaacaaaaaaataaaaaataaaaccaaaaaataaattagaaaaacaaaaaacaagggacacagaaactcttgaggttgggatcgggaaaatttttgaaaatttgagtgtaatttgttaacagattttctcaggccttaaatcgcatagatagacactttaaaacctagtccttatgcaatcgctcgcaaattgtaagacccgacgcgcacattccgatttgccccatccctcccctctgtcgctccccttcccccacctcgtcctcatcctgtggctgctgcagcgcctgccctccccgcccgccgccgcctcgtccaccaccgcggccattgccttttccaccaccgcgaccgccgccacgtcctcctccccgcttcgatcctgctccgtttcggccggttgcgcctccgccgccccgtccaacggtgtgtcgctcacatcccgcctgaccattttttcttcctgcgccgcactcgcaaatgacaatagccgtcaaaaggagcaggaacacctataggccataaatgattactatacattaacaaagagaaggaaaatgctaaaaatatcaattgacatttacctcgcccatctccgtgattttgcccagcgtgccgttgatgctgtccacgtcgagtgccattttgcgcaagttttgctgcacagtcgtttccaactccttgaaaaccatagcaaaattgatttttgaacatcaatttttgcctgcttcgagcgttccatggtgcgcaattgacgttccgtctcggacaactcgcaaccggtggcggcaatcagctgctccaactgtttgacctgctccgccttgtcgccgatgctctcccgaattgtttccatttgaatgattttttcgctggcgttcgcccgtctgtctttgaactcggccaactgaaagtgccaaaaagccaatttaatgtcagtcagtaatgccactttgcacctggttgctgagctgtacccggcgctttaatattccgatgtgctccatggacaggtccaatttgtcgcccgcacgttccaatagtgcgttggctttgccgacggtgccctcgtccccggcactgctggccaattccatcatgtccatgtgcagtgtgttcaggtccatcttgaaaagggaaacccgatttagacagggtcagtaaaacaaatccatatttaattttctttatcacaccccctttttgcatattttaatacaaaatgtataaacctgtttgacacaatgcgtttttgccgagtagacaatgaagaggacaaagtgaaaaaacataatcattctaatgctaaataaaaatttaattaattaaatgttaatatttttatatgccgaggaataaacccgtttctgtctttactcaatttaattgatttacaatccctcctctccctatggcacaatccacgtccccagcaagcgtccctccacccaccgagtatcgacgcgaaaattcaaatttgaatttagcgccaaaaggggcgacaaaagtacaggggtcactactgaaaatatttaccaatcaccatcccccccctttttcatcactaatttgtccgtcacatcattcattcgttcatttttatgtctcactcccctccagggagaaaaaattgttccttttggtcttaatctctcacctcaccactcaatcacggcatccacttttactcctcatttttgccgtttgtcacttttttgcccacccccctcccacggtttaattacccaagtttgagcgctccgttaataaactatttttctgtcatttgtgttcatcaatttgggcgggtggtcaaaagggagccgactcccgattcgcaactcaccttcttctccggccccttttgctgngcatttcggagcgattcagcaagtcaaacgggactccaactctccagagtgcccactcgaaccccacctctctccttt

SEQ ID NO: 826 - DNA, 3961 bp, Heterodera glycines
  misc_feature (2959)..(2959): n is a, c, g, or t
  misc_feature (3042)..(3042): n is a, c, g, or t
tgatgagaggggcatatttgtaaaacaattaggaatggattttttgaatttttttttagaaattaattttaacggagtatttttcgtttttactgtattttcttttttacaaaatattcttttaaatatttaatgtataaaaatatgaacaggagcggaccgcgtccggtggcggaaggcgacgcgttggcagcacagcggcggatcggtcggcacaggcggcagcagcggcttgcgctgcgggcgaagaggcaacggacgaggtggacaacaacgaggaggagcgacagaacatggcggtggtgacaaaaaggatggcaattttggtaaaaaaaatttcaaaattattgtgtatgcttttcgggatttttgtgcttaatacctaggcgccttttttgtgcctatttcgccattttttgcacctatttttggattttttatttattaatatttttccttgagaaaagcagcacaaaaacaaaaatctttcactttttaattgtttttttcaatttttgggcacccctttttatttctattttttaaaggacctggaaacatccggcacaccggcacggattgtcgaaatcccagaaaatgtgacggtggttgagggcgaattggccatcatcaaatgcgtcgtggagggcaacccggcaccgacaattgtgtggaaaaagggcggccgaaaaatgccattgaccgacgaccgagtgcggtgccaaacggacggtgacacgggacatgtaagtggcaatttttaaatgaaatttttaaacacagaaattaaaaaaaactgctgttttttggaaaaaactttttttgtgaaaaagtcatttatcataaaactgagaaatcactaaaaaaatttttgttttaatttcaataaaattacatttttcataccgtagccctcaaatggaggacaagaaaactttttactgtagttctaatcttggaagggatttttacggcactcaattaattaattaatgtagctcatttatttctaaactaaattcaaaacttagcagcaaatttaattaaaaaaattttatcaaatcctaaaataatgttaaaaatattttatcaaattaaaataatgttaaaaatattttatcaaattaaaataatgttaaaaatattgtcaggtttctctgatcatttccaaatgtcggccacaagatgggggcgagtacacattgatggtgaagaacgcgcatggcaagcacaaagttggcgccaagctgcttgtcacgccagcggccgaagtgaaaaaaaattgccagccaaatttaaataataatatttacaaaaaataaatttacagtcgaatttggacatccgggccaagcagaaaaaacgtggcacgggcattagcaattcggaacaggaaaaacagcgccaacggagtgatgccgagcccaaaagcaaggctgaacgacggtgagccaaaaacagctaccaccaaaaaattttgcaccgaattttggaatggtgccaaaaaatcgatgccaaattctgcacttcgcttattttctttttaatttgactgaaatttcaaaaaaaaaaatttcagtgcctcttctttttttttttgatggtgacacaaatttaaagacatggcaaaagaaattattgaaattcaatttttttgattaaataaaaatcgtgaacggaaaatgggtcagtggaaaatgcgtcagtgaatcagtatttctttaaattgagatacggtagtaatattaccgaaatcacaacttgttttttagggatttgggaaagtttcaattattttgacttttaaaaacttaattgataaaattcagaacaaaattattagacaattttgtccttttgtaataatacaatacttaatgctacagtaactttattttaaaaatactgtattattgacaccttttccactgacgcatttgccaggagccaaaattattattatttttaaaaattaattttcatttaaattatggcacaaaaatttccagcaaacgccaagtgtatgtggtggaggagccccgtgacacatttgttgtgccgttgaactcgcagcatgccaacgaaaaggaaaatgccacttttgaatgcgaagtgaacgacaaggagatcgatgtgaaatggttccatgacggtgccgagatcgggatggacgggcggcactttaaggtgggaaggagggggcaaatctcttgctaatcaaagaatacattcatattttgtgttatgaaagatcaatttcaaaaattgagtaggagtttaaattacctattttgggattcctttaagcccaaaaatccctaagtatggatatttccaaaattcaaaccaaaactagctcaaattcttcaattcaaatgcctatcagaaatttaaaaaatatattagaaaagtcagaaacaaaaccatttttttaacaatatattttttaattttatatttttttacattatctaaaatttgtttttatgccaaatttcattttgtttttctattgtgtattttattgatgcttcttgttttacaggaacgggctggatgccgtcgtcgcctgctgatcatcaatgtactcattgaagaccacggggagtacaaatgcacagccaaagacgacgaaacaatggcccaactcattgtgcaccccaaattcgtcaaaaaagcggagcgctagccggtgaccttctagttcgatgacgatttgtattaaatttttttgtttttcactgttcctgttttatttgtgcccatctcttttttcgactttttcttcgagttcgggtctagggttcggaattcagaatgatgttcttaagaattttacttttatacgacaatacttaatgctatcgaactaatttaaaatatttgtatcacagacgcatttctcgggcacgccgccgagcagtacagcaaagcagacggaatgtcaataattagagcnaaatagaaaaggagtccaataaacaccggccaacacatatacaaaaccgaggccaaccaacaagcgccattgtttgaatttanatattaaagaattaaagtggcaagcgttttttgttaatgttacaaaaaatttgaattttttgaggcaagtagttttttatcatatgatgtactttctatgtttaatcccaggattaaatcatttatttaaataaaagctttctcaaaaaagaaaatttagctgaaatattgcattacaaaattcacaacagataacactgtaagcactgataaaataataacaataaattttcgaactatttttataaatgaaaatattaattacaaccataattttgacattttatttttgcagttttatttggacttcaaagatgttaatcctagctggtcactaattggatgcgcactgatttatggaatcacgccacatttagagtcattttcaattcatctgtcattgttgtaacataagaacaaagtgtgaaattaatttaaataaacatggaattctaaattaaattttagcatttgtaattgaaccctgaattttgaccactttttatacatatttttgacatccctagtcattaattattctcccgatggcttattgatttggcaaaaaaataaaaaataataaaaaaaaatccctttctaaataaaaaataaattaaaaaaaatttaatccttccaaggagaaaaaaaaattatcattcaaaaatgcttgaaaaactctaaactgtaaaatttgaaaaaaaatttaaattttttatatgaaaaaattatgacattttaaatatggacggcaaaatgaccccgtcccttcccatcagcagggctggacgtaactgattttcaattacggaaatccgtaatccgtaattacggcaattttttaagttacggccatccgtaatccgtcattacggaggtcaaaaaaggccgtaatttggcgtaatccgtaatacgtaatccg

SEQ ID NO: 827 - DNA, 5289 bp, Heterodera glycines
taccatgcgcttaccataccatgcgctaccataccataccatgcgctaccataccataccataccatgcgctaccataccataccatgacgctaccatacccccccatttttttgtttcaaaattaaatttatttgtcattttttatccattactctgctcatcgatataaattatgtttttcaggtccagaaatgtctaattttaatcagaatgactttgccattacatcggtgcaccaaatgcgcaaccgacctcggaatacaattggtgaaatagcggaagtgcgctttgctccccttgaagaagtggaacggcccgatcgtgtgctcgagcgtcttgtacagcggctgtttgacagagtgcttgatggacgtccagcaccgatgttaattggtcttcaactgcatccacctacctttgagaatccatttacgattccacttcgtccacccgagcaaaacaatccggctgctatcgctgatctgatccaaagactcaatgatcaatctgctgccggaattgatctgactggcgggacaacagtcacaaaagtgcttgcagtttggccaatgcaatcggaccacagtgaatcagggagagcaggttgaaatttatttttattttcttttcatattttcttttgctgtataggcgcatgcagccttgaggaagagcaccgattggtgaacactgttcgctcgttgatccgcattaagaatccgaatgatcgactctgtttggccagagctgtgttgttaggtcttcacgattggcgttcacggtcaccaggcggaggcggaccaacagcattcaaaagtttcgcaaatcgccagcacacccacgggcctgaggcacgtaacttattgagacgtgccgcaattccccgcaacaaacacatgtacacaattgatgacgtccaaaaagtacaagattggattgatcaacgatacgggccagcagaaattcgaattgcagtttttgagaaggaacgtgagtaccgaattgtgttcaaggcagcatccggcgaggcagccaagttcaacttgtgtcttttgttcgaaaatcaacacttcaactacattggtcgaattgagcaactgtttcgtgtgcaaggatattgtattgattgtgaacgtcgcgtgacacgctggtaccacccgcaggaatgcaaagtcgtctgccgtctgtgtttacgttttggcgcagggtatccatgtaaacaacaacaacaacagcaatcccgagcagatgggtcaactggcaatcgtctttgccgtgattgtcaattcgtttttccaaatgacgactgcttcgcctatcatctgagcaatcaggcacccgcaagcatgtataatcagggaggacgcacttttcgcccaatatgtgaatggagaagagcatgccgacaatgtggagccataacctatgcgaattatccacataaatgtccagcccaaattggccaaacggaatgggtgcgctgtgcacgatgctctggaccccatcaaagtggagacccttgttttattcagcctctcaaagatgaaccaatgaggaggagaaggagaagaagagggcaacaacaacaacaacaaaataataataacgatgacgaagacgatgatgatgataatgatggtaacgaggagggagacgacgatcacggtcatgatgctgataatgaggaagaagaagaagttggaacaaatcggtcggtcagactttgctttttcgacgctgaaacgtcccaagatttaccacttcaactgcgtacaaaggttgtacagaaacatgttccgatgctcattattgccgaaattatctgcgaagcgtgtataaatgaaggaatttcggttcattctggtgttggacaatacgcaaatgggtgtgtgtgtggtcctcctgcgggaccaagggggcgtcgctggtgttctcctccgtttctgaatgcacctggggatgacaatgctctaccagccaatgtccactacaacccacgaagactgtttttccatagttttgacgacgctaccaacaatgacccggtggacgattttatcaactttctcaccggaagtggtccacatggtgtgaaaacaatttgtttatcacacaatggcggaaaatacgacattcatttaatactggaggcacttcaccggcgcaatttgccaccaaagcgtatttgcacaacgggactaaaaattttttcgatgactttgaaagggaaccatcaacgacacgtgatctttaaagactcgctgaactactttttctgtgaattggatgcactgccacgcacatttggattgaacgctgaagttgcaacagcaaaacctttctttccttatctgttcattcggcgtgaaaatttacaccaaagattgcatggtttaccgggcaaagaattttatcagcctgatcacatgaaagcgtcaaagagagattcctttatgagttggtgggaggtcgagaaccgttctgcacgcttccaattgcgtgaacaactcatcctgtactgtatgaatgatgtggcaattctgcgcgaaagtgtgcttcaatttcgccaaatcattgctgaaaatacgagaggactggacccgtttaaaatctcatccacggcagctggtcttgcgttggccaccctccgccgctgctttcttccaatgaacaagcttgttaatgcgccagaaggtggctacctaagggggcggcgagcatctgctgaatcggcacgatacattcgttattatgaaatgacacatccgggagtacatgttcggtctgcccaatggtcaattggtgaggctaacgtcgaagacactggctaccgccttgatggattagtcacacgtgaaccccctcaacgcaaccttgccattgaatacatgggttgcttttatcatggtaaaaaaaaaaggtcgcccttttcaaccgaacaaaaaaaaaatgcttaaaggttgccccacgtgttacgctaacgacagacaacaaaaattggcaggtggaaggacagccgaagacctgtatgaacgaaccaagaggcggctatttgaactgcagaatcagcatggctttgagctggaagttgtctggggatgcgaaatgaagcagcgtctgcgtgctgatccagaatttcgccgggtgtacaatgactcattcgttccaagaccgcttgatccaagagaggatgcactacgaggtggacgcactgaaccgtttatccttcagtacacttgcagtccagacgaagagataattctcattgacattgtaaaaaaagttaggagaaacaaaaaatattttttcattgttaaaggtgagcttatatccatatgtgatgaaggcattctcgtttccggttggtaacccacgcattctcacgcgagagacacttctatgcgcaccgaccaccgcttccctggtgttctgtcgacgcgaacacattcaaagggctgttgtttgttcgtgttctgcccccagatcccgctgtacacccgctaaaagttcctttgcttccctatcgaactaccgacgggcgcctaacttttccgctttgtgcacgctgtgctgacaaccgacaacaacgggcatgcaaacacattgatgcgtcaagggcatgggtttccgcgtaattttgtgaaattaatccatgtcaatttacttttttttgtcccggtgtttagatacacccatgttgaattgaacaaagcactggagcttggctataaagttattgatttatttgaggtaaaaataacgtatcgtttattagactaaactttaaaaaaaaaggtatggcattatgaagaatgggataaccaactgtttcgtgactatatgaacacctttgtgggtcttaaagttcaagcaagcggttggccatccggttgtgataccgatgaacagcgcagagcctatgtagatgaatttaggcgggttgaaggcattcagttggaccacaacaaaatttcaaacaaccctggacttcggatggttgcggtaaaaaaaaaatacagaattacaattttttaaactttaaaaaaaaaaaaaaaacacacacagaaaattcttgcaaactccctctggggaaaacttgcgcaacgagtcggtggaacggaagttcgttatacccgaactccaagggagtatcatgctctggtggagaatggctccgtgtcggggcttaaccctaatttttattcacaattttatcgttttccaaaaaatattaacaaaaatgcaataaaaaccaaaaatacaaccctaagaaatgaaaaacatcggcttttcctacgcctcgttaaaaagtggtcgactggcatggcaaaaaatcttattctatcaataataaaataataatgtgtaaaatatatttatggattttattgcctttaaaatatttcatttaaaacaattaaatttatttattaatataattttctgtactgaaatgaccccatccctctgaagtctctcactgatatttttgtcacttcggctcaccacatgtgcttacaaattagatcggtctgatcggtcactgatcactcccccccccatttcagccttacttctcttttctgtttttgcttgctcatctcctctccatggtcgtccccgctgcaaatcctctcctttacggtaatttcttttctttttttttgccatttttcatccgcattttttagcttggatgaacgcctcttttcgtgatgcctttttgcgcgtattgcccttccgaaaatggcacaaaaatgccatttcaatgaaacgaaaaacgaccgaagggaaagccagagaaagagacaaaggagaaaagagaggcgaggacaaaacgaaaggacagacggagaaaaaacgccgcggggggacggaaaagcggtaaaacgaagaaggaaaagcattgcgcacccattcattggcttttttgttagctcagcaactacccaatcgttccgctttccgctgcacgcgtcgtcgccgcgtccgctgctgaggagacggagcagcggcgaccgaatggtgccgtagaggagaccaaagaatgccgaaacaaagccatggacaccgttttaattaatcagacggtcattacgacgggtaaatatgattagtcacttaatcaccacttgtgtctgtctacattttgtcacatcgtccaaagaatggctgactgatcagtgatcactttgccaaattttcctccgatcggtccctttttccgacgccacttctcttctcaatccgtccatccgttctttctgcccgttttccgcctttgttc

SEQ ID NO: 828 - DNA, 4426 bp, Heterodera glycines
atacattcgttattatgaaatgacacatccgggagtacatgttcggtctgcccaatggtcaattggtgaggctaacgtcgaagacactggctaccgccttgatggattagtcacacgtgaaccccctcaacgcaaccttgccattgaatacatgggttgcttttatcatggtaaaaaaaaaggtcgcccttttcaaccgaacaaaaaaaaatgcttaaaggttgccccacgtgttacgctaacgacagacaacaaaaattggcaggtggaaggacagccgaagacctgtatgaacgaaccaagaggcggctatttgaactgcagaatcagcatggctttgagctggaagttgtctggggatgcgaaatgaagcagcgtctgcgtgctgatccagaatttcgacgggtgtacaatgactcattcgttccaagaccgcttgatccaagagaggatgcactacgaggtggacgcactgaaccgtttatccttcagtacacttgcagtccagacgaagagataattctcattgacattgtaaaaaaaagttaggagaaacaaaaaatattttttcattgttaaaggtgagcttatatccatatgtgatgaaggcattctcgtttccggttggtaacccacgcgttctcacgcgagagacacttctatgcgcaccgacatcaccgcttccctggtgttctgtcgacgcgaacacattcaaagggctgttgtttgttcgtgttctgcccccagatcccgctgtacacccgctaaaagttcctttgcttccctatcgaactaccgacgggcgcctaacttttccgctttgtgcacgctgtgctgacaaccgacaacaacgggcatgcaaacacattgatgcgtcaagggcatgggtttccgcgtaattttgtgaaattaatccatgtcaatttactttttttgtcccggtgtttagatacacccatgttgaattgaacaaagcactggagcttggctataaagttattgatttatttgaggtaaaaataacgtatcgtttattagactaaactttaaaaaaaaaggtatggcattatgaagaatgggataaccaactgtttcgtgactatatgaacacctttgtgggtcttaaagttcaagcaagcggttggccatccggttgtgataccgatgaacagcgcagagcctatgtagatgaatttaggcgggttgaaggcattcagttggaccacaacaaaatttcaaacaaccctggacttcggatggttgcggtaaaaaaaaaatacagaattacaattttttaaactttaaaaaaaaaaaaaaaacacacacagaaaattcttgcaaactccctctggggaaaacttgcgcaacgagtcggtggaacggaagttcgttatacccgaactccagctgagtttcatgcactgctcgagaatcgcaacatcgacattattgactttcatcacgtctctcaccatatggacagagtggtagtgaggaaaaaggctgaatttgcaaaagcaccgtcaaccaactgcttaccaattgcaatttttgtcacttcatatgctcgtctacacctttatgactatatggaacaagtgctgcgtcttggtcataagctcctctattgcggtgagccaaaaaaaaaaatttttttttcacctttattgacctattattcaagataccgattcaatttattacgtgacacgcagcggtagacagcaggtgcctgaaggtgaagcgctgggacagatgaagagggaacattgctcgaggcgaatatacgaatttgtgtccggtggtccaaagaattatggttttcgccattgtgatcgcataaatggagaggatgagcgtgctgaattgaaagtccgaagttttcgtctctcatattctgcgcagcaactgctcaacttcgagtccatgaagcgcattgttttggaacattacaacattgatggacaaatgttaacacatttttctctcacataataatccaagaaaaaatacactaaaattctattccacagatatgatgagctggacatgaaaggtgttcatgttgtcccgggaaacaacgcgtctatgagaatccaatttccacaaattggacgaactccatgtacggatctgtacacctacgacgctcacaagactaccacctcattatgtgaggaggcatcacccacatggaactgagcatacagatacgtgaagacaacggatcagaacagctgaacatcacgacacagtgaatgatttgatacactataagtggtaacttacggatgtcaattggatccataaaaaaaaataatgtacacatataagaaaaaaaaaactgcagcgttgcgtcgaagaaatataattacatatcacacatcgcagcatgagacagatgttcctgctttttggatcctgtaaaaatgattttaccagaatgataggctaaacatgtgaccaaagcgtgatgattgtctacaacaatcttacaacgcatagcgggaaaaattgtgggatcatattggatgttacgaaatctgtgtgggtccagtgttggtataaaattcaacagaggcaaacgatggggtaatgtgaatgaaccaactatgtttgtcacacgtatctcatggagttctaactgagagcccaaagcatgctgcacccttcttctgattttttgcgcctcgcgtaccgctctgtttggacaagggacacccgttaacaccgcacgggctgatcgaaatagaagacacgcaagagtgcgttgttgaggcagacgcagtcgtataatgattgcatggaatcgttggggatcgtactccgagttgaatccgttttgagcaattttcaaaaactctgtgtttgtgaagggcgtccgctgtagttgaaatgtcactgtacaattttgaatagttaacatttttttttaatctgacattaaaaaacgacaatatttgaattaaaaaaacacccgttcatcatgcatcatcatcatcatcactaaatcatggttctttaacaacaataacactaagacactcaagcgggaacagagagctatgatcaccaccaccaaattgaagaacacatggcagttgggggtaagccagctttataccatgctttacatagtagtagacgcgcacctaaagtgtattgtacacatagattggttaaatttaaataaatcaaacacaaaccgtaatgccaagataaccgcgcatagcatatgcagtttgagctggatgaattgtcagttcgttgcaatggacgcgaatgtttttccaggcagggcgcagatgattggtgcgtaaatgaagattggaacgcaacatttccgaaatttctctacgtttgctcagcgtctgcagcagaacgtgaagctcattcattgaacatttgtagtgtttgcagagaaaatcaatcaacggcacactcttctgcttttcattgcaactgcacttggtttgtggttgcgggtgctttggcaactcaatgttgtctaaatttaaaaaactgtttttaatgtctaaaaataactaaataaacctttcacttgttccagttccatttgatcattttgcaattccctcgcccgctcctcctcctcctcgatgattttaagccaactcatttgtccttcctgaaaatttattttttttttttactaatatagttttatttataaacttttttcataaaaaaaaatacctgtgttgctttatcttcttcttcatttcctgttgtcatcttttgttccgggtacgcattgtggagccaatcggtcgcaagaatcgcgtccatttgtttaatagttaagagattattattattattattattattattatttctgtaaagctttattgtgtatatataatattttttaaacatggataatataagataaaccgttttgcaaaaaaaaaaaaaaatggcagacaattttcaaaaatttgatgaaaaacacttacaactcagacacccgtttacgctgacaatctcagggagcacggggagtggaaaatcggaatgggtgttacgaatgctgaggaatgtgaatgcgctagtttcggaacccatctcggagattttctactgttatggggagttgaatccaaatataatacagcttcagaaaagtggacacatcggcggttgtagggttattgtacatgctggaagcccaaccgaagagcaggttaatcggcgcgcaaaagagtgtgatggaaaactgttgatggtgttggatgatctcatggttggattgggccaacaatttcttgacactgtgttctcccggggatcgcacaattggggggtcagcggtgggttggtcactcttcatttgttcgcgaaagaactgcgcattgcgcgcaacaactcccactatttggtgctgatgcttaacccgggaggc

SEQ ID NO: 829 - DNA, 776 bp, Heterodera glycines
aaatggcctaaataggcttaaaatcatctttttacaatttaaaaataaattttgaaacccctttttcacaaaaaatttctataaacaatctaaaaattctgtaaatttaaacaaaagtaacacaaaaaacatgatttttccaaaccactgaaaataaatgttgttcggaagaacaatcttgaaaaggcaagaaatattttgaccaagagaagacggcgcaaaatcacttaaattttccgcaaaaaaatagcctaagctaaacgagaaaaattttaaacttataaatagattatttttcgaactaatttcaaagcgaaacattgttattactagggatgcgatttttagttaaatacctaaaattttaacttcattttcaataaaaaatttaaattttaacattatcggcataaaactcttaatcatatataatatacattagaaaataatcaaaataacagaataaattatgggattataaatataaacttgagcttttgaaaaataaatatttaaaaaactagaaaacgaaatcatagacataaattaacagtaataaatatgggacaaaagaaataaaaataaactaataaaagtttatatatggaatacacatttttcccagattttattgagtaataaagtatgaatattgaaaaaacaacaaatttaaaataatattgtaaaactaaaataaacaaagagaaaaaccattattacacgcataatctaaaggttgcaagtttttttctaataaaaccttaataaacatgggc

SEQ ID NO: 830 - DNA, 8121 bp, Heterodera glycines
  misc_feature (8097)..(8097): n is a, c, g, or t
aaaattttttattttattctattattaccatgttgaaataaggttggttttattcgagctgcgctagatcattatttaagcttcttttctattgtttgcggacagatatttgcggacaatttcaggaaaaaataaaaaaatttcttgaaaaattaaacaaaaatttttgtaaaaatggattagaagatttggcttcgctattatatcacttcaaatttcagatatacagaaatatattttaattttttgagacatgcttaatcgcgaacaaaatttacttgcaatttcaaaatgtgcagcatataatataagtgctgaacaccagctgtactaaatttcgattcccgtcattttttgggcctcggaattccgatttctttacgaaaatttttgggttatcggaatgttatcctcgctgaaccctagagcaagatttatctagggttcttccccgattctatgggaaagaaaagtaggggagcagatagcaaatcccccgaaaagacttgtcagcatagctggagaaatttaaaaaatgtaggcaaatactcttcgggaagtaaatctttttaaattctaaaaaattaagttaagagacacaccagcatctcattttgacgattgaaattaattattaaaagttaaaaaaagattgaggccttataaataaaaaattatttaatttgttgtgcagtcgtctccattcaatgttttcataaattttttaaagaaatttttttatttttttccgaaattgtccgcaattgtccgttcgcaagtgtccgtccgcaaatgtcccaattagagaattaataatatttgagacattttttccaccaatcaacataatcataagacgatgccgtaaacttcgatttatttttgttagaaataactataatttaatttattaataaactttttttacaataaaaattgattatgttgcttaataacttaacaataaaaaactgcatgaaataattcgagcaataataaataggattcatttaaaagaaagaataacagcaacacctctattaaaattatatttaaaaaataatttttataaaattttatagattttattaacaaattaattgatattatttataggtaaaatatgacaatggttggttatacaacaaaatgccccaactaaacaaaaggatagttaaaatatttcaggattaaatacataaaatgagaatttaaaatattaattcaaaaaagtaaattacattaaaaaatttatgaagaaaatgtttattaaaaaattttaatgcatatgtttagaaaaaattaataaaacattcccaaagttcttattttatgaataaattaatacgccaaaagcataaatcaaagttattattttattaaaaagaattatttaattaaccaaaaatttttctatttataaattttttacgaataaaaaattacacatacaaatatatttcatctaaaggaccttttacttaacactttttgtctccacaaatttcattgatcttagtaatcgaaacagaaattttataaatgtaagaaataatatagaaagacagaatgttatctaaaaatagcaataaataatttttttgaaaaaacatcagctaaagaagatatttcatagggttcgaaataaacgcaaataattataaattttatgaaattataaaaacacgaactaatgaaatctaaaacattcaagcagtcttcaaaaacgtaggaagcagatcaagaactaaataaaaaaattaattagaaaccagattacggtgataccaaaggacaacgatatccatgggtgcacttttcatttggtttccatgaaaaagctataaaataaaattcatgaaaataacaaaaaacagaaattaaaatataataaataataaaagttgcagagaaataaaaataaatttttatttattctaagaataacatcgatctcattggtaattatataaaataaaatattctaaatatttgaaataatgcgaacagataaatttttaatatgcaaatattctcgttgaatccaaaaattaaaataacaaatgaagatgactgtgataccgaaaggaaatatccttgaatgcagtttcatgtggttcccgagaaaaagctataaaatgaacttcatgaaaataaccaaaaaaagagaaattaaaatatattaaataattaaaactctaaaatttgaaataatgcgaacagataaatttttgtatgcaaatatatcgatgaatccataaaattaaaataacaatttaaaaaaatattataagaaaatattactcatattttattttcaaaaaacccatttgtttaaaaataaattaaatattaattattagtttttattcgtcattctaaaaaataatttcattttaagcttttaaaaaagaatgttataaaaaatatttttacccatttaaagataacctaaaatttgcttaaaaaaatacagtctctaatcaaccaagtaccatacctaagacttgtcttcagggcaaagagaaaaaaacataaaaaattaattgctaattattagacaactacaaaaacagaaagaagtgtcaaccaagtcatgaagcttgtattaaactaaattgctttgtattttttgctgatgccattccacattttttttcagatcttgctctgcatatcatgaagcattttgatcaggcattaaatagaaaatgtttgcttttaagtgtttcaaccttatttgaataaaaataaatttaataaaatctcagttaaatttttgcttcattatttactagaaattttagctttgttttattatggagattacctcactaaaatttaaattttactctcaaaactttttctacatgttacgtacataattaaaaacaaaaatttatggagcaattcccacagcatttaattattagtttatttaaatttatttgattaaatatagtaagtaaattagttttatatcaggagtagtataggggcaaaaatctggcccccccctgggctgagagatgcgcattcactataggagagaggagagagttagagaaaaagagtaattgcaaaagcaaagaaaagcaattaaaatgtaaagaaaccccggccactattttaatgcaaaaaccccagcctaatggtattcccgggtacatttcgcaccgatgcgcgcgtcgcttctttttttgcgtgtcccaaaatagtgataataaaaagttaaaattttgattcatctaaattttattattcgtttttggcgcacaaaaggccatgaaagaaatttctttcacaaatcgcatataatttcctgctttcttgagaatctttcgtgaaaaggaatgtatttatttttaaattactttctgacctgaaaaattcgtgtaaaagcgctgcacataattcgccaaaggaaagttgcaatatgcaaacaaaagtaattttaattatattaaataaaaatttttaaatcctcattttgtcagatagactttattcgttggcaaatgataaaaaatttacgtgcaaatgcttcaaattcatgattttaagcacatattattagggctgcgatttttaggcaaatgcctaaaattcctgcgcacataatacgcatagataagcacgaaaaacgcattttccgcttggtttggggtgtctacgatgacttttataatgcctaactttgcctatttcggggtttttgtgcttagtgcctattttgcaagccttaataaaaaaaatgcctaagtggacaatcggacagttaacaatccgacagtaaattacactaaaagataataaaatgccgtcgctgaagggaccgattgtgccgtatcaagaaaaaaggaaaataaacaaataaaaaaagtgcgaatgcagtctaaaattgtttcgttttaaattaacacatattggcattttgaagggaggctgcatctttattgaaataaaagcgctttttcttgccattcctcgcacccgaatgccgtcttgtaaattataggtgaaattttgatcaataaaattccaatgcctactttattactttgctcaaacttggcaattttttgaaatttagcaccggctgattaattaaggtaaaaattcagacattcgaatatgaaatgcgcgtcggtgtatatatgaataatcttttatttaatgacataaaattatctgaaaatagttcaaaatgcaaatttattttaaaacaattaaataaattattgtaagagagtctgcccatcaactaaaataatttagcaaggaaacaccaaaaattttttataatcattacatgttttcattattgtttttttatctagttaaattctatattttcttatttacttaatatattattaattttcgttaatatttatgtttgggtcaaaagttgtaaagaagaattaatatttatttatttattgttgtaaattttaatttttctgaaaagcatttaaaatttattacagttagtaatcaaatgctatcaaacatcttccagcaatcgcttttaacaaggttataatctggtgaatttatttactatatgagtttatttaaaaaatttatttttgagttttatatttttaattttttttggctcaaaaaagaaaagattttcttaattttcttaatactattttgttttataatcatttaaaaaataaaccccctaagaaatgaaaaattttccaaaaattcatctccaaaatgtatttatttattttcttgacaagaatttatgctttaaaaaactattaatctcaatactgtcttggcctaatttttttacttttttgaataattttttgtcatttcacacacctaaaaatgagtttttttagtgcctattttccattttttagtgcctattttgggggtttttttagagcctaaagcctacctattttggcggtttttagtgcctataaatgtgagccctatttataatgaacaaatttttaatttattttatttaatttctttaaaggagaattgcaaatataattgattgaaattttatatttttaattttatatgaatttttattttaaataaaccaacagaaaagttttttattttctcttgctatttaactataatttatataaaatatatttaaataacaatatctacaacaatctatcttttaatataaaatataattcttattaagatttatatattcaaattttgagcagttgcctctgcctcaggtgcgtatagcgtgactattgaatgctatactccatatttttgatcaattctgggatggctaaaattaaaaggatttaaaccttaattctttgtttaaatattaaaaataactttaaaaattatattattattctgctttatcttttttttcctttgttgaaaagcatcacaataaaaacaaatagaatatataaatatattttttttgcagtttttttacacacctagttattctaatagagtattaggttaagtaattaaaatttgttatgattagaatgttatattcaataggtatatagatgctgaataggagcaatgggtattttcttatttatctatgaaaagttactttttttttatctcgtgcagctgtccgtttttgatttatgatactaatgtcacattaaatattttgtgtcataaagtgattcattaaaatcaaatatttatttaatttcttattttaataaaattcatttatttatttcataaaatttatgcttacggtggttatctttataatcatttattccgtcttgcttagtgtttattactttttaaatagtttataaaaatatttttaacagatttgctatttagtataaaagtctttcaatcttgggtgaagtaaccggtttaagattgtcgttatactataccaatttttatgtattttcaattcttatttgaatgttcaatggtgttctgtttttatattttgttaattgattatcatctcatcacttaaaacatattttcatatgtaaaaaaatcttccatttcagcaataagttcattgtaactcgaaatattaaaaaaaaaatttaattatatattaataattgctctttatgtaataatagttaaaacacttttaataattatcaaatttttatatatccaatttcataaacttttgaaaaacaattttttatgcaatgattattttagttttaattcaattttcaatctaatcagtaaaccagttttaaatcgcccgtttatctgaacagcatgtgcttcaacctttaaatttaatttttaattaaatgttaaaaaatctattataacttttaatcatgcacattggttccacttaattcttcgtgccattaatcttaattttaataatttttatttaatttaaaaaatatatttaccaaaatgcgttcgcttcgcgcattctttcattctcgacatggcgaaggtattcgttgttggttttttaaatgaatgatattaaaaattgattatggaaatatttttgacatgctactttatgctttaaggtattactggagatcataaataattataatattttataggacaaaaattaacaaaattattgattgtaataattatacttttatcaaattttatttttttgtttttcaatgactgtgtttaagaattttatttgctaaaaatacttaagcaatcgctgcgtttgcgcacgcatatcgttggaaatatgtattttttatatgtttaaccattttcatacatatgtaataatttctatttacattttggtaaaatttattttttaatcatatctttattttttcagtcaattaattcaaaatattttcgaatcgttttttgatatttatttggttctctttgcataatttttgtaataaaatatagcctcatattaattagggttcttcgatgcaaattaaagatatgttaaattaatttttacaaatttaaaaacaatttagatgaattacgctttccttttgttattttttaaaattatctcggtaggaagaattggtttacctcacttttgtacagttatgcaaattttgaagcttttgaatgaccttattaaaatgttttctctgtatttgagcaattcatacgcacatcattcaattttttctggaattggcctaaatttttgagttgatctcgccccactacttgctccgtcttcgcatgctcccttttgcgaaattttgcttgtaattgttatttcacgtttattattttcggtactgaaatgttcattttcactgggactcagttgccccagtgctcagatggcgccggttcgaatttatacattgttttttagacttagctcatcaagagctttcgaatgataccaaatttgtgtgattttgaccgttttaaatcttaggtgcttcctttcactcaatttttcaagttttaaacgggttcaaaaaccggtttaaacgctttgccgcgcagttttttgatggtttaggcgttttcagcacctaaaaaacctataaaagtgttttatctattaataaaatattaaatgacttgtgaaggtacaaatttacaagatttgttttacttattattaaaactgagtggttgcggggtagtttaatccgatcactttacacatactttagtcctctattctcgttctgggacatttcgcccatttctcagataatagtttcttatattttgttcaaatactttattttacattggtcatacatttaattatttaactatagagtaattgtttctttatttcattattttaagttgtttttttattttcatattttacaagatgatttgttttttctacagtaagtgcttccagtgtcccctgttgattaatcatttcttttatttattttatatattacaaattgtttgttcagaaagttttgatatttttaaaattcaatggttaaatattttagtttgctaccctataatttagatactattttaattcattgggtttttttaaaattatcaattgcaaatataccttcatattattctttagattttccattttattgaaaagataaatttttgttattattataactgaaaatttttttcaanttgtttatttgatttcatttttcc

SEQ ID NO: 831 - DNA, 4100 bp, Heterodera glycines
  misc_feature (38)..(38): n is a, c, g, or t
aaaatttttttcaattgattatttgatttcatttttcntatactttctcattttttgtgcttcacaataatcaatgaaaaatactaatttttatttttagaatttttccttccttatatgataattattatttggaactacaaaatgaaactttcgaacgttttttaattgttcatttctcgtgcttgtcaacgataggtatctgagtagctcatacatttaatcctattttatcattttttttttaaatttattaaataaatagctcattttttacttttatttggttaatattgttccgtaagagttgagaaatgacatgtagttcgtcattacaagttaatttttataaagttatttctgcattcaatttttggctttagtttataaattaaattgcctatggcaagctgtaaaccctttttacatactttactatgtttaaatatttattttaacacttttcatatttgtccatttgtttttataattgtcttcaatttggagaatattcaattaaataaaagtgattttagcttcaagttctgtatgtaaatcatattaatcacaagagttcaattctatttttttctcaatctacaatcttaacaacaactttaaagtaatattattcatttttctttttttcatcttgtttttacagcttaaacaaataatgttttcttatatctatgttaataatacgttttaatgtctatatttattaaaagaaaattgacttaaaaatttttatttatatttcacacgctagatatttctttgtcatttttaatgctgtgtttatagttattagaattatcacgatttaatgtcccgagatcctgtccatgaagtatgtgagctcctcctacattttaaatgtttattcctttcgttcaaaaaggtagtttattttttggttatgttttttatctttaaagaattttttttggcatatataaattcatttttcaaatacaccatgaactatgtcgtcattagtgttatagttaaaatttgtaaataattagacaaatctgcgtttttcaattaatttctttatctataaatatttatttttaaaatttgttattgtatttaaaaatcttgtgtattcaaggttaattcattttcatcatttggttgaatttattattttaatcttggtcaaacgtaagaactctttatcggtcccttcaacttaattgatttatctttagtgaggaacaattagctattttgatttcctttaaatttttatttatgcaaattatattcaataaattaaatttataatttatagattatgcatgataaatttttttttatgatctatctaaaataaaattataattgttttcagagagaaaatatgaaaaatcacaaacttttaaaaaaactgccaaataatgatattaaaaatgaacattgattggttaaaaatatcactttattttgtcatatattttattcaacaagttttactttttttgttctgattcttaatatatataatttgagctttatttttaaaaagaatttttgctatttttgctattttttaatttttgttttgcctttgttagaaatatatggatcatttaacagaatttgatagaaattgattttttatttaaattcatttttatatttccatatgtattaatatattttaattaaatttttattatttgtatattcagttctttttgcttttttttttataaatttttgtttcttttatgtattttgattgccgacgacttaaatttttcataaaattattaaaatgatgatttttattaatgagactaaaatggtaaaaaatagtaatttttggcgtaaaaccgctaaaaattttgtaaaatacacccattaatttgggatctcaaaaaataaaaaataaatccctttaaacaaattcaaatttttctgttttttacttttttccatttttattaatttattccacttcatttatatctaaaatataaatgttttcttttaaagcttatttaacaaacatccaccgcaatgagattctattataaattctgtttattatcatttgttcttttttaaatatttcgagaattcatcactttggttgtaataaattctaacttcatttattttttaataatttccttattagggaaagggttgaataaatttatttataaaatgctcaaaactcgctgtttattaatattgcaattttgatttttcaaaaaattttgtttttgtaaatttttctttattatttaaattgttttcaattataagtgtaataattgaatagtaaaaatagtgcttaatcaaatgaaaatttttaaactaatgtcatatactcaatctttaatattattaaaacaaagattcaaatatggattaggttttttaaatttatttgtctattgtttctattggtcatttttcattttctataaaattgtgctttaaaataattttttcccatttgtttccaatatcatatttttcataagtattcctcatttccattaaactgagctgtaatcgtcgtttaaatttagttaattagttcatttatttatgcatttatttgaatattaaaaagtatatttattttttatctttaaatatttaatgtaataaatgtatttgtttcgtaacaaaaaaaaattactgacataatttctttccattgttgaatttattattttataatcgtgtaaagcaaatgaaaaattaaataatttattttgtcctttgtttttattgagtaataataaaatttaaaaaaaaatacttttaaccacggggttgggctttgcttaattgtacatttcaatgcttaattttatcatgttcatttgggggctaatctatataaattatttttttatttaacaatattatgatataaatattaattattgattgtttacatttcactattgattttaaataatcgtgtttttaacttaatgttatcgtttttattttgtaaaaatcggcgacttaaatacttctcaaggaatatttgttccagaatatttattctaatttgatataataaattagacttgaattgcttcaaagtttttgattttttaagtaaaaatttgacctttaataaacgttaaaatagaatgtaaattatttgaaagttttattttatatttaaaacattacataacttttaaaatttgatgcgtaaaacaatatctcctttttacaaaaattgattttttattaattaatttattaagattatcattttagttctgataatttgaagataccaaattttttcactaattataatataatatttaataaatgttgactgtatttatattgattttcaaaaagcatttgactcagtgccccatgaattacttttatacaaattggaaaaaataggtataaggggcaaacttttgatgtggataaaggactttttgagtaataggacttttcgtgttaaaattggggatgatttatcctccagtaaaaaagttggctctggcgtcccccagggctctgtccttggacctttattatttttgatttatattaacgatcttcctgatgctttgccatcaggagtaagaattaaattatatgctgatgatgttaaattgtatatttgttataaagcaagaaccgaaacagaaattatgcataaagcattgcataatttatcagaatgggcaaataaatggcaaatcagaatctaaattaaaaaaacttttgtacttcatttggggaataaaaaccccaaagaaatatataaaattgatggaaatataataaatgttgtggatacaattagggatttaggcataaatattgataataaattgcaattttccaatcatgtcacacaaataataaagaatgcatatttacgtatgcgttctttatttcgggttattaaatcaaagtcttctaggatttggattattttgtacaaaacttatgttagaccgttattggaatatgctcctgaggtttggaatccatctcttctaaaaaacattaaaaaaattgaaaaaatgtcaaaaatatttcaccaaaagaagtctttttcaatgcagccttccacccattcc

SEQ ID NO: 832 - DNA, 4177 bp, Heterodera glycines
  misc_feature (75)..(75): n is a, c, g, or t
ggcttcttcttctacctgatcgttgctgcggcaatcctcacgcggtggaatggtgcgtttgctcattccaaatcntgttgttccatcaatcattttaacggttttgttttcccttttcagttcgttggcatgtcacttggcggcaaaaagtcatcggatggagcgagcggcggcggggccaagaaggagaagaagcacaaaggatcgaagagctccagcagtgagaagagccaatgatgctgccgcagtacacgaggacggacgaacgatggaatggccgacaacagttcccctcccaaaccgatgctatccccaaaatatatgttgttacccctatcatttgtgttttatcactctgtaagcaaattttgcgctttccataccagcgatcatattgttctaattgtattgatgtgttatatatgtgtacacatgtatttatgtatggtccaatgtaactccgtttcaaaataggcaattaacaaattagttacgaagattggcaaaaaaagacatttcaattttcaaattggttggttgggttggccccgtttttcctccatttccattcgctttctgctgtttattacatgcacacctcatcgattcaaatgctattttctgttgaaaagtcccaaatttgcactgattttcctcgtggttttgagaaagagtacgccattcttggccaaataaagatggtattaattaattctaaaataaaaaatcttccattttcattcattttttgaatgctctcaacgccgattccgaaaaaaaaacttttgacagaaatggacaattgctgaaattggctgccaacttaaccccccattgattaatatgaatattgctttttagttaatttagtcatcaactttatttttaaaaataaacgaaaagtgcgtcgcctgaaagttttatgaattttttcgaatagctgtaacggctaaacaaacataaatttgtttagacaatttaattctgatgaaatattcgtgtttaatgaaattacatatttatccatgcttcaagaaattcaatgcatttagctacttaaattttaaaaatatgcatttaattttgtttccaattacttctttttcctttcatttcacttttatgtgcaacaattaaccttagcagctgacacctgcaattaaattatgtcttaattacccaaattagcaacaaaaaaaacttgccgttgctttgctccttgtagtaagcttggatcagttttcctgaggttgtccagtaggaagaggaaccgacctaaataaaattacaaaaatttggaatgtttccatttcgagaaatgcaattggtcgaatacagtctcggccattggtggccatcatttcctttccgttttttggcttcacatttcatttttcctcacattgctcgccgatgcgctggtggtcaatgccgaacacgactcgcccttgttacagacggaccagttacagtaggagattttgtagccgtccaaaaaggaccaccattcgttcatggagctggtcgcaattgtgccgtcgccggacgattcgcacgcgccgtactcagtcagaaaaatgggcagacctggcaattagtgcaaatattgtttttttaaatattatgaccccaagaaccactttttgtgtaggccgtcttgagttttgccccgaggccagaaactgtgtgagtgccggtgtaaaagtggaaagtgtacctttggggaagtttgtgtcaaacagattagctaaaatgatatcccaaaatatatgacatcatataaattcacattaaatttgagtagccagtaattggatttgcagcggcaacgtccacgtcctttcaaatgttcgttttaacaattaaatttaatggaaattattagggtcgctacttttagtgatttaactaattttttttgctcaattgtttcgaagaaagaagctcaaaaatacatttctgcgttgaaaattttcgattcggatctcactatcgcatattcgtaatcagcgacctcgaaaaccccccataaacatgtttccaagacttttggtcgctaatcacgaatctgacatgtattttgactaatttctaatccctaacccgaactcgaataaaaatcggaattttgaatttttcaaattatgattttttgttcaaattcagattaggaaatcggaattgatcaaaataattgaaggattcgtgatcggggaccccaaaaaccccagaataaatttttatgactatcacaaaaaaaaatttgcaaaacaaaagggtccccccttttgaaaaaattttcaaaaagggccactttcaatatagcgccaaaaaatgtttcttcaaaaagggggggggggggtaccatctatagtattacccatacaagtgtcacaattaccatcaaaactacaatttattgttcacattttacatacaatatgaaacggagttacattggaccatacataaatacatgtgtacacatatataacacatcaatacaattagaacaatatgatcgctggtatggaaagcgcaaaatttgcttacagagtgataaaacacaaatgataggggtaacaacatatattttggggatagcatcggtttgggaggggaactgttgtcggccattccatcgttcgtccgtcctcgtgtactgcggcggcatcattggctcttctcactgctggagctcttcgatcctttgtgcttcttctccttcttggccccgccgccgctcgctccatccgatgactttttgccgccaagtgacatgccaacgaactgaaaagggaaaacaaaaccgttaaaatgattgatggaacaacagatttggaatgagcaaacgcaccattccaccgccgaacagtgccgcagcaacgatcaggtagaagaagaagctcatttggttgattggagaacaagcgcggtcgaagttgacgtgtgtggaagatgtatcggttgaaggtgttgcgcaattatcgtcgttgagattattttattattgggaagtgagcgaaaatgcgaatgcccgttccttttatacaatctcagccacgacaattcttaaacccaacattttgccaaatttcatttgatatataaggggatgcgttttcatccttttcaccttcgctactaccatttgcccatttcgaagtgcacccactgcaacatttttgtgagttttttctcttttttttcgtgtgtttttttgtcttctttttacatcccctccatttgtgttcagaaacggcctcgacaaacaagcaaattcttcaccaacacaccgatgaagagcgtcgtcagcccaactccgttccgccggcccctttcgctccgctgtgtgtgctcagtgctggtgctgctcatctgtgcgttcgatgtgtcactggcagcaaaagacaaggagaagaatggcaaagaagaaccaggaggcccatttaatacgctcagcatcattttgctgattccgctggtcatcttcaccggcgcgttcgtctacctgctgtttatgaagccaaagagcgaaggaaccggcgatgacgacggagaaggcgaaggagacgcggacgtggaaaagggaccaaccgaagagacgaagtaaaacacgggcagagccaaattggcaaaacaactaataatgtttttcccatttcagaacggagcctcgaattgaatctccagcaactcttttgggcgtgacagtgccgttggagcaagacgaagaagagcagaaaaaggacgacgaggggtaagtgcaaaggtggcggatcattttttactcattaaaatttaccatttttagtggcgaccaaaccgcggagaagaaagaagaggacgcggcggcagcggacgaacaaccgaaagaaggcgccgcggaggcagcggaagcggagaaaagtgcgacaaaggaggagacgaccgaggacacggaggagaccacggaaggatcgaccacagagacttccgacagcggctccggctcgggatcgtcttcagcatcgggctctgaggggagttctgggacttcggacgccacttctgaagccacagaggacgcatcatcttcatcggagggttcttaagtgaagcgatgcgaattatgccgtttaatgacaaggaaactcagaagggtatttcccatgcacatgtattgctgtattattgt

SEQ ID NO: 833 - DNA, 4769 bp, Heterodera glycines
gaaatggatatcgaaattcgagatcagcaactccgaaaacctaagaaaaggtgatctatccgactctaaaaattgtaatttttacaaaaatttatgggggacaaaccatataagagccaaattttgcgctcgttatcgcgacagaattgtagttttgatggtaatcgtgacacttgtatggagtaggaggtcgacaaaaccagagtagggtccgaaaattgttttttgttgcaaaacaaaggtggaacccttgacttgcaaagaaaaacaaattttgtttgaggaaaaaaacggctctattgcagttacgcgtccaaacgacttttacccgtccaatcacaaaacggcggcctaggacttgagttataaccagggctcgcagatctgagactcaagggttccaataatttatcatgcgtgccatcaacgcggataaatataattactaatattaaattgaacaaaatattaatgtttcccttcccgtttaggctgtgttctaccaggagttccggatttttgtgcgctaaaatttaagaaatcctatcattagtcacaattcagttctttctaaaaaatcgaaactaagttaatattgatgtaaaatgtttatcagcacatatacacctcacacaaacatacatacggaaatatgaaaatgataatgacaatagattttgaggagcttgtgatatgtagtgggtttacacacaaaatgataaggggaattgtctgatctccagtcgtgttcccagggcgcttctccatccttctgttctgttagtgttcggtgctcatcgtcctcaggccggcgggaagcgggtgatgctgtggctcaggttcggcgcgattgtcagcgttgctcccgtgttgttgcggccagtgtagcgcggcgccgagaaaagggtgatgagccggcggccggcgaaatattccactccgtccatcacgacctggaaaggggaagtgggaatttagtccagaagcaaatgaaaaaaaagaaaaaaactcacttgatgcgcccgaatgatgtagtcgaggcagagcatgtcgcacacccgctccaccacgtcctcgccgaatgcgatgcccgctcctctggtgttcgggatgacgccacgaactccgcgcgcagggtccgcccacaaaagatcgatctccagcgtccgaagcggcgggtcgatttgcggacgattcaggtggctgagctgctccaggctgttgatctggtcggagaggccgccgtgcatacctgaaaaataatgaattagtatgaatggacaacaacaacaaaaaatgtgactcacacaggattttgtcgccgatcaggccgacgtagggcatccaggcgaacgtctgattgaagaggtcgtagaggcggcggggacccggacgctggtagcggcggttgacctcatcgaagaagccataccttaaagggggggggggaatttaagtctgaaacaacacaaaaaaatgcgatccttacactctgttgatgttggcgcactcgtggttcccgcgcagcagcatgaagttcgctgggtatttgacctgcaatggttttggggatttaatttggtctgttaaagattcactaaaccacaccttgtagcagaagagaagaacaattgtttccagtgactgggggcctcggtcgacgtagtcgcccaggaagacgtactgctgctctggagggttgccgtgcgtgtggaagatcctctgcaggtccgtgaattgtccatggatgtcgcccacgacgacgaccggcggctgaatcctgacgagcgtcggctgcattctgaagatgtccgtggccgccttgcagagttgtttgagctcctcgtcggtgatctgtggaaaaaatgaaattttttaattgttgaaatgtcatgtcaaaaaaatcccacctcatccgtgaagcgttggacaggcgactgcctgaccttcctgatgatcgcgtccacgaagctgcttgacaggccatctccttgcacaagtgttgaagtcgttgccgaaggccgagactgctccgccgctgccgccgccgttgcatcgaagcagtactcctctcttgccattgttgcgccgggcacgtcgcttcgtgggattaaagttgcagacgatgagcaatatataataacaataatatgtgggcaatgaattatgtgatggaacactgcaaatgcgctccttttatatacattatttccgttttcactatgggtcaagtccagtgcagtgttagacaaaattatcatttcgccaaatagcgtaactgacgtaattttttgcgcactaatttaaaatttacactggtaaatgccttttttgattttgatcagccataactcgcttcattcctaacaaaaccgaacaattttagtatctaaaagaagttttatgcttgctttttttcttgactcgaaaaaatgcttttagtttttctttctgtttattacgacagtaaatgaattgtgatcatgcagaggctgcagaatactcaataaagcagcaaaaaaggaaggatctattcgcagattaatttacgagagcaaattgaaggttttttaattaaaaagggggcaaccaatggcaaattgtataagagataatcaagtaacacatgatttcacttaatttgttattacttatctatattactttttttgtaatttgcaaaatttttacgattttttatttttttaacgccgggacacaaattccatttccaaaggattacccaaaatgtggcaattcaccaaaataaattcgtcagcaaattattgagtgagtttatacaaccatgcatacatatacatctactaatataatggtacatacaatggaatacaatagtttatgaaatataggtaatctaatttatatttgcaggcttgagtatcgctaatatttgacacattattaaaaatttaatttttggtttggacaaaacgaaattcagaataaatgatacaaaaaataaaacaaatgttatttttgatgcaaaaacaatgtattttgtactccatcactctttttcttttctctgtagcgatttttccagtaggcaaaaattcgtaggcgaaacgtccgattttggcttagtaggcgaaatgtcattgtgccgcgtcggcccgccttacgccgcttcaaatccaacgcaatgaaggacgggtaaatgaagaaaatgccgaacaaattggtggtcaacagaatggcggtctgacaaagaaaagagacataaaaaatgggaaaaaaggaattttgaaaaaaaatctatccattccaaacccaaatataattttcaaaaatattttccgacaaattttatcaattaaatattaaaagaaaagaaatggacggaatacttttttttgttgtaaaaacaaaatttcgttttcagaagctgtataggattatgaagaaaaaattatttgtacggttttagtgggggtccgtgtcaggttttagctttatttttagggcttttgcttgcttaaacaaggaataccaaatgcaggccctaaaacatggttttcagtctcaattacctattaaatgacatttgttggacgcgtaaaatggcacgggacggttgaaatgtcgtggtgattgaacgcctagctagaaacccaaaaaacaacagtatcacataaattttattgtccgaatacattcatacaacatatttatgtacacataatgattggttgttgcattggagcacatacaaatacaatacaatatataggacatacatacatatatcattacaacaattacaatggtttgatcactgatatggacagcgcatatagcttatcacggacaacagatcagagggtgataaagcacctacaaatgatataatttggggggaggggaacagcgtcatattgtggggatcagcagcagttagaaggggagaagcgtttgttgctcgaagtccatcgttcgttcgttcatccacgggggccatcctcgagtcgatcattgttcaccgctggggctcacgctttctgcttcttgtccttcttggagccgccgccgcccgccgatgccctggcccctttggtggtgtaaatcatgccacagtactgaaaaggaaatgggaaacaaattagacacaaaacgaacacgaacggaggcaaaagcgggccaactaaaccattttactagtcatggaacgatgaaatttggggttttcgggtccgaaattggtcaaaatgaaccgtgtatatgttaatggcacttctgaaatgaaaagcctcaaaacaaattttcggattttaaattttggtttcgtctcacaccagcaaaaaacacgctgaaagtaagccaaattcattttccgtgcttttatgagtctcgaattcatcctttttgaaagctcaatcccgagctgattaaaacaacaaattttgaaatggatacaaatttgattgggactcaaaaaatgcagcaacaaaacaaattcccccaccctcaaacccaccgctccaccgccgaacgcaaccgcagccacgaacatgtacaagaggaagcccattgtgttgttggagagcagcagcagcagaagtgatcggattcgacgtgtgcacgggcgatggatgtgctgtgttgaagcgttgcgcaattgtcgtcgttgctgattgtttgttgttgttgttgtcgctgtgaagggaatgagtgaccaaccgacattttcgctccttttatacacattttttcagtcgaagttttgcctttaaaatttttagttcttt

SEQ ID NO: 834 - DNA, 2715 bp, Heterodera glycines
aaaaaaccacaaaaagcctcaaaatttctcaaaaaaccacaaaaagcctcaaaatttctcaaaaaaccacaaaaccttcaaagcctcaaagcctcattttgaaaatttagcctcattgacctatcaaaaaaccacaaaatgaggctaaagcctcagatctgcgagccctggttataactcaagtcctaggccgccgttttgtgattggacgggtaaaagtcgtttggacgcgtaactgcaatagagccgtttttttcctcaaacaaaatttgtttttctttgcaagtcaagggttccacctttgttttgcaacaaaaaacaattttcggaccctactctggttttgtcgacctcctactccatacaagtgtcacaattaccatcaaaactacaattctgtcgcgataacgcatttattgttcacattttacatacaatatgaaacggagttacattggagaccatacataaatacatgtgtacacatatataacacatcaatacaattagaacaatatgatcgctggtatggaaagcgcaaaatttgcttacagagtgataaaacacaaatgataggggggggggggggggtaacaacatatattttggggatatcatcggtttgggagtggaactgttgtcggccattccatcgttcgtccgtcctcgtgtactgcggcggcatcattggctcttctcactgctggagctcttcgatcctttgtgcttcttctccttcttggccccgccgccgctcgctccatccgatgactttttgccgccaagtgacatgccaacgaactgaaaagggaaagcaaaaccgttaaaatgattgatggaacaacagatttggaatgagcaaacgcaccattccaccgccgaacattgccgcagcaacgatcaggtagaagaagaagcccatttggttgattggagaacaagcgcggtcgaagttgacgtgtgtggaagatgtgtgggttgaaggtgttgcgcaattatcgtcgttgagattattttattattgggaagtgagcgaaaatgcgaatgtccgttccttttatacaatctcagccacgacaattcttaaacccaacattttgccaaatttcatttgatatataaggggatgcgttttcatccttttcaccttcgctactaccatttgcccatttcgaagtgcacccgctgcaacatttttgtgagttttttctcttttttttcgtgtgtttttttgtcttctttttacatcccctccatttgtgttcagaaacggcctcgacaaacaagcaaattcttcaccaacacaccgatgaagagcgtcgtcagcccaactccgttccgccggcccctttcgctccgctgtgtgtgctcagtgctggtgctgctcatctgtgcgttcgatgtgtcactggcagcaaaagacaaggagaagaatggcaaagaagaaccaggaggcccatttaatacgctcagcatcattttgctgattccgctggtcatcggcaccggcgcgttcgtctacctgctgtttatgaagccaaagagcgaaggaaccggcgatgacgacggagaaggcgaaggagacgcggacgtggaaaagggaccaaccgaagagacgaagtaaaacacgggcagagccaaattggcaaaacaactaataatgtttttcccatttcagaacggagcctcgaattgaatctccagcaactcttttgggcgtgacagtgccgttggagcaagacgaagaagagcagaaaaaggacgacgaggggtaagtgcaaaggcggcggatcattttttactcattaaaatttaccatttttagtggcgaccaaaccgcggagaagaaagaagaggacgcggcggcagcggacgaacaaccgaaagaaggcgccgcggaggcagcggaagcggagaaaagtgcgacaaagaaggagacgaccgaggacacggaggagaccacggaaacgacggaaggatcgaccacagagacttccgacagcggctccggctcgggatcgtcttcagcatcgggctctggctctgaggggagttctgggacttcggacgccacttctgaagccacagaggacgcatcatcttcatcggagggttcttaagtgaaacgatgcgaattatgccgtttaatgacaaggaaactccaatacgtatttcccatgcacatgtattgctgtattattgtataatcgtatattgtgtgttatatatatatccaatgtgtttttgtctgatcaatgattgatgtatttgttctgttaatagcgtatttatggtacatataaatgatgttgaaatgtcatttcgtttttttagttcattcatcgctctttgatggtttttacttcgatcaattttttaaaatatgtacataaattttctttgcacagtagagttaatttctagtttagcatggaatttaaattcctggacctgggtttttccaggccaaatgtgtaaaaaaattcaggtcgacgctaaaaaaactcggatttcctggacaaaattttggactattatttcaagtgaccgatgttttttctagttttcaaaaaagtcggatagaacaccttttcttaggttttcggagtgctgatcacgaatccgacatccgttttgacccatttcgagtcccgaattcgaattgaatagatttttttgcaaaaaaatgtgaatttgttgtaattaagttttaga

SEQ ID NO: 835 - DNA, 2937 bp, Heterodera glycines
  misc_feature (7)..(8): n is a, c, g, or t
aaacgannggaagagatgggaacgggaacgaatgcgttcagtggagaaggcaaaaaaatttcaaatttataattatacataaataatgatcggagcttttcacattgtgggttcgattttcgggattggggtcgaatttacgagatttatcccacgataatccagcatttcaaagaaattcgggattatcaattgggcgtcccgaataatttcggcacaaaattcggtctcgcactgggtgtaatgcagttcgtacaatgtcatcattctcgggtaaaagcccgaatttggggcaaatatttaaaaaatagaaaataattaaattgtgtgtgtttacttcccatagggggcacagttcaagcggaccaactcaatgccgatgattcggcgccaattgtccgaccatcagcttcacaatgcctcatccatttcagacctttcaaaccctgggattatggtcgtcggtggtccttcccaaacaccggtaattttttcatattttcggcattttttcaaatttaaattttttttaaagttttgtccaactcgtggcacggcaaatggtccttgttatgctccagcagcaactccagcggatgtgatctatgaatatgtggaccagggctccttgtcgttggcttccacgttgaaagccggcgattttttgtaaggaaataaatgtataggcattttatagatgaatcccttggaaatacagtaccctgaaatatgttaattttatggactgaatgaacgcgcaagaataatacagtgccctgatatttgaattttatggacagtatgaatccctgagaaatacagtaccctgatatttaaacttttatgacagtatgagttcctgggataatgcagagtagtagtctatatttggaatttgagctaactcaatgccctgatatttgaaattcaaggacagtatcgactactgggaaaatacagtactccgaatttgaaattttatagacaatatgaatcagtcagtggttaattcgttttgttaattatttaggcgctcaaggagtaaatttaatgtgtacgatccggtgccgccgatgagcaatggacagcagcaacaacgacaacaacaacaacaacaccgtcgggttgaaagcacttcaattggcacacaacaaattgctgacaatgatcatcaacaacaacagagacgggaaatttatggggtaaaatttaacaaatttaaaaatgctaatatttaatttaaaaaacctaattgcccaattaattattgaatttaaatattcatactagcctaattaattataggataatgaatatttgcaaccgaagagtttgacgagcaatgaaagtgatgacaataatttggcaagcagttcaacagttaggcaccaaaaagcattaattgtcccggtggatgtcggaacatttcgaggtggataaatgtcaaaaatttatttgaaaaataatgagtttaggatgaaattttgcagaatagaggaaaaattgggacccaatttaagtaaagcgcgaattttattgaattggtacttagaactgggaatttttgagtaatattattaaattaattgttattctatacttcctttggtgtatgcttttccaaaacctaagaatttaaaaaaaaatacctagaaatcttttcccaagaaattattaatatctaagccaaattttttttaatttcccaaacacaatcccacatttttttcaaaaaattttaaaaatcctgcaactggataacgcaaatttgatttgtcggtctctagttctaaatgggaatatgcctcctaattaagccatttcccgagaatgtcccgttgtgccaacgacaacgaccacatcatcatcattatcatcaccgccatcgatggcatccgcttatgagcacgtaatgccacaaattccgctgaacacttttcccaatcaaacaccacctcaacgacaatgggaggccgaaattttggcggagttgaagcagcgccaacaacaaaaacaacagcaacaacaacggcaaaatgtaaggaataaaaagcaaaaattggcacttttgctaattagtgccctataagaaatttaaaaaaaggaaatgaaattaaaattaaaatttcaaatttttataatatcttccacgaaattccaatttccattcattcacaaccgaacgcacttgttgaatgctggcactgaataaaaatgtttttttttaatggttaattatgtatattcaattaaaatttgggatcagcgagagtagagagagagttcagtcttttgggtccagtaaaattcaaattaaaaaaaaaccctctgatcccgtgcaaatccacccaaaccctttgatcctacccgctccaaaatgcgttgttcacttcgtcagctaccatctgctcaattgcttctgctttatgaaaattgtgacggcgtttcgcatcagtgaatgagcgtctcaattgtggcgtaatgccatgcactgatgggtcgaataattggcgcacttttttggaaaaaaacaaaaaatatttcgggatttgtcttttattttgtaaatcccagattaatgtgtcccttaataggtgtaattagtaaagcctggacgggatcaggatccaccggaattttccctgggtcccgatcccggcttttttgcaaatgggttgtggtagggatctcgacaaaatcgagcttcacatcccggcaaatccaggattttaatcccgataattctatcctggtgcctgatgccaatctcagatcccgactttttcaaaatttcgggctctagtgatttgctctatatctactaacttgaattaatttcaataaaataaaattttcccaattttgttaaaaaatgagattctcaaaataaaacattaccatagaaggcatcaccgattaaattacaaaggcaggtaa

SEQ ID NO: 836 - DNA, 1895 bp, Heterodera glycines
aaaattttaaaatttgtttcaaattttatgaattgagggggaggaaaaaacaacaattaccccagacaaaatgcacaaccaaatcattttcttaaaaagggcttggaaaactggattttttattattgtataataaaaacaacacactttaaaaatgatgtgctctcaacaaataaaaaagtccaaaaaattaaaaaataaataattaaaggataaaaaaaatgcaaagtttttgtgacaatgaatgatccaaaattattaattgaccatcattgttaattggataatgaaaatttcgcacataactttcaggattaaaagtacaagtttttgactgaacggttttccggaattttttaactgtattttataggaaattttttatgatttatggaaaaaaaaatttggatagccgtggattactaaggctttaaggaattaatgaattaattaattttttagctcatcgacaaccattcgagcagctcatcccaacggcggttgtgcccaccaattctcagcgaagtgccatcaccgctcggcaatactgtagcgcaacagtcgctcggcacaactactgtatcgagggattcctaccgtatccaaataaacactttccaatcaatggctgatcggcaacaacaacaaccatatcttatcaacccaattaacaacagatacagcaggtaaatgagcaaaaacattgcagttcgtgaaatttgaatgttagacggagtttggcactcgctccattaatggaggggtactgtaatgaaaaaaaattcataggctcattttatcgattttatttgcatttttctttaaaaaattgtttggtttttctccaacttttataagccttaaaatacatacactaaaggtcaatcgccgatttggtaccactgggcctcaatggcacagctttgcccatccgcgcatttgaaagaggccaagccgactcgcccgagagaaggtcaaatctgggcataattaattttaaaagaagaaattgttataaattttcctaaaaaatattagaaaatttatttgaaaatttttctaacatttttacaaattttatgatgaaaatcactaagatttttttcagaaatctttccaagaaaagattttcgggctcttataataaaaaatgtttttttaagtaccatttctacaacattgtcgacaatgcaaggtgaaaacagtccgccgaccttccttggcggcgcggaagtgccacctccgatgggcacgagtttgctccggcaacggcttggctccgcatcggtggcacttatggggtcataaattttgaagttttttaaaaattttgattttgtaatttttttccagctctgctgattggaggcgaggcactttgcagtcagaagctgagcgatcattaggctcaagccgtgccgcgaccaccttcttgggcagtccaccagaagcagcagcaacagattttggacaaaccgtcaccaagacatttggccaaaatggaggaatggacaatgttggacaaagtgtcgaccagcaatttggacgaagaaagtttttcggacaaaatgacgtgtcaccaggcacagatgtgtgaaagcgaatgaacattttttgttgtggaatttcattttcaatatttttttttctcatttatccgacgacgggttattttcctatgattttcattatttgataatgtaatttaattgtttttttctcattgattaaaaatggattagggttaaattgataggggtggcaaaaatggtactttatttaaaaaaaagttctttaacattaaatattatagtacaaaaaatccaaaatcttaaaattactcagttcatttgtttttgaaacgttcaaaattcctaaataaaaatttttgggaa

SEQ ID NO: 837 - DNA, 2473 bp, Heterodera glycines
  misc_feature (52)..(52): n is a, c, g, or t
  misc_feature (123)..(123): n is a, c, g, or t
aattaacatttaagatatgtacatacatattagtatgtgtttattaactttntggaacaaagacattttgtttaacaaaacgatggatcatttgcataatattcgcactttcgtcccccgggngggccaacccattcattttcaattcgttcattcgtttcacccaaatcccccccccccaaaaaaaattctttataaacacatcttttatctgtttgtttgtatctgttgtttgttgtgtcccaactattagcagagtttaatccaaattctcacatttgccctagtaaattcacactttgtttgtttgttattgaaactttttcattgcgaaaagaatttttaaaaacgatattggaagacccttaaaaaattttgcatagctaattaaaactcaaataaaaattccaaaaataatattattgctgagacacaaagatcggctcagacggagttggccccgcccgcttcatccggcggagttgtgagaaaaacttttttttttaaacgaaaactaatttttttttcgctgcttccaaccccccacaaaaaaaagtatttttaacgaattaatcatcaaagcggttgtggtgtaactctttctgctgttgttgggtcagtcattgttgtgacttgtgacacattccctctggggatattctcagcaaacttttttgttttgttttggcaaaatgttgcctttggcgggaatatattttttttttgtatgcatttcctcctctcttttttctttgaccgctgattgcccttcaaaatggggatgatacttcgtcccaccaccaccacttttgtacgaccacaaaacgccgacaaaaatgtggcacagatgtgcaaaaagtgttgggttggaggaccattggggggggggggagggctaccactaatcggcgacaatcttttccgattttcaccagcagacccaccacaaagtgcgataacggaaaaagtcattcatattcattggttcgccatcatttgctcattttatgatgagatgtctcttttatgatatgacccccatccaaatgcaaattttattgcactaattatatgttaatgccaattttattgccctaataattatatgttaattaactcgttaacttgtctcattcatgttaatgagttaacaacatatgtgtactcattttatttggttttgaccagagtacaaaatatatgcagtttgaatagtctagtattttagcttttgggaattaaaactcgaaatcttgtcgaattatactgtgcgttggaatagggatgaaaatgatatcaatgccatttcaaaaaaaacgggaaaatttggcattgctaggcatgtaaccctaacatttggcaaaggtctgtcatggagactgtaaattcaacaaattggcaaatatatacttggcaccttaaacttagcaaatttttgggtttttatgaaaaaaaattcatttttattccaaacagctgcttgttgaacagcagcagcagcccataaacaccttcattttcccacatttgttctttgaccctctgctgcttctgtgtccccacttttccaccatttttgctcatcataaaaacgccgggggggggggcattggaacgaacacaaaagtcatgtggataaatcatcatcatcaccagcgacagatgcttacctatttgcatttatgagaatggattccaaatttaacatttaaaattggacactgttccgatcagtgatgtaattccgatgccaggaaatttttaaaaattggaattccgaaggcaaatattttttctgaatttggaaatcggaatttaattacatccttggttccgatgacaaaaactccaatagttttcacaacgaaatcttgaaaaattcagcgagcaaaccccgaaatttaatgcaaatttttccttaaaaattttagaaatttccacaaaaatgctattttttctgattgcctcgctattgcctattttttgctccgctgctgctcttccacccaattatttgcctccatccaattcttccgatgccttatgtgtcgtctattttgactaccgtaacccatcaatgcctcggctcaccgtaatgccacaggaaatggcattcaattacacgcagtggaaggagtgcgcgaggaaatgctcagattttacagccgcagggcacgagaaaaggcagtggaatcacacgtgggcactttgttgttttatatcgctaattaattagttaaattgattgccatggagcgagcagcataggccatttatcctatttttaataattaattagagtggtgggacgctgaaaataattgtttttaatacgggttcggaaatggaaagccctttttccagtgcacaaataatttgggggtttcaaggactctttggacaaattcggactgaacataacacaatatttttcccatctaaaggacatccttgtccaacaggacaatccgtg

SEQ ID NO: 838 - DNA, 4183 bp, Heterodera glycines
ggagtgaacataaaaaaatatttttcaaatttaaaggacatccttgtcgaaaaggacaatccagtgaaaatgctctaccataatgccaatttcatactcttgaaaatggaatttaaacccttgccccgcccccacacaatggcatttcattttgatcaggtgccatcctggcaaagaatttgattgcaaaatcactttcaattggggccaactgagcgcggccggtgagtgcccatcactgtacaaccaattggatcaccagcagcaacaggacaaacacaccggtagcagcagcgtcaccaaacatattgagcaggtggactattttcactggatataattgaaatgcctgacaaatcttttggtattgacaatgaatggtaacttactgtaattttgcgagagagtaccgtatcctattaaaaaatctctttaattacccaatatcttgatacgaacaatggttactgtaattttgcggggaatactgtattttctcaaacaatctttaattaccccctacaatggttactactgtaatttgcaagagaaaataccgtatttcatacaacaaattttttgaataaaattttaaaaaaatctataggccaactcggatgtgcatgtcagtgggatgtgtcttctgtttgcggacaatcggacgaccgttggtttcaaagttgtggaaatgaaaccgccggaatggaaactgccacagtttggcacttgtgcccaaaaatgtgtcaaatttgggcccaaccacgactcatggaaaatcacgtgggaaatttaggagctttcaaataaatgggtcaatggcaactcgatacaaaatcaaatcgagaattggaaattcatacaattttttaattaaaaaactaaaataaatttaaaataaattttagaaaaaaatagcaaaataaaatttttgataatttttagattaaattcgtttttaattttttgtacgagatgacaccaaaataattaccctttgcttacaattagttttaactagactaatttgtccataattagtagctctttaaacagttgcaatttgccgtcgggcgatcagtgccaaattcggcgtgacggtcccacttttggcatgcacggcttttgcccggtgatgcgcgcgaatggcacctattattttgcgcagcttttcacggatttgatggctgagaggcgaacctcttccgccgcagcgaacatttcattttccgtttctatggtaaatttttggcgcatttttttcttattggcattatatttttgatcaattacaacgctttttgaacaattttttccagattttctggtccatggccctctttttcggcacaattttgggcggcggacaatggcactttggcatcgtttatccgaccaaatgagaaaaaaagtgttcgcccaaacggcgcgttaataattttctgtctctctctttatatctcagacaattgaaaaaacattttgatgcaactcatattaattatcccattttcacatgtccccctgctgaattttgtacgtctcgtttcacccgcatatttttgagcatttaaaatgtgccattttccgacatattccattcttttttttctctaaattttcgtgccaatttttcatttaattgtatgtatttttcataaatgttgaccagattttatcagaaaatgtcaaaaaattcaaccttcttgctctatctacatattcatacatatgttcttaaatttcaaactcaataatgacgataataataataataataatccaaaaatggattattttctgcaataatatatcaaaaaataataattttttgagacttatagtaaaaaaaatatttttttcaaaagaatttctttaaaaaaaacttcttattcattttattagcttttcaaataaatcgaataaatttatgtacttagaaaactaaaaaatttacagtttctgcagtgttgaacttagtgcacccacataagctggcatctaaaaacccaagtgccaaaatgtgtcgaaatcgtcttacctctcgactcatttgggctttggtctctgcccaatttgcaataaaaatgccatcataaaatttttaatttcacattttgtccataatttgtttgccattccacctccctacccctttccccaatcatttcaaatccctccacaaaatcccatcaaatccctccacaaaatcccattgatacaacaataaccaatcactgcgcaatgaacaatatttttatttttgccgtggattgttcgccgttttttgggcgctcccaaaaaattctgtcgcttgcccatttcccgttgtcagaagagataattgcccaattctcgaccaattcggggaacaatttaatctctcaacaataataatagatccataaatttcaaaatttttgttcaaaaatgggatagaataataaaaaaaaattcttatttatttggttttggattctcaaaatttcattttattaatttggcgattccccaaattttcattgtcactttcatttttgattcccattcccgtccattagctcaatcatttgttgtttttttgggtgctccacgaccttcggggagagaaaagtcgagaatcggggaggaaattcccagaaaaatatgccggggatggctggagaattcgtcgggtagcagcagcaactcctttgttttcggggaagaaattttaataaaagtcgcaaaaaagtcttagaaaattacagccttagtttttttaattaaaatatttcaccaaagaattcaattatcttaaaattaaatcaaatgtctaaaattgcatttttgctcttcatacttttggcagtcaatgaatgtacgtcggcccaacaagttcatcccgaaccaccaaaaagtatggccatgacatggtttttaatgaatgacttttttgggaggctgcgaatggatgaaatctgtgaaaatttttttgattacgatatacagtaatctcgcagcctaattaccctaatttaccaagacccgtcttcccaaccgcttctgccacatgggcgatcccgtcgtgatgaaccagagttgacaactccaacaacaacaacacccgggaaatcgtcgacggaggatgaggaaaaggacgacaaaaacaggtcagcatggggcctggatttgggtgtgcccaaatatttgtcatgaaattcgggtttcggtctctaggtaagtaaaccaagacccttcttggagaagttcttgccgagattgagaaagattctaaaaaagtcacgggatcggttgtcttagcccggtctctcgtttcttaggtcgtggacaatttcgtctcaaggctaggcccaaaatttcctggacaaaagggcaaccatccaatttccgagaaatttacattggtcgacaaaaatggtggtcagcatgtgtccgaattcagtaccaacctcgatagctcagtggtagagctgcccacagattggatggggtgaacgtgtgggttcgactcccacccgatgcctaatattttgcccatttcttttttaattcgaaaatgaaatttttttttgagcagtagcgagctgaaccgcgataaacgtgaagaagatgatgacacaccgatgcatgacggagaggaattggacgaggagggcgacaaatcggacgttggcttggagacgacggccaaaaacgacactgaaacgaccggggaaccatcaacggacggagagggggtaagaaaatgggaaaattttgaattttttggcaattagccaaccacggaacaggctgaggagcaacaacaacaacaacaacaagagacagtgcaggaaaatcttgaaattgctcgaaaaaaacgtgacgaaaaccaaacgggtgagatttaattgattgagcaattaggaaaggaattttcgaaaaattcacagaaaacatggacggaggcgaacaagctgagcaaacacatgtcgaggaattatgtatgatttaacaaaataagacacatgattgtaacataaataaaaaatttcttggattaatagtttaattgatttttaagaaattctatccctggtggcgtgcccttccctcccctagtgctgctcgagacccgaaaatttgccaatccttgaaaccgagactaaaaatccgagactcaaaaccaagccccaaaaaaccc

SEQ ID NO: 839 - DNA, 824 bp, Heterodera glycines
tcctggtattgtccctgggacagcaaatccctcaagtccagcctcatccctaaactatgggcctgaaaatttaaactttgattttccattgattttaaatttagcaggcaatcaaacggcggaagacgggctccgtagccggaacagacgtgccagtgccacgaacaacaaggcaaaaatggcagtgaaaagcaccaaaacggcggctgccggagcgcaacgtggaccgcgcggcttagagacggggccattggaatgaattttggcattcaaaaatgggaattttttttcgtccctaatttaaaaaaaccctaaaatttagggccacaattaacaaaaaattgtcagaattaacgtgatgttggtgtttgttacacatgcatacacatattaaatatatttttttaataaattagaaaaggtacaattttttcaatttaatgaaaattattaaaatttagaaatatttttattttaaaaagtcttgctttaatcagtctcaggatgtaaatttatctgttagcttaacagtcacatttcagggattggtttctggggcctttcagaattacgaacgacaaatcgaccgacaaatttgtcgtttgtctcccaatttgtcgttattacgacaaaaaaatatatcgtttgtcgtccaaatatatcgttttgccatttgtcgtccaatcagaattaccaaattttgcagagtaatttgtcgtttgttctcaattttgatggaagcaaataataaatatgtttgtcaaaacttttgggcaaattttgggggaactaagaaaactgtgcggccaacaaagagtgatcaa

SEQ ID NO: 840 - DNA, 5571 bp, Heterodera glycines
caatcagacaaaataaaataacaaaagaattttgctatcccccccccggtatgcaaagacaaacatattattaaacgacgcccctcttattgtggtgaaaaatgtaaatgtccagagggattcaaattatgtagctttgcatcttacaataaaatcaaaaatgaatccgttgaaaaaattaattaccaaaacattatttcgttcttcaaaccaaatatctgcgcactaaataaaactgaaaactgcccaatcatgaaaagaaaattatttaattcaattgttcttcatgacaattcaattcacatagtgaaaacattaaatttacttttttcccaaattgactcaataaacaattttcgttgttttggggagggcaatctgacgattggtactccaatttactgtcgagaacatgactgttttaaaaataattcattcaaacaaataaatggaacgaaattttgcttttacgatccatacgaaaaaatttaccttgttaaatctgatgaagaattaattcaaatcaaagcatggggaactattgaaaaaatattttacttgccaaataatttaaatcaaccattcattgaaaatagacggaataaaagagaagaaaactcttcaatcactgaagaatcaaccattgagtgtttaaaaggaggcattattattaaagcaataaatgatatacaagaattacaaatttccattgaaaactatacaattataaaaaagaaccctcaaaaagaggaaataatttatttacccccaaaacttacatcctttgaatataaacctgtcattaaatttataagtaacccagataaatcaaatgagaaacaaatcacatgtcaatcatctcccgtatgtgaattaattaactgtcgattttgtatggaatatcttaaaaacccacaatgtgtagaccagattcactgggcattaatgcttgtaattataatgataattttatatgttatttcattaagcctccaaattattcgaatactcacacgttttatccattggattttacaatttatttttaattgttttaaaagaaaacccaaagtaaatcgaattagaatttcaagaccaaagttaaaaagaccattgatttatttaatcacttccagtttaattttattcaaaatgatttttgcttgtgatgaagtgacaaatttagtcgctggaacaaatgactgtgctgtaacccaagaaggaaaaattgaatgttcttatgaccaaacaacccaactctctattacacctgaacacttaacctgcttaaaactcgacaatacaaaaactaacaccactatggaaacactacaaattacaatagaaactttaacaataatttgcaccgaaaaatctgattattttacgagaggttgcgaattatcttcgacatcacaaaaaagatgctcaggcgctgggaaatgtaccggccaaacttgtcaatcagtaaaaatttcagaccggaatcccgaagtgaatgatcacgctaataatcaaccaggttattcatactgtgtaccatcgtgcggaggatggcattgtcaatgtttcctcgcaactgatggatgtctattttacagaacttatgccgaatcagttggtgacgaaattttcgaagttgttaactgtccatcttggaccattcaggcgacaattaaattgtctatcaatccagaattaacctattctgttgacttgaaacccggaattttaacacacattggtgacgagtctaatagttctatatctatcacactgacttcgacttcaattccaccgacgccgttatttggttcgacatttattatagttcgcgaagaattaaaagcagcaatagttgcgaacggaaatttactcaaaaatatattacggtgtaaaaacaaagaagaagcgcaaagttttagttgcacttttccaccagaagcatgtcaatgccacggaggtgattccgttgtacattgtgaatgtgaaaaaagtccacttaccgaaatatttgctaggcaagagaaccttttacccattaaaacacagggaagttacgtatacttcgattcccaaattaaagctaaaatacagcaaacaacttctcttcaaatgcaagtcacacttaaaggacataaggttaaagctatttatgataaaatatttgtaatattgttaccatatcattggaaggatgttattcctgtactagtggtgctaattggactctatcatgcaaaaacatgtccccatgggtaaaactggaaatatttttgaaagctaatctggaatacatacacccaacaaaaaacaaaaatcattacccctaaacaatactaatgaaaaccccccaattggaaatttccttttgaccaaataactgaattattaaattttattttttcccttattaaagccaattttttcaaaaatttattattatcatattccaacccattaaggattttccaaaatccccggcccaccacccaattcaaaaaaaaaattttggtcgctgccctccctttcgcccggggggggggccccgacaccccccaaaattctaaaaaaaaaaacccccaaaaaaaaaaaaaaagaaaaaaaaaaaaaaaaaaaaaaaaaaaaaaaaaaaagggggggaaaaaaaaaaaaaaaaaaaaaaaaaaaaaaaaaaaaaatatttttttttttttttctttttttttttttttttttttttttttttttcccccccggccccccccccccggcaaaaaaaaaaaaaactcttttctcccctggcgttgagggagccccccgcctttttttttttataaaaaccaaagttttttccctacctttccctttttccaaatttggggggggggccccaaaccccaaaggaacccaaaacaaaaaaaaaagcaaaaaagaattacgttttatgcgtcatcgtttgtcaccattcaccgcgcccaatgcaaaaaactaattcctaagtccaatagattgactttttaacaaatatatgatggaatggaaagttgatgagttcaacgtcctgagttcttttaccgaaacataaaaaaatgcaaaaatttaatttgtttagcgatcgaatttattaaaatgccaaaattaaaaaaaaatcaccaaattttcctgctggtgtaaattttctctaagaaaaaaaaaattttcgtgaccgtaaaaatgagtcagtcggaaaatgtgcccccagtgaatcagttaatttattgatgataacgacatacggtatagcatgctttaaaaattttaaaggtgaaatgactgtgggaacaaatttacaaaaatctaattaaaaatatattttttttatttattaaaatttttaaacgttttaaaaggtgagctttttatacggtttgacctttttcactacaatacttttaacgcatacagattaaatttaaaaaatttttactgtcgattttccgggagaataaattttttggcccattatttatttgttcaatgaatgaatgaattgctttctctgtgttttattcctctgctcttttcttctttaagagcttttcttctgtgaagaggtcccctttcatttggccagtattaaatttggccacaattttctgccaaagtgaaatgttttccaatggaattttaatgttttcaattttggcggcttataaatttggagatggtaagctcttttaatagaataattattaagatttctcataaatagggctgaaaattaattgttgtattcaattttcattttaattcattttccgttggggaataatttttgaaaatttaaaatgcgattttagaacttcattattcctttctattgccttttggattaaaaataataatttcaaaaagccaaaataggggggaaaccaccaaacttgggacgcttctattttagggctgaaattccaacaaattctgataaagataatatttaaaataaaattattttttttaaaaaaaaaagcgctctgtctgatgtgcaaagcatgtgagggtgaaatgtgcaactcctaccagatgagtgtcagctgtgaatttcccgttcgtcaatgcatgcgtttgtccgacccatacagtggcagaggtccaatttttcggtggaccccaaaaattcgacggacaattttttggatcatcataactttgttttctgtgttgatcaaattgggggatctgtgacgacgccctcaaaaaatcagaaaccggcattctgacgactaaaaaattttggcaatcggaattccggtggactcaaaaaatttcggaaatcgtaagtccgagcccaaaaattataggaaatcggcattccgacacatcagtgttactatgaatgtttatacctttttatggttctcaaaagaaaaaaaagttatgatccaaaaactcgcttccggcgattttttgtcctctgttccgaaatagaagcttgctccatatgaaaaagcgcatttgtttaagtgtacaagatgggctgtgtgtatccgtatgatgagatgtgccaacaacagcgaatgaatgaacaaatgcggtgggttgattatatcgtcagcaaaacaaagaaaatattcaaatttgattggaattctggggttctaattaaggagatccatgtaatttttaaaaaacaaacccaggatcaggatccctaacaactcgatttaaatcctgaaatcctaccagcgttttgtttcgaattaatataaatagttaagctgttatacatgtgactacgataattgcaatgccatctccaacccatacggtccaggcaattctccatattccaacggaggctacgacccttacaataatgctcaacgatacggtccaaacggacggtacggctattattggaacggcgcaatgaaacaacgacaacaacaaaccgcaaatttattaatggcactaaccgtaacactaatgacacaaattgttctaagcattttttgatttgataattcaattttaaactaagcaattgaatactttgtggaaaaagttgcaaatcaaattaccaaagttccaccgccaataaacacaaaactgtgttttcaaaacatttgtgtatttagaaaacatgagaaacacaaaatgtgtttccaaaacatgagaaaaacatttgtgtatttagacatgagaaacataaaatgggttttcaaacatgagaaaaacatttttttattttgaaaacatgataaaaacaaaatgtgttttcaaaacattgagaaaaacatttgtgtatttagaaacatgagaaacacaaaatatgtttccaaaatatgagaaaaacatttgtgtatttagaaaacatgggaaacacaaaatatgtttccaaaatatgagaaaaacatttgtgtatttaaacatgagaaaaataaaatgggttttcaaaacattgagaaaacatttgtgtatttagaaaacatgagaaacacaaaatatgtttccaaaatatgagaaaaacatttgtgtatttagaaaacatgggaaacacaaaatatttaaaagatatgagaaaaacatttgtgtattaaacatgagaaa

SEQ ID NO: 841 - DNA, 1232 bp, Heterodera glycines
cccagggccttcccctcccctttccctggctctgtcccccttctcctccctttccgtcccctcttcttcttttgctccggctgatgtttatggccgatgaccaaagctctcgccatcctttcccgtctcctttcttcctcttcctcttcttcccctcatcatcgatggaagagaagggccatcctcccacctttgaaaccccccgggaccaccaaattggagctgatttactggggaacaaaggaaaggaaggagaaaagtgaagaaaaaaagaaaagaaacgatggaaagacaaagcggatggaaaagaaaggcaaagaagaaaaagaaggaataagtcattagtgggcttaacaaagtgatcatttgttgataagagaaaagtaatgccatcccaaaaaactcttccggcaaaacagaacaattaacggaaggaaatgggtgccttggaacaattcattaattattctttatttgaccgacaaagggaatgagaagcaagggataagaggagaatgaggagggagatattgtaatgatgacggatggaaaggaaggatgggagggaggggggggacatcatgcaagcacgacaggaaggaagacaaaggaagaattggaaatgagaaacgaacggatggggaagaatggaaacggaaggaaagatggtgaaaaagagaaaaggaagagaaaaaggaagagagaggaaaaagaggagcaagaggaagagaaactgggaagaacaatgaaaaaggaagaattaagagaaaggaataaggagggaaggtctgatgcctttgatcaatttttggggaaacattcttcctgatgatgcccctcttcattcattgagaaaaggttttttgaattggctaagatttcagattagccaaataaatagggctaatccctccctccccctatccctgtccacactctcccccgggtgaatggggaaagggtctctgccagaaggggttgcgaaattggcaaaagatttgtatggagtaagaattggaaaagagggaggaggatgtgccatttggcgggctgtgccgtgcttttcgtgcgactcgaactttttctaagagaattgcctgccctggcaccgaatgccatttaaatgctgctaaatgttctcatccctttcaatttcttttgaagcgaaaagcgaagaatgagtgaatgggcgactgttcttctctttcgagaacaccttttcttcttcttct

SEQ ID NO: 842 - DNA, 1210 bp, Heterodera glycines
atttacttaaatgctttgtcacattcggcacatttgatcttatgtgcctgctgaagttggtgggtttgatgctgagtttggtgatgttgttgaatgatcaagtcggcacaattttcagtcattgaaagagaaacggacaatcgaaaagaaaagagagaaagaggggaaagaagcaattgtcatgcaattaacagggaataatacgcaattaattagttgccgaatagtctaattaagaaaaaatttaaaattttttaaaaggaatttacgattaatgagtaatccaagaataaacattgtgtgggatagaacacaaacactgattaatggtcgagaggagggggggggggggaattgactcggtcattcccgaggggtgcctggctggggctgagatgggggcgggggactgattcagtcatcgcccgaggggtgtttccttggctgtggattatttgagcgaccgattgcataagagattttcctgccgacttcgtccgattatggccaaccagcagatgccatccctcccattccctctcttttccctgggaatcggatttccaagacaatggccccattctttgtgaaggacgaatctcctccaatttcctttggcaaattgggttaatttctgtccatttttgaagtgctcaatccaaaaagtgtgtcttttgttccgaatgaatctctctgatcaatcggtcccttttccattggcttttccttccccaaaatgttttccgttgcatttgtccttattttaacatatttagcaagaaactcccaaattctcttcgctcacctcattcatttctcattcgccgtgactatcaattaatcattcgtgtgccattcgactgtcctccgcggagggtaaattaagaaatgccaatggaagggagacgccccctcccctccctccctcttctattgccaccactattctctcctctccctatctcatccctctctatctcccctccatttctcccccttcccttgcccccctacccttctcgtcaacgttgctttccaattctcattaaatgtgtgccccgtcctccgttggtgccgccaaccttaggcgtatcctccccaagtgcggtgtccagcagcggactctttcatggccagcagtgtttaccaatgcctgtgctgaacatgggcacaacagtatgttgcttacaaatgaccccatttctctgtc

SEQ ID NO: 843 - DNA, 1217 bp, Heterodera glycines
tcccccccccccccccccccgcccccaccgtcgtccttttccttttctctcgcgccattctctcattgttttgccattggaaagtgcgcggagaaacgaagaaaagtgaaatagggaggaagattagaaacataggaagaagcaagaaacattccgagaaaagggagggaataaaattttattttgggggggggggggagttaaaatttgaggtgttttgagattgtgagggacgagcaaaatgttgggactcctttcattgctcattcactggaaaggtcgatgcccttgggacagcttcgcattcgcagtccgtccgagtcaccgcccctttcccctattttcccctccctctttctttcccccccccccttttgcctcttcacctcaccagcagcagaagtaagcgaaggaaaccaataaatcgcggtgtccccttcttcccaccccttcccaatttttctttctttgtttgtgaaaagcggccgactgctggtgggacagccgagaacgaaatggggggggggggaataaaaggacaggagagagagagagggggggggggagacacagccaatgggcacaggtggaactcatcaagcagagaagggcgaagcgaatgggatgaaagaatgaccgagcaagaaatagccatttttctgagaattaattcacaatttccgcaactcttgcggcaatggaaaaaattttgaagaggctctgcggaacggattaacatcggggttacgagatagaaaattgtcctaaaaagagatagccatttttctgagaattaattcacaatttccgcagctcttagggtaatggaaaaaattttgaagaggctctgcggaacggattagcatcggggttacgagatagaaaattgtcctaaaaagagatagccatttttctgagaattaattcacaatttccgcagctcttgcggtaatggaaaaattttgaagagtctctgtggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattt

SEQ ID NO: 844 - DNA, 2050 bp, Heterodera glycines
gtgttctccgtttcccactgaactgccccgactttgctctgcttcatctccgatgatgaatctcgtcccccttccatcccgttttgctcccctttgccccttctcccgtctcaccttcgaatcggagtgcataaaaaggatgattggagggaaagtggggagaggggagagaatgaatggggcagatgaaaataaggaggggcaaaggagggaaagggggatgtcagcatgctgctgactgatcccatccactcattcatccttcagtcaagaatatgccctcaggcgatgaaaggtgatgaaacgaaacgggggaagccctcggcgatgaatggtgcgctggtggaggagaaaccttccgccccttccctccgcccccgccccttcccccactttccctttttgtctttattccaatattcatcccagcaggtccactcgactctttcagctgacacattcaaattttccgaaggcgaccaaattcttttgcatctgttaggggaaatcagcacgaagaatgaatggcgagggagggaggcaaatggggaagagagagggcggagagaaaaaggggaagagagagagagggggaagagatagagggggaagagcaaagatggaaaagagagagggaagagaaaggggaagagaaaggggaagaccggtcgaagggtgccgggaaggcgagatgagatggacagcatcgttcattgtcagctcatcacaagaatgcgaggggggggggaagttatttgcaagtttgggttgagacttgcaaatgggatcagcagatcactgaaaatatgaactattaatatgatcagcacagaatgggagaatgaatggtaaagcgaacatcagcggagggattgacagaaagaggaaaagggaagacaaaaaagagggggaaaagcaaagggaaaagcagggggatgcattgcatggacaatgaatggactcacagatagaaggataagcacatttcaacgagattgaaatgaattggagagggcaattcggtcggcagttttgtggggcgggacaggaaacaccgcgaagatagcacgaaatggaaggaaggaaagacacgcccatttgggggaagaaaagggcaatcaaagcagcagaaaagggcataaagtaagaaaagtgggagggataagcgaacaaaggacagaaaggagcaacactaatgggagaagcggacggaggacaaaaaggccaatcctttggttggacttgctgatttacaggtcccctcttctcgaaggagggcggcactaatccgttcattttgccgcgtccgtccatctcttcgtctccttttgatccatccatcatttacccgccaaaacggattaacggcgagtgccaatgcaaatgtcctcgtccttcgtccatttgtgccgtcgtcttggtcttgactctccaattgttttcccgtcgtcggctcggctcgcgcaaaggatgccatcccgcgggggtatggatggatcatccttattgccctgtgccctctcgacatttgtccctctcgcacaatgaatgcaaatttgtggaatatgcaaataccccgccttctccatcaatgccatgattcgttgtgctgttcattttccccaattgactttctccgttttgcctttggcaatgaatgccgtcttttacattttcagcgattgaacggcggaatttgcttatctgtccaccgcaatctcttctgccctcggcgcccgccatttaacgaggttaacctttgaacagatgtttagaggaaaagtggtcgaagtgatcacaaaaagggcgacaaaaaatgcgagtggcgggggggggggggtaattaaacggccaaatggccgagagttggtcactctgtcgagaatgttggctgtccttgccgtgctggtggtcatgcttgttttgtgtgcttgctcttccgaactcatcaatcggtgaagtgagtggacgggtggacgaaaagaggggccaccctcccccccctcccattcattcatttgtccccacaaccccaacggtggcacatttg

SEQ ID NO: 845 - DNA, 2450 bp, Heterodera glycines
cacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttagggtaatggaaaaaattttgaagaggctctgcggaacggattagcatcggggttacgagatagaaaattgtcctaaaaagagatagccatttttctgtgaattagttcgcagtttgatcacattgcatggatgggacaccggggtaggggggggggctgacctctgctgctaccgagtctaattgactgccgtcatccgttgggtgacctttggcgacatttggtgggtggccttgggcaaaaggtactgtaattttgctgaaattaatttagcaatttatccttttcaaatttctttattttgacatttaattgtcaaaagatttgacgacagatgttggaaagttgaaatacttaagagtgttaggctaaactgaaggaaaaagaagtcgttggaagttggcattcatttgtcggcacttttgaagggaatcccaaagagaagaggcggagggataattgccaaagtcgtaaagttgtcgcgcgtccatatgggaggaaaggcacggagaaggacgcgtttcggtacttttgtaaaagaaagccattcgagcggagattggcgcatttgttgcacaataatcggagaatgtgcacccgaattcagcaaaagcaaacaaaatacagaagaagaagaggaaaaaacggacacaaaagggaggagagaaaagagaaagggcaaaaaagcgttaaaaaataaattaaatgccatttttaaaatcgaactttgagcgaattgtcctaattttgatcaaaatataattttagccaaaaagtgcaaacatttttataaatgatggggtttaacgatgaaactcaccggagaatttgaatgaaaagatggacaacagaagggtaaaaaagaaaagaaagtgagtcaatcctccggggcattcattcgccaaaggtgggcttagccccaatccctccaattattcacttcccccacccccaaaagccccgcaaaaagcaattcaaacggtcgtcgcaatttctcccacccttttttttacctattttgaaattgaacatgaaaaaagtgcaacacatacttgacaacactcaagcaaaaatgaaggcaaaaagttcggcggaagggaccgaaagccgtgccattgcctttgctgggcgtacgaaaagcaataaaaattaaattaaattttgatcggatccaatgttcatgtgatccgatctttccaagtgccgtctgttctcttaaatagtgccgtcctttccctctctcccaatttatatttatttttttgcctttctccgctgtttgtgccgttttcaccgtccgctcattttcacggctgattgtgctgagaagagagtttgccttactcaccaaccgacgaagaagcaaatgcggtgacattcccgggggaatgacaaaggacggacggaggggcggaaacggtcgtaccatcccttccatcccttctccccgtgccccaatccctaccaaatcagaccaaaagtggggagttaatttgtggccattgtcatgtccctaagggacctcaattttggccatattctttggcatgaaatgggaggaattgaagtgggtttagtgatgagtcaaatgcaaattgcgaatttgaggcggacgaaggaattggaaggatgaggaggaggaaaaagaggatgaggaagaaagcccaacacgaattattatgaaagacgtgattttggagggggggggggggaaagagttggcacaaattatggacaaaatgatgaggcacagaaagtgggatacgaattatcacccatctcttcacttgccaaaaggcacccgagaggccattcccttctctcatcaaaggagccgtcgtaatggcctaacaaataaggggggggggataaatgacggacggaagagaagagaaacgccaagaaaaaagcaacataaaacacggtaaatgaaagaaatgtgggaaacaataaattccagttccttcccctccattcttttcttccttttcctcttccaatttcttttccttcctcttccttttttctcttcctttttccttaatatct

SEQ ID NO: 846 - DNA, 1337 bp, Heterodera glycines
cccccccccccatagatccaatttcggttgcgcaattcaatccctttgagcaaatgaattattttattggcactcttcccaattgtcggcttggccatttggccacacatccaattaaatgtgttcgcccgaaagacaaacgaagcaatattctcccaaatataccgcccctttattttcgagagggaacggagcgatgacccaatggaagaagcggcaatttagaagaataaagggggggagagaggaggaatcgtggcggaaaaggatgaggaagaggggggaggggggggggaagggttccttcccgcattcatcggacggaaatcggcgccacaaaagggcatttattcactcattcattcgttggcattggcccaaaaaaagcaaaaaaaaaaggaaaatcggacaaaatgaaacaaaaaattgagagaaatttaaccaaaaaagggaaaacaattgtcaagatttgttcttcaaaaactgaagcatcagcgaatccatctcccacaagtcgaagaattgaattatgtggtgactttccacaaaaatattcgccgtttccttaaaatccaacaattgacaaatgccattctcttccaccaaaatcaatcgcttacaaaaattggcgacaaaagcaatagcaaattgccaaatcgctcggcgtgcccaagtccatttttgaaggtttccgatttagtttcataatatttatgaagagattggcacaaggaagacagttcggaactgatcagagcacggccggcggaggaaacatcgggcaaagctgacaaaaagggaggagggggacagaatgccaaaacaatcccggattaattggataattggcacgtaattagagaaaagcgcactcatttggaaagacacaaatgccttcagcgcaacaaattcatcaaagtccaaacgcatcagaagcattggcgaaacgatgttacacatgagggggacgagcagcggccagtaaatgctgaccaaatgggaatggaatttgacttttttgaatggctggagaagcaaatttgtgatcggatggcattttgggaaggatggaatggcactttgtaatcggatgacattttgggatagaatggcataatgccaggtcgcctctctccacctcattttggtgtcccgcgatatctccggctcgtcctcccatccctcgtcccttttcgtggacacataacccccattgggcaacacgaatttgtccaagtcgcccatttgagtggtcaaaaagcacgggtccaaaatggtgtggtaaggacgcatttgcggagaagagtgatctataattagaaaaacaaatgcaaatt

SEQ ID NO: 847 - DNA, 3312 bp, Heterodera glycines
  misc_feature (3174)..(3175): n is a, c, g, or t
  misc_feature (3180)..(3180): n is a, c, g, or t
  misc_feature (3187)..(3187): n is a, c, g, or t
  misc_feature (3193)..(3194): n is a, c, g, or t
  misc_feature (3196)..(3196): n is a, c, g, or t
  misc_feature (3200)..(3202): n is a, c, g, or t
  misc_feature (3211)..(3211): n is a, c, g, or t
  misc_feature (3213)..(3213): n is a, c, g, or t
  misc_feature (3215)..(3217): n is a, c, g, or t
  misc_feature (3219)..(3220): n is a, c, g, or t
  misc_feature (3225)..(3226): n is a, c, g, or t
  misc_feature (3242)..(3242): n is a, c, g, or t
  misc_feature (3255)..(3255): n is a, c, g, or t
  misc_feature (3261)..(3261): n is a, c, g, or t
  misc_feature (3267)..(3268): n is a, c, g, or t
tccttagctgagagagagacaatgagagagggcagagaatgggagacgaagtaaagcaacggaagagcaaaaagaatgaacctttgtccttttcttctttttctgtcactccctcgccccattccttttcccattcgccaaaaaatcagaccaccgaagaaacagacaaaacaatcgagtgctttaacttttattacattatgaaaattaattgattttttagcaattaaaatccaatttaaaattaattgtgaatttggtgccaaattaaaaagtgaaaatggatgataagagtaaggcattatgtaaaagcaattttgggacgagttcagtgccggcagacaccgcattaattcatttgtctgctctgctgatgatgatccatccgccgtctgtcctcctcaatttgctccgccgaattgcggccgatgttcctccccctcgtcgtcctcctcctccaaatagtcctcgtctccctccgtcatgtcatcccccgtcgtcgtcatcgtcgtcttcagcagtgctcccacttgcgggtcgcctgtcacatcgaccggtctctgtcctcttctgttcctcacgtgcgcatttgcccccgcctcgaccagcaaatgaacacagtccaaccgaccctttgcactggccgcgtggagaggcgaatcgcccaatttattctgattaaagtacagagaatgtgagagaaaagggggcaagggaaggaatgacttgggccaaaagtgtgacattcggcacggacagcaaatgcttcagaatgggcgtgtgcccggcatacgccgcccagtgcaacgcggtggagccggacctgtccaacccattgacggacatctgacaattggggaaaatgactacggaggggggggggggtgaaatgccacgcgtggactgtggtgccacccgtcatgcaacacaaggaaaagcgcactttgttgtccaaacactccctcaaaaagctcaaatctccggccctcgccgcctcgtgtaatggaaattcgatgagttccatgtgttgttcaactgacaaatgtttttgccgattcgtcccactttctcgggtgccatgacaattcgaacaaaggcaactcaaatatgggcttagtctcaagcttcttgggcctacgataggatcaggctttatttcgtaaatttattattgtacgaattgccattgactcatttctcgtgattttcaccgaattgctttggcagaattccttcggtgtgccccgtggaacttttcgcttcgcaacttttcgtcccctccggcgcttccttcacatagacaatgtcctccccgtacaattttaactcaccagcctaaataaagccaaacaattccattccgaacatcgcaacaaatttattgccttcgtcggcacgaattgcttaagcgagcggaacatccgaatacgccccggtttggccatcggcgggggcggcggcccatccatcggcgtaagaaaggcccaaaacgaagcgaaagttttggagaaataaatcaaaatatgccaagggttgtatcagcgaacggaagaagacattaacaaacagagaggaattatttgttggaattttattgtttaatttaaaatggtgaaaaaaggcaaaaacaatgagtgaaaggacagagaacaattgggaaggatcacaaaaatgcgttaagccaatcaaaagtgacaaatggcatgccaaaatacaaatgcacaaaaacatggaatgcaattaagggaaagaaggaccctcgccctttgtcgtccgcttcatttccctcccttttcgtcctcattttctgtccaccactcgcaattcgctcactttcctcaaatccctttcaatcgccgttctgtcacccgaattaatattgtcactgttttgaggcaacattgtcccggcattttctgacaacttttttcgcgttaaaattggagtaaatgcgaattgaagaggcggcaaacggtcgtcgaaggacaaaagttggtttagcgaattggcggaggaggacaaatcgagaagagaagcctaaatgggggaggaattggagaaattgtcaatttgcggataaattgtgcctgaatttcctccaattggctggaaaaagtgccgacccttctcaattcgttgttcagtgcgtccaatctttttgtggccgtcgaagtctttttgaacagcgacgaaattaattggtcaatctgacaaaagtaataaaaggcaattaattgtacagaataacgacccataaaagaaaacaagggggggggggattatttgtcataatcatgagacttatgatggaagtcagaacggggagatgtaaacttttgtatattaaattgatgtttaaagaaattagtacattcattacaccagaaaatggatatttcgggaaaacaggatttcttgacttgtcatttccacatcatcccccccccccgctgacttcgacaattcgggcgaacattcggccctgctcagtcgccaccgtttgagcacagcttttaaaatgttgctgaaggcgatgcataaaactaagaatgcttttgctgtcgattttctgctgcacttcggggatgtctctgtgaccgggcaaaactccgcggagtaaaggcaaaaaacgaggaatttcctaaaaaggcgttaaagataaccacacgacggaaaatccgtgcctttatcctccgaaggtccacgtctttgccagggacagcggacgacgaacagctggccccctcgatgaccacgacaatgctgcccatcaccgcactttttgccgaatttcctagacatcatttattattagcgaaaaaataaaaaaatatataaatactttgcaaaaatgcaaataaatatgagaaaaacattttaaatttaatacctaattaacatacgtttcttagcgagaaaagaaaatgaggcgggaattccagtggaagtgctcggagatgtttgaccgccatcgtcgtcccccttttctttgtttgtgccgttgccaccaaagcgaccgccgctgtgttcgttgcccattttccgttgctggtgggtcaacaaaaaataaatatcacgaaacatttttcgagcttaagcttaagaattctaatatattaaattccttggcattatgtctgtcgccaaaacaaaaacaaaaaactaattagttgnngcttnagcttgnagcttnngnttgnnnctgttgccntngnnngnnccctnnttttgctatcagatgnttttccttggccncgtttncctcgnnttgtttgttattggataaaatttaaaattaaggcacttaaatat

SEQ ID NO: 848 - DNA, 2288 bp, Heterodera glycines
ttttccgttggttggggggtcaacaaaaaattaaatttcccgaaacatttttcgagcttaacctaagaatttttaatttataaatttcttgggcattatgtctgtcggcaaaacaaaaacaaaaaactaaataggtgaagcttaagcttgaagcttaagattgaaactgttgccatagaaagaaccctaattttgcaatctgctgattttccatggccacattatcctcgaattgtttgtttttatctaaaatttaaaattaaggcacttaaatatgtcagaggcaagcagcagcaacgccccccataatgccaatgccaacaacagcagcaatgccaccaacggcggaagcagagatcggatgaaccaatcgcaaatttggaagtgcttcgagaaaatgcccgactatgaggcggcaaagtgtcgcttgtgcacttcgatgctttcctttaaaagggcgtcgacgaaaggactttgggaccatttgaagtgcaaacaccggtcggaatacgacatgctgaagcaaaactttgaattgctcactccgtcgaattcggacgcatttaaagcgccaaaaataaaggttaattcgattgttggccattttagcatgaagtgattttctataaattacagaaaagaaaaatggagccgaaaagcgatgtctgtgcggacagcgacaattcgttggtctcgggaatgggcacgcctcagacggaagtgatccgagtgggcggactcgcgaacgaaggccgaacggaggcgcaactgaacggcgccggagggggcggcggcgcaggttcgaacagagaggagagagtccgttttgttggccaccctagccatggccacaagcatttacaaagggttgaaaatgcacaaaatcattcaagcttagcctccatgtctgtaatccccgatggggtgtgatattctgctgaataattgccatttccaaaatgtttgtccgaattcgtcctcccattttcagatcgattggccgccggttccctggacgcccaaccgtcgccggtcgtaatggtcaaccatattctcgtctggagttccatctgcagtcagtcgccccctcagaagaccttcatcatgtgcaatttcctcgactctgatcaccaccacttcggcctcaaacccggcacttccgcttcgctcacttttgtgctccaaaaactgtccgcgaagaccgagccgtccggctgtatttccaccccttactccgttaacgttgtgctggacgaactgtccgcgttgggctaccgagcgattggaatggtcaacaaaagggcggacgaagtgctgtggacacttgcaaaatgagcggagggggggggggcaacaaaagtcatttcgagagagatttgcaacaactctaaataattatattatcaatcgcttgtcgggggaccggcttaattttgcaaattaataaaaaggttataaacttttacttttttgcctctgacgcgcccatttgctcttgtgtaaaaatgtttatttgaaataggtacatatattgtacatattctctgaattgcccagcagttccaatcattttatcgcttttatcaaaaaatcgctttctcgaatcccaattaaattaattaattaataattgtcctccaataaattattattttttgaatgtgtgcgtgaaaaaacaattagttaaaattgaactgataaatacaggcaaaaagccgtctcttccgttattcttcgtcccctttgaccgggggacatgaacagaatgggtttcggtcgccaaatgagtcgtcgattcggccgacagttggccaaacttttcgtgacgtgtggcaccatggttttggccatcccgcctgctcacgcgaataggggcggtcccaaacggaggcggccaacacggacagagtgtgcggcgcattctttgggattggcatcgattcactttgttttgagggcactccgccgacagtgccgcgagtgatcgccgcttactttgaacagatcgatgtgcaattcgcccctggcaatgtcctcaatttcctctcttatggctatcagtgcttcacagtatctgtccatctccgctttgtcttcactttctgtcggttcgagcatcagacaatcgtgcaacggcctaaagcatcaatcaaaggcaaagacaccgatcggttgcctaatgaggcccttgtcacactaatggcattaaaattacaaaatgcttctcaccagtgcattgttggcgagtgaaagctgaaattggatttgatttttaccgtttccttttt

SEQ ID NO: 849 - DNA, 1907 bp, Heterodera glycines
ttcagtttcattgtcccgaaccgagcggaatttgtggcaaaatggggagggattggccaaatgttcgtttctgccatttgacaaaccatcgaatggaccaaagacaagtctttgttctcgagtcgcttcatgtacctattggacaattgaatagaaacagcgatcgccttggctgacctgatcagttgcgtttcgctgtggtgactgttaaagacggaatgagtcagaaagggcgaacgacgcgcgtgggacgaattgccaatcagaggagaggcaatttcgttgagggagtggtcaatctcatcctgaggtttgaaaaagcaatattaacacattcccaaaaaatcgaagacattccatctttttttttttgctcctttgccttggtgacgtgaatgtcaaacaaatagagcaagtcgcgcaggtcgtccactaaaagggcaaaacattggccatgccatgccaaagtgatcggcggaatcgctctgtttctctgctgattttcactcacccaaagtcgtctcatcgatcgaaatgccgacgaatccgtcctcaaaatagcgcaccttaattcaaaatcagtttaaatcagaggagcatgagtggatcacattgatctgttgctcctcacaacgcttacgaaagtcgtccatttcctttggctttgctttgattgtgtcgaaaaattctttgtgctcaacttcgattccattcgcttttaattctgaaaccattggaaatgtaattttcttttcaaaatgattgctcactttgtgccaaataagcggccgatttatggacgatttttgcgatttggacgagccgacggggaccgtggtaaacggcgtacctaaaacatcagaaaatggcgaagtgatcagaaaatggtgaaaggcaaaacaacggcacatggcagcgatgtttgccggaagcacttgcgcagtgcaaatgttagaagtcgcccggtcgcgccgaatgtgctgttcccgcgtctgaaggctcacccggtaagcgggctttccctgctgatcccttgaaaggatttacttggaaaatgaacgaacagcggacgatcagtgcaattcacttttgccctaattgcctgccaatcctcactaatgataatgaatgaattaattgcctaaatgcgaatgaactgttgcaccattttcatcaaatcacctcgacactccgacaattcgtcccggcatttgccgtgccaatgccaaatccttgacgcaaataaaccccgcgtggggtccgccgtagcccaacggaagtccgaagcgctgagaagtgccgacggcaatgtcggcgccgaggtcacccggcgaccggataagcgtaagggacaaaagatcacagacgagaatgacgagaatctgaaaaataggaaaaatagagtgaaaaaaatcagagaaaaaagggaaacagagacaaaagataataaagaactgagagacaaaagaccagagaaagagaggaaagtgagagaataagctttgtgacattgtgccgatgggctgcgcgaatcagtcgctccaaatggtcgtacagtttcccctccgtgtttgggtactgtatgattattgcggcggcctcggcagacaaatcgccaactgccaaagttgacacattgtcaattggtcttaattctgctccgattggttcacaacgagtactcatcacggcaagattttgagggtggagcagcggatcgaagagaatggctttttaagtgcgggggaaggggtaattagtggaaattaattgactaattagcttatgctatttgcaaattgaattaagaagtgtattatttttatgccttttagcaaatttatctattataatatgaattgctctgtcttcaagcattacttttccttttggtcgcccggatggcc

SEQ ID NO: 850 - DNA, 2311 bp, Heterodera glycines
cttcatgatgggccccagcgcccttggccattgacttcacgatgggcccagcgcccttggcctttgacttcatgatgggccccagcgcccttggcctttgacttcatgatgggccccagcgcccttggcctttgacttcatgatgggccccagcgcccttggcttttgacttcatgatgggccccagcgcccttggcctttgacttcatgatgggccccagcgcccttggccattgacttcatgatgggccccagcgcccttggcctttgacttcatgatgggccccagcgcccttggcctttgacttcatgatgggccccagcgcccttggcctttgacttcatgatgggccccagcgcccttggcctttgacttcatgatgggccccagcgcccttggccattgacttcatgatgggccccagcgcccttggcctttgacttcatgatgggccccagcgcccttggcctttgacttcatgatgggccccagcgcccttggcctttgacttcatgatgggccccagcgcccttggcctttgacttcatgatgggccccagcgcccttggcctttgacttcatgatgggccccagcgcccttggccattgacttcacgatgggcccagcgcccatggccattgacttcatgatgggccccagcgcccttggcctttgacttcatgatgggccccagcgcccttggccattgacttcacgatgggacccagcgcccttggcctttgacaattcgcctcctcaatttgcgcttcttcgagtgtgagataggctcactgcctaagggctcggcacactgccgcccttctgagtgcgagataggctcgctgccttggcgcatgatcatccatttctgaggggcgcgtaaaacgaggcgtgaaggcgaggcgcggaaggcgaggcgcctcgggtcacaaaagacccaaggggccgtatggcgcgcaatggaatgcaccctgggttacagacaacccagggggccaacgcgcgaaatggaaagcgccccgggttacaaaaaacccgggggggggcactacggcgcaaaaatacaaaacaaaatacaatgcgcaaatgcaaggcgccacgggttacgaaaaacccgtggggcctacttactccccccttcccttgctaacagaccccactagtccctgcccaggtcgccacatgaagcggatcgcttcgggacgctttgcgtccattggttcgggggtgggtgaaagcggagggagagggagaggggctgcccagactacccaagaaacccccaaaatggacgggtttttagtctttatttgtcgcaagccatcgaaatgtacaatttgtgttgcttatataggatcagaaaatgggcgggtacaataaaaatgatggggtgatcatttgggttgattggtcgttcttcttcttcgtcgtcgttgatcgctcgatcggctttttctgcccttaggcaccattcacatgcgcggcgggggctggtccgctttttcacttcttctttcttcccattcacatgcaaaagcccctcttgcggtcccccttttttctcattcttcgcccaatttcccgttctcctgttttttcctccttctccccccgcatttctttccattcgacaactgtccgatcatcggacagtcgcggctaaattcgagccgcgacaagggagtgggaaacatgatttcaaaattttcaattttttctagtctaatctactcaaaccggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaccggctcagaattcaataaaaataacattcacggtgcgaaaaatggggtttgaaaagtttattggggaaaaaaagactttacaaaataatacccctgcgagaagggagtgggaaacatgatttcaaaattttcaattttttctagtctaatctactcaaaacggttcagaattcaataaaattaacattcacggtgggaaaaatggggtttgacaaagttattggggaaaaaagactttacaaaaaaaacccctgggaaaagggaggggaaaaaagaattcaaaattttcaattttttctagcttaatcaaccaaaaccggttcaaaattcaataaaaaaaacttcccggggcaaaaatggggttgaaaaatttattggggaaaaaaaaatttaaaaaaaaaaacccctggga

SEQ ID NO: 851 - DNA, 3006 bp, Heterodera glycines
  misc_feature (144)..(144): n is a, c, g, or t
cagactcagtttgcgcctgcaattgatttgcgttcctcaatttcgcctcaatttgcgcgctgtctttttgttcctgctcagacagtttgctcttccctttcgcctcggtttgagcttcctcaatttgcgcttcctctgacaatnttccattccgcctcggtctgcgcttcctcaatttgcgcttcctctgacaattttccattccgcctcggtctgcgcttcctcaatttgcgcttcctctgacaattttccattccgcctcggtctgcgcttcctcaatttgcgcttcctctgacaatttccgcttcccttccgcctcattcgcacttcctcaatttgcgcttctccaatttgcgcttctcaatttgcgctgcttcaatttgtgcatctccaattgcgcttcaacaatttgcgctgctccaatgcgcttctccaatgcgctttctccaatttgcgcttcaacatgcgctgctccaatgcgcttcaacaatttgcgcagattaggctcactgccctctttgtgagctcggcacaatgccgccaatgagtgcgagataggctcgctgcctaagcgcatgaccattctttcctgaggggctgtggtgcggaaggcgaggcgccacgggccaaaaagagacccgaggggccgtatggcgcggaatggagcggaatggaggcgccccgggttacaaaaaacccgggaggccaaacggtgcggaatgcaaggcgcggaaaggcgaggcgctacgggtcacaaaagacccgaggggccctatggcgcggaatgcaggcgccttgggttacaaaaaacccaaggggccagaaacgcggaacgcaaaatggaatagcgctaatgccagacgccacaggttacgaaaaacctgtggggccggcatgctccccctacccctgctcacaaaccccaaaaccccaccaaaatccctgccagggtcgccacatgaagcggatcgcttcgggacgctttgcgtccattggttcgggggtgggtgaaagcggagggagagggagaggggctgcccagactacccaagaaacccccaaaatggacgggtttttagtctttatttgtcgcaagccatcgaaatgtacaatttgtgttgcttatataggatcagaaaatgggcgggtacaataaaaatgatggggtgatcatttgggttgattggtcgttcttcttcttcgtcgtcgttgatcgctcgatcggctttttctgcccttaggcaccattcacatgcgcggcgggggctggtccgctttttcacttcttctttcttcccattcacatgcaaaagcccctcttgcggtcccccttttttctcattcttcgcccaatttcccgttctcctgttttttcctccttctccccccgcatttctttccattcgacaactgtccgatcatcggacagtcgcggctaaattcgagccgcgacattcccacgcttgaccaacgtgtgcgatgaggtcctttttcacttcattgtgtctttttctggctcttctgctttgctggtgggcacttccgcccttggcctttgacttcatgatgggccccagcgcacttggcctttgacttcatgatgggccccagcgcccttggcctttgacttcatgatgggccccagcgcccttggcctttgacttcatgatgggccccagcgcccttggacattgacttcacgatgggccccagcgcccatggccattgacttcatgatgggccccagcgcccttggccattgacttcacgatgggcccagcgcccatggccattgacttcatgatgggccccagcgcccttggcctttgacttcatgatgggccccagcgcccttggccattgacttcatgatgggccccagcgcccttggccattgacttcatgatgggccccagcgcccttggccattgacttcacgatgggcccagcgcccatggccattgacttcatgatgggccccagcgcccttggcctttgacttcacgatgggcccagcgcccatggccattgacttcatgatgggccccagcgtccttggcctttgacttcatgatgggccccagcgcccttggcctttgacttcatgatgggccccagcgcccttggccattgacttcacgatgggccccagcgcccatggcctttgacttcacaatgggccccagcgcccttggccattgacttcacgatgggcccagcgcccatggccattgacttcacaatgggccccagcgcccttggcctttgacttcatgaagggccccagcgcacttggcctttgacttcatgatgggccctagcgcccttggccattgacttcacgatgggctccagcgcccttggcctttgactttatgatgggccccagcgcccatggcctttgacttcacaatgggccccagcgcccttggcctttgacttccagatggcctcagccaggcttgtagtgtagaacacaaagttttcacccggtgggactcgaacccacgacctcctcaaagcatgaagtgctctgtccaactgagctacgggcgccacttagtggttctccagtattgcgcctgtggtcgtctcagtttgcgccatcgttctgtttgcgcttgtgttcaatctcagtctgcgccctcgctcagactcagtttgcgcctgcaattgatttgcgttactcaatttcgcctcaatttgcgcgctgtctttttgttcctgctcagacagtttgctcttccctttcgcctcggtttgagcttcctcaatttgcgcttcctctgacaattttccattccgcctcggtctgcgcttcctcaatttgcgcttcttcaatttgtgcatctccaattgcgcttcaacaatttgcgctgctccaatgcgcttttccaatgcgctttctccaattttgcgcagattaggctcactgccctctttgtgagctcggcacaatgccgccaatgagtgcgagataggctcgctgcctaagcgcatgaccat

SEQ ID NO: 852 - DNA, 3204 bp, Heterodera glycines
  misc_feature (3025)..(3025): n is a, c, g, or t
  misc_feature (3043)..(3043): n is a, c, g, or t
  misc_feature (3105)..(3105): n is a, c, g, or t
atagaatatactatttagtaagaaattaagaaaaataatgattaaatgaaggaattactcaaaaatgtgtaaaaattacacatggggtgtgtgtgtgtgcatgtgtatatgtgtaagtgtgcgtgtgtgtgtgtgtgtatgtgtatgtatgcatgtgcgtgtgtatgcgtgtctatgcgtgttcgtatgtgtgtgtattgtatgttttttcgagggtgaagttgacattaattaggagtgacaggcggtgtcggtcacgggccacttactactattgacttagccatctggccttttcttcagtgagaagaaggcaggggtatttgatggaatttaatgaggaagttagaacattttaagtggaagggaaaagaaacaagcaattagttggaagacttagattaactttgtttaacagtaattaacaagcaattaataatttgaattgcggaaataatttacatttctttgattgagatggttttagaaactgttttatgacaggctgaggttttttaaaaattaagtaattaattatgacaaattaccaataatggtgagtagcggtgtagtgggctaattgtctcattgaccaactgtcatttttaattatcttccttgaaacggtctggtgtaagtttaactaactatcagttcctaacatccaattattaaatttgggaaatttatgaattaattattttttattgggatgattttacataggaagtttatcgtttgggtgagactcttcaaacttatgtgattaattatgacaaattaccaagaatggtttctagtatatgcttgtgaataatgagtcctcgacaaccataaggtctaattagtgtcagtttgtaacgacatgatatatgattcacaactaatcactatctatataccattgtttttagatgagaaggtgtagtaattgatgaatttaatgatgaagcattgaacatattatgagtgggaagtatgaaaaaatcaaagaattttaattattagtgacagttgttaaatcaatttttgggtaatttaattaagaaccaattaatcaactaatcactatctatatgccattgtttttagatgagaaggtgtagtaattgatgaatttaatgatgaagcattgaacatattataagtgggaagtatgaaaaaatcaaagaattttaattattagttacagttgttaaatcaatttttgggtaatttaattaagaaccaattaatcattaaaatgcgggaaaattattaacaaagttttgatcgagatgttttacatatgtgttttggtatggtcgaatcccatgctaaaatactccaattgctaatagggtatgacatctgcattaattataattataaccaattattctttaatttttacaaactgaatatttctggggaaagaagggttatgatggaacttaaattatatgccacatttttgttgtaattcaatgaagcagaaagcttgaagctgagacaaaggaaatgatgaacactaaatgagtatgataattgttgacagattaacttagttatggtattgatggttaggaaatatggcaattaattctaaaatatctgaaaaagaatgcaactttttgggtagcgataaaccttttttaagtaagtaactaattattacagccgcaaggattttagaaatgtataaaaacaaggaaaataataaaagatgaattttcggtagccaatactcggctctccggtagtcagtacctaattaagctcggccctccggtcaccaatacctcacaaggctcggatttccggtagccaatacctaattaaacttggcccgccagtaaccaatacctcgtaaggttcggcactccggtagccaatacctaattaagcttggcccgccagtaaccaatacctcacaaggctcggctctccggtagccaataactgagtttgcgatggtaaggagcaataatgaccgaatatgtgttggagaggaagggcagagttgaggaaaccaaataagtgaaggagagggggtgaggtcactgcgtcatcttatcctgtaaatcgattcctctaaaaggaacaaatggaaagaggctaacgccaactgttttcttaacaaaatcctatatttagatattttggtttcgggtttattttaattattttccttttctccgtaatacactttctctactcttctatatctgtttactttcactgttattccttattaatttcagacctacatattgtctaaataatcgtttccattagctatttttcaatatcttttcttccaacactatgttttattctcgaaccgttatcttccaagtgttcgtattcttgttctttatcaaactattctcttccctatacattacctaatgtttgccttactaactcatattaaattctcactatttaatattgactctcttcaaccacatttctgagttctctatctctatctcttacacccattattaattgtccttgattctatggtgcagtacaatatcctcatatgatttcttcatttattcctattacaagacctgcttcacgcatacatttagcccttatctaccctttctcgtcacatacagtcagttagctgtttgtcaaacctactttctattctcggttcaatcttagattcaaaattgtctatttctcttgtttcctttgaatattacttattcaatggaattgtaaatgttccttattataattagaattattttacgttgaattaggcaaggagcattgtttgtgtttatgattaaaattaacaagttttatataagttaataaatattatgcagaactttcaaacacactttatcctcaccctcgaaaaaacatacaatacacacacatacgcacacgcatagacacgtacacacgcgcacatgcatacatacgcatacacacgcacatgcatacatacgcatacacacacaccccatgtgtgtaatttttacacatttttgagtaattcctttcatttatcattatntttcttaatttttgttanattgtatcttctattccttaataattacaaattgtgttacaaaaccctgactatttttctcngtaaatacctttttaatttatacctttttatattagtaatgacacattttttccattttatttctgaataaacattcaaatgaaaaatacaagtgtaaa

SEQ ID NO: 853 - DNA, 1842 bp, Heterodera glycines
atgcaactcttttgatagatttgaagacatatcagaattcttagagttccctttgaaaaaagtgaaaaaacacacccagggaacggcttcacccttcggtccccaatctaaacactcacgcaccaggctgtgcattacaataatgaacagctcgtccaccttcatctcagatggatggcctggagtgttggagaggatcaaccaggggtcattccgtcccacatgagtgatataaacagagagaaagaaaagaagggaaccataagaaaactaatatttagaaaatttaattgagaatgcatacttatcatttgcgataaccaaattcgaggacttggaatgaatcattaataataccttttgtgaagacaggttgataatgcttagttagagattgagtgtacactttgccttggattagattagggcgaataaaatggggatatgttacaataatggggtccgcggggtcatcggaaccataacgcataatttgatctttcacactgtcataatggatcgtttgcacagtttgttcatccagtgttatccctcttattttcaagtcgtactcaatttccccattgtccttacgttccaacttcagcccgtagtttttgcagccagcgctgatgaactccaaaatgtcgtggtccggcttttcgtcagtcagctcaccgagatgtccttttcctgtcgggagtgggtcgttgtcctcagggtgaacgtagatgatgctgtccgtgtcaaagtagagaatttcacatccgggagtgtcggccactttttttaacacttcgtaaaggtatagacgcgccattgatgttgtgtagagtgagatgacgacattggagtatttgttttcgtcgacaaactcctctttcggcttgtaggtgagcatgaatacgtcgttgtcctcatccatcagctcaatgtccataatatcaattttcttgtcgtcggtgtattggcggagaacacaagggtcattgttgattaccgccttcgaaagtagattcctcatggagaagcggccccaaagtgagttgaggcagagcttggcgatgtaccgcttccccggttcagctttcatcttctccttctccagatgaattccaaatttcatccagcactcctcaatgtattcactcttctcctcttcgctctcacaccatgacgggaagccggttgcgtggatcttcagggccatcatttcactcacgtaagacttgaagacattgttactccattggtcgtattggaggacgtggaagactttgcggactgtgtagccggcctccaatgctgcgtttaactcaagatgggtgcaagtggacacgaaggcccggtcgttagggttaaagtggggacaggaatagtcgttgtctttgaggccattgggatattttgctgtgatgtatttggcgcacttctcacagagagggaagaggaggcgttgatcaaattttatgggcataacagtgacgttaatgttgttgtttggaggtagaagtagcactttgagcagacctttgtaggggttgtcggatggagagcgccagttgaccgtctgctcatttggtgggatactgatgattttagggtggccgaggggatagtcggtcgtaaagttggtaaacgggtagaggctggtgaagtccttgtagctgattttttgtcccggcttagctgtgtggagtagcttcattggtcctgtccgtcctccgtgaaacgcgtctctgatttttattggcgaatggtccttccagttgtcaaaaaactccctcattgctgtgtcctttttcagcttctcatttatttcgtgttcccaaataacctcca

SEQ ID NO: 854 - DNA, 3565 bp, Heterodera glycines
cttctcttccctttccctaatctcccgcagcgtctttccgttcggcatcctcgtttcgtcgtccaagtcatcaaaacactcctcacaaccgtgccacagacaaccatttacctcaataattttatccctcttcccattagtcacttttatataaccatccacttgatacacctgaccctcccgtttaaagacatattcaccatagcgggagtatgctgtttgaatgttgacgttgttaatatgtgagtaccaatcgagatatttgatggccagtgcactttgattctgttgtggtgtatagcctttctccgggacgatggcgagcgagttgggcttcaaatgattgagtgcaaagttcttgacgcaggcgctggcgatggtcatggcttgccaaagaatgtcgattcccccgtgttttccgttccgttgtgtcagttgtttgaattcccggcgtaattcgacgagggcgtgggtgagtatttgtacgtcattacaacaatattcaggaagtttttccttaaggttaaaaggttggttgtaattattattgtaccatttgtcaaatttctgcaggttcgccttcttcttttggttagggcaatagtcttcacgtggaggaaggtgctggaggaccttatcgtagtttgatgatttgttgaacatatggggaaagtgctgtttatcttttatatgaagcccaaagatttgatgaggccagatagtttgatgggcattaggttgtaattgtcgtgaaaaatggtgagtgggccgtgctcgttttccctgattttcagctcgtagaggcgatttccttgtttgatgatgtccgggttgtgaattccttgcgctaaaacctccttgatgatcatcgtcatgtcgtagcggcccccaaagtgtgcaaaggcgactgttggaaactttttgttgtggtcaaaaaggagccattcaacgaattcgcgtagcggttgttgagtgatgattttttggtcgactgttgtctccgtgtagtcaaagggtgaaaaggtgattgagcggtgagggccgcaaatttggcacttttttccctgaagtgatttgttccagtagccgttgataatgcagtcggtacagatgatggtagccgctgcaaagttaacttcatgctcgaaccggttctccaccttcttgtcctgtgtcgcctcaaagtcgtatgcgatgatactgtatgacttaattcgttgttgctttaggggctggatgaaacatttcgtacaggggttcatcccgtcgtcgtcgtcttcttttatatgaaattgcttgcaaagtttacaaaactgttccccacatttatgcccaacactcccatgaacctttatgttataaattaccccacaatcttcacagcgttgaaatttggtacacaaatccttgtggaggtgtcgcccatagcagttattgttgtagaaggtgttgttacagtgctcacagtttttgacgtatccttgctggggatcgcagggatagtcaacgcccacctcacggcacctgtgacagagtgaagagcattttgaagagtgttcaaatttgtggctgtaggcagattcacaggagatgcaatagtaacgtttgttgaaaaattttgaaagagttttgatgccgtcaaagtggttgttgttgtggtagagaagaatggggaattggtaatcggtgatatcggatttggtgattgggcgcatctggtaatcattaaaaataaatattttgtactcaccgggatacttgacgttccacaacccttgcacttgatgtatataaacttccgcgtcgtactctgtctctgttgtagggatccccgcatcgcggagcagttgctgcgccttttgtcgtaaaaccgtggtttggttgttgttaatccatcgccatcgcttttctgttataattccgcgtttgtacagtgaatagtagcgcatcagttccagcgcgtaaaaaagacagtagttgtcgttgttgttgactttgaaaatgtgcgattgtgaggagacaggcggtcgcccttttccctttgttgtccgttgtcgcggtagtccattggtgtttaggacagtgacggtaattataaagggagcaccatataagttgacgtgtttcgatttgctctgctccactttacaaaactggttgaaaacggcgtccacgacatttgcggtaattggtgtaattggtaggatgatgtcaccctggtctaaaagttccgatgaaattataacccccaccttatttgcagcgccaagtgtgttttgtccatctaaaattgcttcctcaatcgaatggtgcacacatgaacggagctcagcagcggggtcagcacatttgtcaatttcctcaatgacgaacttggattttgagcgcaccagttgatattttttactttttgaagtgaggttatcaattttacgaatgcatttatttggttgggattttttggggaaggaggaggaagaattttgagagagggaaaaacgtttcattttatttgaataataatatatgaatgaaaaatttatgatttataggtgatataagataatatgaaagaatattttgaattagaaaaatgtaaattttatagttgtaatagaaaattattgaaaatattttttttttataagttgaatattggatgaaagggtaatttagttgcaaatttgttagtttaaatattttttgacggagcgcgcaagcaatgaatgtgggtagaattttcgcgaatgaatgggagaagttgacttttgctggtaatagccggctatttatactagttaaagtgggcggggctaaaactaaaatggtcatttggcaggttgccaaagagacatatttaacccttcgctttcgcgacagatggtgcgaacgaaatggtcatttggggagagatgtcataagggacggcctctacccctccattaggatggagtattggtgacagtaaagggacatttaaatgaccacctgcgggcgcatagatgacacgtgcgagcgctcaaatggccctgcgtgctctcaaatgacccggcgtcgcttccctcccgaagctgacgcccacccctccccttttaaacatcagcgaagccctataaaaacattccaataggcatccgccaaaactaaaccaatttctcaaattcaaaaataacgaaaaattaaagttttggcgccaaattcaaaattttgaccccggattgactagtcaaggactgaaacggtaggactcaataggtagcgccctctcagctttttttttatttgactattataatttgtgtttattattattattattatttttataatttatcaatttctaaaatttttttcatttatttttaaatttttatctattattttaaatttatttattaatttttaactattattattttaacaatttaattttaattaaatttaattttttaatttatttattattattattatttatatttttatgtggtattagagagagcaagagaaaagagagagagagtgagagagaatgagagagaaagaaaaaagagagagagtgaga

SEQ ID NO: 855 - DNA, 1942 bp, Heterodera glycines
ggccagaatttaagatgaatgcttttatcatttaaattttttttaaaagaaataataattgtgattcatttaggggtatataaaattaaaaaatattaaaacatttacggatggttaattgtcaataatgtcaatccatgaaaattgatattaaaaaaaaattatatcgtttaaaacgccaaaaaaacaaaaattatttaatttatcaattttgacaacattagcactgttaatcattttttctttcaggtgtacagtatctttataaaagataccagagattatacgtttatttggttcagataacaaaaaaatagtacaaaaaaaagaaaaagaaccacttatcttaaaactatctagtagttcagataagaaaaaagcagggaaaataactatttttattagttttttttatcatttcttataatcggattttgcttcactatttgtttctgctttatgcgaaccagccaagtcaccattggtgctcgactgaccagcaatgtttgttttactgcagttataacggtgcattaccggttcgtacctaaaagtaaaattaaatatgttaaaaattatttacttaaaataacaatttctatttttcctaccaatttgaatggtgtaaatccagtgtagtcctgatttgcagggctacagtcctaccttttttaatactcgatgaaattttttgaaattttaaccataaataaagaattcttaatactatcgaataataatttcattttgacttaattgcacaattaaattaaattttctttttagaattaaagtgctttattaaaatttttaaaaattctaattagatgactctagttatatttaaattcatcccataaatttggacataaatatgtaacattgaaagaactgaatttgtggaaaaataatcaataattatttaaatgaataaagtatttaaatatttttaatttgcaaaaaatgtccaacgtgatactctcatgctaaaataacttttatcaatgttatgttttagatattataatgcaaaaaaaatatatatataaagtaataagcacttcattgccattaaaaattagccggtgttttcaagaaaaaaatagacagtagctttaatatcacatgaaataaattttcaactcaaacaataatgaaattggccaaacaaattcaaaaaatcgatcatagaatatataaatatttgcttacaaacgcataatatcaaacatgatatataaaaaatatagatgatatgatcaaagaatatttacgaaaagactatataattttttatatttttaattcaaaatttaattataattaaaatagcccagagtaatataaataatttatgagtttttatggaaagatggtcttaatgatatttttttaaaactgatgttataataataataataataatcttatttagttaagttgttgtttataattaattcttaaataaaatccttttaaaaagaatcaactttataattctgttgtaaatctttcgtacaaaaatgaatatacttaataatgtaaagcgcaattaatcatatccgtttaatctctttcccaagcacatatctccgctctattccattttcattttccgttccataagtccaactatttaatcgggagcattctctcgataaagagtcagttgagtgtgcagttaatcggcgagcgagagcaaagcgcagcggaattattattttatgtgattggccaatatttatcttatattttactccttctcgcccatccccgctcgcgtattcgatctagtgggcacccatgggattaccaatttggggaagccatttatccagggccggattttggcttattcctttttcccccaaatacaatcctcgttttcactcgtctccttcctcatattctgggctggacatcagcaccttcactataatta

SEQ ID NO: 856 - DNA, 2626 bp, Heterodera glycines
  misc_feature (2609)..(2609): n is a, c, g, or t
cccacaaaagccacaaacagtgccattatggtaaagagtcttcttgggcattccttcaccccacgggactttgtccaatttcttggcccttcgtcaactctgttcgatttgccccaatcagacaacgcaacggaatttgtttgacgcatggcagtcggtcagttcaaaatgaaaaacaaccaaaaggttttcttcccgtttgacttcgttttctcttgtccagttgatgtgcagcgcccttttgtccctgctgaaaaccgccgaaggtcggctgaatatttacaatgtttttcattgaattttcttaatacaaagtgtccctatttcactaattaatcatttctaatgtcattcattttctatagttttcctctcccccccccccctctaaatatttaatttatctctcctctcattgttatttttgccacattttctcagagtgccgtccttccgactccgaagtgtcctccgtttcattgctttccgccgtcgttttgctgctttccgcactttccgcgcatccctccacttcgttcgattcgctccctccatcgcccgtttcctcgtcgtcatcctcggcgtgtcctccgacccgtctgtgcattggccgtgaacttttccaacaattctgtgccgttctccgccaatctttgcaccattcatcgtgccaatccgtccaactgaaggctcttcaagcagttcgcctcctcttcgaatgctcgtcgttgtccgcactttttgtgcgcgagttgggcaacgattgttttgccaacattcgtccatttgtggacgaagcgtcggaacgcagtgagcaaaataaacggcgtcggaaaatgccatcggtggaagacgtgccattgattcgcgaaacgtgtcttgccattgaagccattctgagctgtgctcgtgatgagcggggttattgacctgaccacatccatctaacaaattataaaatgttcattattgattcagaaagggtctttgtcagtctcatcgttcgctctttggtccaatttttatgtgccgacgacgacgaactcttccaacaaaagggccccttgagggaacttcacgaattcgcatttggccgactcaatgcgattttcgcgcaacacccagaggtgattttggcaacgttatgtttgccttccacttaataattttgttcgttttcagactttcaaggcattgcttcaggcggcgccggacattcggcagaaaattgaaacggccacaataaaacagcaacaacaaaaggggcgcactcagcagaagagagtgagcagaagcggcgaagggggagcagcacaacagcaacagccgaccatcaaattgtccaccgatttcagcgcttttgccgcctcgggcggcggaagcggcaaattgcccgagggttgaaaagcatggaatgtttgtattacggtgcatttacagggattcaattattttgttttaatttgacggaatttcataacacttttccaacatttactgattgtctccttgtggtgcgtgaaatctcttcgttcctaatgttttctaatttttatttttatttgtacaaatgaatatatatatatatataaatatatgaataaaataagcaatataatttctaaatcgttgggcctttcacttttatcgtggaaaaccctgtgttgcaatacaaatcacaattatggaacatttactgtaaaatgttgagatttgcgaatgaattgttccgctttctgtgccaaatgattcacttttccgcttcagttgttggcaatctgtgctgactatgtttgacgtacacctccaatttgctgccctcaaactcccacacaatctgcgctttgttttggacattaaatcattttttaaattattttaaaattaaattggtttggattattaataaactgaaattggcaccaaaaaatagaaaatgctgttgattccgatcagaaaatattctgccaatgaaaatgttgcgtaagctttgcaaaagggaggggaaagaacggttaaagcaaagcgttgagggagggaaagaaaggcaccgaaagtgctgcagcggagaagaaaagtggtgtaactaatggcagtggacacggaaatgggatagccgagcagaaagagggcgcatttgatgcggaacacgcggcaatgctcaaaggggggggggggaggaattggcaaattttgaaaatgccaaaaatgaggaaaagtttggcacaacggacggaatggcaaagagtttatgctaattgccatttattgtcttaattaccatcggattgagcttgttgatgcccgaatggtagtggagcatgttgttgaacagcatgttgaagttgaacggaaagaaaagggaattttaagagaaaggaaaaaatattttggaataattagttaaatataatttaattatttataaattaacataaaaattaaaaaacttactgggatcagccataaagcgaagcaaatggcgtgcacttcttaaaatgggaagaattacttaattatcttatttattttttgattttttaattaatttatatttaaattattttattaattgaataatttaaatgtaaaaaatttaaaactctttnaaaataaatccacaaca

SEQ ID NO: 857 - DNA, 1884 bp, Heterodera glycines
cgattaattcaaaaagagaactgtattagctgatcaatcagtctgatcagatggaccaatctgatcgaataaatgattgatctgatcactgggtgtaaagaacagttgttctgatcatatggaccacacaatctctgatcaatgcgcaatcaataaaaaaataataataaaagcaattagcgtacaattgaatagaagaatctgggcggaatgtgtactgtgagcacctttggcagggaaagggactgatcagttggtttcaagggaagaaacccccggcattccttcccccctccccccccccacgggtggaaccgaccattagccaaatgtatttttgcggcttccaaacgccaatgctaaaggggaaaagggaagagaaaagggactgatcagtgatcaaagcaatgataagggaaggacaaatgaacaaacaaacagtagaaggacgattagacactcacctgtaactgaccggggggaacatactcttcagaccctaaaaaagggggggggggataagtgatcggacagaagagacgacaaagtggacggattgactaccattagaaaaacaataatcgaatggatcgactgttttgtcgcctttttatggcttgatcccctgctggtcccttccctcccccactctatcgcctgttgctttttgcctccctttttggagcttttcctaccggacaaaatgaagatggaattgtgaagttcgtcactctgtcgaattgaaacgcgaaagtgtaagcgaggcaaaaatagcacccaacggctgaacaaggaacaaaagtgaagaatgatcaccaaaaatcgttggattgacagcaaatgtttaccgggcaaaatggcggccattagtcccaatgtccgcacttttaatttggcgtccggcttttctgtcggtcgccacagtgtctcttccgtctcggcaatgcttttgctgctggtcgccggagtgtggcacactttctgcggtcgcttttcggcaccctccgcgtccggcggatggcacgaggcggaggaagggcaggcggaggaggcggaggagcagcagctggtggacgagtcggacagataaaaggccatgtccgccgtattgtccgccccattcggactttgcgtcgtcctttcgtctccttttgccgttgtcgtccttttgcctccgtttttcgctgccttcactttgttgtcatcgtcgtcgtcggcggaagtgagtaaactgttggacggagagcggccatgcagagggactcctccgccttctgttggtgtccctcgcctttggtggccgaccaaaatccctgccgatcccgacgaacacggcccagcgcagtgagacacagccccaatttgaacactgatctcgatctcttctgtcatctcatccggcgatgtgaacgttgagattggagaatgaatgactttttgtatttttgaattttaaggctcaacaaattgcattgattgcgttcaaatttcgaaatttaatttgaatgaaaagcgtaaacgatcgcttttttagttccttcggttgtggctttgttaagccgttgtgggaaagtttgacgccaaatgcgcgaagggaatgtacgcgatgcccaaaagcaactgaacagcgcgaatggaagtcactcagtcaatcggtccctccccatcccttccccccccattcgcccctctgcttttccctctcccacctttccttccccgcttctccagcataagcggcttttcgttgcgcaaatggacgaggagcaaatcgcccatggcgaaatccgataatttgggaatgaacggagcagccactgaaactgcccgggggaggggaggcgtaaggcgcgaccacaaagtcgaaacggggcgaatccgtcg

SEQ ID NO: 858 - DNA, 1936 bp, Heterodera glycines
  misc_feature (36)..(36): n is a, c, g, or t
  misc_feature (40)..(40): n is a, c, g, or t
  misc_feature (1896)..(1897): n is a, c, g, or t
atgtccagttttttttgttacggcgtaattgcgatnttcnccctaaaatcggctccttgtgtttcaggtgactcgggcgtcggaaagacatcgctgatgaaccaatatgtgaacaaacggttcagcaatcagtacaaagccacggttagtgcctttttcctgtttttgtccatttttcatttgtttcccttcagattggtgctgattttcttacaaaagacgtgatgatcgatgaccgacttgtcaccatgcaggtcaaaaattggattgtaactttttgttccgtgtgttttccccgaattgctggtcacgaatttgacacccattcgactgattccgaatcgctaacccaaattttaacaaaaattttgcattccaaaagggcccctcatattgtttttaaaattggtgacttaaaccgaatgcgtaccgtctttactttgctctttattcgtacaaatgccattttcgatttgtttgtacggcacttttccacagatttgggacactgccggccaagagcgtttccaatcgctcggcgtcgccttttaccgtggtgctgactgttgtgtgctggtgcggacggccaaacattgggccacccaattgaaccgttgccccccccccttttaaggtttacgatgtcactcacgcgccgtccttcaaatcgttggagagttggcgcgacgaattccttgtgcaggcgaggtgacccattggaattggcactttcaattagcagacaaatgccgagcaccgaaagcattttaaaaaagtgtctaaaaagcagtccaaatacgaattttaagtcctcgtgatcccgaacactttccgttcgttttgctcggcaacaaaattgacaatgacgcggcgcgtgcagtgaatgcaaagagagcgcagagttggtgccagtccaagaatgggatgccgtactttgaggtgaattccacgcaaaacatttaaaaattgctacacaaactcaaatcccgttccgattagttgaatttaaactttttttggcattttctccatttttcaggtctctgcccgggacggagtgaacgtcgaagagggtaaaccatccctttcgcttttccattctctcccatccaacttttgcagctttccaagcgattgcccgtgctgcgcttgcacgcgactcgcaggaaacgcacgacttcccgggtcggtttgcgggataaaattgggggaaaatgttgccaatcatttttttttggatgaaaaaggcactcgtaataaaatcttagaaataaatacgctatccaaataagttgcttttcattttcatctggactaaccatccaaattctcggcttacaaatgttttatcaatcaaattttgccagttttataaacataaaaatttcttcagaatttccggaccaaattcgacttgatcagagccgcaacggcagacagcagaattcctcctgttgctgaccgtccgggggcatttcgcgatgagtgaaatggaagaaatggtcgatcactctgtcgatcaaatgatttgtaatttccaaaagaaagaattcggatttcaaattcacatcttctaacacagacaagctcattccctcactttgactacccttttaaccaattcaaacagaaacgatgtttagcacttttattataaggccatttgccccccccccccccctcctgcgttgattcatcgccttcgccaattaaaaatgcaaaattttattgaatttcattattttactatatttgtgtgtgtctgtctgctgatttgacctcgccacttttgcatgaacggtctttgtattattagaaatgaattctgataaattttgatgattttccaacattctatcacttttattctgtgaggggaaaagtgcttttaattgnnggtcaattagtaaatttgttccccataggctgtttgatc

SEQ ID NO: 859 - DNA, 5622 bp, Heterodera glycines
tgggggtcaattagtaaatttgttccccataggctgtttgatcatattggggaatgtctttctccgttaccccgggcaacggctaaaattcgctccccccggcgcattgttttttctcttttacgcgcctttcatttccgtcgatcagcgaatggacgaggcaaaagccatcggttggcgtctcttcgatcgcttccgtccgcccgatcagcttaaccctttgctctttcgtctgtttgtgcgcggtcaattcgcacaatgcaaacaaaaaattcaggtgcaaaaattgggagagaggagaaattggaaaaatattaatttgaaaatgccgttatatgcaatttttcggaatgaatggtgccgaatcgaggcgccattcgcttccgaaaatttccgagaccaaaaagaaacacgagactgctcgagtcgagcgctactctcgagcatcattactaattggggccgttcgttccgaaaaacacgaaagctttcttctgatccgatccctttatacccacccaagaaactgctcggtgagtccccggagattctctgtgaatttgcgcttgtccttcgcggccaaatcgcgcgagaagagggcgaacttcgcgaatcggtcgcttggcattttaattttcaattccattgactcctccctttccccctccccttaaggtcggttggttttcgcgtgccctccgtcacaacccaaacagtgccaagtccgtccgtcggcccttttatctttcatttgccattcgaatttttcaattttcccggcagaattctactcgaactcggaaaaagccactaccttttggcggaacatagaaaagcgattgaactgttcacaaagtcattggaacaaaatgaaaagagaaatggcaacgcaaattgggtgagcaaagaaagaaattcgaatttcgggggaaaaaagcggcgagaatctcgacaaaacgacagttgcagctaaatcacagtcttatcagcagtccttggtaaactgataagtctgttagtctgttgtacccagtgatttgattcgcccgtccaatacaatccgatcattttgaattgagatattcctattaaaatctgatccatttaaatccatttacgttttgcgtgttgataattgataagacttccatgatatttacctgatcaaaatttgaataacaatgctcaatttttagaaattatactattggcaatcgctcgccgtttaccacgtttttcagccgccggaatgtgccaaaaaagtgccctttttcggtcattgatcagttttccattttgatttttaggcacaaatggccttgctttcctctcctcaaatcaattccagcgccgatatggtcattttttacccaatttaaattggagtgactcaaattgacttttgcctctccccattaagctgatgtttttggcgcgtttactcgacgagcaaaacgaaatcggcgccgccgtcgaggcgtacaaacggagcattgaaatggaaccagaaaatgtggacataatccacaatttgggaatgctttacctaaaggtgggtgggcgatttgaacagaaaagtgccaaaaatggaaatgccattgccgctgaaaaggccgaagaccaaccgaacgcatttacaacttttggcaaggcgcttagctacgacccgaattttgttccttcggtgctggccattgcttccataatgcaaacgaacggcgattgggacgtggcactcacaaaatacaagtgagagagagagagagggcggagagagactatgtgggagagagagagaacagagggaaagagaccatggaggaggaggggtacggtaaatggaagaatgatagaaagagagagagagagagagagactatgggagggggggggggaagcgaattttcgttcgatcgaaaatgccgacacattccgatgattccgatcactgataataacagttggaaatttctcttgctgcctttagggcggccacttctgagtttgaccattcgtgtgccctttggaataacattggcatgtgtttcttcggcaagggcaaattgttggctgctttggtcggtcattcattcgttcactttctttttttccccttccaatttcacattcgctttttaaggtgtgtctgaacaaggctaattatctttgcccgttggattggaaggcattctctcctaattacccctaattacgtaattattgtgactgatctctcccccttgggcaggttctgctcaatctttcccttgtctactgcactctccaccaattcgcctccgcctatcactttgtctccgccgcatttgcgatcactcctcagaatccgttggtcctctgcacgatggccggtgattacgagttgaagatcagtgaaatggatcattttcccatcgattgcctttgaatttcgattccgtttgggtgcccgagggcatgggaaagtctgatcagttttaggcatttaacttttgcccaatcgaagttggcaaaatttactcaaagagagaggggacggagatcaaagaaagggcccccagagataacaaattaattaattaattggggttaattgtttacaaattgttttcagtgattctcaccggcctggccgactttcggaatgccaaatcggcctacaaacgcgcccttaagttgggcccctccctttgggccgtccgtttcaatttggccattttcgagtcgcgtcgggcgaattatgccgaagcgactcgccgtttgacggaattggagtcggacggatcattggcgatgggctcgacgcatggcacggcataccccgaggtgtgccattcattggggtgccaaagggaagctaacgctttccaggaactgcttcaactcgtcgtacgcattcgaaagcattttgaaaagttggaaaagcaaaaggaaaagaaagagggaggagaaaatcagcgaaatgaatgaacatcatttttctcaccccaaaaaagataaacagatttttcttcaatttgtttaaatatacacgaaaacgaactgagtcatcagtagggcggggaattatatggatataaaatcgcaaaatatggccataaaatatggaccaaaaatcgcgaaatatagacataaaatggcaaaaatatggacataaatttttcaaattgagggtataatttccctaaatttctttaaaatttggcgaaaaaatgattttttggaaaattttccggtttttgggctcaaaaaggccaatttagctgctggaggccgttctaatagaggttttttggaaaaatgccaaaatatggacataaaatatggataatgccataatatggacaaatatggacataaatcgcgaaatatggaaaaaatggatatggaactccatcctaggagcttcaaaccaagctaaaaacatggatttccatataattccccgccctagtcatcagtgtttcaataaaaattatttaagccgtttttagctaaaaagcaaaatttgaattttcactttttgttcaaattctggtccgaaattgatcgaaatggacgccggattcgtaatcagcaacttcggaaacttgtttttatgttaaattacacaaattgtacgtttcgtaaaccgccaagtgggcattttaaatattttgtttaggttaagttctttctctgtcagtcttattttttccttcctaagcagaaattaacagtccgatcaaatacccttttaatttacattttggtgaagaaatgaaatattacaaaagaataaaattcctaatatgctaataataatggatcggtatggaatacaaattattagtacaaatatataggcatttccatgaactgaggaataatcaagcggtgttaagggttgtcagttaaataatcctaaagcaaaacaatcccatcaaagtgccccattttcggcgtcccaatccgcccattcgtcgccttttgaattgttctttttccgtttctttttgagcagcgtcgccagaaaagtgtccggaggactgaattcgttcgcctcgtttttcacttggacaattttcgtgcaattctctccgtcaaccgctaaaaataatggaaaagagaaaatgagtaaattcatggatttattagagggttaaaatttatcgaaccgatcccttcttgtaattctttttatttagaaccaatgttcgaaatttctcgagttcactataagtgcaaaatttagttttaaccgaaagtcgattaggtaaatatctccggattaacaaatcattttcaaattatgtttactctcaatgtgaaagataaaaatgttcgaatacttttcgaattcaatcgcagaaattgggccaccgcgtgcaaatgaaagcgtttcacgcgcgaaatgatttcctccgcgaaaacatcggccggcgattcgccaaagaattctctcaaagcgaattccattctgtagaggcaatcctaaaaaattaactattaaatccaaaaatccaaagaagaaacataacaaattggacgttccgtcgtttgagcaaacagtcgcggaattttttgtcgagtcgctgaaaacaatcggacgacgatttgccaccacccgacgaaggctgaccatctaaggaagaaaagaccaaaaagggaaatgacgtggcaataatcagaaaaaaaaataagtggatggcccatcaaaaaattcatttgtttattaataatttgcctttttatatgtttagtccccattttttttggttggttcattgatttttccatgtatataaacaatttcattaagtttttttttaagaaatgcatttttcgtagaaagtcactcacttttattgtgcggctgactctccgactttttgatgtccgtatttttgaccgattgttgcgaatgctgcgccttcgaagcgtcgcgtgccatgagaatttcgtattcgaattgcaaaagcatctttttctgtcctgattcgtctttctccaggaagtcattccaaacctaaataaaaagtgcaagactcactcaaatgggacaaatgcaatagtaagccaaaaaccttcatttttgcctcatctcgcaaaaggcgtgagaacgcagaaatcgtctcggggattaaatcggaaccatcaaagcaaatgtcctgagtgtcggcaaaactcgtcaaaagcctagctaaaagcaaagatacaaatgaaaagaacaaaagacaaactaactgttttccacacgacgccacttctgcgcccccatgtttcgcttcaacggaaatccgtccacaatttcaatcggccgatagcttttcgtctttttgcgtcggtggcctccgatgggttggctttgaatttggaccgacacttcgttttcctcttcggcattgtcgctgtcggattggtcggaatcgaagagatagcggaaaagaatgggaaattacggaattaaagggatgaaaataactactttgcataatcatcggcaaatccattttcattctcagcacattcttcaattcgaattggaattctattgatcgaacggttgcgcaaaatacccatggtggaatgatttaagccaatgcaaaaaataggaactcaaacttttgatctgatttttattgt

SEQ ID NO: 860 - DNA, 3974 bp, Heterodera glycines
  misc_feature (3853)..(3853): n is a, c, g, or t
  misc_feature (3884)..(3884): n is a, c, g, or t
  misc_feature (3892)..(3892): n is a, c, g, or t
  misc_feature (3898)..(3898): n is a, c, g, or t
  misc_feature (3952)..(3952): n is a, c, g, or t
aattaaaaaattttaaattattttcaaaagggactcaagcttattccttcacaattaattttttaacacatttattgtcttttcgattaaaaaatacataatttgtaatattattaaatatattatttttatttatttatataatgaatagtctataaaatattaatttatttatttatgttaattgttggctatttttgcacatatttcttcaagatgtgccgcggaagtcaaagcggcggtcgtcgtacacgacgctcattatcatcatcattagcagcagaatatgcaccagccattgaatttgacgacgaattagttgggcctgaactgttcagcagaatggccagagaagcggcgccaattaacggtaattaaaattccaaaaaatattttttattttttatttttacagagttcaatgaaacgacggcaattccactcaaaggcattagtgttgtgggcggtgacatcaatggtgaacacgacaaaaatttattcgggggtacggtattatatattttatacagtcaaaaattttttcaattatggtaattagtagagtgcagcgggaccgggacctgaacacggacaactgagtaccaaggtcccggttttgaccgggaccgggaaattcccggcttttttcccggttttcccagccaaaaagtcccgggttttcaacccaaaaagtcccggtcccggtcttgccaaatttcccggtcccgctgcactctacaaaaaaggcatttaccagtgtaattttgaaagagcgcgcaaaaaattacgccatttacgctatttggcgttatgaataataagagaaagcaattaagaaaatacataatgtggaaaaaaattatctgtccttattttcgggtgttcacaactggaaaagtattcaatattttaactattttttataatagagcatggaagactcccagcagaatattactgaacagtctgtatcggctcccaccactgatcgcgacgaatatgaagatctttgcaaattggtcaacccaatctcaaaagataagagggttgaacaggaaggagccaaaaaaggaagtgatgaggaggacattggagacgaaggagccgaaaaaggaagtgatgaggaggacgttggagacgaaggagccgaaaaaggaagtgatgaggcggacgttggagacgaaggagccgaaaaagaagatgatgatggagttgaaaaagagggaggaggcgatgaggagggtgttcaaggggaaggagtcgaaaaagatggagatgaagttgaaaaagaaggagacgatgaggaaggtgttcatggggaaggagtcgaaaaagatggagatgaagttgaaaaagaaggagacgatgaggaaggtgttcatggggaaggagtcgaagaggagggcgttgaaggggtaatttagtatttttacgatgtttctaaaaaaacaaagttaagacttcaaagcaaggagaggtatctcagcttatgcaggacatttttggtgacaatgaaatgagcgaggacgaagaggttggaatgtttaatttcgttagctcatatcaatttgcactaggacaaagacaaaaaggctgaatttgaggacgaggatgagcccaaactgatcagagttgaaccggctgaggaggatgtggagcagtaagcggaatgaaagtggaaggaattcaggaattgtttaatggtcctccttttagggatagcctcggacgcacatgggactttgacgtgatgttggccaagaagaagcaggaaagacgccgtcgtcgcagaaaggacggctccattgacctaatggcggacgctgacgaccaaatcagagaattggtggaggcgatgaatgaggcagcaaatgtgagcaaaaagtgacaagactctttttattgcagcgtataatcatcagcacattctataaaagaccgacgttgggcccccccccccttccacaagcctttttgtaatggtaggggttttccatttaactagataatccagggttttggtatggctgttactaaaatataccgaatgccaaacgcataatcttcgtcaaaaatttaggaagaccgaatgtcgaacatggataggagaccggcagttaagaagcgaaagatgttgcaagttgtgaagaacactttgttgaagactgacttattcgaagcgatgcttgacaacggtgcaaaacatggcattaactgcttattctaagcaaaaacctgaatttagggatgattagcgccctctccgaatggcttgccccactgcccgacaagtcattacctgccttggagatcaggcgagtttaccgcctttacaaaatatttctcattgtcagtttttccttttattcagatgcacgcttttgaaaattcttgaaaattggcccaatttggagcaggtaatgccaaactgtccctttaatttcttgctggatctgacaagctttttttgcaattcataaactttccaattcgaatgaccatactccgtttcgatttgcgatatttataaaattttattagaatgggattgaaaaaccaataaattattgtcaaaacttgtaattcaaaacggcgtgttttggtccttacttttcctcatttgttcgtccctttaagagcattctgaaacagtccgggcttggccgtgccgtgatgtatttgttcaaacaccccaaagaaacaaaggagaacaaacttatcgccgcaaaattaatccgcgaatggtcgcgacccatttttcaggtgatttggagggcgaagagatgaaaattctatttttattcaaattttccatcccagttggacagcgacttccgttcattgagcaaagaggagagagtgcagcgcgactactcccaaatgccactggccaaaaagcgccgactttcgtcagtttcttttttgggaattttttagctaaatgctaaatcaaactgttccgtcctcccattcacttttatctcagcatggacaacgacgagggaatttttgcagctgcacaaaagcaacaaaaacagcaaagggaggagacgaaacaaccaggcgaagtgggctttatgccacgtgcgcgagtgccgagaccgtccacctgcgactacgttatccgtccgaagcccgaaattgagggacagttcagaggagaaacgaagaacaagcaggtcagcagcaaaatgaggagagaatgacttcccattaaagtaatgaaaattaaatgtattcagaaatctcgcttctccaaaatgcagagggaaatgcgcagtcagaagaccacaaagcgcgcagttggcgtgtcaattaacaaagatgcattttaagttaaacacatgaaaatgatttggggttcatttggatgctattcaaatttcgctttatcatcattagagatggtaatttcatatattttttttgctgaattctatgagctccagaaagcaagaaaaacatttttgccggtgaacagaaattgggtttacataacatgctccggcatttttgtacatattttaagtataatttcgcaattttatataaaattgtcatccctaatcattcgtttcattaattttctcccaccaatttatgttattttattgaattttgatgggtttttagtagtatataaaccattttgttaaaaactttattaaattttgttgtttttattttgcgttacaataaaaccaaaaaatgtaaatgcatttttattgggcggacaatttttaacttgcttcacgttttttgttttgaaatgtctccagcagctgattaaactgcgcgatgtgagcgaagtttgggccgtttgtcgttcgttggtcgcacttttcttccattntgtttcgatttcgcttctctttttgtccgtntttacggncgttgngggaggacagcgaaaggtgaaagttacgcgcaacgaaatggtggaaacgaccgnaatatatactcatttgtcagtc

SEQ ID NO: 861 - DNA, 4301 bp, Heterodera glycines
ctttcccccccccccccccctcacccattcctttcccagatttatgcccttctgcggaggatgggccgcccctttcgtaaataaatgggaaaagggcggcggaggagtcgtcgccctcgtccccactgagaaagtgacatattttccgaatgttttgctttggagtgcatttttcactttctttggcataaaaatgccggaccaaagtgtcgttcccccgtcgtttcacccaaaaaggacaaatcaaattataattttacaaattattaacaacaaattcgatgcattcttcaccctaaaaactttaaggaattgaaaaatggtgccgaaacaccggaaccgtggcgacattgaacttacggaggcggaggacgacggcacaacaaatgccaccgttgtgctgaccaatggttgtgttgcgacggcggaggaacagcgagcggaaatgtggtcagatggcagcagcagtgactttggcgtctaccaatgcctgctgtttctgttcacccaactcggctatttggcggtggccccgtcaatgctttccaccactttcttcgagccatcctcggtcattttttatgatggcatttaatcttggcccgatccttcggttgtccattttccgatcaatccccatttttttgtcataattttgccagtatttttcaggctttttgcgacactttccgcctcagttctccgaatggttcttcttctgtcttcactttgtcttcttcccctccgtcggttgagtttcattctctgctgatggagtggggcgagcattgtcacttttccgttcgtactgtttggatgtccagtgccgtgatggtcggcgcggtcgttggcgctttcgtcgccggttttgtggccgattgtttcggcagaaagccggtggttgtcggtaagcagtgggcacaattaaatggaatttctttggaaatgcttttcatctcccaaatacccaccatttctaccgcatttctctcatcccctcccgaaggttccatggctctgatcagtgtggccaactctctgatcgccctcttcggcgcctcctcccctcctttggcactttcgctgtttgctttgctcggcttggcctgcggtgcttacatggtcaccaacatggtgttgctcatcgaaatcctccgccattcctccacccgtcttttggccgtctctctcaacggttggcccctcggaatggtcggcacggcactgctcgcgttcgccgtgcgccattggcgcttttaccatttggcggtttctgtcgcgtcgctttttctcttcattataattgtaactttttttcagcgtttgttttgtcccgttgtatcaaatgcaaattttccagcattatttggccttcgaaagtatcccttggctcattcagtcgggaaaccatcggagagcgcattcggtccaacagaaccttttcaaggtgatttaattttgaaagggaattcctgagtttacatgactttttaaacattttttgaatgtcaatggatcaaaaattggcaggtgaattcctttttggccacaaaggacggcaaaaagacggcgatggcaccgtttggagtgaatggcgtcgctgcgccgatgacgcgaagttcttcccccctcaacaactgttcgttgaacgaaaacactgacgacgcactgttggaggaggtgggcgggggcagggaagaaggcacggcacagaaattggctaattgtgagcattggagggagagtttttgacacttcgccacagagagccctcctccagggatggtaccaggatttcggcttacaatagatgggaaacggctttcaaaaacttctactttgaaaattttctgggaagtggtggggaattgatcgtctccaatcttatataattttgctaaaattcctcattttcccgactctttcctcccctcccccgccctttttaagcctttacctttcccttaaagtccgaggagggcactcaaccagcagcgcatcgtcaacgtcagcgcatttacacctatttggacctcttccgtcaccgttcggtgtgcgtccgaatgctcactttgctcttctgtttcggctcctccgctgtcatttcgttcggcctttacttcaccgccgaagtgctgcccggctcgcgctacctgaacatcgccatgatgggccttggcaaattggtgctcggctttttgccctttcttttgtccaatcgcatcggacgtcggcccattctgctcgtctctgttggtgagtgttttgctgttaattaggaaaatgtcattgccaaatgcttttcctttccaatgcccccatcccctgtccaggtttggcgtgctggactctgatcattgtttggctcttcttcaatctgtccaaacattggctcaccgccgccctcagccttttcatcaccgcggcaatcgacccgaattggaagatcatacacctgttgtccatggagctgtttcccacccccgtctgcaacatgtcctggtcggtcggcactttgtttggcatttgcggtggtgccaagattctctccccgcttaagtgccctttgcaatgtgattgcttgcctcggcagtttgtccgtccccttggtgcaattcctccgttccctcaacggcgtcttccccttttggctgtttggcatttttctgaccatccaatggcttatttccttctttttccttcctgaaaagactacgacattggtcgacaaaggtgagtgggatggatggtagacagttccccttttcagtaagataaggagtttccatgatttggcattgggtttaccaatcgaaacgaattttttgtcaacggcctattttggcttggaatttttacttcgtgtactccccatcctaacactccgtaccaccaccattctccggctatgaaacgataaaacgcaatgcttcccacttgctaaattgaaagtaatttcaggggaaggcagtcaaccagcactaaaggcaatcatattggacccggacagtgggaacgacagtccggacccggtgcgggtgcatccgtcgttggtgcgcgttctcaaaaagcaccaggcggagggcatcaaatttctctacaattgcacaattgagtctctgtcgcgattgaacgagccgggcggaggaggtaagtagataaaaattaattgtcgtattgttcaaatgccagccaattgttttagcaattcttggccattgcatggggctgggcaaaacgctgcaaatcattgcttttttacatactattttgtctcacacacgcatctccgaaaatattcacaaagtgttggtttttgcgccgaaaaacgtccttttgaattggatcaatgaatttgacaagtggctttttgacaatgatcctgagttggacggtgtcttgacggtgggttttgtctaatttgaattgcctattcattttttattattttagtattccgaaattgactctctaactgacaactccgacagattgttggccatcaaacgatgggccaaatcaaaaaagccttcagtgttggtcatcggctacgatatgtttcgtcgactcaccggatcagatgaggacagaaatgtcccaaaacgcgggggaaaagtgcgatcgcaaaagccgaagaacaaatcgaaaactgagaaggagctggacaggctgaagccacagtttcgcgctttgttattcgagggtaattcagtttattttttgctttttgatgtactgcaattttagccccccatatgatcatttgtgacgaaggacacaaattgaagaactacgaatcggcaatttcaaagacaataaatcggatcgttgcccggcgtcgcgtttgtcttaccggcactccgctgcaaaacaatttgagcgagtactattggtaaaaattatccattattttttatgatatattcttggaatttatgttttttagcatggttaatttcgtcaagccgaatttgctcggcaacatcaaagagttcaaaaatcgtttcgagcacatcatcaacagggggaggacggctgacgcgagcagggaggacgttgtgtttatgaagcggcgttgccatgtgctccatgatcgtcttcgtggcattttggaccggagagattacactgtgctcaaggagtcgttgccaccgaagcaggaatatgtgttgatgatccgactcacccaggcgagttttcccgcatcccttcactgtcaagcaatgaatttgtttcatttagtctcaaattgagctttaccgacatttttttggggtttgctgaacgcaacaacacactga

SEQ ID NO: 862 - DNA, 1754 bp, Heterodera glycines
  misc_feature (28)..(28): n is a, c, g, or t
  misc_feature (61)..(62): n is a, c, g, or t
  misc_feature (152)..(152): n is a, c, g, or t
catggacggtaaaaaacgaaaaaaatgnccaaaaaataaattggcgtaaaacaaacgccannacacacgcaaaaaaaaaagtatatgcacttacactggtaaatgccttttttgtattttttattttgatcagccataacacgcttcattcncaacaaaaatgaacaaatttggtatctaaaaaaagattttgaaaaggagaatctttttctaagtgaatgctaagcaatttgacatctcagaaaaaagttgtgcgagtttcaaattttcattatagtagcgcggccgtgcgcggtggacgtgctggcgttgggactgggcaatttgggagggcagatggggaacattgggaaggaactcataaactcccgaaggaagggccccatgggatgatcaagcccagggatcccatcccgcctttgatggacacactgggataagtggctttattccggagagactgaagatacttcgcttgaaatggcgaacattaaatacacgtgaaaaatgaaatgtgatcgatcaattatcgtcgggaaaggggcgacaataagcaaaagggaaattaaatgcgaaatgaaataaatgtgagaatgtgaaattcatagggcttcggccggcaaacaagaaaacccggatctaccttacacctccaaccttaccaaagaccgtccctggtctcttaccaagattttcgcttcaaaatttgcctaagcaaagaaaattatttcaaaaataattttgctaattttcatgccctttttccaattttaaatcaaaattttatgcttcgtgtcactcactcccaaccgtacattggatcgtccctgatccagttcaagactcaggcatcactggcaaagtgcccagccatcaacctttgtctgcgagaactgatcaggacttttttcatttttactgccgaagcacatgaaaaaacaattcccaaattttgcctatgaagcatgaaattttgacatttttaattacctatgtaaattagcgaaattattttaatttaaaacctagacccccaaatcaaaacacactcattttccttgccaaagcccccttttccactatctcttattcctctcaatcaactccggtcatctcgccgtctttcttggcatgacatgccacgtgtcccgttcgtccacaattgtagcactttgtagcgcttcctcctcgtccgccgcgtgtgaatgtcgtccccgtgaattgtctccagcttgtgcttcgccaattttcatcgcgtcgtggtgccggtccaatgtcctccgtcgccagtcgcttgccttccaatggtcggccggcagtcctgaaaatgggaagaggggtgttaggcctgttttctgtaatagaaccactcgagtcccaccaattccgttcattcgctcagtgtcgccagcaatctgaaatggaatagggagattagggttaaaaaaacaacacaattacctcaacctttaaatgaaccctcaaaattttaaaagaatttattttactgatgatttcctaagaaaaattcctattacctttcatttcgcgtacttcaagtgctaagtcttcaatcatctctctcaattgttgtgtttcactagcacaatcatttttggcatgattctcagctgaatgttcccaattttgtctattttctgaattagagggaccaggaaaatctcgaggacaataccaacattcattttgaatgtgccctggtcgattgcaaaattcgcagaagagccgagtct

SEQ ID NO: 863 - DNA, 2762 bp, Heterodera glycines
caaatccatatttattttggtgtttgatcattgaaaagccaaatgtctgcacaattttaaaattaaaacttttggtgtttgatcattgaaaaaattgagccaatttagaatacctatttaaaatttaaatatgatcattgatcattgaaatagctcttctaagaaatggcgaacgaattttataatgatgtttatacatcatttatcacgaagtaatttggtctatctgtggcctaatggttagtgtgtttggttctttctgagagggggggcaaaaagttcgatcccgacaccatgtgattggattttgaaatgaattatttaatcagaaataaaatgctcagcacgaatacatatcagtggcataatggttagtgtgttgggcttttttcggcacaacctgggttcggttccgcgcggagttagcagattaaatttaaggacaaatggtcgaaaagggacaaaaggtcaacctgggataaatgatccaaaacggacaaaaggtcgacaatgggacaataggtcaaccatggggacaaatggtcgtttgagtgccagaaaggccgtttcagtgccaggactctggtactgaaacgtgtcagaaaatctgggactgaaatgtccggtactgaaccgtacagggaatcgtggtcttacactacttagatgtaaaaatattttttattatttatgttttatttttccccattttattttttagtgttttttatttttccccttttttattttgggttttatcataggatttcgcgttgtcgcgacagggctcaaccgcagatagtaatgcgatttggctgaaaacccacatgtcaaatgatgtagaaaaaagagagccattttctgagaatacctaggcgtcacttggcgtcgtttcaaaaccaaattagtaaattaattggtccattcaacaaaactagcatttataactgggaaatttcatgtgattttctgtaatttgcgtcgtatcaccaattggttggcaatcaaattgtctttgagccgatacatggccattccaatcaacgggtacgtatttgtaatggtttgggatgtaaaagaggggagcggtgatttctcattccccaaatggttcgtactgggaccggccgagattccctattattgtattttataccttaggatatctctgggcccgggaatgtgctaatggtttcttatttcctttatttccctggtaagcgatcgtacacaaaggcagcgacacactgcgcttggtgcgtagcatggcgactgtgacattttggtatccataaatgttgctgcccgaggcttaaatttggctgacggcttcaagttgattgtggttaattttgaggttttcttttccattttaaagacaattcattgtcatctttcgccacagttgccccgacatgtcgaggattacgtacatcgaattggccgttcgggacgggcgggaaacattgggagggcattgtcattcgtcgacttgggctcatggcggaagttcaattccgtaacaaactcgtcgaagtggtgactggacaatcggacagtggacaatccgacagtgaggacaatcggacagaagtggacaatcggacagtggacatcggacagtcaaaaataaaatagataagaaaataccggtcgccgcaatggaccgattgtgccatatcaagaaaaaacaaaataggcaaataaattacctatcaagaaaaacaactttactcaattccaaaacggcacagcattatcgatgcgtaaacttagattttagttatttaattctagagaccggacaagagggtcggtcgaacggtttcggttaaaaaccgaaaaaaaccgaagaaaaattgtcgatatatcgtttcggtttcggttttttttgaatttttatattttttccaaaaaaacaataaaacatttttattaatagaaaaagcgaaagatcacctctgaactaaattgtaaagctattgaagctctatcgaatggtgtactaaaggtttggaaaatgatagaaaaggcagccaaaaaacatgtgtttgctccttgattctaaaaaaaccacaaagattagttttagcgatttggtgcctttttggcgtttttttccgaaaaattccattaaaaattcaatgaaattgggaaaataaacccctaaaaaatgctctaaaaaaattcagagaatatacctttatgaattgaacgccaaaattctttttttttcttgataaaaaattttaggtttaaaaatttccttattgaaaaacattataaaattaaattatcaataaatcagcaaaatttagtttttgattagtttttacgtgttttgctccctaaaaatcattaataaaaaaatttaaatgccttttttcatgcctttttcgggatttttgtgccttttttcagtgctattttgcgctttttggtgccttaattgcgagctcaagccataactttagggccggcggtgctgataagagccgccgggaaatttttttgtaattttaatgctatttgttagcaaattttgtctaaaaataccaaaatttgagattttgggctaattttttaagaaaagatagctttttggggggtcggcggtgccgataggcgccgccggaggaaaattttaagaatttttaatgaattttgttaaaaaaatggccaactgatttgtcaacaaagtcggtcgattgttttgttttttaattatttcggtcgaacggtttcggtaaaaaaccgaaaaa

SEQ ID NO: 864 - DNA, 5121 bp, Heterodera glycines
agctttgcatgtattttggaaagaggggtgatcagatctgttcgggcaaatacccaacggaggaagaccagcgaaaagccctggagaagtgggctgggtcatgtagttgaaaaaaaaaagcaatagctttgcgtccacttttcccaattcaaatgtcaaaacggtgattgtcaacagttctctgcgatctgtctttataaaacaaaacaaaacacaaataaatttataccaaacaaaaataaaatagcgacgacaaaacaaaataaaataatccagcacaatttctccccaaaattaataatcatcaaacaacaaccaaaaacatcacaaaatatattgagtctcttaaaaatatacgaaacgccacagaaattaataatttaaaattgaaatgaagtcaattagcacatcaccgcccactagaaaagacggtcccctcggcttacaataacaaataaaataaacaagaacaattcggctaccgatcggtggggttcaaggttgtgctgcttaatgacgacgacggctgatcatctcgtttccgcctcttcttcctcctcattcgcgtggtctttgtccatcgccgcttcttcgccgtcctcctcgcgctcgccctcctccccttcttcgtctttgtcacagaccaacacttggtcgctcagattcagactgtctctcagtttttctatgtcctctttcgtcgggatcggtgcatcgataaaaagttgtgggtaacaatcgcgaatggaatctttgatttcttgtgcaaaacgaaggcgattgtccatcggagcctcgtgtgaattgtgaaagtccttcaaatgacgaacaatcgtctcacgcgaaaagtgacccaagttgcattgttggcacttgaacaggtcgcacccctccaagtgagagtaagcgtgatcagacagacgattgatgacgagtttgccacatttctcacaagaaatggcttcgttgctgcgcttcttgaaatactgagcaccgccaagtcgcatgctgacctcgcgcagtttgatcatcacatcccgcgccttacgcgaggcttcctacccctcgatccgaagaaacgacggcccccgcttcgtcgtttcctcaccggctctttgggcgtccagtcgcgaccaacattttcagacttcaacgagactctcagattcatgatatgctgttgagaacggcggcgaacaatttgctgtgacagtttggactcgttgtttccgtgctggtaattgtcgtcgtcctcggcacggcccgccgaggaattttcagtcgaacatcgcgcaaaacgttctaagcgattgcgtcggcgtatttccttttcgaataaacgctccacgccaaagcacgccttggacatttgcttgagctcgtcctcgaagttgtacagcaaatcttcacacgatgcttcgtcgccgtgctctcgaatgccatgcgcaacgaccgattgaggacggtcatgcttgaagttgcagtgtttgcagccgtaacggacgatgttgaggtcggtgttcagatgccaaaggatgtggaagcctttgatgcgattaaggatgaatttgttgcacagacgacattccaaatcctccactcggcggttggcggagtcgtaaattggtagaccggaagagcgggagatgacgttgttgttgatgttggcggatagaagattgcagccaaaatattcaggcctccgccgctttctcactcccaaattgccctccatttcgcgcatttgctgctcataaatctgttgcgctttcactgcagttggtccgggagtgtttcctttggtgcccagcaattgcattgacatttcttggaccatgttgtacaattccatgcttctgtcttccatcatttcggcgtcaacttttccgtgcgctttcgactgatggttttccatctgatccttccgatagtgttgcactttgcatcccgcatgtttgcaacggaaacgataagtattcatgtctttgccaaggtggtagaacatgtgcatctgacgagcgccggcagtgatcggtttgtcgcattcggcgcacaaccctaacacgcattttttggaggtcattggtccgggtctgttgtgcacaatgcgtccaaagcaatcgtcagcattggcaatttgcttcacctcttcaactgcagcaatttcttcgttttgtttcaaaattactgctttgtgtgaaaaatttgtgattgcattaatcacttttccctttctgcctttatctacagaagactcaaccctaattctgtcattctcttcttttggagtgatcaaaacatttttgtcgtcaaaatccggcgaaattgaaagttcaacaaattttgttgaatatggttcaaccaaagtactgtaaatcacacgcacagaatcagacttgttgtccacacactcaaattccactaattcaccgttgggagcatcaaaaattttgaacccaaggagcccaagtgcatttgttccaaacaaaattggatgtccaacaggcgcatccgtaatgtggaacataatttcaactgcttcacaacctcttctcacaactggcaacaaaataattccataacactcgacacgctttccattaatgtcaacgacattccgggttttcggccaaattttgagatttgtgccttccaatttctgactttccaaaatatttttaagaaactccgccttaataagtgaaacttgtgcaccgccatccatcatcgaaatagcgggctgatcaaaaattgtaacattcgttgtcattattttgccgattaggcacagttcctttttgccagcagcttcaaaattgtcttcgtgctcctcccaaaaacttttgaaaaattcctccatctcgggttcattgttcagaacacctgtgcatttgaccgcgtcctccttgtctttcacttcttttctttcaataagaaaattttgtttcaaaaaatttcttgattgaaaatgttgaggacggtgctgattagcattttgttcgggtttgctcataaaattcgtatttgggttactcggaattggggtacagtttgcaccggtcgttgggatatgttcgaagtttcgcatttggccattttgttcggcttgacgcctgaagcaatttctggcaacatggcccaattttccacaattgtagcattttgggcggttgtcgttcgtttgctgtgtttgcgaattgttgaaaaatcctcccgttgaattcgcttcattttgcctccctctttgtatagcattttgcgatgccatccgacgggttgccctttgagtcgcttctgctctcgccgccatcccgacaaaatgatcaaatgtcattccaggtgtccttcccatttccaaactgagtgccaattccgaattgtcgaatgttcgtatcaaatgcttgatagcataatcgtcgaccaggtgatcagtcaaacctgggtatgcgcgtcgtactagggtgatgacacgttcagccaaactgtccaaatcctcgtcgttttttcgccgaataccggtcattatctgatcaaaagcactccattcacgggcatccgtttcttccaactgccaaaacatttctctttttatggactcatatcggtacggttcggtggaacacgcagacttaaaagctctctcagcccgaccaaagagttttgattctaatgaggtaatgcgttttgcattggaccattcagcggtattagcgtcaaaacgcttgaaaaattccttaattttttcggcgccttcatttccctttaacgaaggtatttgactcataatcagagcatatgacttgatccatcccgggaccacggatttcattttcagtttgacgaatttcagcacccgcattttgagtaccaaaattgtttggacggtttgtaatcggagggttttgctgctgggcaacaggttgaagaacttctctctgctgatttgcttgtacaattggctgctgttggctaggtacacccattgcataatttgcatgctgcaaaactggtggcggaaattgctgattaaaaatcggcggttgttggaggtttgggtttacatagccaaaattttgctgtggagggtagccaaaagcagttggataaggaccgtaaagaaattgtcccggataaccccagataaatccaggaaatccttgttgaaaaactggttgggctggcatgggttgggatggctgttgtggttgcgtttgttgaattgggtgcggatgaatttgctgaggatgcgactggagaccggtgggtgcggtaactctttggttctgcatagctacaccattattcaacatgttttgaaaatttgcttgtaaattttgattgtgcggtctgcattctacggtgtgctctacgcgcaactcttcaaacatattttcgtatggggttgaagtcctaggtctaacattttgcggcgcgggatgtaaaatgcgatggccatcattcgaattttcgtttctaatttgccattgttgtccgttatttctcccaacgttttgcaatcgaattcgcaaacctccatcagcatgctgttgctcgaaatttcctccgcctcgtcccgcttcatttcgaactgcttgttggccattctgttcatccggtgccgcgacgttcaaaagcgcattgcgaatttcgttggatcccatgctttcttctgactctaaaagttcaccatcaacccggttatttaacgaaacatttcgattttgtgtgttagcggtgttattcggcctgcttaaattccctacaactccgttttgctgttgctgtaatgccgccgcatctcgagctcgttgtctggtgaatggtggagagcggttaatcatctttttaaaacaacacgagttttattggagaatcttgaagagcacaacacgagtgctttattggagaatcttgaagagcacaacacgagtgctttattggagaatcttgaagagcacaacacgagtgctttataattcggttggatgcatgaagagtccaacacgaggacagaaaaatgataatgtcgatatatgataatgtcgataaaatccaagatccaacacgaggattatcgcaacttatatggccgacgtaaaagttttccgtttagtcgtcact

SEQ ID NO: 865 - DNA, 1294 bp, Heterodera glycines
ccaacgttttgcaaatcgaattcgcaaacctccatcagcatgctgtgctcgaaaatttcctccgcctcgtcccgcttcatttcgaactgcttgttggccattctgttcatccggtgccgcgacgtccaaaagcgcattgcgaatttcgtgggatcccatgcttcttctgactctaaaagttcaccatcaacccgtttattaacgaatcatttcgattttgtgtgttagcggtgttattcgccctgcttaaattccctacacctccgttttgctgttgctgtaatgccgccgcatctcgagctcgttgtctggtgaatggtggagagcggttaatcatctttacaacacgagttttattggagaatcttgaagagcacaacacgagtgctttattggagaatcttgaagagcacaacacgagtgctttattggagaatcttgaagagcacaacacgagtgctttattggagaatcttgaagagcacaacacgagtgctttattggagaatcttgaagagcacaacacgagtgctttataattcggtgggatgcatgaagattccaacacgaggacagaaaaatgataatgtcgatatatgataatgtcgataaaatccaaaatccaacacgaggattatcgcaacttatatggccgacgtaaaagttttccgtttagtcgtcactaagcaagccaaccttttgttgcaggagcgccaagttgaaaaaaaaaattgttttgcgtccacttttcccaattcaaatgtcaaaacggtgattgtcaacagttctctgcgatctgtctttacaaaacaaaacaaaacacaaataaatttataccaaacaaaataaaatagcgacgacaaacaaaataaaataatccagcacaatttctctccaaaattaaatcataaaacaacaaccaaaaacatcacaaaatatattgagtctcttaaaaatatacgaaacgccacagaaattaataatttaaaattgaaatgaagtcaattagcacatttgtgcttattttgaggggtcggatcttagaaagtaaaaatgtgcttatttctaagatttgtgcttatttcagcgttacgtgattattttgtgcttatttttggatttgaaaataaaaaatgaaaaatttgaatgactattttgatttttcatttttttctgaagcgaatatttgaattaatttgattttaaaaaaaattacattttatttcattttttgagtgaaattcacaaaatgccaccaaaacgtaaacatgtttaaaattcgatttcgagtaat

SEQ ID NO: 866 - DNA, 4068 bp, Heterodera glycines
aatttcaagccatttttgactttcctgatcaccatgaaggagtgatctgatcaagttggtgtaaaagcctttttagatcagtatcaaaagataagctagcatgaattatttcaggtttttaaatgaactctaaggtggtttttcaagtttgagtcaagacttttttccgaccttttttgagcaaggtctgattaggagacttattcacgagaatgataaagcggaatgaaatgattttgtggtatatgaaaggcccatatatcggggtaaataaatatacataaacaaaaaataatcagctaaatttccagtcgaaatttaaaattctacaaattttatcattttgagtcaagacttttttccgccactgtatgaaaactaaacctaggtaactcggaaacaaaaacaaaagcgtacgagacacaaaagccaaactttttggtcatgtttcttgagcagcatgaaacttaaaagcatatttaaaataattttaggcttacaattagcaacgacataaaattaaaatttcatcatttggatatacaaaaaaaatcataatttttgaatttactttcgaaatctaacagcatcattagtagaaaggctttttttattacggaaaaatgttgatgcttttgttggcatatggactaatttgtaagtccaaagtcaaggttgccatccgtcctttattctaaggacgtcctttgttttcttcggctttcaattctgaatttttcgatggacaatgctggcttaaaactttggtatttaacttgccgaccaaagatgactgatggaatatgtcacattaatttgtaagcatggaaatgagacaaatcattggaattggaagtgcatgttaagagctgctgatgaagtttgggttcttctgttttttgacaacactgtggcaaagaaactcggccggcgctgacggctagggggtctgtgcgcgggagtttctctcccgtccctcgggcccaattcactcaaattgccgaatttgctgctgccgtcgggtccttgcccaagggagtgaactggggagggggtggggaggacaaacaagatggggtttgcggttgttgctgtaacggcaccaccgactttttgaagagctgtcggcgctcccggttgaggttcgggagaagagttggacttccggccgcgaactgcgtcaaccgccaggaactggctcccgtcccttttttgctgctgctctgcgggggattgtcccccgcttcgattctcggggctttggctcccctttggtcacttcgtttccgagcgaatttttccccccttttctgccctctgaccctttcaacacttttccgacaaaatgtttattggtgatgatgatgataaaatggtcaaaaattggtggatgattatatgcgagatgttgatggttatatggtgaaaattggaggaagggaagggcgataaggattattgagggggtcaaaaattgggaatgattcagcaaaaagaaaaagatggtgaggagtgaaacgagtgaagagccagaggtgaatgtgtgaagtgaaaatggaaaggaatggaatggccccaaatagacgataaacaatacttaagtaccaaaaacaatttccccctgggggggcaaagattaagatgcgaaaaagcgacgccaatgggtacaaaatcggcggggaaaaaggggccaaaacaaagggaaaatgagatgacagcaaaaatggcccaatggaaatggcgatcggagaaagtgtgaacaaaggaatcaaaatcggaggcagatgtgaatgggcaaatattggaaagaaaaggcaaatggtgaagttgaagaaaacattatgtaaatgagcaaaagtgaaaggaaatgaaaagtttaaataaagagataaataaagaggggtgaaaatgtcgacaaataaaaaagggatcgttccctcctcgcgcactctcgtcggcaacaaaattgccgacattcccgccgggcggcgccggtggctccggcactgcctcctcctcgtgaattcgctgttttcggttcagaaagtcggaaaaaatgcccaaggctccgccggccaagaagagcaccccgatgagggtgggaggcttctcccacccgaagttcagtctcatgtcgcctttgtgcgttgacgggagggtgatctcgacccgtccgtcgtcggcctctgcggtgctgatcattgccaacagcagaattagagtcattaggcgtttgtagagctgaaaatgtgggctaaatttgacgaacagaaacagggccacaagtccgattgtggctgctcccacggccataagcagccatggccccctcgttagcaaatgtaagagggggaaaggatcaatctgccaatccgggaggctgaatccaggcccgggctcgagtcgtcctcctctcgattcccgctgattaaatgccgaatctgtatgccagttctgggagatagaacagcgacgttccccactatttacgttcggatatgtgtgtctgtgccccgccggggcacttcacttttgcactcggcgaacacctcggcccggtcgaacggaattgcctcggtcgtcgtagattcgtttccgccgcagtgaaaggcaaaaagcgtgccgtccgcgcatttgatcttggccaaggcggtgccgtagtcggttcggcatgttgcgttgaaagttgcgcccgaaacgcatcgatagcatccgctgagtttgggtgaagtcacccaacacttggtgttgctgtactcgctgatcaattcgaggccgttgagctggacatgcacctgcacaggtgagtactgaaattcgcctcggacgttcgggccgttgttatggagatgcaaacgggcgacgtcgagcgggagtcgttgctctgggttgttcatgactcggcccacgtccaagtcgcggcaatgacaatggatggtgccgttgtcgtgatccggcgcacatttttggcatgcgccgatcgaaagctggcacttatcgaagcttcgtgccatctcttcatccaagcaatgcaaatccgaggggagtgatttccccattgccacagcgcgtccgtccgtaatgaaatgtgccgaaagtgccggcattggcgggagggaggtggggacgaccgcgatggtcatatttccccactgctcggagactcccgggtgtagagtcagccgatgtgtgtcgacttggccactgtttgtttccagctcaacccatgcgctgatctgcatgtcccattcgaggcaagtgaactcctcgaacaccgtcgtcgttgtcggtaccgccgcccacctgtaaaagaggcaagaggcggttgggagtccgcaggcgttctgccagaagctggtgctgcgcatgcagaacgaatgtcccgggcggttgttcagttcggccaattcgggaatggccgtctcacttcggattgagttgcacatgttgccgcggcatgaccccgccgatgggcatcgctttaccgccgtcgtcgagatagagtatgatcggagccagctttccgtctttggcacgcagaccatggtgagggaggccagtctgagcctcactgccccgagcagttcgtcctgttgagtccgtatgacgaatgagtttgtctggtccgccggcagaagcgtcagcaccgtcgctgctgtccctgcacatttgagtccagccgccgtcctcgaacagtcctccgatcggaccatgacggacaaaggtttgttggccgttgccgggccgatgatgagcagcaatgggatgagggctgccactgcctttgcgggaaaggcttttcgagtcccgtcgggattttgccacgctctggccatcgcccgagcccgtcttcccaattgcagttgctgctgcagctcacgtatttccgttcgtgcctttctcgctcctttcctcactttccgttcgatttgctccgtggtcggtttccgaaaatcgcgtccggttgcccaattgatcagcccgatggggtaacgaactccccatgccacggcttttgagagcagcttggctcctgacaaaaaccgcccaaaaatgagcagaagcagc

SEQ ID NO: 867 - DNA, 4043 bp, Heterodera glycines
ttggccaaaaaatcgcaaatttgaatcattttccatgtgcgaatgcaaattcaaattattgtaaagtggtgcaatcatttcgccacccatttcgttaaaatgtcaggagttcgatgatttttcccttgctttttctatgatatgttttcagtaattttattatgtgaaaaaaaatgtggtgaccgggaggaaaggaaaggtatgtccgaaatgaaagtgccaatccgaccttaatcaaatcgatggtgggcgaaggcgaacgacgagaaatggacagccgaggcgggtcctcaaatgggtcttccaacacaattgtgtgggcaatgctgaaacgcaaaaaaaaattggttgcaattttagcaatttctaaatttaatttaaaatttgattccggtacataaattgtaattcaaataattgaacttttaaattttgaaaaaggttaaagaaaggtattaaccgaatgtcccggtagggtcggttgtttcggtccactaattcctcgttcagtttggtcactgtgtccatgccttcgcccacttggccaaaaatgcaatgtttgccgtccaaataatccaattcgtcgcccaaagtgacgaaaaactgcgagccgaccatcccatcgccgttgttcaccatcgacacaatgccgcgctgactgtgccgcaatttgggcacattttccatttcaatgaaccgtgcttgctccccaaaaagagtgctgaaagagaaagtactataatatagaaattgtttaagggagaaaccgacccataaattgattcgccacctcttcccgagttcgttgggtccccagtttgggcgatgtaatttggctaaaaaatgaaatacagtaaaattaacgactaggaaaaaaacaattgaatcgcattttgtatgtattaaaattacacaaatcgccgtagaatttttataaatatgttgcgggttatcagaacagttgaattttgctggaaaaacattgacataaagcctagctccttgaaaatttcaaggttttttaatttttaggttataaaaaatcgtaaaatttgaacaaaaaagcaataaaattgaaattttctcggggacaacgaaaaggaaaaatgcctaaaaccaacatagtaaaaacttaagtttgaccacatataaatccgtgccctgataataagcaaagccaacctcgatggtgaagaattggcagagattgtaatatttggttttgcaaagtttcaggaaattcttgcacgcatttggccgttcgtcgacaaaaaggtcgatgaccaagtcaccaagggttgtttcgatgagcacggccatgggaagctttaatttataatttaaacaactgtaaacagtaaatgtaaatggttatcgaaaatccgaaaagcaataaaattggcgtgggtttttcaaactaaacaaaaataaaattgaaaaaacgcaataaaatattttggcattatgttttggcgttttctttgaacccactttaaaaatttccttttttccttcagcagctgctgatggttgtgagtttgtgaattttgattgcgatcgcgaaaaaatcagtttcttaaaatgaagtgaaatgatgaatgaactaatgtaaattagaggtttattccatttattagaaattgaatttttagttgaaatgtttaaatacaaattccatatggtaatacatgaattgccttatgttggcttttgaataggcttattgttcatctttactctttaggactgtttgcacaaatttggttaattttttttcgatgggaaataaaggaaaaaagaatcgccggatgtggtcagggattaagccgtgagttgggcaatttcttatattttctttgtctgtatctctctgtactttgcaggggtgacgaacatttcacgccaattccggccaacatcggactcagtgaggaccagcgcaaatgggaggacctttcattttggcagagggcagaaaattcggaatatttccaaagggagggaaaggagcgttggctgcgcgcctgccttctgctcaactcgcaggaagacttcagaatcgcgtacaaaagtaattttttgctgtgtttttattacaatgttccgagtccgaaataattttttttcgtaatttacgaatttaaaattttagttttttcatcatttctttggtactgaagtatctattttcacttgaacagttttcccgtcgctcaatttgcttcatttcgatttaccccaatcatttttagatttaaccaagaactttcgaatgataacaaatttgacagggttcggcattttcctccgtaaaagtcaggagtgcccacagggacgacttcagaatcgcgtacaaaagcgaattttactacattttcgatgcggggttccgggtccgaaatgatttagttttttttcgtaacttacgaattaaaaaaattcatttaattttccacttcagtcggtccgccggacctttacacggacgaagcgctgggaaatttggacacgcgccagcgaagggcgacgctcgattcactgaaaaaaatgcaccccgggattcagtttccggagccgttgcaaaacttctcgcccgagccgttggacctgatgtacgggttggtgatgctaaaggacctgagcttggagcagttgctgttgtacgtgcagccaggatcctatttctacccggattcaccgaccgacgaaagttcgttttgacaaaaaaaaggaggtgggaggcagatgcccaaaatgggttcaaacttaagtttttcaatccctgatagcctaaaaagcattatataagttatagaaaggagagcagcttatttcctccacctcccgagaaataataaaaaaatttactaacttagaaatttttcataaaaaaatttttatggtgaattacaaagatttatgaaaaagtagagccaaaggagaggcagtttttcggacttacaaataatagacgcggggtttaattggcattgaaaatgaaaatttgaataaatggcctaaaaatctatgccttttcgtgataaagtctcggattataagcatgccctttttcagtaaatgagatggtccagcagtccaagtgggaggagaaggaaggacggcgctacaattggactgattccaattccatgccattcgccgattgggaagtcggggcgaaagtgcccaaaacgacaaagacgccgcctccggcacaaccgccgccgctgccaatttttgccgagtcacagaaagacaaattgtaagcagtcaaagtcacactactgcaaatttatgcaactttccattcaaaaacatttagtgtgaaaaaacaagtggaaaaggaaaagccgacggtcgaaaatgaccgaaaaacgacggtgccggagggggcgccggaccttccgtccggtttcggtggcattttgcgtcagaaagcagcggtgaagcccaagaagaacgtacgctggtcgacgctgatgatgatgagtgacggcaacaaagtgcagctggtggccagcggcttccaaatggttgacaatgaaagtgttcggatggcgatggacgctccattggacgacgacggatgggaggacctttgaaagtggcgaaacaatggagaaatcgatagggagtgccaatgcgacaattgtgccggagtttcaacattttttgtccgttttatttctcattatggtttttcaattaaaaatggaaatttcgccccgttttaatgatttttcattgttataaattgtgtacttaattctaagatttgtactggttttgccataaaattataggattaattaaaaaacttaccccccccccgcgaaattaaaaaaatttataaattaattaaaattttctaggcgccacctgatgccatcgccggttcctcattttaccatttctaaattcgaccccaaatacaaaatggcattcaattataaaaattggtaaatacccaactcgtactattttagagtatctttttttctatgttcagtgatcgacttagcgctgtctcccttttttccgtt

SEQ ID NO: 868 - DNA, 3296 bp, Heterodera glycines
ttgttgtgtacggacattccgtttaattaccggacatcttttggtttcatgtttacttagccaaccagttcctttatgtttctttcttttcatgtaaaggtacatatttcgctctttaggcattggaggcgtcctttttgagttagtgggcgaaatgacctgtaggagaaaaagtaatattttaaattgtaaaaatccgattttgtgttgattggcgaaatgtcattaattaaaaatcaaaaaaataattttatcgatgctctggtttgaaaaaacaacaactttgttattttgaaatcagtcacaatgggattatcggtattgataagtcaattctcccgatttccaaatttaatatatttatcagcacaaataaacagaattttttgcgaaaaaaaataaattggccaaagcccaataagaatgaagccttttcccgttgttagtgcattttccattttcacaacactcaaatttattgcgtttttctctctgtgccctctcaatgtctctcactctttcgctgcctgttccaacaccaatgatcgacttaaaagcaaaagtccgcccactttccctgtcccgaccgcacgttcgcgacccaattcatccatcaacagcagcagacggtcggacggattgtcacccaaacgatgatgactcatccatcctctgccttccccgtcctctctattttccattgtctctcccaatttgtttgacccttttcctccgctatttcgccgatgaaggctttctctcttcttcctctcttacatggcacagtctttctgtgctggggagagaccccaactccgacgactacagtcacaccacacaacagccgacccatcgtcgtcgtcacacccattcagccaacaatgatggggggggggggcaagggaacgacgatggcgagagagttggcaattggtggagagtcgcatcgatccattcgtctttcccttttcgcttctcaaccacacccatccaaaacgtccgaccatcccccgctcacacagcaccaccacccattcacattcattcttcatttagtcctcctcctcctctcttcctcttcgcccaacaacaaccagtcctgttggatggatggaggagggacagcgacggacggagcagcgatctccgccaacgctaaaacaggctaatgggggggggagtgagcgaggggcgccgctgctaggcccaccactttgtgcgatgatgaaatagacatcacatccccgcgggggaagcgtcatcacaaattttgggtccaaccaccacagcagagcatttctgcccactgcctgttacgaaagtggcagtcctctgctccgtctgccttttcccccgaacaaacacctcccaggctgctcctcacagacacaattcatccccttcccaattccacaaagaagggatggtaaatgggggacgcggtttcccatggcgattcatccaaaatcaaattcaccccccccccgtccgccgctcgcgtcccttccgttctttaccctcctccccccgtcattatattcctgaagaacgaagactgacgactatggaaaagggtgcaaagtggggggaaacggggaaaaacaacaaccgatgaattcttgcaaatccaatcgatcctctgagaatgcattcaatatgtatgtgaaatatgcgacgggtgtaactgaaaaggaaaaggggaggggcaaaaatgaactgaccgatgacgccaaattgacgtcatcccattaattttgcaaaggaaaaggacatgacatgtaaagcagaaagggaaatgttgcgtttccattcatttgcaaaatgcgcgtaaaaggaaaattggattagaaaaagctaaatttgaaattggaaaaaaggaagtgtggaaagcaagtgatgcggaacacccatccattgagaggaattagttccaaccaaagcaattaggaaatccataaaggaaagggtcgaaattaaattgaactattttaaataaaattggcgttttgtaatttaaattaaatttcggaataaaaaattgttaaagttaggtgtggtggtgccaaataagtttgttacagtatgtctttttatttggtcactttgcgagtgctgagatgggtgcagtcgaagaaaaggaacccataaattatattaatttcggcgccttacacttacaaaacaacgaaatttattgttgtcgctttcatttattctatctttgcatttcttgtcgcgctttttaacctctttttgtgatgccatttacattggatcacttaattgaattcattttcctccctttttatagcacttaattaattatgccttgccaattgcctaatgaaattgcgacggtcactgacgacgtgttttcgtatatgtgcaatttggcaatggaaaagtgttcgaaaaaggccgataaaaagaaggcctcgtgtggtggggcagcaatgcggaagaggtgagaggcaaaaggggacgggggaaggcaaatcgggtgactaagcaatgtaattccatcatttggctctaaatttactatttttgaattccagtcaattcaattgcttgtactaatttcgtatttaatttgctctctttttttagacttttgatcaaaaacttcgtggcacaaatgctcgcgcaggatcgccactcgcgagagctgtcttcaccaacttctgactgttcctcccacttgaatcaggtgagctaatgagtgtaattagtcaaaaaaggcggtcagcccatttattatttcacgtaaatgattttttgtgttataaataagcgacagcaacaaattaaatttttagaccttcgacgagtcgttcgactttccgtcgtgtcaaagcggtgcgaatgcagtggaccaatttggagacgacatggaaatggacgccatcggagaggaagttagtgaacgattcttgtaaaaatatagcaaatacaacttttggtgtttcataaaaaaccggcagaaatctgccaaaaattttcacttcaccgccccgccccccccccccccaataaagtttcacaaagtaggcgcaaattcttaacaaattttcactcgaagcaattttggtcgccactgtcagaccctcccccaaattgatgtcccgacgaaaaaaatgtttaaaaattcacagctattttttctaggcttaaaaaatgcgctgatcacgaatctgaactcagattttgaaaatcattaattaaatttcaaaaaatcgtaaaatgttgaaaacttgacttatctatagattcaatagatcgttcgaaagctcttt

SEQ ID NO: 869 - DNA, 1551 bp, Heterodera glycines
tgccaaaaatcttattgggatcgagagtccgagttacttttttgaaaacaatcaaactttctctgaacttgtttcttttactttaatcatttccgatttacaggttccatccaatgcgacaaacgatgcctttctgtgcctagaccagccgtcgtcattgttgaccgacttggacgacgtttcgtgcgaccctcagcagcagtgccattcatcgcgcaatcggaagcggccctggtcgttggtgttctccgccgatgccaccgccactgctgactctatgccgatgccgtcgctgtgttcgatgggtgtcgtcgtcgaccagtacaaccaccaccacctgagcaacaccaacaacagtgttgtcgacatgttcacggctgcaacttctgctcagcaccaccacttcatcaactccaccgcaaacaacatcaacaacaacggcgttctccactcgtcggctcctccgctgttgtcgccgctgtgctgcggcatgctgcagatgagtccgttcgggtcggccactgctgctggcgaggccatgctgttcaatggtgctggtggcggtgccggtggtgttggcacgggcggacgtgtggagcagccgatgctcaagcgggtcaagctttaagtgacacgggggcgagttgcgcttcgcacaattttgccgttttggtgaccaattgacgcgtgtggactcctcttgggaagacagatcctcatcaacaaaacctgctctttatcacagacctctcctctcctccttctcttcacactcaaatatattctgctgcccaccccatatattttcttttctttcattcattgttatttaatggtggcgattttttatgttattatgtgtatgtgttgcgtttgcttggactttggaaagcagcgctcttaaaacgttcctttatcattaagcatttaatattgcaagttgtttgatttcaaaataaaaggatatgcattattattatgttcgtttgagttgacagccaatgagtctaacaaaaaaccataaaaattaggtgatttttactgaaaattgccaaatccccagggaccaattaatatctgcgaattaggtacatgaatttttccactttttttctggcatttaaatatgttcgacagaaattcacacggatactcactcccccactctttccctccgccttttctgtgatgcattaggacgaaatggcgggtggggagagaccgttcattaagcaaataaaaagcatcggagagaactgctgggaacatttgaattaagtgcgcgaaatcgctcggcataatcccccccccccctaatgagtgcgttttattcgccacttttggaagaagtttttgtcgccagccactcactttctcaacaacaattggattcgttgattaattagtcacccccgatgtttcatccatcgttccgttcgttcgttgtccttccgttgcgttgttttccctttttgtcggcaatgtgccataattggcatgccatgacttttcagccatttgtttgcgtttgtacaattgacacgccacgag

SEQ ID NO: 870 - DNA, 1291 bp, Heterodera glycines
cctttttgccattgtttttgttcatttttaattcattcctttctttacttacacccgccgatgatttctccgggcgcagctgctgccggcacatggcgacgcgcatcgcttctgtgggtaaacacggcacgaaaatggggaggagggaaacgatcgacaaaaattgtgaaaaataattggaaaccgaacataatttacatttcttatttggacacatccatcgagttagagagagagagagagaaagtgctgcttaatcgaacataaagctttaatggattattactgtttctcttaattggcatgcttgaatgggccaaaaaagaggtggagagaaggagagaaaggcactttaataagtaagttgtcgtttaagaaggtggtcatcccccaccacccatttgacgtcgtctttcgttttcaataattttttctttttaagcggataaattttcgagagtgaaatttaaaaacggcgctttataagacatggaaattgatggaggaatgagtgagggtgggagggagaacgcttgaaaatgatatagagggaaatttaatcaaaatttggtgtgcctttccgctttcatctctccgtcgtccgtcgcccccccccccctcgaaatgcacccaaaatttcatcactttttttttgcgaacccaacattcattcatttctccattatgtaatttcgaagccgttttaaaaatttagtccgtgaaaagccatcccttctcccaatccaattctcgaggcttaaaaccctctttcattcagtgagtgagttgagtgtcttgaaaagtgagaacggaaatatctgtggcgaaaagattagtagctgtaaatgacatcaaaaatgttttattagtatttttgctttgattgcccctgggggcatttttgccgaccgatgggacggacccctcccgtgtccccttaagtctcccccctcctcactccccgctcattcggtggtgcatttgatggcgtttgaaaggacaaagagtttcggtggcactttcagcgccgctgtcactggcacagagccgctgacccgtacggcggccgctgcaacagcgggcgccaccaccgacatgttcttccacgcgacgctggcgcgcactttcatttccgcgctgcgcgttcgcggtagcaaaaattgattttaaaaacaacggaaaatgcgtcatcatgccctttccaggcgacgacgatgtggtggaccgtctcaactactactacacgccgatcatgttggccatcgcgtgccttgtcgtgtccgccaagcag

SEQ ID NO: 871 - DNA, 3135 bp, Heterodera glycines
  misc_feature (3048)..(3048): n is a, c, g, or t
  misc_feature (3108)..(3108): n is a, c, g, or t
tcggcacacggtctctctctctttctctacccgctccctttccccgcccccttttgtacattttgctcttcaggtgttcgctttcttttggctttggtactgtctgcttttatgtgccacaacgtatgttttttatggggaatgaacgcggcttcttttccaaataaaaaggagaagtattccaaaacttttcttctcactccgtaaattgtgggggatataaaaagttggaaaaagctaattaatgacagggatggtccccggaattcggtgaggagggattaattaccgctagtgatgctcgaggtttcggtctcgagcatcactaattaccccctccccctccatctgctgaactcacagcaacacttggtaattaagctgttccgccctgttttggctcagcaacattctgttgcacatcgcccgggtggactacgtgctgaagtttatgcaaattgctgaacacagtgaacaacagcgaagcagcggcagaacgccaaaactatcgcaacaaaagtgggcgatggtggaggagggcgaaatgccacaattcaccaaaagaccatttcgggtgccgagtgcgcattcggtggacaaatttgtggacgaattcctcaaatcggacggggtaaaactattggaattgagcagagaatgccatttaaataacatggaaggagtgcatttttccaaaaattccaaaaatatatgaaaatttttcatactttgtcatggatcgtaattgtatgatacggtggtattacagtaggattgtccagttttttctacaatttttgctcaacacccttacaaattcagctgttcattctccgattggtggccacaaatgcgggcgaattggtcgtcgttgacattgtcaagtgcctttggaggttcgaaattcggagaatttgggtcaaattattattagcgatcggaatttgtgcccagccggcgccggatttattatttatgtttatgatttgccaaaaccggacggtttcggctacaaatacccggtggtgcctgatatcgcatttctgttcctttttaaaaatggcattcattgaaattcgcgcttttcagagagttttcttcccgtcagtttcatattcgtccgttggtctatgaaaacgaactgagcgaagaacggaggcgcgaggatgaagacagtcaccacagccttctgctgaatgtgtacagcagcagagggaacggaccgacccatcaacagcagcagaggaagcaaagccaacaacttcggttggtggtccaaaatatttggaaaacgaaattcgaacttttgtcagatattccactaatggcaacagcctcggccttccactcccgacaatgtctcggccgccttctgtggtcgcattggacgattctgtcggcacaccgtcgcccgtctgatgaggaggagaaagaagcaaatggccgaagacattctcaacgaatggatgcgatgccatcagattaagaacaacattattattttaatgcgaccttttcacattttgtacataaatgtaattaaatacaatgtcagtcaaattgttaaagataataatttcaatttgaatataaagtgattggttgtctttagggtttccattttaagcaaaattatagtccgatgaggaacagggaatcacacagttcatgggcaaatgaaagtaaagcttttaactagagtagagcggggacaaatgagtacctaggtcccggtattgcccaaaattcccggttcgctctactctacttttaactgagaatttatccaaaaaaagaaaattctaaaatttatttttgcagtgcgccttttcaaaaaaacattggaaaattttctctcacaaccctgtgtttgtcccactgactaagcttttcactgatttaatgacctttatccaaaaaatgtgcaaatggtttctttaacaatagtcaacaaaaaacatttaacgtcagagtctttcaaatcattgactgaagagtttcaatcttagccctaagaacgtcactctcagccctaaggcttacattctcatcacgaaggccggcattctcagcccgaacggcgacgttttgatcacgaaggcttatcttctcatcacgaaggccggcattctccgccaaaagactgacattctccgcccgcagactgacattctccgcccgcagactgacatgctccgccaaaagactgacattctcatcacgaagaccgacattcagcgcccgaaggccggcattctcaccccgaacggcgacgttttggttctgactgtcggtcctatcaatcgccaactgattaaaggtagcaaaggtttcatagagtgcgaacagaacttaatgaagattcaaattattagtataattaatagacagtgtttacgactaacactgcgaagtcttgttaatttgggtggcatttgcgttttctagcaggttgagaattcttccaaactgaatctcgaaatgtcctgcatttggagcttgactgtcttcgtggtgaggaaatccatagttgtatgccacctcaaaaaatgaagcgatcactaaagggaatttagtcggtaagcgttaatttaagatagacaaatgaacttacaattgcgcaattgtccgaggtggactggaagcatgtgtgccgccaaatttcccaaaagttccttcgccttggccaagtcgacccgtgctttctaaaagaaaataatttcgtctttaatattaataatctatttttccacccatttttgttttcgaatccaaattcgttgcctttccaatacaaaatagtcaaagtcaaaggaaacccgagttttcgcccaacagatgtcaaaacgaagtgaattgaccacttcagacaaattttctgggggcagggcaattccttttttcataatttggattctgaagcataaaatagtaattgtacaaatatttaaccaaatggatgatggcatttgttgggcagtgaccagtggatgacccgcgagttacgtacaataatcgtcaactaacaattgattgcttgcctctgancgggggaggacccaccagaagtgtgcgaggtacgcactcctcgcctccacccgcccctgntaacttttatctcctcattaaatttgt

SEQ ID NO: 872 - DNA, 1538 bp, Heterodera glycines
  misc_feature (1467)..(1467): n is a, c, g, or t
ttcattaaaattgttagcgtaaaaaaggtcaagttcatattcagagcacatgtcgttgtctctcagctcattactttgatatagacagcgtccgccattttaattgtgtgaaatttgtttggcagcgattgttgaactctgaagaaaaggcaaatcagtttcagtgtttaaattgttgtcattcagaagcgtagccaagcagcggagggatacgaaacatttttaccccccccccccccacccctcactccagggaggggatacgcgtggtataagccctttccccaggaaggaaaatccgccgtacggtcatcgcacatacattaatttcatagtaaccaaaaaagacaaaccaaaaaaaagattccgaacgtgtcgtcaaagtcgtccaatgcgcacaaacgtaaaaactttttgaaaacaataaacgctaaaatctgtacgtgaacgatcaaatctaaaattacaaagaaatgagagatgccaggaattaaaactagtagaattaagtcagagaaaaaaaattcgattagccaccctttaaacttctgtagactttaaacattcaattgataccaagaaggtagaactatatgaaaaattcttgacagtagcagagaatgttcttcattttttagttgaacgaaatcacaaaaatgtcataaaaattaaagaacaaatagtaattaattttctgttttttttcaactttatctctcattttttggttgaatacataagatgtattagtcaatttgcattacgcatttttttttttatcatttcgccatgaaaaaataaaattcaaatgatgccaggacgaattcatgccaaaaccggacggtttcggctacaaatacccggtggtgcctgatatcgcatttctgttcctttttaaaaatggcattcattgaaattcgcgcttttcagagagttttcttcccgtcagtttcatattcgtccgttggtctatgaaaacgaactgagcgaagaacggaggcgcgaggatgaagacagtcaccacagccttctgctgaatgtgtacagcagcagagggaacggaccgacccatcaacagcagcagaggaagcaaagccaacaacttcggttggtggtccaaaatatttggaaaacgaaattcgaacttttgtcagatattccactaatggcaacagcctcggccttccactcccgacaatgtctcggccgccttctgtggtcgcattggacgattctgtcggcacaccgtcgcccgtctgatgaggaggagaaagaagcaaatggccgaagacattctcaacgaatggatgcgatgccatcagattaagaacaacattattattttaatgcgaccttttcacattttgtacataaatgtaattaaatacaatgtcagtcaaattgttaaagataataatttcaatttgaatataaagtgattggttgtctttagggtttccattttanagcaaattatagtccgatgaggaacagggaatcacacagttcatgggcaaatgaaagtaaagcttttaact

SEQ ID NO: 873 - DNA, 3348 bp, Heterodera glycines
  misc_feature (3328)..(3328): n is a, c, g, or t
aaaaaatgataaacatgtatcaattaaaaaaataataaggaatcatattttgtcgataggaaaccaatgagtatacaaaaagaaaattttaaaaaatttaattcctgcagagggattgaaccaagggaaaaaagaaggaaaagtcaaggatagtagccactaggccatttgcaaaactgtgaatatattaattttttttttaattttttcctttaactccaagtttcgttcctaatttttcactcagccccccattcttaccagtgcttgtttttcccggttgccctaccgggaccgggacctgagcttttcaaaatccgggacctctgaggaccgggaatttccatcccggtcccggcgcactctacttaggggtgtattttttggttatattgcatttttgctaataaattctccgaaaaaatgtcgaatagtgaaaaaatagtaacaaaacgccaaaatagtgatttttagtgaccgatagtgacaacataatcgaaaaatttcaacggagaaatgtgttttttgagttcctttcttcaaaacaatttaaaacctaaaaattgcgaccctaattatgataccgccgggatttacgatttttcataaatatatgtacctaataataaaaaataggcaaaacgccctttcttttaggggtcttatcaacccgcgacttcagaaaaattctaatctttcattaaaaatatattttttccccaaaaattttaatatatgaaaaacttgggtttttaaaatttttactggtgatttctgacactttggcctactatctctttatatttaatagaattaaagttcaatgataccataattgttcagtttaattagggatgaaacgagttatggctgatcatcaaaataagcaatacacaaaacgcccataatttttgaattaacgctcaaaacattgccaatttttaatttttgaattaacgctcagaacatgccaattttggcactgggcttgtgacccattgccattgtgcctagtggaactggcataataattgttgaatttctttatcaccatttatttgtcatttatttagacttaacttttttattcaccgattggctgatcagcaatttattatggctttattatttactcgattgatcagaaatgtaattcttgttattgtgttttttaatgtcgtaagtttgcaaaaccattttatcttttgtttattaatatttttaggtttcctattatctccgctggaaatcttacaacatcgctgctcgggacttcaagaccgcttcggttaactctgcgagtaagttctgtctgttctcattttcatgttatttcgtttctttataaggtaacaatgcgctttcggcggtgtctaagtttcagtctgaactgaaacgcatcacaaagggacaatcggtttccagtgattcgacctgggtctgcatttattgcttattccgattggtctgtctttcatttgcttccttttcagattccactttctgttggaggattgcatttgcgtcttcagatcgcttatgccacactgttcgaagcgtaagtatttccattttcttgtttttgaatgtacttcgattttcctcacagtgtcactttattggtcgctccgtcgccgaccgtcggtcgttcgggcatccactgggccaattcgacttgtactgtgttagtgggggaagtcgtgcgccattccgatgcctacagcggactggtgaaagagacgttcacttcaggtttgtgtctttgttcatccatttttttacattgtggcaatagtcccttattatttttgttatatttttagcccaaaacttccgtcacggtcaatttgagagttacgtctacgagttcaaggagggcactcatgtcgtttgctactggcgtgggttcatccccgccagcggtttgtccgctttggtcggtgccgttgcttccggcgatttgctcggcgccgctcgtcttgtcttttcttattctaaggtccttcattattgcttttgtttaccaatattttttctttttttaggtgacctttgaaaacacctccgttttcttcgtggacactttcaatcacctcaaaaacaaagcgatgaagatggagttgtgagtgttcggatttcgacgttgtcacttctctttcatgtccgattcattttcgactcatcgcctcgctaacaaacgaaatcactttggcattaattcgatcattgggcttttgacttcccctttttatcaattgcacacctaactaaattgtaacagtacaactgacagtagtgcagaaatcaatttaaagaaatttaaaagggacatcttttggttgttttggattttcatttgttttttttattcttaaaagggttttgatcagcatttatttaattctgcccaactgcccgtttcctttggctcattgacattttttgtcattccaaatttgtattttagctcatcattaattatttattcgtacaatccatttttcaatctgttaaagaattcgtaataatgctcagttttaattggtaatattaactcctgaaaattatttcttagcaagtgattaaaatgccaaccgttattttattaataatttcccttttcgttacatttaattaattattttggttcggatggtttctgtggtcgctgggagagtgcatcttttgccgcgtgagttccataacatttgctaaattttaaagccaggaaaatgtagggctgctgcttcccccaccttttggtttcaacgaacacctaaattattaaataaaaaggtatcccattaggcaccgcctcttttggcaaatcgtttctttcatcggatgcgactaaaaagcctgataagacttcctttggcaatttgaacgactctgatcggattttcactaatctttacggtcgacatgactatcgcctcaaaggcgctttggcgagggtaattaattaatcagaaaattctatcgatcggcatttgccagatcattttaattaaaaaataaattttgtgatcttcagggcgattggttcaaaacaaaggaaattattctgaagggtcccaaatggattctcggcgaaattagcacttccgggctgcgcggccgaggcggggccggctttcccagcggaatgaagtggggcttcatgggtaaaccgttcgacggtcggcccaaatatttggtggtcaatgcagacgaggtacaccttcctttttacttttcatttgtcaatttccttttctttcagggcgagcccggcacatgcaaagatagagagataatggtacataaattagtttgatttcgatgnttattatttcataagtaaaa

SEQ ID NO: 874 - DNA, 6573 bp, Heterodera glycines
  misc_feature (2517)..(2517): n is a, c, g, or t
agtcttgtaaaggtcaaattttgaaactgtttccgatggcgatgccgatagaggctaacttcttaagtagtagttagtaaattgagttttcaaaaaacccatcttttccctttcatctttacttctctcccattttcattattgttatttctttagagacacgaccctcacaaattgatcgaaggttgtcttatcgcgggcgttgcaatgggcgcgagagccgcttacatttacatccgaggcgaattttacaacgaggcgtgcattctgcaagaatcaattcacgaagcttacaaagtgagtgcttttgacgaatttctgattttgacttattaaatgagaatgattgtggggaaagttgtttttcttcaggcgggttacattggaaaggactgtcttggcaccggctacaacttcgacattttcgtactaactcatatttcagttccatcaattttcttttttctttcctttggcaggtccatcgcggagcgggcgcttatatctgtggggaggaaacggtagaagaagaagaagaagaaatagcgaagaattaaactcggaattggtccgtttccaggcactcattgagtcgttggaagggaagcagggaaagccccggctgaagccgccatttcccgcggacatcggattgttcggctgtcctacgaccgtaacaaatgtaagcattgagaaagtgtgcgttttcatccttcggatcagaaaatctgtcttttggtaataaaaagcgctgtttttagtattttctccagttttttccttttcattctgtgccttttccttattgttaggttgaaactgtcgctgttgctcccgcaatttgtcgccgcggtggcgcatggtttgccagttttggcagggaaagaaaccgcgggacaaaggtaagaaaaaagtaaaataaatttcatatgaaatacttaaatttgccccgctcagttgtattgcatctccggccatgtcaatgatccgaccaccgttgaggaggaaatgtccatcccattgcgcgatttgatcgaaaggcacagtggtggagtgatcggtggttgggacaaccttttggccatcattcctggcggttcatctgtcccattgttaccgaagaggtgtttatttggcattccgacaatggccctaaagattcgtcttttagcatttgtgacgatgttctaatggatttcgatgcgcttgtccaagtgaattcggggcttggcacagcggcggtcattgttatgaacaaacaggttcaccgatacccttgaacacaatgccgcctcttcaagtctattgcactcgtcgaattaaattttaaaaaaacagggacaaaggaaaatcggaaaatttaagaacttttattttaaggcctttaaaaatcttcatagaatttttgtgagaaattcatgctaaacgaactgccctaaattgcgagtattgttccattcccatttcagtgtgacgttgtcaaatgcattgcgcgtcttgccgagttttacaaacacgaaagttgtggacagtgcacgccttgccgggaggggtgcaattggctgaacaaaataatgtggcgcttcgtccagggcaaaggagtgcccagcgaaattgacatgctgtgggaactgacaaagcaaatagaggggcacaccatttgcgctttgggagacgcagctgcttggccagtacaggtcaaaaaaaattttactgtaaatttcgccaaaaagttggtggtaattttatttttataattacctgaatgggaaaaacatcaacggattttggtggttttcaaaatttttataattttattttatttttagaattactgtattacaatatgatgtattttccgggtgtcagattttttcacgagagggggagaagggtctttttaatttatttttgtgttcttaatgaatttcttaatttagggactgatccgacattttcgtcctgaattggagaggcgcatggcgaaatatgcggagagtcatcccgaaataaaggaaactttagcgaccgcataaaaacctttgttcatttgcttggattaggtgaatttttgctatgtttgtacagagtaaaaaatgatggataggctcataaataattatttattcgcttaattagttgttccgttttaattaatgaactcattgcgcaattggtttcggcacattaagctcaaattggccgcttcgatttgagttccccgcgggcctataaaatgctatgaccacaacttttttgactgcttcttctgagtgtccatttgtaattttctcgtccttttccatctgttgtgggaatgaacgcattgtcgaccgaccgactccgacctttggcgaaagggactgactttagaattgcccaaatgcattttttaccattgcaaaaagaatacctctctggtcgatttccatacgatttgtgtgaagtaattagtccctttatttttgtaatcgtttttcaattattttccatcaaattaccttcttgccagcctgnggagtcgtattcgtactttctgttctccgcgtaccaatagtcgaccatttcgcgggcgcatttcccctcggggaaaacagttacattttcacccactccttgattgttgtctgacagtgccattccttcccaactgcccatttattaccgctcatttcggcaaatgacacatggccttgccatgcgattcggtccgcccattctttggccatttcgctgagttcctcgcagagcgtcaattcggggcatccgtgcttaaaaaatagtgtgggtgaatgtgcggggactctccctttatggtcaccaatttgcgcagttcattgtgccgttccacgaattcctttgtgaattccctcccaaattccctttcattttccattttggcattggttttgtccgaattatgggaaggcgaaaggggacgaaagaacggaacggaggaggaggaaaaggacataaaaacactaaaaaaacaaaggaaaattgggggaagaatggggtttttgaaggacgaaaatgaggaaaagacgaaagaacggacagagggaggaaaagcaagtgacgtgaagaaaggaaagaagaaaacaagacggcgggagtatcgaattgaaagcattgggcggagggggaaattggcacggcactcgccccccccccctccatctccaatttgtggacactctccgctttcgagagtccacgggccatacaaatatggagcagttgggcccatgaataaattagctgccagcaaaagaatggaagaaaaaagtgacgagaaaaggtttctttcccataatgttcgccccccgcacttgggtatttatttatcaaaaccgataaaattaatgtaaatgtttgattgttcatcctccgattatgtatatcctgctcaaaaattgtacatttaaaatacacacacaaaaagagatcagaacacaaagcgttttctcaatggactgatcgactgaatgagggcgactgttggtgcgttctccgccgctgctcctcaaagcgtttctccatctcatccagcagtttgggggtgaagcggacgaccaatttgaccctgcctttggcactcttcagcaaacggaccgcagtttcgtggttctccctttcaacattctgaaggagacagagaatgaatgccaatggaatggtgaaaatgccaatggaaagagagtccttttttaccactccgttgacggctatcaattggtcgcctcgtttcaatccgccgtgaaggtcggccacgccgcctggaattgaaaaaagcatatttcggtcaaaagtgccattttaatgacccgggataatccgagaaacgtaaatgggcgagttttgctccttgccgcccatgacgttgaagccgagtccctggtcagtcttcggcagatcgatcacccgcggatgggccgaaccctcggcggcggaaaaaacggcgacctaaaaaaagccaccgtcatcagtgtacgagacaaaaagcaaaacgaaaaattcaccgtagacttggcagcggcattcgacagaaaagccttgggaaaattggcacagtaaaatttccgaatgattaatcagcatttttcccccataaaatggtttaaaacactttgtcctttttcaccgtttcttccgaacgttcggcagcactttgttgttgtgcgtagacaaattcatacacatttttgaccgcattgaaaaagggcgattggatattttgctgaaggcgcaccaaattgggcatttccctgccgcttttctgcagaatccgtccaatcagttcagtcatccgatgcaaatctgacggcgaatttcattttgcctaagggcaaaaaggacgactcaccacgctcgatggacaattcggcacgatcattaatgaattcaccattggccatcggatggagagaatttatttattaaaattagggttgagcgggaccgggacctgaatacggacaactgagtaccgaagtcacggttttgaccgggactagtcccggttttttcccggttttcccagccaaaaattcccggtttttcaacccgaaaaggtcccggtcccgtatttgcccaaaattcccggtcccgctcaactctatttaaaattagagagagaaaagaaagacggcgcggtttggaaaaagccaaagaaataaaataaaaacaaataaaaaaaatttttcttttgtataacaatgcacgattttaatgactgactaagcggcggaatttacaataattttgtaaatttaaatacataattcactaaaattctgttggcggttaaaaaaggaatcacaaagagaattaaatgcaaaaagaaataaattaatcggactcatcgtacaaaaggagaggaaatgaggaggaggaaaaatgggacatttgcgaaacgaaaaagaaattcagcggacaattcacaattcgtcgtgtcggaactcttttctgaatccgtcgatctcccaaatgctggaggaatatctgccaaagctttggaacagagcgaccaaatcatttctaaacggaaaatggcaaatttacttcattaattgtgaatgaatttgccaaatctaataaatattaataatgttattttaatgttttttatgtcgccatttatgactcaaaatcagaatttgaagctcttttgggcataggcacaaaagccggaggcgtaaatttaatgcaaaccgaaagccgaagccatggtggaagtcgatttttgaacgaaaataaggaaaaatttgtggaagagggaaaaagatcaaatccatcggcccctgaatcagttgatcccttatcgtttttaattccttttcttcaccttgtcaatttgaaaagtccgccgttcgctgcactttctccgttttccgtttgctctttccttccgttcgctttccctccgtttccgttccgcggaaggtccgaaaagagcactttcagtgccgttcccattccgtgcgtttgcaatttgccccaaagtcggcacttgtcgcagccgacacagtccataatacgcgaaatgttccaaaagtgctggcgaaactcttccttcagcagacgggcgtgggactcttggaaattctgaaagaaagacgcatttgaagtcaaatccgattgggaaaagggcaaaaaaggaaataaaaaatgaatgaaaatgggccaatgcctaccgagaaaagttgagtctcgtcgaattggttggggaactctttgagcacggcgaggaagtgttccaaggattgctgcgtttctcggtcttcctgacaattacgagttttggtattattttgtttatgcgttcctttggcccagaaatggtcccgggattggcttgagtggacacgtgtccctaatgccccctttccctcttcgttttgcccttcccaattgtgcccacaattcattattcacctgctcgttgcccgtgtagaacagttgactttttcggatgtacggcgtcgctttgaccaatgccctcagttccttcgcatttccattcattttctcattttccaatgatttttgggccaccactcaccagcatgtaagtgaagtacaaattcctcaaccgttcgggcccttctttgccccatttcgtaccgaagcgattttcaaaaaactagaaaaatcaagcgatgtcagcattaattaaaatttgttttacttcaacatttcggtaccaagtgccggtgccgaaaccgccgggggctaaaaggaaaattaagataatgcaaaaataagtctctggaaagcggataatacccggtctgtaattgtgggccgcaatcgaaacggtaatggccgagtgaaggccggagatgagccgatagaacactctcttctccaaacacatccctaaaggacaaaggcaatgaattgcgatgtttaattggtggcaattgcaaaaataaacccgttggcgtcggttggaggagaaactttttgtcgaatttcgggtcgggtcttaagaaaaaacaaagtgtcataatgccaaagggggtggacgacttgaaacagttctcgttgtaaatgcactcccaaactttg

SEQ ID NO: 875 - DNA, 8168 bp, Heterodera glycines
  misc_feature (7401)..(7401): n is a, c, g, or t
  misc_feature (8164)..(8164): n is a, c, g, or t
tggagtgagataaagcagcggacgatgcttatcacctctccttcgatacttttatctgtacgcatttgtacaaaaaaactttttaaaaatgcactttaaaattctgacaattggggcattaaataagaatgttgtcaataatttttcgatttgagaattttttgtccattttccctctactgttaaaaattgaaaaaatgccaatttaccttcgacttcgcaaaatttgttgctgttgtcctcaaacatgtccaattcgcgcagttgcgctctgtcaaattcacttagcgaatcgtccagcgggtcgaatttgttactttcacttccaccgcacgaatcattcgaatttgactgaaaggaaaaagaaataaattttgtggaaaggaaaacaaaaagaatgacaccaaattttaaggcattttgtggttgaaaaaggcatcttaaaacaaaattgaacagaacaaaaccattaaaatccaaatttgatgtaatttcaaaaaacgaaggcccaccgtacggacatttccatcggcggaggtggaaaaatttgcggaacgaaccgccgacaatggcgcgatgggctcctttagcgccggtggcacttcgtcgtcgcaatatccgatggaacattctttggaggagcattggcccgcttcgtcttcccaaaacggacacggcttggccatatttacctgaatatgaggggacaatttgagggaaaatggtcagaaattgggacttttggaggacggaccttgtagaatttgaaaggctccttttgcaaaatgttctgcaaagccgggtaaatcttcgcgttgttaaacacatcgattgaattcgagtcgcacgcgcaactgtcaatcgcttcgccgactttgcaaaagcaaaatctgtggggcgagtcgaactgacaattgacgaaatgaacgaaggaaagaaacaccaaaagggaactgagaaagagtaaaaaacgaagacaaaacgcggattttggcacagaacgaataatcatccaattgttgtcagaaaaaaataaaattaatctgctcaattaccaaaattaacaactttatttaattaaacgtaaaaatttgattaaaaatttagagaatgatttcacgcatttcaatttgaaatttgtttagctgggcatgagagagggcacccgtccacgtgcactaatccgaaagcaaaaccaaaacagctgcgcttacgacgacgacgacacgacggcagagaacactcattctcattgtcagtaccacaattcgtcgtggcttttggcaaaatgtttttttttatttaaataattaaatgataaaatttacactcttacggtaattttgtctttctcaaaataaaaaacataatttttattcgatttgcttttaaatatttctcctcattaattaatgatctgattaacaattgaatttgtcctctggcggcttcaaattaatataattaattacaataattaattacacatctcttcttttgctcttccttctctttgtcagggaatggaaggtgagtcggttgttgacgatcgcgagaccgaacgtgagcacggggagaccaaagttctgctaaacggcgcaactcacaaatgataaattaaattaccaatccaaaagtcgcgagtcaatttcggcgattaaacggcgcatttcgtcggtttcatgctgaaaatagttaataatttccttaaatttgaaatgttaattttcttcccaactgttttggccattttccgcgtgtacatataaggcaccaccaatccccggggctctcccctcggcgtttttgccgcttcaaaaaatgtccatcttcgcctgtccgagtgctgctcccattgtccactggcgggctaaagcaaaaaaattttaaaatgccaccaaaaaaagagaaaataaaacaattggagtcgaatggacggagcagtgagtgtgggaggaggaagaaggagaagcggagagagaagcagtcactcgctgcacattctgctgacaatggctggtcaaaaagctgagaaatttgcaaaaaaaaggcaaaaagtgactcattcatttgggacgaaccgacggacgaagggggcgccgacggtggcggaggaactgacagtgagcgcaacgggcgaagaagtgagggaggaggaagcgatggccaagcggacattctgccgacggcgaaggatgggaaaatggcaaacatattaatttcgtgtttataaacccttttcggtgctattcactcacttttgcggatgagtcggccgattcgtttgatccgtcccttcccatcgaatttccctcctcccgactccgtcgtcccattgggctttgctctgtcggatgtcgcacgaatgaattctgctcagatgactcggtcaaagtttccttggtggaccactctttcattcactgtccttggtaccgtgctgtcccttggtttccgcccacctcctcgaccagttcatttgcggtttggttgagcagcgaatggtccgtcggttggtagcgaaatccatggacacagcaaaagtccgtttgagtggactttgagtactgaatccgcccatttatccatcatttatggcttattttttggcatttgcctggttcatccgcatttgaagcctccgaaggatcgcttctctccgcctccgtccgaatggaaacagtttaatcactcggcgcaaattgccttccgacagggcgatgttcggccattgtcgtgccgcgcactgggccttcccagcagacatccgtcgattgttctgtttgaattgcttttgttgtggcgcgtcgtccccgggcgccgtctcccccaaatccgtcgattgatctgaacactttcactgatcagcagccgtttccgtttcaacaaatgactccattaaccgtcaattacgtaattacccccctccctttttctgtgtcccgccatttccccccccccccccccccccctctatttccatttccattttattctgttcccatttgtctctgtcccccctttactccttcgttgccttctccgctgccaaactttccacaggtcgaccatgctcatcttcggcttcatcgttgcggttatttcttccaccgttggtccgcctgcctccacatattcttccatcatcgtcagcaaaagttcctcgaataattcctccaatttcaattgaatgacattgatgcacattgaaacctatttgggagcgggggagaaggaaatgggtttaagaaggccaaaaagggaaatggccgaaaagcggtggaaattcaagagtctcgagcaggaaaaaatggcggagaccagggaaagtccgacaatgatgaagccgaaaatgatgaacatatcctcggaatttgtgggggtcacatcgcctgaaacattcgctgataaaacgcatttaaaaagaaacattttgaaaagtaaattttaaaatgcgcaaaagtaccgtatccgatggtggtcaatgagcaaaagaaaaaataaaagctcttaaagtagtcccaatccttctcgaatttgaggaaaatggccgcacaaagaaactgagaaattaaaacataaaatgaaaaaggaggtaaaaatgacggaccatccaagcgaaggccacgccgatggcctaaaggggaagggacaccgatcagtgatcagctggggaatggaggaattctgatcagtgatcagctatgttgacttcaaccaatgatcattttgggtggatgactttaattgcaggtctgttcgaggaactccgaacagtgagaagctgataaattcaatggcttggaaccgaccaaaagcacgggcattcggcccgtcccgcgcacttttcccttcagcttttccgcgtccttaacacagctgacaaattccatgaaccaaatcaatttgttccaaaagtgttcgaaacagagcaaaaagaaacggcccaatttgtgcagaaccataaaagtcattctttaaggggaaatttcaaattgagacgaaatgagagacaaatggcattttacggaattccaatggcggcataaacctaaataaagggaggggacaaacaattcgagaattacagcaaattagtttcataaaattcataaaacgcaccatggcggccaattttcccaaattggtttttggcgtaatgttaccgtacccaatggttgagtaagtggttactgtaagaaggaggaaaggaatttgtgccatttttggcccaccgaccggccaaaaacatcgaattccaaaaggtccaactgggcgccaatgtgtgccgaagtccgacgaactcgttgaactcgcggatgctctttgtcagtttcgtctttttgtgatccgtcgagttcagttccacgcccaactcccaacaccgttcagccaactgaaaatgccaataattcgaaaccattcggtgctcacctgttcagtgtaatttttcagcgccacaattcttccaatgcttgacttggaagggctcaattggaaatgcgaccgccagtggcgctccgggttttttggatgaagcagagaggactttggaataaataatgaatgattgttggaaattaatcagtgatttatcagcagtgactctgacttaagtgctttatcaccttatatgtctgctgatctgaaaattgaacaagcaaagaatgagagacggattcaatcaacaaataccggtcaagaagtacaccagcagcacataccaataaatggtctgaaaatcatttctattccatccaattcatcccccaattgcccattttttctcacttttctgatccgattcatggcaaattgcttgtatttgcgcatctctttctttagcgtctgattagaaattaattaatcggataaaaatgttttaaataggcggacaaaaagcaccgaaatgctcgcgaatgtctccaatcggtccctattctgagaattggccaaattgtaatggccagtcatctcgcgaatgcgttgttcgaccagcagtacctcggccaaaatttgaatctctgtgaaacaaaatggtttacttcggctaataaatagttaattagtctgtctcatttggcactctttccaattgacttcccctcacttccgctgctcaccttctctgtcgaccatctccttcttacgtatcaacatgttctgttccgctggatgttcaattgtatagaaaatggccccgccaagaaaagagtaaatgacaaggacgagaattggcaaaaggtaatggacccgggacttttcgtaaatactctttgaaagtggaaagggaaaaaggcggagattagtggggacaacggactgatcagcggagaatgaattagtaaattgtctggctattgcgtttcgattggtccgtctaattcagccgatcagatttcgcaattcgccacttttctgatggtctgtgaatcactgaccagcaacacttcggtcactcgttggaaacgtgtcttctcctttttgatcaaagacttttggacaaaaaatgccgaaggttttcgtgacgatggtccaataaaaagggaagtctttcgagaagaagcaatgttagcggaggaaacgggcaaattgtagcgaaagccattcccgaaaggcaccaaattgacgccgagaaaagtcagcccttaagaaagtgagggaaattagcacggacagcagcccacagaccatcggggccaatcatttgagtggcctaaaagaaaagaggaacaaatggaacaacggacggacgcaaaaagtcaattccgaatcccgatcccagactttttcaaaaatccattctctaaaatagacagtcacttcggaaggacctgttcaaaagagcaggtagaaacacgcgaactaaacaaacagaataagtgatcgcctttttttggggggggggggggggagaaggaccctgcgacgcaattcattggttagcatcaaagcggcggacttgcggcgaaggcgcggcccgaaaaccgaattggcagccgattgcatcatttgctgacggatttcattgactgattaaccaaaaagcataaaagacaaatcaattggcacatgcacaaattcgcaaatttaaagggccccgagaaaataggacggtcggcgggtggagggacggaggcattggccaagtgccgaaacgctctttcttggcttttccctccgctcgttggccacatgggccttttcaatgctatccctttctttaacagattcgattcattgtcctgagataatcaaattaaatatctcccatttaaacacttttattcgaaatgcctgccaaatgcgagcaaatgaccaaaacgaaaattcaataatctttttgtgatctctttttcaaagactcgtgaaccgataccgagaatgacccccgatagttgagaccgatgaattcacatggattatctttatccagcatggaaatgttaatgataaatcattttatgctcaaattcttagcccggcatttgactgatttttttgaggcaaatacttagtttttcttctcgagtttgttccggtatcagcttaggcttacttcagcttaggcttaggcctaggcttaagcttaggcttaggcctataaccgtgttcagcaaactcgaaatctgtcttatgttctttttatagtgcggtcacctgagtcccagctgagtttggcactctaattccggcacttttcagcctgaaaaagggcaagcgcgcccctaattaaatctttacaacccatttttaacctttttacatcgattctgacgtttttaagcaattttgagtatggtgactatgatcaatatttaccttaatttaatccatatcggtttacagctgcattaaacaaaatgctcgatacagagtttcattattagggctcggatttatagttgctaaaaactgccaaaataattagtttttagtttctaaaaatccctcaaaatagttgctaaaaatgggtaaatagttgcaaaaaagtttcaaatttaggggtgtaaaatcgaaaattttattcaaaagtcaacaaatattaatccaaatcattattgaaattcacattgcaaataagtagcatttcaagatgttcgggagatagacatgagcgattgtcagtcaaaatagatttgtaaattgaaaatgatcgttcaacatcacatgaagtcaggggggcgtatttgtaaagtgaaatcagattgggaggcataccgaaattgattttatgaccagatagaatttttccaatatcacaaattgtatcaaatcccggggtttttgcaatgacagcatcgaatttccggcggattttcgctccaatttctcccgttgacgaaaagacagcttcgcggacttcacacagaatgttggcacattcgtgtatcgtaagcncctccttctccaaacgagtaattgctccggggagagaaccaaaattggccgcaatgtaggcaatgtcaaggggcactgttgtcatcgaaaagcatctttgagatttggcaatacactgggcctcctcagggtcaaatgaatcaacgacctgaaactttaaaaaaaaattaattaaaccaattcattcacttctttaatggcttcgaaattgtgagagtaaaagttgacggcatcaagccaagtgccccatcgtgtgataatgggtttgggaaccagaggaactgtaggtaatttctttctgtagaaagcaacacgtgacggtgctttgcgaaacaccattttggtagaagaaattaattcgtcgacgtctttagccatacagcgtccatttctgtctgtcgtttcgtcaaccgaacaccaaacgaatccattttcgccaatgtcgtccttgatttttgacaaaacctaaaggaaaaaaattggtcaatcaaaaaatttcaaattttaccccttcaaaacaatttttcacataattgtttctgagggtcgtacaatgcggaatggatcttccgcaatatttctccaaaaaagccttgaatgaaggattgttgaccttaaaaaaaattaaattgttaaaaatgaatatattattcactttacaaagaggaatattcgctgaaagcagcattgaacacaattcagcagcaaatttatcaacaacaaaaggaggactgatcaatggttgcttttgttttgacgacanaaaa

SEQ ID NO: 876 - DNA, 6961 bp, Heterodera glycines
ccaacaaagcgcagcgaatcgcaaactgaacatcagcagcagaacaactgaacagcgcaaagcccacggcaaacaacccacaatggcaagcctaatccaaaagggcatcacattcacactcaaggcgctggatagtgccagaacgaccacggcactttcactacatccagacgccgacctctcaaactgggaatacgcagtcaaattggagactcaatgcactcgcgtgaacagagaagtccaaacaatggaagcacaactggacaatctgcgcaacctctccaacaattggattgacctgctaaaccgcctcgaaggagcagaaaaagacaaaggcgaaaaggaatacgtgaaattcgacacgcatgagaaaattgccgaacgccatgacgcggctacaaccaaactccgggatctgggggatctcgaagcaatgctcagtgccgatgccaaactgtaccgaggcagagcagaaagagaagcaagagcagatcaacaggcaaatccgccaccacaagcagcaacgccacctatggcagcaccgacattcacggcaccgctctatcaattccagccaatccagctggacaaattcttcggccaaaagcgaaaatggcccgaattctacgagtctttcaaatcagccatcggcagccaaacaatcagcaaagcacagaagctgaacttgctccgcaatcttctgggcggagaagcacgggaactcattgctgggttccgccttgaggaccaaactacgagacggtcctccagctgctgaaggacacttacggtgcacctgaagagcacatcagagcgctacactttgagctggctaatctcaagacgtgccgaagtctccgagacacaaaagactttctgcttcagctcgaacgactgacaagagagctgaacaatgccggagaggacatcgagggaccgcaggtgttcctcatgttggagaaaaagctgactccagcattcctacgcaacatcctcaacaaaaagggagaggatccggcaaattggacaacaacaaaattccgggacgttcttaacgaagcagttcgcaaggaagttcaaattcaagaggtgatgggtgagtacggacaccaccatcagccactcaatcggccagcaaggccgcaagcacaagcacatcaggttcagcgagcacgcatgccgacagcaaatttccggaacagaaatgcatctcccgccaatcgggaacgcactttcatgtcctcaacaattgaggaggttcagcaacgaatgaaccacagaccgcaactgcgaaagtcccaacagaggggatcaaggccaactcaagcgccttacaacgtgccaatccggaatggcacagcacaagcagggtcaaggaatccgccttcaccctgcatcttctgcaatggcactcactggaatgagaaatgccagaaactcagtaccgttcagcaacggtcagcctttgttcgagaaaagggcttatgctttaagtgcatgaaaacaaatcatcgggcaaacgaatgcccccgaccagcaaaatgctacaaatgcaaacggtcacacccaccagcactttgtcctgaaggtaacaactcaatgacacaacatgccgccgccgtcgttacagaacgaccccaaggcgaaagtgaatccacgaatcagacagcacaactgtgcaacgccatccaaagcaaggacacccgagcgctgttaatgacagcgaaggccacgatttacaatccggcacagccatgcctcagcatgatggcaacagtgttcatagacccgggaagccaccggtcattcgtctcatgcaacacagccaagcagttggaactgaccaaccttggaacggaagaatgcttcctcacaagctttggcgagcgagagccaaagagatacgtaagcgaccgcgtcgctattggctttttgtgtcccgacggggaccgattcatcttcaacctgaacgcactgaagttcttgttgaacaatttgccagtcttacaactcaatgaaatggacaacatgcagcttcaacagaagaagctttacataccacatgagtcaagacagcctgacgtcatgctgggtatggacgtgtggcacgaactgcaagtgcaacccgtcgaacgactgccaagcggcttcacgatttgtcaatcgaaaattggcaaaatcatcagcggatccgggcgcattgaactcagtcaaccgtccaacgtcacattcgtcgtcacagtgacggacgaaaatgtcttcaccacagaggaagacttgaaagccgacgatgaactcaacaagttctacggcttgaacatcatcggcatggacgattcatcaccaccgattgaccacgacgaagtcatgaaaaacttcaaacggaatttgtcgttcgtcaacgaccggtaccaaatcgcattgccgtggaatgacaaagtgacacagttgccaacgaattatcatcaggcgaaagcaaggctaataagcctcgtccgaaaactgcggacaatcaacttggtcgacgagtaccaagttattttggatgaacaactgcagaatggcatcattgaaagggctaacccagaccattcttgtggaccagtgcattatctgccacacagggcggtaattcgcacggacagagccacaacgaagattcggatcgtgatggatgcctcagcaaagcccaaatccactccatcggcaccatcactcaacgaatgcctgcacacgggtccgttactgctcaaggacttgacaggcattctgctccgcttccgtcaaatggaaaaagtcgtactggccgacattgaaaaagcattcctacaagtgggagtacgagagcaagacagagacgctacacgattcctttggttggcaaatccaaaggaggcaaacctcgaccaactcagaaaagaggacatccacattctccggttctgccgagttagcttcggcttgaccgtgtcgccatttcttctaaatgccacaatacgtgaacacatggcactctacgacacagatgtggcacaacggataagcaacaacctgtacgtggacaacatcatgatggaagtgaagccgggcgaaaacatccgagaaattgccacagaggcaaaaaacatttttgagtctgccgggatgcgaatccgtgaattctacgggagccacatcgaagagctaaaagagctcgactcctcagacttggccaacgaattggaagacactaaggtgttgggcatcaagtggaagccaaaatacgaccaactcgttttctccatgccacacttcgacagcccaatcaccaagcgaaacattctttcgcacattgccaaagtatatgacccactgggactcatttcaccggcacttctgccagcaaaacacttccttcaaatcgtccaaaacgcaaattacaaatgggacgacccgttggcagaggatttgaaattgatgtggctaaaactgatgcgtgcgtgggacggatttggattcaactcactcgtcgaattcccacgccacatcatcgctgggataagcgaagagttccattgcttttgtgatgcgagcaaatctggtctgggtatcgcgttgtaccaggtcgcagaaacgcattacaacaaaagggaaagcaatttgatcttcggcaaaagccacgtcaagccactcaaggtcgcggaccacgattcgaccatacccaaattggaactccaggcgctcactttgggagtcaaggctaccaagttcgtccaaacacagctcaactttgccgacagccaagtcattttgtggacggacagccaatgctcgattgagcggttgaaggaaaaccgcacccacgacagattcgtagtcaatcggctaaagaagataagagaggcaaacttcaaagtccgacacatccgaacagctgagaatccagcagacatcgcctcacgcggcacagacccgcaaagcctccaagcatcattgctttggcgatatgggccagcctggctcaccaagacacacaaatggccagaaacgaacgtcacttacactcccggagaagagacacgggaagagactgagccaccgatcgtcgagtggagtgcaacactccaagaagagcagaaattcagcccgtcaatccaatttgaaagattttcgaattggaaccggctcaaggcggcagccgcctatgccattcgtttcgctttggcacttcttcaaaaaagaaatgtcgttccggcgatcgattcacttctgtatcagcaagaaagacaagcggggctgctaacagcaaaggaattggaaaatgccgaaacatggattttgttggaaacccaacgtcttcactcgcccacagaaacagccacaaacaatttaaaattgtccagctcgagctccattgagccactgagatgccaggggcgattggaaaacgccgatctgccctacgaaagcaagcacccgacctttttaccaacagaagcctggaccaccaagctcatcgttatccactacgatcgggcgctgaaacactgcggcccacggacgcttctctcaaaactccgagaaaagtattggataccaaaaggccgacagacagtccaacacatcctcaactccaacaaattcggatgtttgaagtgcagacgggagagactcaagccatatgcttatccggacgctcctgacctgccaaaggagcgagtcacggaaacacgacccttcaatcataccggagttgactacttcggaccgctgaaagtcaagcaaggaaacacgactgtgaaagtgtatgtggcacttttcacatgcctcgtcatcagagcgattcatctcgaggtagccgaggactactcagctgaagcatttctgagagccttccggcgatttgctgcacggcgcggcattccaagtttgatgatgtccgaccaagggacaaatttcaccgccggcgccaaaacgatccaagaaaattggacaacgcaattgttcccaaatgaaatccgtggacaattggcacaccaaggagtcacatggctcttcaacacggcacacgcaccttggcgaggtggtgcctgggaacgacttgttggcataacaaaaaatgccttacgacgaagcatcggtcgaaatctcctcacgtgggaggaattctgcacactcaccgttgagattgaaacgatcgtcaattatcggccattgacattcgagtcggatcgtgaaccgagccccgtcattcgaccaatcgattttctgattccgtactggtctgcggaaacgaatttcccagtgattgacgtggatccagaggatcctgagtacacaccaactccaaacaaactgacggaaatgctgcataaaacggacaaaagactcacccgtttttgggatctgtggagatcagaatatctcctatcgctgcgcgaacggccaagtctaaaccaaaaccacggagcacacatgccccaagaaggggatgtggtgttggtcgaggaggatggcactcctcgatccgtctggacaatggccagaattcttaagcttcagaggggacgagacggggaaactcgttccgccctcattttgcttaatggaaaggaaaaatggagggcaacgaaccaacttttcccaatggaagttcaatccgaaattccagaaacccagctcatcgcattcatcatggacgtcgacatggattcagtctcactgcccggaagcgaagacgaagcttcagagcgatcggcacccaactttaaaattccaaagaagcgccgcgccttcttgcgaccgatcggtcaacagcatagccctttgcaagggcctcgtcgaaaaaagatggaacttggcgactccggactacgcaagctctttgccgcaataagcgaagagcaaggcggcagcaaggcgacgacaaatgcgataacggagagccgacagatggaaaaggccccggagcgcgtcagaaaggagcacgacaaggaaatggccagaagacaaagagaaaaggtccaacgaataccaacggaggaaatcaggcagaaattggccgccctcccacacatcacagtttcttcggagaatgccgaaacacagagaaaggagcgaaaggaaaacgaagtgcgtcgcaaaaacaatcagcagtccacaagcgaaggatggaagcaactcgccaagcaactggattatgacttgaaggatcagcccgatgaaccagccctggaacggcgaaaagctaccgaagaacagtcggtaaaaggaagagaagtcgaacggcgtcaaattgcacggaaaaaaggcatcgtgcaaatgaagaagcgcgcaaaaccgctgaagtttcccaccgaagatgaaaccttgctgagctacgtaaagcggttttacgacaaggataattgggttctctcttggaaaagccgacgtattctggacgaacttcatgacttggagaacgaaggacgttggttcttataccacgcagcaaatggcgctcaactcactatctcaagaacgttcgatggaacacgaccatttgcagaatttcgatatgtggaagaaggacacctcgtggatctgactccaaaccaagtcatcttccgccaaacggttccagatgagcccgaagagagtccagcgagcaataataaaaagttggaagagaaggcagaaaaaccggcacgcaacgacaaacgaacaactctggccactcggaaggtggaggagtattgcacggcagagatgaagcagaacagctactgctatgacatatttgaaccgtgcgacgcaacgcacgaaacgtgtgccaagtcggcaacgtacagcgctcttgccgaaaacagacacaagctcgaagagttcaacaactgccatgccagctgcctctttgaggccctcatcttcagctggctgtcaaggaacacaaatctgcccgacagcgaagtatcaagaatgcatgaagaactgatcaagc

SEQ ID NO: 877 - DNA, 4268 bp, Heterodera glycines
aaacgactttgatcattggcaaggaggacaacgccaaaatggatcatgaacgaagaagcacctctttgatgtttgccgccagatgaaaggcaggattcatcgtgttcaatcgtgagatgggagaagcccgaaaaatctctgatcggataaggcaacgaatggaagaaccaatggaaattgacaacgaaatagtgccgtccacctcgagtgttgtttcgagcagccaggcatccagagctaccatggcttcaagcagtgtcatcacactgatgttgctcagtcttctaggccttcttcttgtgccatcagtttccgcagctccactgcgaatacaccgagcaagtctgtcactaacagcacaaaattatttgaaagcaatgcataactactataacacgctcacgacgacaaattcaactgataccacgacagccacaagtttgccatggacaagcacaacttcaaattggccaatttcgactttgccgacactcacaacgacgatggtcacacgcacagctccaccagggaccacgacgacgactcagcgaacaacccttgcaacgagagcaaggacacggatccagtatgtcaccagggcaagaatgcagaccacgacagagccaacaacacgcaccaggccggtcaaatcgtcaaaacgagacctcgggatcaaccgagatggccatgacattttctggtgttcggatcgcggaagcacgacccggcaacgaagtatcaagaatgcatgaagaactgatcaagcccaccacggaattggaagaagtggctaaacttttccacgacgaacaaatcgtgaaaaacaaacgcggactcgggaaggatcaacaagtgatgaaagtcatcgaaatctggagaaattcatgcgatcgcttcggagagcttttcaccaagccagcgatgcagcagatcaaattccggccaatcctgattgaacacaatggccagtataaccaatggatcaaccgccaaaacacgcgaatggcggaattattttccaaaatgcgaacgaaggctcagcatccgacctacttgagctacaactgcacaacggtgatcgtcggcgataacgtagcggaacttttcaccccactatttgatgatgccaaatggttcacgcatttcccagcggacacatgccgattgatacctgggccaaacgtcaaacatatcatcatgggatatcaagccacggacgagaacatggcggcgcagttggcaccgatgatccacaaattggcaaggacagaaatccaaacgactttgatcattggcaaggaggacaacgccaaatggatcatgaacaagaagcacctctttgatgtttgccgccagttgaaggcaggattcatcgtgttcaatcgtgagatgggagaagcccgaaaaatctctgatcggataaggcaacgaatggaagaaccaatggaaattgacaacgaaatagtgccgtccacctcgagtgttgtttcgagcagccaggcatccagagctaccatggcttcaagcagtgtcatcacactgatgttgctcagtcttctaggccttcttcttgtgccatcagtttccgcagctccactgcgaatacaccgagcaagtctgtcactaacagcacaaaattatttgaaagcaatgcataactactataacacgctcacgacgacaaattcaactgataccacgacagccacaagtttgccatggacaagcacaacttcaaattggccaatttcgactttgccgacactcacaacgacgatggtcacacgcacagctccaccagggaccacgacgacgactcagcgaacaacccttgcaacgagagcaaggacacggatccagtatgtcaccagggcaagaatgcagaccacgacagagccaacaacacgcaccaggccggtcaaatcgtcaaaacgagacctcgggatcaaccgagatggccatgacattttctggtgttcggatcgcggaagcacgatttgggaactcaagggcacggaaaattcacctttttgccgccccccgccatcactcactgctcaatggcacaacctggcaattgagctcttcgtaaaagtcatcaagcccgaacagatcacctttgcatggcattgttctgtaaagcgcactacggagcgctattacactaatcttttggccgataagttcgtcaccatcgagaaggagtttccaccggtcaacaagcggatctgcaaacaaatggccattcaccaggaatacccattcgccaaatctgaaatgacgaaccacgaaggacagctgtggtcgacgaacgacgagatggaagtcaacttccccggaccaatcgccggactgttcaaaggggaacaaatcagcacggcaaccaattgctttactcaaccagcaacactgttcgtcaaacggcacaacttacagatgttctcgccggtccaccatgttcaaaactgccaatacgccaccgaattctgccaactgcccgacaacacgactctcatttggaaatcaacctgcaatggcaatgaatgccaaacgtgtgactatgagaaagcggaaatcatcaacggcaaattcactgcggcctacggcgaatcaatggcaacttggatctccgaagatcaccaaaaggcattaacgttcgtcaaaaatgcgccagaattcatcgcctgtgatggcacacggatcgtcatgtccgaacagaatttcggaatcgccaaggatcagtacgaagacatcgtaagcacaacaacgagatggaaaagagggatccgaccagagcagctcgcatcacaactctcggcatcacaggtggcaacaagcgttgcgttgaatcagctctacacgcgggagtgccagcgaaacacgagagcagccaacccaactctccaagccagacgcttactacgacagcctaacgtccaggcgcgctggatcggagaaatgacaatggaagtgtttccatgcgtcaacgtttcgctccaggacatctcctaccgaccaatgaacgattgccgtgtctacattccagtgacagtgcatttccccgaccgagcgatagcagcattcctggaccccgaattacgcatcatttctttgacggcgcaatttgcaagctgcaacaatcaccgtttccatcatcttcaactgcgaagcaatccgaacatttggctactgatcgactcacgaaccgggattgcacgtcaaatgccaaaggactatacgcatgagctgtacgaaacgacactcaaccagtccaacagcaacatcgagcttcatcctctgatcttccacgcttggcagctggacaacgaatcagatgcgacacgttttccgcacattaacgagttcatcaacttggagcagttcaaggaaaagttggaacaacacatcacggcgagaaccgaggcgttaggtgccctaaaaggtggcatcgaaggactgaccatgcgctggctaaaaagcatgatcgacgaagtcatcacgtggtggattcgaatcgcctgtgtctactcaaccttcttgttcctgcgtgacattgtccttccatgcacactcgcctacttgttcaaccctgttcgggtcacatttttcagcttaatgggagttcgacgtcagccgcttcaaccaatgctcggcaaaacgctacgacaggaggaagtgccgcttcgagaagttctccgatcacctcagccacgcacttcaccgcaccgttctctgtcacccgtccacctggacgtgatcgctcgcagtgcccgttaccaacaaactcgagcgcaaagcgatgcaaatctggcagaagtcgacaccccgttcggacgacgaacgcgacgaagagaggagcactgaggaccacgaggatcaaggaacagacgagcccaccgagaaggaacagattagcccccacgagaacgaatgatggatgaacccatgcctcgggaatgtcgaaattttcgtaaaatcaaaatttgattttagcattaaaatgatgtaaaagggggtgataaggggatggtatgactgatcgatttccctcccgtgttttgtttgtttttaatcccttcccccgcccgttccacatcctgttcctccccaaatttccctccgccgcaaatttgccccacttttttctcccgcaatcgcaactgtgcggaattgtccgcccatctcccccccataaaaaatcgtttgttcgccaattttgccccctccaagtactttgctccccccaattgtagtgatcgggcccattt

SEQ ID NO: 878 - DNA, 4729 bp, Heterodera glycines
tgttcccaagcaattaattgaatttttcaacatttttttgatttttaaaattggtttaaaaaaatccaggtccaggcctggatccaggtctcgaggagcctggatttttcctggacctggattttcctggatttttgtccaggaaatccaggtccaggtccaacatggaatccaggtccaggtccaggtccaggcatttttcaaaatgtcgatctctacgaataacgttcaaccttttgttcttttataattttatacaataatactaataataatatttaactaataaaagtcacactaataagacaaaagacttaaatgctgaaaataaattaaattattagaaatttcattatataaaattttatcaaaaaattcattttaaaatatacaatattaatgtgtacttttgtattaattaggcttcaaaatttccaaatagaagaaaataataccgaataggaatggcaaatagagaatcatttttcgaatcatttattttgaaataaattgtttttgagtcaaataaagtaattaattatgaagaaataaatgtaagcagatccaagcctttttattattttattggaaaacttttaaataaaatccaatttattaacaaaatttgaattatgaaaatgatttaatattagtgtttaggtattgtatttttatttattttttttttttgttgcaattttttcatctctccagcctcattttctcggacaacctcaaacctaaactaaattttgtttttattatattaatagttttaatttattaattttttggcacccattatgccgtactgcttgccattgattgattggactatgcgctgtccttacacatttttcccacacatttaaccagtccattttcaccgccctgtaaatttagtatgtatttaaaaatattataattacataaattaaaagcaccaaattaccagatgcatttcattcctctcgtcatttaccccctcggccccaaaaaacattttcttaccgaaatttttcaaaaaaaatcttcgaaaatttaatattgaatttttttactaacaattattttttcaaactggaaaatttacaaattttcttttcttgaaaccttaatgaaaatatttcctaaattttttttggaaaactttctgtttgaaaatttctctttgaaaattggcgggaggggggacgggggggggaggggaggggacggacgacctgctgctccattaattaccaatttaatcgcaaatggacacttggcattgtcgtggtgcccaatcactcccaatttgccccccttttgggcaatgccggccaacatgtcataggccagcgcagtgactggctcctccatgctcaacagatagccccaaaatgatctgttcatgaacagttggtcggtgttgttcggcgcagtgcccacataaccgtccaaaattcggtactcaccaaacgaaatatttgagcatggaaattctccatacaaatcaacatgggttcgccttttgtcaaaaagtcattcattattgagcaattatgacttaactcatggccacagagtcatggaaaaggttgttacttttgttcagagttcagacaaatttttgtaacaaatttcagatcaaaccaaaaaaaaaatcgctgaaatttttgcagaaagatatcttgtgattaggacagtctgttattatcctgctgtaaaattgagtaagtttgttaagatatggatggtttcgaattcatttttttcgaccttttagagaaagtttcctcgaggagcaacccaaagaaaaatttcaataatttttgcatgaatacataataattatgtattttgcttcaaaaaatagttacaaaatccaaacattttccatgacagtgatttctcagctataaccaataaatatttgagtcaatgagacaacttgtacaatggcaactcttacaataaaaattaaaataataagcttaagtctagggctcgcaagcctaagcctggcctaaagcttaggactaagcataaaccttaggcctaagacctaaagcttaggactaagcataaaccttaggcctaagacctaaagcttaggactaagcataaaccttaggcctaagacctaaagcttaggactaagcataaaccttaggcctaagacctaaagcttaggactagcctaagccattgtacgagttgccttttgtacaagttgtcatgacaccaaaatttttagtacttttacttttcttggtgtgtcgatgtgtacaaatccataactttttcctcatccgtttcactcattacaatttgaaagccgtgcagcactttgtcctgttcaaaatgttttgcccattttgtttgctgtgccattttgcatttggtcgcaattttattgtcctcctcataattttccatgtgatactgcgaattcagtcgtgcatttgccgggtccatttgtccaagaaaacaaaacgtaattctaatacatttttttgaatatatttttaattatatttgaattatcaaattttaatatttatatttattattattgttttaatgacttataataaataatacatcgctttggccgcacattctccaactcggcacacactcattttcaaatggcgattatcaatgtccagggtggtgttgaaatacaacgtgattggattgggcacaatgttgttgatcaagcccacttgcaagacactaattagcaaaacttgatgataaataaacaattaatattttaatttgttttttttaaattttatttttcttacttatcagactcacatttcacctccgtccgaaattacgatcggcgctttttttagctcttcactgttcagctgcttgccggttgtccaatcaacgtttctgagacaatcagcgcaattgctgattaggagaacagctcccaaaacaaagtggtgccaaacgaatccattcattatttattttaaaataattttgcgcttagcttaaatgaaggagaagcttaattatcgcataatttacacatttttcatatttttcagtttcttaaaagcttagaaaactagggaaaataataaataactgatttataaatggatacaatggttcaattaggcttctttctatttagtattattgctaaatattcttccaattttttgacgtacaactgcaaaatgatttggctttcatcgctaaacgccaggcgattgagtgattattccattccaacattaatttattttattttacttataaatatgcaaaatgatggatgcattgatgggtgggtggtacttgttgatcaaaaaaaaatgatggttaaataaatgaatgcgatgattcattgcgaaatgggaaccatttttaatgaaaaaaaaaattaattcatttagcattatgattaaaaaatataatattgaaaaatagagattttatttcatttataaattcatcaaaatcacaaagtttgattaggaaagggacaaaatcattctttaggatagggttgctccccgaccccgagccccccgacccgacccgagacgtttttttacctattccccgacccgacccccgacatgtcgccccccgaggtccccggcccccgactttttgcccccgaccccccgacactaattcgggggattggggactcttgaaaatttttgaaattttgaacaattttcttaataaaattaattaaaaatttcgaaaaacttttcggcggcgcctatcggcaccgccggccccccaaaactccaaatttttcccaaaaattggctcgaaaatcacaaaatttggacaattttggacaaaattctcttaacaaatcatactcattttcaaaaaatttcccggcggcgcctatcggaaccgccggaacacatcccccccacctcaagtttccaaaaagttgccgccggggaaaattttggaaatttaatgcaatttgttaacagattttgtctaaaaattgccccaattttggtgatttttgagctaattttaaagaaaataaaggatttttagcgtccggcggtgccgataggcgccgccgagggaaattttgacagattttcaacaaaaaaggctggtttttgagattactaggctcaatttgtatggattttctttaaaaaatgatacaatttgtgtcaattaaaaaaatatgagggaaaaattaaaattgtccaaataaaaaaagaattttttaaaaaatcattcaaaaaaatattttgtcgataggaaaccaatgaatatacaaaaagaaaattcaaaatattttaatttctgtagagggattgaacaatgggaaagaagtagaaaatcaaggactagcctctagatcattttcataattgtgtgcgctacttttaaagtatatattaattattattttttaatttttccctttaaatctaaaaagatttagttgatcactacccgatcggggtccccgacatttgagctcccccccgatacgacgctggggccgacttcacgcggtgcgcactgtccttggtttaattgccactggcgtttatttatacgcagtaagcaaagaataaaaggagaaaggaactttaaatccgacaacataacataaaatgacatattttttaatgtcaattttgcatattcacaaatttgtgtgcgtacactttcaatcacatttgtatatttgcactttattacataaaaacattaaagcgtt

SEQ ID NO: 879 - DNA, 3217 bp, Heterodera glycines
  misc_feature (3160)..(3161): n is a, c, g, or t
tttgcactatttttgacaaaattctgtagacaaatctatactcattttcataagatttccgggcgacgcctatcggagccgccgaaacacatcccccccacctcaagtttccaaaaagttgccgccggggaaaattttggaaatttaatgcaatttgttaacagattttgtctaaaaattgccccaattttggtgatttttgagctaattttaaagaaaataaaggatttttagcgtccggcggtgccgataggcgccgccgagggaaattttgacagattttcaacaaaaaaggctggtttttgagattactaggctcaatttgtatggattttctttaaaaaatgatacaatttgtgtcaattaaaaaaatatgagggaaaaattaaaattgtccaaataaaaaaagaattttttaaaaaatcattcaaaaaaatattttgtcgataggaaaccaatgaatatacaaaaagaaaattcaaaatattttaatttctgtagagggattgaacaatgggaaagaagtagaaaatcaaggactagcctctagatcattttcataatttgccccccgaggggtcggggagcaaccctactttaggatctcttaatattttataaaatttaatcagaattgcagcaaaagcgagatttaattgatcgagttcccatctcggactattttccagtctcgacactgatctcgtttttttgatcaaatttcatgctttactattattggacaaatttggacgaatcatttggttaatctttttctccaatttgcttattcatcatcatttccaatcactgggaaattttgctcttctggctaatagctaaaaccaacatgttaatgtgcataaatttatttgattttgtccatttttagtttaaattgatataggaatgggctaggaaatatataattcatttttatagaattcgttccaattttaatttaaatgcacagaaaaaatttcattgcttatctgctgaaattaaattagcaagattcattaatttatgaaattatttcttgtccattttaatgttttcagcggattttataataattaatttgatttttattcaacgtttgtttgcaaaaagattgaaaaaaggtggggcttttttgattaattaaattaatttatttcttacacaatttagtcaaaatgcatgattttgattttgcattgttttttctgtttgtctccgtgcatttgttgtgttcgtcaggtaaaaattatttttaaataaatatatattaaaaattatttaattaaaattaagctatgaaatgcaaaaaaggcactgtcctcgacactcttgacttagggatgaacccaaaaatgaacattagtgttgaagaatgcaaagccggctatgaatattgtgcagcttttacatgcacaaaaggtacttagtcaatcaggcatttcagttgagtgaaatttgtacataagacgctggaatttaaatgtaattaaaattaattaaatgccgtttaaatgtatttggaataatattagacttttagatggaattaaattaattaaatgcatttaaatatatataatattcggctgacctatatcactaatatttaacaattgatttaatcaagtttattattcgcattttacagctggtcgggcaggcttttcacgaatccaatggtattgtgccaggatcaaatcccctccttatgagtgtgccgagcggttcacaaagttggtggaagaatacatcacacattccaatggccattggtgcgaatgccatttcggggaaatgggcaaagagatggacaatgaacaatttgtgcttccgcccatccctgatgggatgatgtgcaaagtgggacagtttgatgagaacgaaattggccaagtgtcggaggggaaatgcctgcacgacgaccattactgttacattgccaaatgcacaaaaggtgagagagagagagagagagagagagggagagagaaaaagagatgagagtgagagtgagggagaggcgagagagagagagagagaaacagagatgagagtgagggagaggagagagggagagatgaagtagggagagagagaaggggagagatagagtgatgtaagagagagagagagagagagagaaggaatgatagagagagagagagagttagagagagagagagtaagagacgagaaagcgaaagggagagagtgtgagagacagcgagatgagtgatagagatggagagagatagagagagatgaggaaaggaaaggtgagggcgtgagagcgtgatgtaagggatagagagtgagaaagaaaagagagataaagagagaagaaacatgagagagagagagataatgaggctaatcatttttggaaaaaaatatgaatcgtttcataatttcgccactttattatattattattaaattacctatcttcaaaatactgaaaaatgtaaaaagtttcgccaaattaataaaaaaaaagatttaaaaaaaaagaattctagcaaagtgaaattttctgtacattataattactacaaaggatgctccaaaaaaaatatatgtaaaatgaattcttggtaaaagtatgaaaattgatggtcatatttttaaaaaaaaaacaatgagttatttttttaaatattttaaatttttattttaaatttacgacatgtgaaaatcccgcaaaaaatatgcacacggttttatgcaaattgcatttgtttttgtttttttcattttttaatccatgccattcccgccaaatgctctttagacaatgaatatttcaaaacggtgtgggattgcactgatcgccccaaacgtgatcacatcactgatcaaatcgggcaaaaggccagtgttacgttgtactgtgacgcaatgtttggcaagaagaacatggccatgtccaatgaacatttcacaattgaaaagctggaagagcacgtggaaatgatgaacatgatgacgacaaagaggcgacgacgtcggaaaaaaagcacaacaatcacaacgccaagcaccgatttggcaaccaccacaatgcctactgtaacggagcaaactgtgccagctactgttgaggaggcgacagtcacgggttacgatagcaagcaaagaaaaaaaacatacataattnngatattagtatacagtcttctgtaacaaaatatattaattctttttcatttttaaa

SEQ ID NO: 880 - DNA, 2674 bp, Heterodera glycines
aaaggagaaaataaactaatgaacaagaattcaatgagaaactcgaattcagcttctttcaagtacattaagaacaatttttgtctctgctaaaattccatagcgtcaattaggatggccattgattgactaattggactcgtaaaactgcagtagagccaaatgatttacctatatgtataatatgtatttatctattcaaaatgagcataaatgagttgaaggcataaaagtgaaaaatttattcaatgaaaactgaaatgaatttaaacaatatttcaaaaatggttaagttaatccttgaaaatattttactggacactgaaatccttcctctactaattaatttattcaaaaataattttaatcaaaactgctattttttataaatgtttaaaattcttagggatttgtattcttattttctgcaaaatttcaacccatttgaatgggctgaaccgagtcataaaaaattaacttgctcacaatccgagcttttgttgggaattaaaaatcagtgatctttggggaatctgatcctgtcaaattttagaaatttaatgaactcaaaattacgactcacttatttcaaattttttctatataagcaaaaaattctctaatattgtataaaatccataaaacttttcattgattataatacacaataaaatgttttaatattgaagaatttaaaaattttcagtcagccaataaccatcatatggcattgcacatgcgcaagaaaaatattttataaaaaaccaacagcaaaatttatttattttttaaatttttttttctattagggtgaaagagaccaaaaaaatattatttaatttattaaatatttgcattattttagaaaaataaatttctttttgattctttcgttcttccttctcttaatggcttgtttacacattgctttaggcacattgattgtcaaaacatttgcccaatccatcgccttcctgaatattaattaaatacattttaatcaaaataaaatttcttttctttttaaatgattttttaaattttgatttaaaaaacatgcaagaatatatattttttaaatttccttttccgaattagaaagatagacccactaagtctacatagacttagtgctctacgccaattaagcctctaatgacggggttttagtgaaaatgtaattttaaaattgcaaaagtgaaaacatatagaaatttttgggatgaggattgttaaaattccgtaccaaaatcaatttacaataatagcaaaaataattttaaaaaattccatggtcattagcccatggcaacaaaaaagttccgttccattgccatgtcattattatcaaatggtgccattgtaaatccgaatcaatgaccaagtactttgcccatggtaccagaatgattttgatgttacacgcgccacccgccgcaataatgccaattttgccgcctttttgcggaatgccggacaaaatgtcatagctcaattcggtgaagaagtcgttatccttttcaagctttttattgtccgtgtaatccttcagaaacccgtccaaattcttctcactcccgagatgaatgtcaaagcattgttgcgcattgcgaatggcatatgacgggcttaataaattaacaatgatggttaattagcggaatcgtgtcaaggagtaggactcaaaaataaattaatatttttttttgaaatttaatattcaatcatcgttattattttctatataaaattacactattttttatgattaatttacaattaaaaatacattgaagcatttaaaatcgattagcattaatttatttatatgaatatgagattatattcatttaaatattgcttcatctctgaccatcattttctttcactattactgaaaatactgtcaattacagtcgactttaccgtataccttttctggctggtcgatgacgtcaacaacagcttgtcctccgcaaatgcgatgttgaagccgtgcagcaccttccctatcgccaatgtttcacttccacccgattgttgcagctgttgctcacaactcgtcgcaattgaatttttttgcttgtaattttcaagactgaaacggccaccctttgtcgccacggttgggtccattttgccgacaaaacagaaagtcactctagcaaaaaattttgtattttggtaatgattttcaaataaaattccttttttaaaaattttttgcctttcattataattttattgctttttaaaaatcgtataatttcgggtttttatctaatttaaatattacaagaatagtaattatgtggcaatatttaaaaaaacaacaaatgcattcattattcttataaattttatgcttatttaattgactcctcctctaataaataaatgtattaaatataattaagtttttaatttaataataaaaataaatgcatttaaatatatgaacttataatttaataaaaataaaaatgcttgaaatataattaattactcattgtattaataataataaatatatttacttataaaaataaattatttaaaattttaacattttattaataataaaaaatgattttaaaataaataaatttatttgtttaattaatttgctgaccctttgtgacaaacaatgcccttcaaaacacacgttttgatg

SEQ ID NO: 881 - DNA, 3646 bp, Heterodera glycines
  misc_feature (6)..(6): n is a, c, g, or t
agtccnttttgagcatagatttacatttaagcattagcatttgttttcaaaatgtgtgccgaactttgatgatgccaattaaaaaatcatattttaaataaagtcaattgaaaacgcattatttttagcaataaaaaataaaattaaaattaatttttcaatttgtctttatataaattaaattaaaaaagaagaaaaacattattttgaacccaaaaaattcatttaaaaatgcattaaattttttctaaaaaaagttcattttatcaaaaattttaatgttaagaaatgaaaaattttaagcaagagatttataaagggattttaaataaaaagaaatattttaatttattgtttttttcgcggcattttagcattttttaagaaactttcattttaaacctaatattgaaaattgggaatatttttgaaaaatataaattatataaatacgaaaattatatatgcattaaatcctcatttcgaattttagcattatatctttctttttataattgtaatattttatttatttctattttgtcttacactcgcccatccgggtttatcaccaatggcatttccatggcctccttcacttccaattgcttcccattttgccaatttgtccatttcttcaccggctccgcagcaaacacactttcaataacaggccccgagtggacaatggcatcagattttggcacaattttgccggaagaaattgctaaaaataaattttcaaaattaaaatttggtgtcaaaaactaggtttttggaaaaattattgcaaatgaaaaaagcaattaaattcaattttttaaaattttaggagaattttgtggggcgacggcgccttaggcaccgctgggaaaaaagtttagaattttcaatgaattttgttaagaacattttgcatcataaatgttgtttttggctataacttttttctttgcaaacaaaatcaagcaaatcttggtttcaattgatagccctactctattggtctgaaaaatttcaaaaattatgttatgtttgtacaaagttatggccagaaaaattcaaaaaactgagtgctcaaatattttttgccataactttgttcaaacttttgaaatttttcaggataatataggacacctagggctatcgaatgataccacgattggctggatttggttggcaaataaaaaagttatagccaaaaacatgctggggaccaactgagataaaccgggacagtgtgggttcgattcccacccgatgcctaacatattttgcccatttcttattgtagtaatgagacactctataggcctgactaattaatatcttttaatcacctttcgttacattttcttcattgtttttgtccgtggcatttgctgccgaacattgctgcagaacaacaacaagcaatgacgaaaacaacaagaaaaaattgtaaattgacatataattagttctaaattaacatccaattcatattaagagaaaatttaaagaaaataaaaattttatttttaaaattcttttgaactttccttaagatctcaaaacttacgaaaaaattatgaaattttctatttttatgcatttaagaaaaatttcattaaaaatcccaaaaaaataaataaataaaaagaaaaactgcaaaatttgtacgaaaaaatgtaaaaatgtgccaaaaatgtaaaaaaaaatatgtaaatcccaaaatatgtataaacataaaatcgcttttattaattaatttttaaaaattaaagaaatttgaaatcatcatcactttctgtgctttcgattaaaaatgaaaattgcacggaaatttttgtgatttatatttaataaaccaaaagcagtgaatgcaaaaataaataaaaatcagccaccacttttagttaatgtgaaacaaaaaacagaaattcctatgctaatcaaaatgtgtaatatgttgggacaaaatatctaaataaatgaagaaatatatatatatatatatatatatatatatatatatatatatatatatatatatatataatatatatatatatatatataaagattaatttaataaaccatttacattattaaatttttttcaataaataaccgaaaaataatttgagagtccttttgagcatagatttacatttaagcattagcatttgttttcaaaatgtgtgccgaactttgatgatgccaattttgttgatgaatcactgctttttgtgccaattactcaccaatcggaaagtgcaaagagattttagagaagcgcaatgaaaagcagaaacaaaagtgccggatgtgataaagacggaaaatgggataattaattaattaattattaattaactaaaattaagtaaaatttttaagggttttcgaatgataccattttgtctgggttggtttgacacttttaaaagataggagctttttttgcgggaagtagcagcctaagtaattcttatcatttaaatagctctgaaattttccaattcaagttttaactaccaaaagcttttcggtgaagggttcagaagttccggcaaataattttaaatttctgaattttaatctcaatttaaatgagtgatctggatagctgatcaatttaacgaggcaaataatgcccggcacgtagttttcgtgcttttttaactttacaagtcatttgtgggatttacttgaaatttcttaatcaaattgggaaaaaaacagcaggcctctctaattttcctgtccttgcagagctaggacttgaagtcatgaggccaacaccacttatgtgtcgactggcccttctttttcagtttttttaattaaaaaggagagattttatatctctgtaagataatgataatccatttatgcatttattaagatttatttaaaattttcaacttgtggcactttcaagatcatttgtctgttacataataaacaaaaaagttaatttttaagcaaattgggatacaatttttcatttttaatgctaaaaactgccgaaataattcctttttatttttttgctaagtacctaaaaatatcagaaaaattggaataaactccaaatttttaattccacacaaatcgctgttgggccttgtaggctcatcgagggtcgaaaaatttccaagactcgagaaccgaggccgagcattgaatccacgccgagactcgagaccaagaaataattctgaacactctatatgattttttcaaaaaaaaaaaatatatattcattatcaggaatgtctaaaactatctcggttttcaagcattaaatcttaattataaatgcagtacatttattgttaacaaatttttctaatttacaataattttctattaaaaaataatttttaatttctcaattgctaaatttttcttttcattaaaaatgaatgaatgtatgaagcataatcataattaattaatctttctgattacgtcccattatttcaaaaaaatataagccctatttattatatatattgaattttttaaatgctaggctaaattaaaagcaaaattaaaaatgtctttttatttatttcattttaaaatttgtgctataaagacaattctaaacggatttaaatattttaaatttggcattttgttctctattatt

SEQ ID NO: 882 - DNA, 3386 bp, Heterodera glycines
  misc_feature (3372)..(3372): n is a, c, g, or t
attgcatcataccaatcttccacaactgttattaattgacttgttgtagacctatttctaacaaaaccaaattgatattccgaaattttattgttttttaataaaaaattgtaaatatttttgctgagaattctttccataactctgcacagagagcaggttaaagaaataggtctataattttcaggattgaatttatccccctttttaaaaagaggaaagacaattgattccttccagatatctggaagagaaccagagtctaatgaaatcctgaaaaggtcagtaataacagttgctaatgaaggatggcaatttttcaatgttttatagctaatattatccggagaagttccatttttattcggaagttttcttaaaagtttttgggtctcaatgatgttaaattctatatctgatataaagctttgattaacaaaagtgttgtccaagcttagaaagcctggatcaacttcagaattgttaaacgaatttacaaataaattggcaaataattcacatttttcttggtcattatgatagcatttgttttcagaaaccaaattcgatatttcaaagggattaacatcatatttttgtatatatttaaaaattgaattttttccctttgaaatagccttttgttcaagttgagaatgaaatttttttgtttgtatttttatgtgtaaactaatgctatcataaagtgccctttttgttgggtcgattttacacagcttatatagtttggccttttctttaatggatgccaataaatgcgttggatatttaggggctaactcatttttggtaagtctttttatcggaatacactcgtttaaggtttctagcagtgttttattaaaggcgttatatttttcatttacactaaaatgaccctgagataaggtgctaattctagatgaaataaccgtatttaaaagagacacattcgacggggtgaaccgtcgaatattaataaatttgggtttttgagtagtttttggaatagacatagtgaaaaattgcgccaaatgatctgatgaaaaaaccccgccttcaatattacactgctttacaatttgatcatttgccgatagaactaaatctaaccacgagttctccctcgttggtccattcgtggcattaaagagagaaagcttactgaaaaagtggcaaaaaatttcaccaaatttactcttagaaaatggatgcccttccttccataccaggtctctttttgaaaaattaaaatcacctaaaacaacgtaattttggcttgaaaatttttccaaaaatttgaaaagttccatagtttgtttgtacgttgtttttggtggtctatataccaatgcaaattttgttgattttaaattttgtaattggaaaattaaaatttcacaattaaattttgtgccggaaaattttatgaaaaatcctatttcctttttgatcaaaataccacaaccgccaccacgagaacaacttttggattttcgtgatgcaaaaatgcagttgtaattttctctagtccatggactaagaggaatttcctcattttcgttagtccatgattccgtgattagtaataaatctgtatttttgtttgttaaagttaaagatatttcgtcaattttgttcattatagaacgaatattaattaaacaacagcttagaccttttaaataattaacatcccctttaactgtttgtaagaaattaaaattgtttatttttttataaaaattttctaccaaccggaaaaagcaaaaactttttttgtaaaaatttatatgattttttggtgatttgacatgaaaatttaaaaatttttacgaattgtgtcaatgtcactgcgcaggatgacctgattcgcgtagataatccaatctcccgcgtcttcttttcttttctttgcgcactgctcaattaatttccggcgttcggccaattgctccttggtcatgctttccctgatgcgcgcaccatgtagagcattcaacgccaaagctttgcccttcattctgagcacatgccgagccgcatgtcgcgtgggaaattccattttgagcggtctcgctctgttgggcgttcgcatgccgacacggaacaccactggcgtttggtcgaggtccactgtgtccaaaatcaaattgaccagtgctctgtccgcctccccacgctccgacgctttcccggattggaactccggcacattggtgatgacaacggttcgctgtctgcggtcttcctcaatcgcgtcattcgccgtcacttgagattgaactagagacgaagcggtggccaacagcgagtgcaactgcttaataagcagttttgcgtagtcgggaatggcgctgtcgttgtcaatttcggggggaatttgaagctggtcaagggaagttaagaatttttttggtgcggtgttgtccatgggaggggaaaaattcgccgccgttctctttgccatcgattgatttttgggagatgacaatttgaaacgaatgacaatttgaaacgaatgacaatttgaaacgaatgacaatttgaaacgaatgacaatttgaaacgaatgacaatttgaaacgaatgacaatttgaaacgaatgacaatttgaaacgaatgacaatttgaattcgctgttaatccaaatattgcaattttttgtttgcttccttaaggttggatttaataactaaaaaactcaatagagagctttgaaaccaagtcaattagcacaaaattaattttaaatgcaaaaaggaacattgccaacatgctcacaatcagttgcggcgcaggtcctcccccccccccacctccgaaaatttttataaataatttcccacacaaatttttcaaatgcgtaggaattttttcataagctaattccaaacaaaaaaaaaatttttttttaatatggcgattttttcagaattttatgattaactactattttttccaaaaaatcgctgaaaaccaatcagttgataaataatatattaataaagattcaaatttaaggatcggctaagcattattaggatgggaatttattagaggaaaatgaccaaaaagacgattcgattagaaaatcaaaaaaaaaacgacaaaaagtcatgaaaaattagcgaaaagtaaaatataaatatttttctaagcaatttatagaattgcattttataaaaccgattaatttcgctagagtttcaaaaagatacattcacaaattatagtaaaacattaaaaaatatatacatgtttgggagatttcaagtatcgaaactgtgcaaaaaaatggtcttagactcgtattcatttgtcaagcgccttaaattagcctaaaaattgtgtattttggttttgccctntatttgtgtgggat

SEQ ID NO: 883 - DNA, 3995 bp, Heterodera glycines
ttgcggtgcgggcgccggtggcgggagcggcgcttttggcggtgccgcgcgcgtggactgcaaaatgctctgatggatggcaccggccgatcgattggatttccgtggctggctgactggtgatgatggtgatcaagaagtgatttgcagtactttttgcgagattttcttaatttcggatgttcacactttttctctttttttttgttttcgccgcttttctccgatgatgataattgatcactcaattttttttttgtttttgtccctctcctccgccgttggcatggtcttttgtttcttctttttgcttttgcattttttggtggcctatcgcgcaataattaatttttctgctgcttaatgagtgatagataatgcgtatgcatatgttgtgcatgtacatttgttatagctagtgttataaattattggactaaaaagctcaaaatatgaactaaaaactcctaaaatataagttttaaatcctcaaaaattccaaaaaatgtatatttattcaatatttgctttaaccgacttaaaaatacactaaaaactagggttcgagcccgtgggcgggggtggcttttcgcgggggcgggggtcagagtcgcgggggcggtggcgggggcacgataattccgcccccgcgggggcgggggcgggggtttgctttgaattagctccaaaaatctcacaaaaaaaatattttttatgaataatttctttggctccacattcttttattcgttgatcgccttgataatatttattttgacataaattgcacagattttgactaaaaataatcaaatttagcgatttttgggtaattttttaagaaaaaaaggtttttttttggggggggggggccggcgtgccgataggagcgaattttaaatttatttctaacagatattcaaatttgcaaaatatctactaaaatatgtaaataaaagtccaaacttttgtttgcaaacacaaaaaagaaagtgtttttcctactgattaggctatggagaagccaggaaaaaatatgtatttacataaaattagcagccctaatcatgatttactcaaggaaaattggaactcagattttttaaatttttcttgcggtacatttttccaaaaaatttgctgaatgtgcgaggggagaggtccggcggtgccgacaggcgccgccggggaaattttttgaaaatttgaatgcaatttgttaacaaattttgtacaaaaaataagcaaaattcgcgagcttgggataatttttaagaaaaaatataggaattttgggggccggcggtgcctataggcgccaccggggaaaattttaagaatttatatgaattttgttagaacttagccaaatttttcagaaattttcttcttttagatgaaaataaggcattacccccaaatcagaacatttcttagaaacaagaacataaagaaacactgtattaatcagaaaaaaaattaattaaaggaaaaaaaaaatttatttaaggaaaacgtcaaccggtgttgaactcataacaaagatttctattagtgctgaagcactaaccactaaaccacaaatattttaaaaaatataagcaaaatttactttatttcataaaaatttgtaaaagatgattaaaaaaatcaaaattgtataaattttttgccttttatccatgaatatgtcgttcttaggggtgtattttcacccccgcgcccccgcgggggtgaaggtcgcgggggcgggggatggcgggggtcagagtcgcgggggcggggacggggctgaggccaaaaaacctgtcccgcccccgcgggggcgggggtgacgggggcggggctcgaaccctactttaaaatgaaataaaaagtgttctaaactttgtttaagcttttaacatgcactttttgtgacttttgactttttgaggtaaaatttgaaattcatcaaagaaaatcccgaaaaataaaatttcgaccggtgaaaaggtactgaaacctgctggatgattactgaaactatgagatgcgaccttagtttgtgcccgaattttgttatcccttgggcccattggcaacagttaatgccgaacagattcaaaaattttttggataaaatgtgattttaatgcttctttcatccaaagtacaatccgtaaaaaataggaaaccctaaaaatccaggctttatccaacgcattaattcttctgctatttgtgtgacatcattcggaactcggcccaattgtgctaattgccaaaaaatgaaccgacggtaaggcatttgaaaagtcacaaattcgtcatttatttagctaacaataaactgttttcccacttcagttggatttgcaacgacgtttggatggacattttcccctgttttgatcgtccccaactcggcctcaaaatggcacttctttcgccacgtttcgatgcgttggtggacaaacatttcgatggcaaaagcgaattgacaatttggagaacgatcgaaattcgtcgcaaggacaaaggaccagaaccgaaactgtctgtgcggatggatagaaaatttatggaatttccattgcccgacgaccgtccgttgcccagtaaaagccgttttaagagccttgagattgtgtaattaaaaatcaaagctttatggcaataaaagcattccttccattttcacagttacattgatcactccgtcatcgcttttcttcgttcaaatcaccaaattttcgacaaaagaggcaccaatttacatttgtggattccttattcaaacaccacggatgggccgcggatttgggacatttttggtcgtgaaatttggccctttttttcgacaaacattcgccacttgcgcttttcccatcgtgatcatttggacaatttgcttcgtcgcacttcgtcgacaattctcactgatctcaaccaattgacttcaatctattcctgtggtttgtttcccgctgcgtttggtgatgattttgatgggccaatttctgctggccaagcattgtccaaatggttgcacacgccgagaaaagatggccaacccaaacgattgcgttgcgaagattacagcgaacaagggaacactgattgggtcaacaatttcaaggaggtgtggccataatttagacaaacgattgatttttgtttttccaatcaaattgtttagcattttctccgtgccaatgccatttcttccgtcagttaccaaattcatttttctgttcatgtgccgtcaatgccaatggtgccatttgaattgcttaacgaatggacaaaggaaaagctgacattggccaaagcaaatgaattggacaaccgatggataatgaaacgattcaaaattattggggagtccgcggcggttcagcagcagaagaaagatgataattgggacaacaattgtaacaatgtgttctttgggcttgttgctggcactaatagcattgggtgagcaataaaaaaaggcatttaatttttatccgaatttgaattttgcgcttaatttaggccattatctccgccaccaccagcagaagaagatgaagcgggacaaagcatcacaaaggggccgtcttctgctgacaaatgagtgacggacaaaagaacaaaatcaatgagcagacgcagaagaaatgaatattaattgaaaatgaccggacgatcataattcatcagtgatcaagtgcattttatgaagaaaatttttgttttcaaaagttggctaaatatggtgttaaaaattattttagaggaaaaaaacaagacgagctaatactcatttttagcgaaaaatcaaattgaaaagcgaaattttcgctttttgcttatttttgacataaatttatcaattttaataaaatttaaatttattcaattttacgagaaaatttttttttgtgccatcaaaaatattttggtgggcaatttaatattttttattcttcggccttattgaattttcgttgcacttttttcaaaac

SEQ ID NO: 884 - DNA, 1111 bp, Heterodera glycines
tgttggtcattattttgtgcaactctaagttgttatgttttcgtacattttttgccatttttatgcgtccgatttatttaccgaaattgagaggtttttcttcataaaatgcacttgatcactgatgaattatgatcgtccggtcattttcaattaatattcatttcttctgcgtctgcccattgattttgttcttttgtccgtcactcatttgtcagcagaagacgtcccttttgtgatgctttgtcccgtttgttcttcaacttcttccagtggcggagacaatggcctaaattaagcaaaattttaattatttaaacaaaattaaatgcctttttgaattgctcacccaatgctattagtgccagcaaaaagcccaaagaacacattgttacaattgttgtcccaatttttatctttcttctgcttctcctctttctccccaataattttgcatcgtttcattatccaactgttgtcccattcattttcatttgctttggccaatgtcagcttttcctttgtccattcgttaagcaattcaaatggcaccattggcattgacggcacatgaacagaaaaatgaatttggtaactgacggaagaaatggcattggcacggagaaattgctaaacaatttgattggaaaacaaaaatcagtcatttgccaaaaatgtggagccacaccagcagggatggcacagaattcggatttccgaaattttgataaaattcggaaattttcaaaaatttccgacttacgacgtttttggggtcggaattccgatttcagaaaataaaaaacttgaagctccccccccccccggaccggggacgggacgaaatctcgccgccgaaatctcgccggccgaaatctcgccgagacaaaatctcgccgccgaaatctcgccggctgaaatctcgccggccgaaatctcgccgcagaaatttcaaaaaaaaattcaaacttagaaattcttcaaggaaaaaattttagaacatttttttaataagaaaattccaaaaaaaaaactatttgctaagtttttttgaaaatttttcaaaaaaacagtaaatttcataaaatttcaaaaaaaaattgctgaaaaa

SEQ ID NO: 885 - DNA, 3239 bp, Heterodera glycines
  misc_feature (77)..(77): n is a, c, g, or t
aaatggtacgcctttcaatgtttttgggaattagaaacgaaaattgctcagaaagtcgctgacaaaatgttgaaatntagtgattttccatttaatttgaataaaccgagcaaatcttctgcaaccttaaatttttaaaatttgctcttcaaaattagaatagttcattttaacataaaatttctccttttttcatttttacgtactctgcaaaaatttcgggggagaaacaaaaattaaatccgttagaaagaggtgtgattttccacaaaattgtcttgtgaatggtctgtcgatctatggcttttctttaagaagtcaaaattggtaacattttggtgataaattagtgtaaatatctttggcatggaaattatgagggcattctgtgcattggttgatgctcaaatagtgcttctcgtggcattttcaataagaaaatttgttttgtttggccaaatttggtggtcgccagtcagattaatacatttaaaaacaatttggggtcacattggttaatatttgttgccttaaaagtgtccaacattatttactcattgtcagatcaaagacatggcctcctattggcgtctgaaaagcattgaggagtacgagttggaaatgtccacgaaaagcaaggagacgcgtcgctatgtgttcaactgtttggacgacattggccaagtgcaccttccgtccgacttggacgacatcgaccgaatgtgcgagcggaatgaccggcttgaatttgtcgacattctgaagcaaatgctgagcatggaccaggtacagcttgaactccttgttggactcaaacaccggcatcagaaaaaatctcaacctttttaatttaaggaccgtcgtctgacaccgacccgcgggttgcagcacaaatttgtaaaaatgacgcatatgatcgagatggggcgcactaaatactgccaggtaataaacagttaactgtaagcaacaaattgtaagcaacatctgcaatttagtcccataattcggcatttgacatgccaagtctaataaaataccgttaaaacgtacttcgaaactgacaatgagccttttaaattttaaaaatatatggcttgaagtggggacgggacaaaatctcgccgcagaaatttcaaaaaaaaaaaaattctaacttagaaatttttcaaggaaaaaattttagaaaattttttttataagaaaattccaaaagaaaaactatttactaagtttttttgaaaatttttcaaaaaaaacagcaaattttcataaaatttcaaaaaaaaattgctgaaaaatttttcaacaattttttttatttaaattttcttataaaaaaaattttctaagaatttttgaattttttccttgaaaaatttctaagtttgaaatttttttttttttgaaatttctgcggcgagatttcggcggcgatattttggggtgcacccagatttcggcgggcgaagatttggggtgcacccccccgtaccacacctccttgaaattgttgatccaatcagtgttcgcttgtgcgttgtaatctatgcaacgcaatcgcttgggttgtccatcttttctcggcgtgtgcaatcatttggacaattcttggccagcagaaattgttgaatttggcccatcaaaaccatcaacaatcgcaattgccttgggcaccaaatgattggaatcgattaaaatcaattggttgagatcggtgagaattgttggcgaagtgcgatcgaaaaaaagggccaaatttcacgaacaaaaacatcccaaattggctggccattcgtggtatgtgaagaaggaagccacaaatataaatcgatgcctcttttgtcaaaaatttggtgatttgaacgaagaaaagcgatgacggagtgatcaatgtaactgtgaaaatggaaggaatgcttttattgccataactctgattttaaattactcaatccgaaggtctttaaaacggattttgctgggcagcggacggtcgggcaatggaaattccataaattttctatccatccgcacagacagtttcggttctggtcctttgtccttgcgacgaatttcgatcgttctccaaattgtcaattcgcttttgccatcgaaatgtttgtccaccaacgcatcgaaacgtggcgaaagaagtgccattttgaggccgagttggggacgatcaaaacaggggaaaatgtccatccaaacgtcgttgcaaatccaactgaagtgggaaaacagtttattgttagctaaataaatgacgaatttgtgacttttcaaatgccttaccgtcggttcattttttggcaattagcacaattgggccgagttccgaatgatgtcacacaaatagcagaagaattaatgcgttggataaagcctggatttttagggtttcctattttttacggattgtactttggatgaaagaagcactaaaatcacattttatccaaaaaatttttgaattttgttcgtcttaaattgttgccaatgggaggcgaaaaccaattgacaaaaacggaaggcgcggaaacattttggcataaaatgacgacggattggaagaaaaagggaacgcaacagaggagaatattttgcaaaatgatgactagggaacggatttttaagcgcgaaaaagtccaaactaaggccttaaataagggcgaaaaaaccaaaatttggtcaagaaagaaaataaattacaaaaattttggtcaatgaaaaaataaatttatgtggaaaattttttgaaaatttgcaaaaaatgtgatctcgtcaagaaaaattttcgaataaatgcgtcaaaacgaagaatttccgagcgaaaaatgtgtttttcgtgcatttctcgtcgagttaaagccgcagaaaaataagcaaaaacttaaaaatccgatccctaatgatgacatttgccgggcgttttaccttatccccaaatcaatcaattcgatggataatttttatccaactttcatttgtaaaaagttagaaattttctttgtcaaccaaatccaacatttgttggtagcaaaaatggagaaacaagggaagaggagggaaatagcattggggaaggaggagagacggaagagaaagagaggaaaaggaaaaattcgacggaaggaagaggaggatgagagaagaatgaagcagaaaagagagaggaacagcagcaaattaacacttacatttttttttaaatgcgggattaatcccgcgggatc

SEQ ID NO: 886 - DNA, 5132 bp, Heterodera glycines
  misc_feature (5108)..(5108): n is a, c, g, or t
tttttgactcttttctgttcacattcgtctcccgtcttttattcatttaatcgagactgttattttcaagtaaatttatttcggtcgatttgatcactgatcggtaaattcaatttggttcattgtgttttcccttttcggcattttttttaattatcatttttcacttgcgatcgctttccaaattatctcgatatgcagcagatctttgcaaattaattctttttgaatgtatggaacaacgcacttgccctctctatttctctctctccctcttttctctctctctctctctcttctatctccatcccatacgatctctccttctctttcagtccattctctctctcttctcactctcttctctctctctctttctctctctctctctctcttctctctctcttctctctctcttctctctctcttcatctcatacgatctctccttctctttcactccattctcctctgctctctctctctctctctccacctccattccatacgatctctccttctctttcagtccattctctctctctttcttctcactctcttctctctctctctctttctctctctttctctctctttctctctctttctctctctctctctcttctctctctcttctctctctcttcatctcatacgatctcttcttctctttaactccattctcctctaatctctgctctctctctctctctctccatcccatacgctctctcgaccttgttgcgcatatataaagccacgcttctccttcccccccccccaaatcattggccagcaccagggcggcagtatatacttctccatcttcttctcctcctcctccatacatttcccataattcccattacaattccatcccaacaccatttcattcattcattcattacacacattctccccccccccccccccccctccgctgcccattcattcgccacacttttttttattatgtacatgcataacataacgccacacattattacatacacctacaagtacatgtgtgtgttgagcacgcatcaaacaacacacaaaagcgcatttgcctttttttagtggggttttcaataatttcttcatttttcattttaataattttctaggggtcattaatcagggttacccttgaaaatttccccgaaataagagcatcgctggtcaaaaataaggacattttttaaaacacgcttcgaaaactttgaatcgcatttttattgaacaaaatcaagcattactcaccgccaactattttctgagcaatttcggcttaaaatgagaaatttatacatttccgaaaatcaattttaaggttttaacaattttgtcgaaacataagcaattggtaaatttcagtgcatttagaataaaaaaaaaacatatttttaacaattttttcggcgaatttttccgaaaaatttttggatatggatgagggaagagagttcggcggtgccgataggcgccgctgggggaaaattttaagaatttttaatgaattttgttaggaattagccgaatttttcagaaatttcctcttttaaatgaaaataaggcactaccccaaatcagaacatttcttagaaataagaacagatacacccctgctctaataggcgccgccggaaaaatttttgtaatttttaatgcgaattcttaacgattttgttcaaaaaatgataaaattacgattttgagccaatttttttaagccgagagaaaaatttgaatatttaactgaatcttgttaagattttggatattaattcgcttaaaaaaacatttctttcaaaaattatcattaaaaatctaatttctccctgaatccaaaaaataagatgaaaataaggacaaatcttacgaataaggacatttcaaatttgtaagatttggaccctcaaaataaggacaaatcttacaaataaggacaaagggtaaccctgatttaaatgatctcgttcgaaaaatgcaaagcaaagtcagatgaatatgaagtgcaaatgttcttacaaaacatataacaaacaatagaatattgtgcatgggagaacaaaggtcaagagattggaagggcctggggaagggcaggctttctttttgatcacaattcctcgtccccctcctcgaacggaggtgggacaattgagaagcgttcgcagtactccgtgagcatgtggagttgccgcctcgtgctctcgtgggcacgctgttcctgaattggggagggttatttgatgatcatcgactgttttggggggactgaccgccacgagttgattacggcagtgttccaactcggcttccagctcccgtttctctgcgaccactttctgcaggcaccactggtacctgctcagctcgccgtccgtcgacactcgcctcctttgctgctgttccctgccgctgttcgtttcggcaaaaagtgtcgccgctgtttttgtggtggagggcagcgcaatgccgtcgcaaaaagaagtcgactgcacgaagggtgccgaattggaggagagaagcgactcctccagcgacattgccaagttggacactgacacttttgcggaggcggacggagcgggcggtttggtggccacgtcgtcggaacgggcacggctaaaggtggaggcggaggagcaggccgactgattctgtggggaggagtaaaatggaatcgccaattgatttagacagtcccacctgtggctgttgttcacccgtccccgtgagtgacgtgtgctgtggccgattggcgccgcgccgtgtttggatggagtcaacggacgcattgctctccaattggtaaatgcgactgactgccgaaccgaacgccggtgcccttaaacgcaaaatgtgaaatagaaatgccattttgtttttaacttacgaatattttttgcgttctgtcaccgccgtcagcgacgtgggcgacggtgtgctgttgccccaggaatcgccggacaaattggaactgagtttggagccgacccgacgctgctggtcacgcagagcaaacatttgctggtaggccaacggttggcgagcgaatgagtcgggggagagcaattgttggcattcgaggccacggacggcgggacaattcgggtctgtaaacaggggaatgaatgcagttgggttttagcctttttttaaagaaaaaggaggctcttcggggccgggccatgtcggagagacaattttgaaaatctgtgtcatttgttttaattgaaaaatttcggaatttcccccccccccctctcttttccatgttttaccttcacatccccgtctcggattaccatcagaggccggggcgatcattgtgagctgaagaaaatgaaaaatgataagcaaaaagctgccgaatgaatgccttaatttgcgaccgttccgccaacaaaacggcgatgtgttcggcgctgaacgtgaaaaaagccgcattttccaactgaaaatccaaacgtatttattaaactaaaagggccttaatgaaaaaaacctcgacaatgcgagagccctgccgaaggccaacgcgccaggcactcttaaggaaaacggggattattttgaaattcataattttttggctagtcattaaagaggattggcactttgttcatgtccacgtccgtgacgatgccctcctcctggacatggaaaccgaacgactcgccaagtgctttattcttatgcaaaatgacctagaaatatgaaacggaaattaattaacgtggaaatggaatttcactgacctccttcgcctcctccccatttgtgacggacgcaagtcgcttcaacaacagtcccaactcgcgctcactgccatcgggggaagcgcaccacaacagcagcaaatcgccatggtcaaagaaaattttgacacttaaatgtggaaattttgagacttaaaacttaggtggcgagatgaaaatgattaaccatccgtagaaatgaatcagtgaccaatccaggattcaggtttttggggatttggaggtaatttaatcttttgagccctttgaaattgctaaccctccatcggcggcttggatccatcccaggatggaatgggtgggcgtggagaacacggccagcccggagggtacggagaggaggacgagcgtgtcggcggacaaaccgagcacggcaggtgcacgttggccggtggaatggtcaaacacgtcgacttgcctaaggggggaagggtaagtcgaaaccttatatatttcccgactaataaattaccaggagagcgcagcacggactgcggcatcgagcacgggcctcggcaccacgcgctctttgcgcttaaccgaaccgcccaacagccgcgacgcaatgcgcgacgcgccttcgtttgaatgggcagtacccgcgtagttctccaccaaatccttcagcgcctcgcgccgggtacgcgccgccatcgaagcaaatttgcgggacctagaaaaagaggggaggaaatacaaaaaatagtgggaagaaacggcgcaccgatggacggcattttcggcgttgattattttggtgataagaaagtcatggaactcggcacttttctgcgaaaatttgaatgcataagaatgtgatactttgttcgttttgtttgttggcactacctgaaaagtggcacttgcggggattggggggccaaacgttggcacgtccttggcacgagagacagcgacccgataggtgacaccctcggttagcgggttgcaagcgcggatgacgatgaacacgtgttggaagtgggaacggacggtgatgggcgagaagggcaaggcgtcgggctcttggaagatgatggtcacctgaagagagtccaatcatttcaatgccttgccttcccttccccgtccgattgccatgtcatttccaatgtgtcgcttccggtacagctgctgtttgttgttcggagtgaatggcagcattgtggacacgtggaacattatctgggcagagtgatgctccgtgtaaatgctgtacagtccggtggtgtctccgcgcgtgtccaacccgcctttgtacgactcgaagcccttcagacgcacgcgggtgcccaaaaagtcgagaattctgcaaaaaggngaacgatatcatcatttatccgga

SEQ ID NO: 887 - DNA, 3369 bp, Heterodera glycines
gggcagagtgatgctccgtgtaaatgctgtacagttcggtggtgtctccgcgcgtgtccaacccgcctttgtacgactcgaagcccttcagtacgcacgcgggtgcccaaaatgtcgagaaaatttctcgcaaaaaatggggaaaccgatcatcatcatttcttccggaaaaaaggttcacggttatcaccttcaaaacgtggtgacgaacgttcgttcgttgtacattctaaaaagggacattcggtgtaatttgcttattgtcaaccgtgtcattcgtctggtgattcatcaaccaaattgcgtttttacgagtttcaaaatctcttggcaaatgaataacccaacctacattaaaaagggtggtgggtcggtacaaatccgcgccgatgatcttttttttttgcttttcaaaaacttttttttcggcgcgctttttccaaaaaactttcgggaacaggggccggcggtggcgccaggcgccgccgggaaaaatttttggactttttaatgaatttgttaagaaaattttcaaaatttgcgacccgccctcgctgcgaaccccccccccccaaaaatgtatgaacccaacaaatgtacaattgtttattttttaaaaatgccattctcatctctcccacttcatttgattttttccacctgctcctccgtcgactgtcccgccttgcagtagagaacaccgactttgtagcgcgtgtaaatgggctgttcgtcgattttgagcaacagttcctccactttgggaacactgagcgaaggacgaagacagccgaattggacctgaaaataaagggaaattcagcaaaaaatgcagtttttttgtttggcattgttttcttcacctgcggacacacaatctcaagcagttcacgcatcagtgtccgcgtgctcctgtcctggttggccgcgtcggacaacgcttcctccgggacggacacgcgcattgtgagcacgtcgctaacgcgtaaaatcaggcggtagatggcgtgcagcgtgccggcgccgccgtctttgctctcctcgcgaaccatcgacacgcaaatggggccctttggagagagaaaatgattgtttaccaacattggcttaatgtgacgacaacgatgatgatgaaacttaccgaggattcgtcaatgccgacgtattctacgtggttccgcccggcgaaacaatgtctgtagtaataggagcccaagtccaatggttccaccaccacccgtggctgtcgactggcacagagacggccgcccaagtaaacgttcgaaacatcttccaaaacgccgacctaaaacgacacatacatgacaattgaacggtcttcggccggtacttctgctgccatgtgttctctgtgccatgtctccgccaattcctccggcggtgtccgtctccgtccatttgtgtggtgttgttgcttaacgttgtgttgttggcactgcccactgctggtggtcggaaaggtttgccgtgacaatgcaatgcgtcggatgggctcttcgccgagttcgttgcgaaatgcgggacaatttgccaacaaatcgttgcatttcccatcgccggggtcatcctccgacggactttgggccttcaaacagaagcaacaaacatttcgcttgttcaactctgtgccctcccctccccccacctgtgaagcgccggtaggccgtgtcgtctccagactcgacgtcgacgtgccaagaccccacgcgtaggctaacgaccggcagtcgtggtaagcgcacagatgtgccgaggtcgggtgccattcgctgtgcgcgagttgaccgccgttgccgctactgatggacgaagcgaacgcaccgccgacgacgacactgtcgtggatggtcggctgggaaagcgaacattggagcaaatttgaagaggaaacaacggcagcggaggaattggcggaagccgaggacggcggcggtgggtggggagggagaggaggcaagtttctgtgctgttgcggtgcatcggcggcggtcacatcgatggccaattcagcgcagacattggactgaagcggagagcaaaaagtgatttcaatttcaaaagttttcattgtttacatttctggcatgcagagacaatttcagggtcttagcttagggtaatgttcggaggggtcaatggcagtttttacaatgatttcaaaaaagaacttggtagaaaatcaaatttggaatttctaataaaattatttaaaaaaaaaaataaaataaaaaactgtcgaactgttatgacacggttcggagataccataattataaagagatggccagttaattttcgattttccattaattttttcccctttggggtttatttccctccccttggaattgtccctgccgttgtatggtcacacttttgcattcgtcgtctgtgctatcttcgagtgctcaacgtcggctgatggcaccgcaacaggagggatcatttgtttgctgttggggtgcccaaacgaaggccaatgccccgcaatgtttccgcttccttcgcttcgtttttggctttcgcttcctccaaattcggcacttttcgttcgctttttgctgaaatttttgttgttctttttctgctgatgttgtcaccgtttttacggttcattggccgcttctttcacggccttggtaaagcatttgtgactttaaaagaaatttaaaaattcaaggtttctgaaaggacagaaaaaatgtgtaaataacaaaaaaatcagaggaaatgaaaaaatttccaattgtttattcggaagagcaaaaaattaatgaattgaaaaaatgtcagaaaaagcgaaaggactttaaaagagattatttgaaaaagaagctctaaattgaggagggaatctgataaataaacaaattggcatttattgcgaaaaaattataattcaagcagaaaaatgaatgaatttatttgccaagaaaaaagaaaggaaaggaaaaaaggaaagaaaaagtgttaacaatcggcggatcagtggacggattggtgttaaaagttaggccaaggccaatccatcccaataatccgccgctgtgtttgccattttacttctttaccgccccttttctccctttcacttcacacattctgttcacgaacgaacgaatcgcatttgtttaacttttgttctttggggatgcagcgggcggcatgaaaagagagcggaaagagagggcggagaaagggggaaaaggggggggagggagtaaatgaatgagagaagggcgagtgacaaggggaggagggtgatgagagaacggcgaaggatggacgaaaaaggcggaggagaggggcgacaaaataagtgggaatgatgaggacagcacggcagga

SEQ ID NO: 888 - DNA, 1483 bp, Heterodera glycines
aatttgaaaaacctcccccctccccccgccgctgtgcccctcatcttccggcagagccgccacgccaccgttttttcaggccttcatcaagtggataattgaaaagagagaatgggggaagggagtcaatgatgaagcgattgagtgctgctggcggcaacattagcgtaaaaagggggaggggaagaggagggaaggggataatggatgggaaagggggaaaagaggggaaagggccgactgaatgagggggacagacccaatccgacggagaaaggactaaatttaacatgtaggaaatgtgcagaaaacagcagctaacaacactatttgacgaggagaagcagagcaatttttaatccggaggacccaaatgaaaaggggaaattgccttcctttgctaaaatcaaaagacgaaagcgttgaaatggcaaggctaatgctgccacacctttccttctgcgctggcgttgcatcagcagcagcgagcaaagcaaaaactcaatccgtccgtccgtccgccccctccgtccgtcgtcgcttttcctcgcaaattgccatgcaaaatgtttaacaggaaacggaaagtgagtgagtgtcgtgtgtgggttgaaagcgtacatttatttgctttccccccattcgttttgtctgcggaaatttcaaaacgtaaaaaacacaaaaaatattcgtcggcctccgaccggcgcaagcggcggaagtgtgtaaaaagcgaatgaaaggagagcgcaatagggcacaaataattggattttgggcgtatgacctgtgctgctgctgtcatcgccacgctgcgcccgacgacgccaaagcgatggcacacaaatttaaaagggcggcgcgggcggaggaaaagtgggagagaaagggcaaaaatgggcggggggggcaggagacgggcgatcatttttgaaaaatggcattggcacaacaccaaacaacaaagtgatggagtggcatgcaaatatgtaaatattaaatgggattcaaataaatgctaattgtaagcaaaggaagcataaaatgcataaaaatggctgggccaaaaagtggggggggggggggagagtcggcccattgactcatcagcagctgatgagccaacatttgatgctcacagaggcaaagaaagccaagcgaaggaagcgagtgacgcactgtttgactgttgttttaaatgggcatattaagcctaaaatgcgggcatttgtaatccctaagatgcgccgctgtgacggaggacgaaagacatgcgacttttaaagggtcggccgagcaatggcgtcaaaatggggtcatcggaaaggcaattttattttttcatcaaccaaaatggcccaatcactcgtgccccccccccccgtcctgtccaaagttggccgagccgtctccggcaaagtgttgccctcagcagagcgcgcaataataatcaattccaccactgccaccaccagtccgagtt

SEQ ID NO: 889 - DNA, 3642 bp, Heterodera glycines
agcaagccaaccatggtgataataatccatttagacagaaaatcattaaatccgataaacaaaacagaaaatcatttcgacggtttttgttggtcaccgatgaaagtaacggcggaattatcgacgattcgtttttccatttctctccattgttcagaaaaggttgagactgatgccgaacttcttgccaatgttttggaaatagtaacgggaaaagccggtcttcgtgtcctcaatcagctgctccggcacttggtcagccttaagctcgagatcggtgctgtcgccctacaaaaaaatgaagaaaaaataaaaaacgaaacctccagaaacaaaaaaaagaaagataagctccgcttctcccttcttactttgtccttaagcgtaaatgtcacatccgcaaaatgtcctaaaaatgaaggaaaatgcgaaacggattcagacttttaggtttacctgatgggtaactcttcaaacgccatgccattgaaataagcgccgcatttgcctaaaatcaatttgcggtgttaattcggctaatcccgcaatttcaaaaaggcgggattgtgaattgagatcccccaaaatccgactcgggacccggtcacgcgcttatttcatatttttgaatgtagattaagccaatgatgtttcatccatttaccaatttggtgaaatgacccgacatcactccgccaagcaacgaaaactggccaccttctcgcgcatcaattgacgaattcggagaccaaacactgaccaactgaaagtttgtggagggaatgaaatgcgatttaaaatcaaattgtggcttaaaatcagaggtttcaagatgaaatgtttatccaaaaaaacacctcagacgcagtcaaaatctcaaaaaggcgttcgggcggcactttgaatgtttcggtcagttcgaaaccaccagttttgagagcgttttgagctaaaacgaaaattattagatttaaatacccataaatcaaatccgtgccgaattccctcccctcgccaacttcgtttattccccccccccccctcactttccgccgtggtcactttctcctccgtcttctgaatgatatcattctgaaagcgcttcttgtccaccaccgttttcccttgcgttgccaccgcctgcggacgaatggcgcctttgctgtccaccggcaaaataatccctttgctgaactcctccttcaactcgcgcacgtaagtgcccactttggaacggacgaatgagagcccatcggtggagagaatgtgccgaatttcgttttcatgtgggcccgccgtttcaatgtgcacggaaatctgtggcataaattttttgttttttttggtgccatttgaaccacaaatctgtaattgctacctcaatttcgtgcgcctcgttctcatcgctcaaattcagaatttccacacttcctttgtactcagtttcggaaccagaaacagttgctaaaaaaagcaaattaaaatcactcgtttattacaaaaaaaaggaaattacaaaccaatgaaattgacgtcgatggaccactcgaagaagaaaatcagtttcgccttccgattgttcgccgtcgcttcgccctccaattttttgaagtcggaaaattcaattcgcaccggccctttttccaaggtttgacccaacaaaagcacgcgaagcctttcccgagaccaaggagtggcattcttctcaacccttcaattgtttagaagtgcatatgaaatgtgtgtgtgagaccaaccaatgccaattgttcacatttgtggcatccggcctctgaaacaaccaaagtcaaagcaatggcacttatttaggaactctctctttttatgataatggggaaaagtattataatggaaagtgcaccgaaattaatatcgtaaaaaatgttcaaggtatcgttttaaaaaaaatcagtaagcgcaaaatagcagcgaatttttaatagctaactccaatatccaaataaatgtgtctaaatgaagcttttacctcttcgacaatccaacgagggtcccctaaatttcgggagaaatttaataagtatgcaatccacaaaatgaattttttaaaatcccaaaccttctccccacttcgccatgacgcaataaataggtttcaatcctcttcttttacaaaaatattaatttatgtttacaaagtttcaggtaacttgttcaggtatctatgacaaaaattatatatatctagtcggataacggaaagcaagaatgttaattacctacattgctattttgaaatttggtcctgatttttctcgtagtaaaacataatgccaattttaaaaatacgtataatctaaaaatctagagcatgtccgttcctcaaaaaggatagaaatctttacatatttaaaaaatacttaggtaggtatctaactaatatagttcattaaatgaaatctccaaatgatccattaggcgtgcgtacgtttttaataatttcgaagaattaggttttgcgtttatttccaagaagtaaataaataaataccggtaaagacatcaatattactatacaatgaaacaaacatacacttcatacaaaaacttgattttatgttcctaattcaattcgaaggtcaattccgtgggcactccgtttgctccgtccagaaccccccgagccttatgtggaaagtccgtaagaaatgggattttcaacttatgtgcgatccaagcctaaaacgcgttttatacttgtaaataggtaattaattagccatcaattcggaccatttcatttttgtcgttaacagtccacacgcacatgtgaaatccctggtcaaccatttcactcacaaaatttctgacaaaggaaaaaggaaagcgcatcgcattttacataaattaaatggcgaaagtcgttcaactcactcgcaaatttcgccacgcttaaaaaaatttttcttttttgtcagtggtatgagaatttaaaatagccaacctcaatgagcaacatgtcaacaccgaggaagtgaggaagacagactttgatactcctgaagagatgataaaacattgtttaaaggtttgtcagtgagttgagtggtcaatcaactccatttaccatctgtacaaagcatcgagcgcaaccgccgagcaatggtaaaacggagaagagaaacgagggattgtcatcttcagatcggtatatgaaatgttcctaaaaggaaaataggtatgttttattatggtatttaaagcgagaaacgaagaactgaccgacgacgaaaagtgaatcctaaaaacagggattgtggtttgtattttcggtcatcccctaccatttccaacctgtgagaatgtgactgttcctccgcttaatccaatagatgatccacggaaagaaggagcagacgatcgcccggtcgaacaaattatattcctcgaacagctcctcaattttgatgaccaactaaaaagcaaccaaatctttgccatgccaatttacaacaattttcagcatcactacctcatagtccgagtctttcacatcgagaatcctgtaattttcgcatttatgaaaccctcgttacgtcattcacttaaaagacgcacattttcacattgtttttcgtcgcccattcgaccacttccttcagc

SEQ ID NO: 890 - DNA, 3493 bp, Heterodera glycines
  misc_feature (3429)..(3429): n is a, c, g, or t
aatttttattctaatttcattttaaaaaaagtacctcttaattaattcctttgcaattgaattcacagaaatgtttccatcggttttaattatttctcatggaaaaaaaattcccattttatcattttctccattttttaattatgtaattattttgggttttcactaaatattccactcatatgtagtcaatcacttgttttttaatgacaatccgtcgaatttcttatcccttccgttttttatgcgaaccgaattttttacattctttttccattaattattcattctttttttcacccctctatccaaaactaaagggcgtcgtgacaaccgctgaacaaaatgtgatcagcttgcgaaaattccacgtttttaacatttcctaccaaaattgtccaaacaaaaagggcgactgaatccataccgtgccccattttcctttttctcctttgaaacgtttcattccgtcaaaaaaaaccaagtcccaactatgttaagtggactcctcaaacggttggaagaggattgtattgagtcagccccggcagcaatggacaaggacgacgccaaacaatttgaagaatatcgggcgaggaaagtcgcaatgataactggcatttctggtcaggtaattgaccgtaaatgaattaataccaagtacaagatacatacctacttattttttctccctaggatgggtcgtaccttgccgaatttctcctcgccaaggggtaccaagtgcacggggtcatccgtcgttcctcctccttcaacactggtcgaattgagcatttgtactccaatccgatgacacacgctgtcggctccagcttcaacttgcactacggcgacatgaccgactcgtcctgtttgatcaaactgatcagcaccattcgtcccaccgaactgtaccatttggccgcacagagtcacgtcaaggcaggagatttgcttcctctcttttcttttatatttgcaactttctcaggtgtctttcgacttgcccgagtacaccgccgaagtggacgccgtcggcactttgcgcctcctcgacgcgatccacgcgtgcggactcacccgattggtccgcttctaccaagcatcaacatcggaactgtacggaaaagtgcaggaagtgccgcagcgggtgagagggtcaaattaattgcatttaaaaactcggaatgaatttaggaaaccacgccattctacccgcgttctccttacggtgagagactgactttcatttccatttttgtatgagaatcaaaggcatttgtttttttctaatttttacattggatcatttttgtacatttttcagcggttgccaagttgtattcctattggattgtggtcaattaccgcgaggcctaccaaatgtacgcctgcaatggcattctgttcaaccatgagagtccgcgaagaggtgaagcaaaagtgtaaagacaaaagcaatttcaattgtttaggcgaaacctttgtgacgcgtaagatttcgcgtggagtggccaaaatttcacttggccaacaggaattggtcgagttgggcaatttgaacgctttgcgcgactggggacacgcgcgggaatatgtcgaggtgacactcaaattcaaaacggaccaaaaattaaaaacaaattgtgcggtgtatttccctgcattccattttttgacacaaatcatgtcttgaatcatggttataatatttacgaggtttatgactctctgagttttcatttcctgctggcggtacggactgattacacaagaaattggggttttgtgtctgatcaaaatcgactatttttagaaatttacagggattttattatttctaatttgtgtcggatgaatgactgactcccttctgtttaaggccatgtggatgattttgcaacaggattcgcctgacgattttgtgattgccaccggaaggaattacacagtccgacattttgtcgaattggcctttaaagagatcggcgaaacgattatgtacagcattaaataattcactaaaacatcggacatttccccgagattgcctttttcagttgggagggcgaaggcgtcgacgaagtcggccgcgagaaagagaagggcactttgcgcgtccgcgtcaacccgaagttttaccgcccgacggaagtcgaacttttaattggggacccgagcaaagcgaagaaacaattgggctgggaaccgaaagtcgagattgaggtggaaaatacaacgactttaatttttaaaaatatttaaatgacaggaattggtaaaggaaatggtggccagcgacatcgaactgatgaagaagaatccgatggcatagacgcgggaccaatggattaatttaattatttttgactctgagccattttcacataattgcataactgtgattggctgggctcagattttcagtctcaaaaccccaaaaattaatttttgacaatttaccaaaatccgagccctagtaactgtacctcctcgcctctttctttttaattttaggccgtgatagttgcacttttctgttattttatcttttactgtgactcgcatagctttacgtaccataatggagctttaataaatttctaattggcaaaaaattacttataaacattaatggttctaaactatccatgaatgtaagatttttttatacaaaataagaaaacaaaaaaaaacaaagctttccccattttgggtagaataatttgtcctaattcaagacatttataatgtgcaattcccgccttttccacaattatcggtccacttctccgaacaccaaatccaaagtgccgataatggccacaatatctgcagaaaataaagattaaacatgtaaaattaatggggggggggaagttgcgattacccgggatcaaatgcatatagctgatgtcgtggattttggaaaggtgtgcaaatcctgaacaattttgaatttaattgacactcatgtgatgcctcgcctggtgctcggatgtaacatcggtacggtttgctggtcccatcggccaccaaataaacgccgaattcgccctttggtgcctcggttggcacatacaccgcccccgggggcacttggtagccctcggtgaagaatttgaagtggtggatcaacgattccatgctatcctgaagtaattactagagatgtgattttttttcgattggaataaagaaagattaatcactttgcccatttcctaccaaactttgagtgtttcaagtaataaaacaaaatttttagagagaagaaaggtggtcgagggtcggcagtttcgttagttttctaatttttcagaatttattttttccgaattttactaaattgcttcgaaatttgtataaaaatacgaatccacttatggtcttacaatttcatgtttttagtttgttttgccatcccanaaattaccttcatttccgctcgattaggcggcacaactttgtggtcatcaattttcacttcgcc

SEQ ID NO: 891 - DNA, 832 bp, Heterodera glycines
ccaacaatcggctagcggcggcacagcatcctctacctccatgccgtcgtcgcaaatgggcggtgccgtgccatgctcatcctcctcctcgtcatccgcttcggttccgccctcatccgccggtggcacagcaacgaccggggcggctggcggcacaacaatgggcagtggacgaagggtaattaatttttttttaataaaattccgaaataaaatttgccaattttgtggcaggctaatcgcacacgcttcacggacttccaactgagaacgctgcaacagttctttgacaaacaggcctatccgaaggacgacgacttggaaatgctcagcaaaaaaatgggtgagtgattaaattataattctctttgatcacttttgctgatcaatttcaatcctgatcgctctgtccaccggattttttttaaatctttgatcagttctagttttggttttctaatcaccttttttcttctaatcactgatcatccctcatttttacgcttgaattttcccactcaaaacactttttttctgatcactttcattggacaagtccttcttttcaatactcgttttgcaataagtaatttgcctcttccgatgatcactttatcactcttttattcccactgatcagaaacttttttgtctttctaattaccgatcacgttcacttggctctattgctgatcagtgatcactttttgtcaaaaaccatatcaattcaccattgctttgctttcataacaggtctgtcgccacgcgtgatccgccgtttggttccaaaatgcgcgccaaaaggggggcaaggtgttcaagcagcaacccc

SEQ ID NO: 892 - DNA, 4986 bp, Heterodera glycines
aaatttgtaaaaaaaaattgagatttttttttgattaaaaaattgcatttcaaattggatattagcatttgctcacaaaattgacttttgatttccaaattttatactgatttgaagggtccaaatcttaaaattttcaaattgtactgatacactgattcaccataacattctttatattgtctgctttttgattgtgccaaatttggcttaaaaatttttcaaaatttgactcaaaagcctcacaaatatgtttttatttcaaaaatttggagcaaagagcaaatttaggaaaaatttttcaacgataattttatttttgaaattttgttatttttgtgcctaataaattattattataattatttttcaattgtaaggaaattttggatgggttttaaataagctatatgagaaatatacttaagatttggtaccttagtttgtttattatgaaaaaaaacttgggagcactgaatttttgaacggggggtaggctttttccataaaaaatgggcaaattttttcaaatttacctacatattttctaacaaatttgatcctaattttaatatattttgacgatggtcttaacggaaccgccggatcccaatattcttatatttttgccaaagttttgtctcaaaatggccaaggctaaaatggctaaaaaatttcacgattttttcccactgaacaaaaaaaaaagagctcttcggccgccccctcccgaaatttttttttttttttttggttactgatttgatccaaattaaatacttcaatcttcgggacacctgccaattttattggaatttgaaatttcgcatgttaatttgcgggagcattcgaaatcagtgaaatgtgaaaaagaaattaaatttaaagcataaaagttcattaaaaaatttttaatttatcttcgttttctgggaatttgccgttttatcgggaaaatcgcatttgctcgagaacactttgccttgactcccgacggcttatatctccagcattaagccagagattcctcatttgatcgttccggcaaatattgaccccaaatttttgcgatcagatcaagcatgagggaggagcggacagtgacgcgcattgttactgtgtcgcctgtgaccaacagtttgcgagtcggcacgcgcttcaggcccaccggtgccattcgccgcatccgccgccggcggaccatgcggcggcacggcactacaacgaagcggcggcggcgacagctggcacaatgtcaaacgcgaaggaattactgccagcttccgccggcggcgttgagccattggatctgagcgtttcgtcgttttcggccgcctccatgccgccccactcgcgtgatgagtggatgatggtgccagcagctggcgccagccggtcatgcggtgccaattcgctgtcgcccaccgcgttttccatgtccgaggacgggggcggtggaactaatgagcaacaacaactacagtatggcgcaggcggggaatcccaggtacggtgtgtgggatagaaacacccttcgatgcatacggtaatgaaatgggaccgttaccgtaacatactgtattataccggcttaatacattatcattcctggaaaaatagctttattgtggcccagatactgtagttagagtatggtaaggaaattataaagttgcggagtggttttctacgtggctggatagtggataaaccgtatgcataaataccggatatactacagtggccctccgaaaaggttggaatattgtatagacaggaaatatcgtctttagaatacagtaggagaatgccaaaaacataaaatgccgtcctcctgactccgcaggtctgctcgccgatgggctcgtactgctccacctctggggccggcaccgcaatgcttaactcgttgttccattcgtcacccaacggacagttaatcggcaacaatagcaacaactacagtaacagcggtggttgtggcggaggaaacggtaatgggtctggtaacaacaacaacaacaatagccacaacaataacaatgccgccaataaacgtttccgcactcatttgacgccgatgcaagtgtttgtaagtacagtatgaacataaattaagggcgtaatatgggagcagcattggtatactgtggcgcataaaaatggtgatactgtggacgactgtaccatatccccttcaaatggccactctttatcgtattcttttcagacagcatatcgtatccattattttacataggatactacagtatattagttgtatcgtaccccttatgatcgacaatttcgattcatctagcgataccatattcccttcctacgctaccgtatacctgctggatttaataaatttttcattttttaatctcgatgtttaaaagccaaacataataattccgggacagatcatgaaatcactgttcaacgacttcaaaacgccatcgatggccgagtgcgacgcgttgggccaaaagattgggctgcacaagcgcgtggtgcaagtgtggttccaaaatgctcgggccaaggagcgcaagtgcgcgggcggtagctgcaccggcagcggcgcaggttggtgccaggccgccaatggcacaaattgggtgggattagtgccagcgcctccgatggcagaaatgggtgaattaatgccagccgttcggcattttgaatttaatgctgataaaaaagaattggagagcgggatgacagtcactaaggacacaaattgattggaatactgccagccaaacggggcatttttagttgctagctaaaaggaacttgtctggggcttaccggtaatcacaaaaattgaataatttgtgacagctggttacggtatttacgggataataccgactgatcaggaacaattttacagtatgttgtcctttggacgaaataattgttttaagcttttgtttaggacatccaccataattgcctgtaggttttttgatactataattgtgatttctgatactctaactgtctatgggtttcacatactgtatttgtcttggggatcttgcatacagtttttgacttggatactgtaattatcatttttttaaatgtgtatcctttgtacagaatcctctgatgatactgctgttacggtgccgcactgcgacttggctggccagcgctgccacctgtgcggcgtggagtttgacgcgcgactgtcgctgcaggaacatatcttcggcatcgaacatgtggagcgagtgcgcgagcagggcgtccaaatgcgcggaatttgcaccggcgtcgctgcggcaccgacggcacagccgctgacagacaatgccggcagcggcggtggcgacaaggagaagcggcagcgagtagcgagcggtgacgcggcagcgattgaagcggcggcggcggcgacgaccgctgcgacaacaacggcacaccaaattgacgccgccgcggcgatggcagcagcgcaacagttcccctatgagctgatgtacgcggcggctgccgccagcggtctgtcacctggtcagtgagtgcggttgatcagaggggctaattaccatgccccaaggaatttgggtacaaatttgttcggcactggttttcccggcatgggatttgacggcacaaattactaattggggttcactccatttttcaccattttttactccccaggcctttcgccctaccttggaaaatttttttaaaaattcaagtttctttctaaaaaattcaaaaaactttccttttttaagaaagttcaataaaaatttaagaaaattatgttattttttaaaattctgtcattttttaattttgtgagttttgcaaatttttattttggttttttttttctaaaattttatagttttcataaaaaaatttattttgttaatttttttttcgatctatagaacagttttcaaattcatttggccgcgccgaactgtctcattggcccaaattttcaaaattgagcatttttctttttttaaaatgaaaatttttggattttggctgtttgtagggctcttgctgggccccattttgaaaatgtgacgccaagacttgatcagcatagtgatcaaaatattcaaggacagcccaatcattttgcaggcactctcccatctctgctctatgatccgacggtgttcggcacgccggtgcccgcgctcaaaatccccaaatgcgtcatgcaacaaatccttgccgacatggcacagcgccgggagcacacgctgttcacacaggacgggctggagctgggtgaacttgcagcaaaggttgacgccgatgactttgccgccgcgggcaccaccgatttggaggtggggtgaaatggcactttaatgaactgtgtagcattttgttggcatacatttatggcattttccattggatttagcacaatccatttgacattcggacattttctctcattggcgccctctcccgtgacaaaattttgaaaaaacaaaatttttttctaaattgcttaaaggtttttttcaaaaaaaaaaaatttaagtaggtagaaaagatttaatattttctttcaaaaatgaaagcaaattaagcggggatttgcccatcatagggtgccattcgatttccggaaaatctttgacatcgtagtcccgatttccggaaaatttttggacctcggaatgccaaccttggatgattagacagtgatttaccaattatttttggggccattaaattagaccatggattatgccaatgtgccaatttcagttgggatttgtgccaacattttgaatggatttaggtgggctggggctgcacccaatgcggcaacgtgttccaacagtccgagcagttgcagaaccaccagaagctgatctgcgtgggcgcggacggcgtgttccggctggtccaaacccattaccaatgcaaccggtgcgcggaacgatttggcacacaggtgagaaggggagaaagccgtat

SEQ ID NO: 893 - DNA, 5020 bp, Heterodera glycines
cagccccacctgctaatgcatgccaatctggcagccggcggcggcattgccgggcccaccgatctgccagccgatgatcagcaacagcttcagcagcatggtggcaccaacttcaacccgttcaacaatgccaacaacaacagtagcgtgcagcagcagcaacaacagcaacgctttgtgcgtacgccgtccgccaatttccaatgtgttcgttgcaaattggtgcggcgtttaattatggctaattaactaattaattaccgattggagaacactctcccatctctgctctatgatccgacggtgttcggcacgccggtgcccgcgctcaaaatccccaaatgcgtcatgcaacaaatccttgccgacatggcacagcgccgggagcacacgctgttcacacaggacgggctggagctgggtgaacttgcagcaaaggttgacgccgatgactttgccgccgcgggcaccaccgatttggaggtggggtgaaatggcactttaatgaactgtttagcattttgttggcatacatttatggcattttccattggatttagcacaatccatttggcattcggacattttctctcattggcgccctctcccgtgacaaaattttgaaaaaacaaaatttttttctaaattccttaaaggtttttttcaaaaaaaaaaaatttaagtaggtagaaaagatttaatataattaaaaaattttctttcaaaaatgaaagcaaattaagcggggatttgcccatcattggatggcattcgatttccggaaaatctttggggtcgggtttctgaaaaatctttgaccttggaattcgatttccgaaaaatctttgacatcggggtcccgatttccggaaaatttttggacctcggaatgccaaccttggatgattaaacagtgatttaccaattatttttggggccattaaattgaccatggattatgccaatgtgccaatttcagttggtatttgtgccaacattttgaatggatttaggtgggctggggctgcacccaatgcggcaacgtgttccaacagtcggagcagttgcagaaccaccagaagctgatctgcgtgggcgcggacggcgtgttccggctggtccaaacccattaccaatgcaaccggtgcgcggaacgatttggcacacaggtgagaaggggagaaagccgtatggtgtggcacaatttagggctgggataaagccaattggccatggcacggcaaattttggggtgtgggattaatgcatcgatggacaagaaataaaattaaaaaattagtttttttaaatggaaaattggccaaatctttgagacagtggcactagagagggggcataaagcatatctaaaggagaaatagcataaaacataaaaggtgaagccttgctaaagggataaagcatgaaagggagtgcatcataaagcataatttaaatgggacaaaacataaaacagaattgaataaaaatagagggaacaaataggctatagcaaataagcacataaagcataggggggggggataaagcagtcattaattgaggaggcgggataaacgcataatgggttgagataccagcagagatttattcttggttctcgagtcaataaatttctctgggcttttctgtcgaggtcattaaagttttttgaagaaaaattgatacaattcttgagtcgagaaattctcaaattttttgggtaccattctctctcgttctcttgcaatcaattcttggtctccgttttctcgagtctctaggaaatttcaacactcccggcagccccagcaaacgaggggtttatccccgtgatccgttcgtggatggattggcggggatggcccctaaatcgggggcggggaccaaatgccatatcattactgtaattttttgtcataggccgagttccaagcacattgtcaagcggacttgcacaagttcaaacaggacaacagcagcagcggtgccaacaatgccgcctcggcacggggcacggaggttggcgcaactgagtgaacgcgaatgcgcgccaaatttggattggcaacaaacggacaaatttatacaacgaaagcctactgtagctgatcgatgatctccggcgagttaaagcatgcttcttcttcacagcacaaacacacaaacacacctactctcctctctgtacacatttaccacatttgtaatagtttctggaaaagctttaaattaccgcgtccaaaaaacaccacatttttggcattctcctcccccccactttttttggcataatgtcacacacaataattttgattttttttttcatttttttgtgttttcatctatttggtcagcaataggctttctctgttctctctctttctctttttgctatgtttgcgccccattgattttttttgatcgctttttcattgttttacacatcgccaaatttactcatatatttaaaacacattcgcgtgcagtattatttttgattaccatttatcacatttaaataaaaaaacaaaagttttaattgttttttttgctatttttcgagggctctctgatcattggcttttgatcaatatggtcatgcctcaactgatcgctcggttctttttggttctatcgatagatcagaagtggatcagttggtcatcgtttgatttcaattttcaaggacctgatcagagatgactggcacattcaaacgatctaagcttataggaactgatcaataatatagatcaaaggttggctgccagatcggaggactttgctgatgaattggttaacggatattagctcaatgatcatttatgactctgatcactccggtccgtgtcttaaaatctcctagacattgtttttgagagaaatcaactccataatttgtttaattgatgacttctgctgctgccgctgctgcccaatttccataatcgttcaccataatatattttgtaataattattttatcactgatcagttaattgtcgattgatcgttgatccgcttaaatttactcattattccccctccccgtccccgctttgttccccccgtgagtccaaaaatgatctttgaaaaatgatttaaaaatgtgccaaccctttcaaattgaggagcacataatgccaacacaaattttgctgctttcccttcctttttactgtcattccaaatatacgattaccgtaagaatttgtctgttattttcatatagtatacgatcaccatacatttttttaaagattttttggtgatcattttcccacacattttctgtatggcaataaataaaaaaacaagttcatttattccattattaattaattaattaaattattgataggaaacaatgtataattagaaatgtaattatcgtatattaattattagagtagaagtatactgtagtttggccaatgtaataacatagaacatttgtactgtacaaagaaagagaggacaattcagaaaagaatgatgaatgaattctgtacaatttgaatttgaacaattgaataagctaatgaattaattaattgattagtcataataatccgatcagaaatctgatcaaaaaggaggctggatcacttgatcatgaactgatcaatgagacaagaaaattgagaaaattaaacagacagaaaatgatcaatgatcaactcaaatcagtggatgatcaaagaaagccgagaaaattttgatctctgatcagtgaaatccattaaaaaaacgatcactaaggcagtgatcagaaaataccatgaaccatacaaaaaatcacttattaatacatagaagaggaaaagccctgctgaaaacaacaaaacaacaacaacaacgagttttgtgtgctgtgtgctaatgccatccatctcattttggcggattttgttgctgattgtgagcaacttgttgctgttgttgttgttgttgcggcagtggtggaggcgtcggttgtgtagcagcgatttgttgcagttgcaccagttgttgctgttgttgctgctgctgctgctcggtgaagccgatgccgccaaatgagtgttgccggaacagtccgttggcggtagcggcgccggcggcagcgactgccatcgcggcaagccgttgttgttgctgttgctgctggtgttgttgttgctggtgttggagcagttgctgaacggaagacagtgcgttgctcagtgcgaccgccgcaacggtcgctgacgcgttcgcggcgactgaggagggcgactgttgaggcggttgctgcgactgcaaaaggttggcaaccgcggcggctgcgggaggcggcggtcgaaatgcgctcggctgctgatagtcagggacgctgaacagatttggagtggaccgcctcatatgtgccggcaattgggctgaaatatttggaggggaattagttagtactgatcagacgggtgatcggaaaattggcagtgatcgaaaaagttgatcgaaaaatattggttccaatacgatatacaataaatgtgatcagggaatttgatcaagaccacgcgatatacaaatggatgtgttcagggggaattttgatcagccacagcagctttcagaaaattgatcagaaaaattttttaccgtgtagcgtggacagcaccatttgctggttcagtaagccctccagggatggcatgcgtgccgccgccgccgccgccgccgcttcttgtactgcttgatgctgctgctggttctgttgctgtgccgcggcggacaacagcttggcagccgcaaccatgtgctccatgtgctgctgctgtctctgttgttgttgctccattgccgccgttttgtggttgttgctgttgccgggctctgccggtgccgggtcaggcggcgccggaggttgtggttgcgcgatgacgggagtcgcttggggctcgtcccgtggcacagtcgccgacgacgccgatgacagcgacccgccagcgagaggagttgttgtcccagtgtcactgagcgactgttgagctgt

SEQ ID NO: 894 - DNA, 4945 bp, Heterodera glycines
  misc_feature (51)..(51): n is a, c, g, or t
aatgggtacgcatgtgccgggtgatcatgtcgcgacgactctgtgtgaaanacagtgcaaattaggcacggcgatagttacttaacgatactaattgcgtcaattaaatctaattgggggcaaaaggactccttttcctaacattttaaatagaaaacaatttagtaaattttaaagaaattcaaaaaaaatttaaggatttaaatccatgtagatcttaaaaccttaactaacaagtttgaaaacaatttaaaatccctcagccgttcccttgtaaaaaaaatatttaaaaatttaaatttttcaagaagtagagaaaatcaactcgttttaaagagattaattttaaaaaatcaaaaaatttttaaaaccaaaatttttttaataatttaaaaaacctagaaattttgaagaaaaaaattctaatttttcatttcgaattttttttgtttgttgaagaacatcaaaatttgcaattcttagaattttactatcgtgggggaacaacaattaatgaatttgaaagcatttggccaaatttgtgggccaactcaccgcggaatagttgcactgcggacactgatacggcttctcgcccgtgtgcgttcgctgatgcgtgctcagatggtcgctgcgcgagaacacttggccacacagttggcacgcgtagggccgaatgccggtgtgcagacgcatgtgcctgtgccaacggaattgggctttactcgggttattggtggtcgagaatgttgaacccttgacaacttgagaaaagtgtctcgaatttttgctgatattggtcccggcttttcagtctcgggattaactctcggtgttcagttgtttcgggaactttttcggtttctcaaaccaaatttattatttaagagccaccaaattttaattagaaaaatcgtttgtaaatcaaaaaatgctgatcaatctgaatcagccaaaaaaaaaagaaaaaatgattgtgtgtgtttttatccaaaatggcccgggcggatttgagaaatttttgcaattcttgaaaatttggcgtgtcggataaaaaaaatttaccatttcttaaaaattaatttcattccctcacctggtaagcatgtccgatcggccaaaactctttgggcaaagtgtgcatttgtggacccgactgttctcgtcgttcattgacgatgatcggtcccggtgacggctggcgatgtgtttggcgagccgatcatgcattgagaagccctggaaccatgcaaatcctgatcaattgaatccagtaatcccggcaaaaccaggacttaagtatcggtaatcctatctcggcctgatgccaatccaaatcccaatcccgactttttcaaaattcctggatctagtatttagtccacagcccgcccccttcagcctaagaattttttattttgttttcttgaaaaaataaataaaataaataagtgattaattttaagacagtgccaatgccatctttatgtttcaagaaaaatattcgcttaattaatgatcaaattaattgtttgtgtatcattaatttcatttacttaatggctttattaatgagccaattaactaattaagcagcattaatcacctggccacaatgttcgcaaacgtgggtggcctcgttgagcggcactttgagcagcggtaccgtgtgctgttggcttgtccgtcgctggtgcattttggtcccagtcgctggtgttgtcgccgacgcgtcgccacagccgccgccgccgctttcggcgctcgcagtcgccgcggccgcttcagtcgcggcggagacgtccgattcggagcgactgcgacgccacatggtcgccggacggatgggcccggcggacgaattcgtggccgatgggctgggccacaaatgttccagcgaattttgcggcacaattgtgggcaccttaaaaatgccataaattgaatatcccggtcgagatttcacgttcatgtgtcaacagattttttcgccgtctcgcgcgcgcgaaaaaattaaaaattatttttattgaaaaaaatctgattttttttgaatttcaaaatttttgaacgatttttttcaattgtgttggtaattttttttcaagaaataaaaattggtgatattttagagcggaagacggaggattatgggcaagggggggggggggggaattgcccaaattatttggatttggcggataacgggggattaagatggctggccccacacatacaacaccacttgcctgcaacaggttggcctcctgctgcggcgggattagcgagtgccgaaatgcctccagggcagctgtttgttgccgaatccaatcctccacttgccgtttgcggtctttgtccaactggaaataggctttttgtatgtttttgtgccggatgcaaaccacgaatcccctttttcaatggcattttatttggatttgttatttttatcagcaattaatagctatcatgttaatcacaataattcaaataagttttggccttttttgttcttggaaataccaattatttccggaattctgatcagtgatcaatcagtgatctttgccagcccatgttgatttaataagccccgattgcacctcttttggcatttttttcacaattaatgattctgatacgtcattggaagacaaggccttcattggaaacgggcattgttacactaccaagagtatgtccttaaaattgtcaatcgcccgtgggtaattggagaaaaaataaatcatccattcttttttgaacaattttgacacaattgatcactcaaaaatctttttgatcactcggacctctatttgatcacttgaaactcgtttgatcactcgtgaactctttgatcacataatgagagaattggcattatttcaaaacattagacaaccagttgatcaaattacccaggtacgtacatcgccgggctggaacagttcggccagcgtcggagacgggggcggctcctcaatggtcggctgtcggctgacttgcgcgttggcgacaatggcactcgccaacgcttctccatcaccgccgctttccggcggtcggctgctgagcagcgacgcggcgtgcaccggcggcgactgttgttttaagacgcacacgctcgctggcggcactggcgagtgccgcccctccgcgcttgccgcccctgccgcgcgtttatgctggtgcaacaagcgccgcttttggcccgcgtgcaactgctgctgcgtgccgttggacgacgacggccgcgacacggtcatggcgactaccagcggggacgacgaggtcgcgtcgctggtgtccatgcgctcgtcctcgtcgtccagctgatgctggtgcgactgcagcagtcgctggtgctcgctgccgccgccgccgccgccgctgtgcagcgtctcgccatcggacagagagcgctcgcgcacctccgcgtcaagcacacgcgactgagacggaatacggaggtggcattcgctaccggcaccaaacgcgtccaacccgtagaagccggcgatcggattggagagggagctgcgcgagcggatttgatcaaaactgaaaaaatggatccgagagtaaatgaatgcgattatccggcacccatagaatccataacttaatatctagggatttatgccaagttttcctgatcggcaattagtaaagtaaccgatttttcgtgtcaataaaatccgaaagttttcggtaaatctgtaaatagaaataattgaaataaaaaatttctggcaaaaaataatattttttattttttatttttatattttttattatttatttatcgaggctcagtatgtttgctaactcactgagaatacaattttgaaaatataattaaaaaactaacaaataagcaaattttttggctttgttcaaatcgaacccaaaaatgatcagaaaatcgatcaaaaagatacccaaaaaatcgataaaaaattttgctcattttaaaaaattaaaataaaactgaattcttgttttaatggtcaaaaaatcagcaatctgttgacaagtgatcggaaagtttcatatttattttttgagacttttttgtgccaaatgcgtttttaaggctcggatacggaatttaaacggctaaactctgaaattgactcgacaaaatgaaaaacgctgatgctttgaaaggcatgaccacctgaagtgcaggttggtgccggcacggtgcactggcgacggtgacaaatttggcgatctgctcgagaacggcgtgccggtgacggaagtgccgcccatatgcaaatccgccaccccgtagtcggagaagggcgagaatggtgccggtgacaacagttggtgcggcgtcaagaaacctccaccgccgccggcaccgcccgccttggcactcgccgcttcatccaccgacaacagctcgcactcgccgctgcgccgacgcgcgacgtaagcgtcgcggaacgcttgccagttggacgcgttgattcccagcgcggtataatgcgaggcggagatggaggaacggggggaggagcccaggtccgaggttgggtagctgggcgacacgggcggcagtctcggcggacctgtgccaaaagtggcggtttgattttggcattccgtgtggcgtagtggcaaagcaacaaaaaaaaaacataccaccggcgtccattgttccgttcggaatgtagttaggactgagctacaaaaaaaagggggaattttaattttaaaaatggcactgatcgggaaatgccagaaaccaaaagcctgaatttttggcaattttagtatgcaaaatagtgatcggaagcgatttgattaaaaaaaatttcaacttgatcagtctcttattgagcaacgaagtctaaaaagtgctcattttgaactatgagccggaaaattcaagtcctataaacaactcataaaatttttgcgaaaa

SEQ ID NO: 895 - DNA, 6704 bp, Heterodera glycines
gaacccgaaaacttcgttgaagttatcttttccatttatgtcttaaaaatttggagtaaccatttttatcccttttttccatttgtgcactgtccaaaagtgtgtttgattaattggccccatttacaataaattcactttagaattcgtgatgcttgttctgaacctgcttcaacacgaataaatttcgacgcgaatccatcgacctaatgtggaccaattgtttttatgaacccattcgtttgtacaaatctgtcggtgacttggatgaagaggaccgtttgcttattaagcagtttatatcagcgagcatttcgtcgatttctttgcttctcgaccaattcgtggacattcgcgcgactcttttcatccatttgggagacctgcacagatattcctacacaactgttgagcaaaatatgcaacatttaacagcagctgctgaatattacaaaaaagcgctgagattggaccccaaaaacggacatccgttcaatcagttggcattgctgttgaaggaacacaatttggagcattcgctttcgctgtttcttcgtgcttgcattgtgccaaggcctttctctcatgctttaaagaatttgcgtgcatttaagcaaaataaatttgagcacaattcgtctctttctctgtttaatcttgtggacattcttatctacgattttgggcaagtttaatttgtcttctttttttttggttaaatattttaatgatttagacgagtttcgttcgaagatgagcgaaagcgttttgatggactatttgacgaacttctaaagcaatcccactatctttttgctgttagactcattcattcgttcgcattggcttcaatttacactttattaaacgaaggtgtgcctcaattaatttgttttaacttttaaacaaaaattaagaggacgacgagaaattccgatgttccgtttcttttctttttcgcaaatgggctttattattggttgaagttgagaagcacttagaagagcacactttaaaagaagatgaacaacaactcgcaaaaaaacgccgccagaatagaaagtcttcgtcttccagtgaatcgtccgaagaaaatttggaattcaaaaacggaactgcgggggaagagtcgcagatttgcgccgactttgcctgggtgttactctcttcaatttttgaatttttgaacttcacggatgggcgatttactggcagaaaactgtctgtttctctcaaatttgtgagttttcaaaatgatttttctaatcaaacaaatttttttagcaattccaaaatttgctcaaaactttagtcgatatactcaatgaattgttgccaaaattgagcgcaaaaatgcaaaaaaatgacaatgaaatggaaacgatggaacaaattgccgaatggtccataaatgggccatttactgaaggcaatgaagaagaacagtgcgaaattgctgccagttttattcgccatgtcgtcaaaaaacaaaaattcgctatcgtttttgacaaattctttcaaatgagcagcaatttgatggaagaaaaagagcttaaaccgatagaggcgttttcaaagatgcaccttcaacacgtgacaaatgaggtgatggaaaggggtcgaacttacatccttttcaaaaggctattttggaaacattttgggaacgaccctccaccccctcagggcgtctcatcgaaaatcttcttcccatcccttttttaattatcatcttctaaaatttaaccaaaaaacaataaataattcaccgaactaatttcagaatgagaagacaagcaaagttcctgtttatgtcgcgcccgattcgtccgttttcctccacaaattggacctcgttaaacatttgcttctgtcgatgaaccaaacgattataattgcgcgcagtgttttgagccgattggacaaagtcaaaagggaaaataataatgcgagggaggcgataaggcaaaaagcacacgaacaacaaccaatgggccacttctgggctttccctttatttaggtggattcagagtcgcattcccgagggccgagttcgaatgcttccacacacaggcgagaaattcatcaatgaatgcctccaatttgtgcgcgaaaagggactattggacaagaaaacattgttctgttcaattttgacaactggagaagcttccgaggaatacgaacggcagaaggaggaaatgcgccaatacaattgtcagttccgaagacaattcaattaaaaaattttcgtttttggtgttaagctgtgtcagtggaagacatcggagattttatcacaagaattgtcagaatcaatgcaaacacttaaatttggggaacataacgaatcgctgtttggaatgatgctttatcgtccggtattaggtatttcatttataaattacttaaatcctaataaatatacttaaaattagtgtcgaagttagcggaccgtcattgggctgccctacggaggtcaaatgaaatttcggtaaatgcgattttgtttttcgagactcattgtcagaatgattattccgaagaataaatttgtttttcttttttcgtttaatttgtccttaaaatagcaaattgcttcattaaatatcttaaagcataattcttttttattttttaatgaattgtttgatattctgtcatccgttcaaatggcacaagttgacgacgattatgaagcgaacaaaagggtggcggagagtttgagggagtatatgggcagggtatgttcatgttttcgtgtattttcttgtctgccttatctccaaatccattcagaggctaaatgttgcgaatgccttcgaaacgcccattttggaagggctaatggctgctgtgaaagtggagccgctgcaacgcattggcactgtgttggacggttagtcatttgttcgtcggatgtttcatttgttaagcattgaaacggcacttttcagccagcgccagatgctatgcattccgtgtggacaacacttacagtgcgtagcctttgcttttgaaaatggaccctttgttaattgtcagcatacaaaatatcatactgaaacagttggattagtgatgagttgtattggctcattgtcatacttaaaatcgtaaaattcattggagtattattttcttttttcaacatttatttgttaggtgcctgctacaaagttctttcagcggcttcaggaggaggtacaattgaaccaaccttaaatacaatttacgttgtatttagagaaaattgccccatttcaaaacgacgattggcagaacgatcgggatgaggtcgagacggtcaatgcgaacgacgagggaggggacaaaagcggaacaattgcgagcggtgaagatggagaagggagcggcgaaggaaacaaacgggacaaaaacaaactgtcgaagccattggactcgtcgagaaaagcgaagcttttgacgcgagagactcaccaattggctgagggactttggaagcgatttgcttccgctcaacactttggggacacggaagatgatttgcatgcattgttcgaccaattatcaactgatgttactgggacggtaatgaaacgacgtcttggagcagtacatgggtcgttggaccgaaaggacaaccaattttcgattgaggatgccatctacaggtgtttctgaatgcacactactcaatgttctgcgccatgttaatttttttgtaaatttcagaaagatttcaaaggatttcgaagaagggtccgctcgaagtttcgtcagcaatcaaattctgatgaacgaccatggttagtggtaccaaatggtatctccttctcatttacctgcttatttttaggcaattttctgattttgcacacaaattggccgggggacgagccgtccaatccgttgccttcgttggtcaatcatctctcagccgcatcggcgcaatgccaaacaaaagcacttgaccaaatgacttctgctgtgaaacgtgcccagtccaaacggccctccgagttcgctcttctcactcaaatttgtgcggacgatgggcagaatttgcccacaatcgatttccaagaggaaaatagctacgaacagcgaattgattgtgttgtcgatgtttttgagaacgacggcggtgatgaggtgtggtggcaagaagcaccaagcccgtctcaaaaaaaatttttggaaggggaaccaggattttttttactctgtgagacaaaaaaatgtttccagtgttttcaccgcataagcgaaaaagcaggaatttgtagcggtgccgattggcgttgccgggaaattttttttggcaatttaatgaaatatgataagaaaataatacactaaaaatatataatttttcatttcggggccccttcccccaagttactcttccgttctttgttgcttttttattttcaaaattgggccacaaaaatattttgatggtaattaatttatataactttttactttgaagcatgcctcgacattggaaagtggtgatggtgcgcctttgcattcgtgtcgaatggctgtcgatgaaaccatcgctaattcgccttttgctgactcggccattgctcctctcacaaatggcataaatgtgccccatggaaatctcgaagaagatggtttaatcgttgaaacgttcagccaaaacattgatgaaggaactgacaatgagtcaaaagcaaccacagcttacttaggcagagatggggaagctttcggcacagaagtggtgagtttggcacggtattcctcccccatttaacttagcactcaaaaggctgaacgtgaaaagcaattggctggaggcgacgaggacattggcgatgaacaaatctgccgtctaattgacgaaaaccttttgccgctcactcaaacggacaatgaaaattttgtgccattaaaaaatacacttgttgaagatgattcccattggatggttgttttttttgggtttcttttttagcattttaaagtttgttctttagggggatcaaaatgttgaccatggcttagcgccaactgatgaaattcgacccaaaaaagggaaaacgaagcgcctgattcacgaggccggcagcgcaaaaggtatttttatttatttttttattttatggcattggaaacattcgcagtttaattaacttcagcaaaacgtcgtctgcaaaagggaaatgatttcgaggaaataagcggaattgcggatgatatgtgttggattccaaaaagagttgtcagctcattcgtgaagagagcaatagcggacattcagcggacatcgctggccaagcgaaggttggagatggacgccgacttcagcgacgacactccgttgccctttttgaacaagagactgacgagggacagggccaaacagctcgagtcaatggcatacgactcgaccaatctcctcagggcccgcattttctacaaggtggagagcaggatggtgtgacccggcacggcatatgccgaaaagtgccgtcggggaaatttggatttgcggcctaatgattttttcattttctacctcttttccacttgtttgttgtttttgcgttaatttttgcttaacggttaagagccacctcggagtttggtccttctttccctttgatgactctctgaaaagtgtccgtctgatcagtcggccccatttgctgccgcccttttcactgcctctccctcgcgacgaacaacacaacgaatttatcaaattttacctcgaattgatggatggtcagggtacggcggatacggaagcagcagatgtcatttccctggataatggggaggaaaattggcaaatggacgaccagaacggcacatttggagacgaagttcccatagacgctgaatttgctgtttctccgcacatggcatcagacgatggaagtcccaaacgaagaagatggggcagtgactgcactgatgaagaggacgacgaccaattggacactggctttggtttcctgaacaacataactctgaggtattcttacaatcagtcgttgggaaaccaacaattgtttttcagtgaaataaagcaaatttactatcaaacgaatttgaatgtggcaaaagtgaagaaggcgatgctaagggtcatttcctcccataagaaggtatttgcgtggtaaatgactaatttaatttaattgcatggtaaatgattaatttgatttctatcggtgatcgtttaagtgtgctcctccggcagttgattttgtgatgggtttggacgacgaagctgatgcagaagaccatctgtcatcttgtccatcagaggacaatgattcggaacagattgaaagcgatgttgaaagtatggctgccatttccgacgatgggacgccaactgcggagggagttcaggtgggcaccgccgagtcattagttaaggcactttggacagcactttcagaacaccgcagcgaaagcccgggggatcaacagcagagagttattcgcgaatgtcccgcgttttttgagtggaatgacaaagcgaaatttgactgtcacaaattcattcgctgttctgctgcatctatgcaacgataaggtgagaaaagaaggaaagaaaacaccgacggattggctgtaaagaaaattaaccacgcaaattttagcaattcactttggcacaaatggaaggagagaataaattagtcgaagggcattctatggctg

SEQ ID NO: 896 - DNA, 2688 bp, Heterodera glycines
tggctacgactcgaccaatctcctcagggcccgcattttctacaaggtggagagcaggatggtgtgacccggcacggcatatgccgaaaagtgccgtcggggaaatttggatttgcggcccaatgattttttcattttctacctcttttccacttgtttgttgtttttgcgttaatttttgcttaacggttaagagccacctcggagtttggtccttctttccctttgatgactctctgaaaagtgtccgtctgatcagtcggccccatttgctgccgcccttttcactgcctctccctcgcgacgaacaacacaacgaatttatcaaattttacctcgaattgatggatggtcagggtacggcggatacggaagcagcagatgtcatttccctggataatggggaggaaaattggcaaatggacgaccagaacggcacacttggagacgaagttcccatagacgctgaatttgctgtttctccgcacatggcatcagacgatggaagtcccaaacgaagaagatggggcagtgactgcactgatgaagaggacgacgaccaattggacactggctttggtttcctgaacaacataactctgaggtattcttacaatcagtcgttgggaaaccaacaattgtttttcagtgaaataaagcaaatttactatcaaacgaatttgaatgtggcaaaagtgaagaaggcgatgctaagggtcatttcctcccataagaaggtatttgtgtggtaaatgactaatttaatttaattgcatggtaaatgattaatttgatttaattgcatggtaaatgattaatttgatttctatcggtgatcgtttaagtgtgctcctccggcagttgattttgtgatgggtttggacgacgaagctgatgcagaagaccatctgtcatcttgtccatcacaggacaatgattcggaacagattgaaagcgatgttgaaagtatggctgccatttccgacgatgggacgccaactgcggagggagttcaggtgggcaccgccgagtcattagttaaggcactttggacagcactttcagaacaccgcagcgaaagcccgggggatcaacagcagagagttattcgcgaatgtcccgcgttttttgaatggaatgacaaagcgaaatttgactgtcacaaattcattcgctgttctgctgcatctatgcaacgataaggtgagaaaagaaagaaagaaaacaccgacggattggctgtaaagaaaattaaccacgcaaattttagcaattcactttggcacaaatggaaggagagaataaattagtcgaagggcattctatggctgaattcttcgttaaatttccaaattgagtccgagtaccttgtatctcacaaatccgaaaccgatctccagacaaattgtatagtttattattgtttctacattcttttgctgaatacgaatgtggtatacaaagaatatcaaatggaatgactgattatactgtatgtgataataaatcagctttcatttcgccagttcttcttcccctccatgttcaaatgaagtccctttcctccccagcaaagactgtctccaaattaagtactccgctgttggggaacggatgcacacatttcgtttctcttttcccacttacacttcaaaagttcgtctggccaaccctccgtttgtgatgtattggctggggatgcgcagtttcactttgcgttgtcctgcaatgcttcttcccctttgggttgtcctccccaatccccccccccccctcacctggcattatcccatcgtcacagtcgtgatctgttttgtttgtttgttttttgccattattaaataaatccccctcccccgacgactgacaaatcttcagcacggggtcaatgtttgtcagttcgcgtgtcgaccctctcatttggaaggagccagaagagtcggtaaacgcctcgtcaagcctaaagaaaggatgtttggcgagtgtcgctgctaggaaagaaccgacacgtcgtcggggtcgggcccgtcgtcctcgtcccacaactgaacgtacgttttccgcaagtgtcccctcccctcttccccccccccttgggcccaccttcactttgacccccgaggcgggtctgttcccacaacggagttggccacgtacggccaccgcctgctgccgcatcgcttgtccacaattggccattatcataatgaggcccaaaacaattaagagggaatggcgagtgccagcgatgcaattgtgcacgaggggcatttggtggaagttaaaaggaaagggacggacggaattatagtagagtcacaaaaagagagaatggagagagacgaatggaacagtgccattcatataaacacttcgttatcaacaaattgttgtttacccattcgagtgaatattaatggcaaagaaacggaagagtccaaaaatgaaaaaccaagacaaaggacttttggcagtgacaaatggccgatcactttatcattcattccatcgtattttcatgatacggtcgaaagaacagacgaagaaataaataaatgtcaaatgagtaatgcacgtacaataaaaatccccatttgtcgtctcacatttgggaactcgttgtcggtttctgggattggccagctttctactgattgttgggacgcttctccaactcaaacaaataca

SEQ ID NO: 897 - DNA, 970 bp, Heterodera glycines
ccccccccccccctcacctgcattatcccatcgtcacagtcgtgatctgttttgtttgtttgtttttgccattataaataaattcccccctccccccgacgactgacaaatcttcagcacggggtcaatgtttgtcagttcgcgtgtcgaccctctcatttggaaggagccagaagagtcggtaaacgcctcgtcaagcctaaagaaaggatgtttggcgagtgtcgctgctaggaaagaaccgacacgtcgtcggggtcgggcccgtcgtcctcgtcccacaactgaacgtacgttttccgcaagtgtcccctcccctcttcccccccccccttgggcccaccttcactttgacccccgaggcgggtctgttcccacaacggagttggccacgtacggccaccgcctgctgccgcatcgcttgtccacaattggccattatcataatgaggcccaaaacaattaagagggaatggcgagtgccagcgatgcaattgtgcacgaggggcatttggtggaagttaaaaggaaagggacggacggaattatagtagagtcacaaaaagagagaatggagagagacgaatggaacagtgccattcatataaacacttcgttatcagcaaattgttgtttacccattcgagtgaatattaatggcaaagaaacggaagagtccaaaaatgaaaaaccaagacaaaggacttttggcagtgacaaatggccgatcactttatcattccatcgtattttcatgatacggtcgaaagaacagacgaagaaataaataaatgtcaaatgagtaatgcacgtacaataaaaatccccatttgtcgtctcacatttgggaactcgttgtcggtttctgggattggccagctttctgctgattgttgggacgcttctccaactcaaacaaatacatcacgtcatccttgctcaaattgcccaactttttagcggcactaaa

SEQ ID NO: 898 - DNA, 2229 bp, Heterodera glycines
  misc_feature (109)..(109): n is a, c, g, or t
gtacgcgctgtcaatggtcgaggcacacacaaatctgagcaaatcgatagtaagcagcagagggcacgtccaccactcacttgtggatgaacacattcttcttctggcncaaacggtggattctgtcggacgcctgcaactccaacgcggggttccaatgcaaatcaatcataaacaaatgatttcccccaatcagattctaaaattaataatagtattggtaacatttaaacccaaaagcaaataccaatccaacgccgccggcggtcaatgataaaagcatcactttgggtcccgtgttggttctgttgaaagcatccacccttgactgactgaagcaaaccagaaaatgcactcgccttttcgaaagaaacacaaaccgttcttccgtgcgcacttctcccgttatgctagtaaaagagatggccttttgtcgcaagtgaaattcaatgagagccaacatcgaagtccattggcttacgataacgctaaaaatgagagggcgatgaaagcaaaaattttattccgtaagtttccattgccgtcctcgtccccattttaccatttatcaccgttctgaacgactccatccaaacggttcatcaaagcgttcacctaaaaaccaaaagaaaaatggacaagactctcttgaatactttggtgctttggtgttccttctcaaaaaggcgttcgatttgctgcccttcgtccttttcccgctcctcatttctctcgagggcttcttcttcgagactcatttgagccattgacatttcgagggctttcgcaactaaattctccgcatcgctgtccgtctcaccctcgtcttgtttaaatgcgtcaatgtcaattgcctaaaaaatcagagtcaattaagtttgctcactgttttatatactgaaattgtgtaaagagtactcacattcctggtcagagacaggtgaacacacgcctgacgaagtcggagcagcagtgaaagaatgcaggagtaagctttgaaattggcatcgacggccatccgagcaccgcccccttaaaagaagcaatgattttgcacccaaaaaccgcgacaatactgaccaatgaatgggtttttgattttcgccccgggcttaaaccgccgaagagtgccacagccaccaaatgcaccgtctcgaagcaactcgcgcaccttctgcctatattgggtagtctcagaaatttgttaccctcccttaatctcgcccccccccctattttagtacggtacgtcttaacttaatgaatccaaacaagaattagaaaaggatgttacttggatgcctcaaacaaaattgaataacaatgctgttcaagtttttggagttccagggtgaccagctcgtacttctttggttgcaggtcaacctgacaatgagtaatttattgttcgactgtctcaattttgatctgtccgaactcacaatcggtcggttcgtttccgtacaaatttgatttttggtacgacggagcagaatactcttcacaataacattcaacctttgagcacttgttccttaatcatttaattaaaacaacttttgtgggaaaggcataaaacctgacgaagtcataatgaattccttccacattttctcttcggaaaagggagaaattcgcaaaaagcttaaaaaggaaacccgttggctttttgttccaatttcagccttttgagaaactcaccgtatgagtgagaaaaggtcccaaagtttgttgtgaatgggcgtccccgtaaggcaccaccgatggacggcctccaaagcgcagcaacaatggaacttctgcgaattcttgttccgaatttcatgggcttcgtcgagaataatgcgctcccatgcaattttcgccagcacagaggaaggagccctgggaaacttaaaaaaggcaatgaatttaattaggtgacaagtcgtcggtcgccaacttttttgctcattctcttcccctggaatttccccgctgcgctctctccgctgtcatccgccccaatcaaattcatccgttggttcttcagttcactggccaaggtatcgtaagtggtgatgaccaagtcgtatttgatgagtctaatcgaaaattgagatttatttcgacagagggtataattttactttgtaaaaattcagtggattttgtgagaaagaaaaaaatattcctcttctttgacgaatggggtggggtggggggggggttgtcagacgcaccccttga

SEQ ID NO: 899 - DNA, 2064 bp, Heterodera glycines
  misc_feature (1976)..(1976): n is a, c, g, or t
  misc_feature (1996)..(1996): n is a, c, g, or t
tccgttcattctttttgtgcaaaatcagtgaaatcatcgccaacgttttgccaagtcccatatcatccgccaaaattccgctgggcggtatttgctgttcacgccaaagtagccaagtgagccccgtcttctgatggggcagcaaatccacgcgaagtccattcggcgaatctgtcgccacattttcgggcagagttgaaagagaactgaacgagtgaatgctttatcacttggggggggggggcacaaacctatgcatggcattgatgacgtcattggacactgatgagattttcatgaatctttcatcagtcatttttccaccaaaaaggcgaccaggttggacagctaaaaatcagtttctgttaggtcaaaagttctaacttacgcattgcattgtaaatttcggcacgattttgctcagaaactatggttggttgggaaagtaagatggttcgtggcacattgcctaaaatcctttgtaagtggtgaatgtaaagtctgagggattcacccgggagattcttgcggccttcaattctgttcggtaaagctccaactttatcagccgattcttcgtcttcatcaatcagcacactttccccctcactttggctgtccccgactgtttcgatgtcttcctccgtctcttcttcggctgttgtctcactcgaattgtgctcgacttgggcctcctcttcgctgctcctcccactttcgtcttcactttgaacttgaagctgtcgtccttcgtcggttccacttgaatcagataacactctcttgcgattttggtcttcttcagctgccacaatcgaattttgttcattttgtcggttttcgtttccattcgacgaacttgacacaatgctgtcctcgacatccgaagagataattttcttcgctttatatttgtgatcgtttttcacgtgaattggagaaagcgaacattcgataatttcctttttctgcgatgagtttgagcacgaagttacttctgacactgaagacaacacttttttctgccgattctcttgcccttcttcctcaaatgaaaatccgtccgaacttttcttgtcgtaaaagaaaaggtccggcattgtctcatttgacaacgattcttcagcagaaattggtgttttcttactggcaggagaagctgagatcgtattgttctgaaaatggtcaaatttttaactaatgtgcaaacactgactttttctttgagtaaaggtcgttttttcagatattggcacgtggatgtgggcattggagtagaagttgcagaaaaatgttggaagctaaaatcattaactgtccgatccattgtaaatctgaaaagcgttgttcttataatccctctccaagacctctctcacataatttccaaaaaaatcgctattttttccaaaaatcctcaaaaaattggctcaaaaacgaagtttgatcatttttggataaaaacacacagcgagccaattttgaactcaagttcaaatttaaaaataattttttaatcgtaacgccaaaattattaaatttaatttgaagttttccttgtaaaaaatgtaagatctatatagttagtgtctactttttactgtctttcttagtttacacacagtacatagaagtagaactcgaacctaggacctttgcttttttccatcgtaactttatttaaattttttaaataataaaaaccgctattttttcctctacaaaaggcattttattaaataaaatttggtttttggtactaataaacaaaatttgccaaatattcctgttaacaaactaggtactctattttacccggcgacgcctatcgacactacaccttccctaaaattttttgggagtgtaccaaaaatttaacgtatttttgactaattttttattattttgtcttttatagaaagaattaaaatttaaatattaggtaaatacatttctattatttaataaattattanattgctcccgctctcactgngactcccataaaaaatagacgggatttttacgagaatcccgctcccaaatttggactcctgcattttt

SEQ ID NO: 900 - DNA, 2076 bp, Heterodera glycines
atcagcatagcatttagaaatatttaaattaataaataaccctgtttcatatgcaacaatgtcacattgtgcaaaaaaaataaagttcaaaaataactctattcttcattacgcaaatatgatattttaaaaaataaaaatctcttaaaaataaaaaatccacattccacttgtctatttccaatagaaaatcagctagtgctccaatagaaattcgttcttcctgctctaatgtcatattattggcagtctataggaacaactaaaactcagatagtggaaaataccacatctcaagtggaagtaaataaggaggattttctcggtagtctttgcaactgcgatagaaaaatagtgttagtccaatctgagaatcttgtgcctcagtcctggccttcgtcattgtccagcgagctctcattttcgcatgagctaacgtagtataagtccgcgtttctcctcacaatatattgaactcgaatggagaaaatatgcaaatcataccccacccacaatgtatgtgatcgtgagtttataactttcctttcaagtccagaccaacaccccccccccccccccttctcccacttgtcgcgaccgctctcaactctctcttgccccactttacatagtttcaatcagagtagacgatgaaaagtaacgaatgacacaacaaataaaaataaaatttaaaaacgaacgagtggatagaaagaagagagcttcggatggagcttgaaaaatgatcagaaaagaaaaccgtccattactcacacacataaaaatcgatgctcaaaattcaacgctcacatttaaaaaaaataaatcatagatattatagaataataaaccaatctacggtatataattcaacatgtcgtctggtgtaatggtgaattccgaatgtcaaaacgctttccaacaactttcggaagggaaacgctatcgttacatcatctacaaaatagtggacaaggaagtgattgttgaggtggcagtttcttcggaagacgtaataagagaaggggaattaatttgaccatctgacagcaaaatattttcagattggctccactggaactgaaagttatgatgacaattcaaaggccgcgtatgaaacatttgtgaaagacctcaaggagcgaactgagggttttgtggactgtcgctacgcagtgttcgacttcaaattccagacacagcgccccggcgcaggcacttccaagatggataagattgtcttcattcaggttttaccaaatttgttttttcggtattcactgttttagctttgcccggacggtgcgtcaatcaaaaagaaaatgctttatgcttcatctgcgtcggccatcaaggcgtctctcggaaccgctaaaattctgcaatttcaggtgaatagaagccgcaaaaaactgtgaaagactaaggaacaaggcgtaataatatctggtagtcctcccccccccccctctttctacaaaatttttgtccgtaaaaagtcatgaaaatgttttatggggttttcgagatccctccgtacgaaaattacatctattttcgaatcaatagctttgaattttggtccaaaaatggactcatgatcattgaaagttattttctttgtattttcttagggcaattgttttttttattttcattatcttttttttaataattgaggtgtctgatgagtcggaaattgcccacaaggaattgctgagcaagctgaacgacaaataccgcgacaattgaatgattggttgggatatgatgtcctacacattcctctcaatttttgtcatttatacccaaatttaatgacgcttttatgttaaaatcaaatcatgtcacttgatcgccacaatatgtttattttaatatcgggtggataaaaaagacattaattcattcatatccgagaaaatttttgttttcataattcccgttatttactatttcaaaaaagaattgtcataattaaatgaatttgccttgttaaacatagaaatgcaacataaaacaatccatttgggcaaaatgatacaataatatgctaaaggtatgggaatttgcaaa

SEQ ID NO: 901 - DNA, 14428 bp, Heterodera glycines
  misc_feature (35)..(35): n is a, c, g, or t
  misc_feature (63)..(63): n is a, c, g, or t
cgtttgctgcttcgttcattcctccccgtttctcntcattgtccgctcaacggacattcgcgnctgcgttcagtcgcgacattcccacgggctttgaaaacgtcgttttgagcggaacgcgaccatttgtcgtttcagttccatcaccagcggtgacggctcggggtcctcttgttgcgaacttgccgtttcgttcgctctcatttcctggggcattgaaggcggtaccagctcaattgcttcaatccttgaaattgccggtgctcgccgtgtgcctcgagtagctctgttccgctgcatccactgattttccgtcaccaaattgcggatggtaacgatgacgggccccattaagtagacccataccaagggtatcaggacatcgcgcccaaaaatgaatgtgacgtaaatgcagcatgccgttgtccagtaggagacgagcagccgaagtttgtccatgaaccattcttcggtgaggccaatcactccgttcgggagagctcccagtgtgagcgcacgcgccgttttgtgctccttctccttcgacttccattgatccaaacgcagccattcatccaagtgcgcgaatagcccttcgcctgtttcgttgtcgatcgtccatcgatgaaaaactagcggcgtgatttccaacaacgatttgtctccagaggcttcgtggatctcagagatgctgctggagtcgattttctggatcgtagcggtgcgtgtgtcgattttgatccaattgctctggctcagttgcagataatggtagcggaaatttccacaatctgcgaatggtgatgacgctgtgaggatgtgaagctccggatccaggaatgcgttgagcgtcttcttgtcaatgcggatttggaccggaatgtagcggtaacagttgttgactgcttgatattccacattttgcattgaaaactcagcgcacgagaagatttgcatcgtgtcctcgtttagccacctggccataacatccttgcgtcgtaaaagtcgtctggcctgaatggtcggatttcctcctctggaacttcttcggcattccttggaaaaaagctgcgcgattgatcggcttgtggcgagttgtcctgcggttaattgtgctgcgacttgttcctcctggatggctctttttcccaatctacgatcgttgacgatcttcaggtactcatcctccaggattccgaacgattggtccgacaagcgaatcggttttccgttgcatgccgtttccattttcgcctctgctaaacgttagcgcctgttccttgcttttggatatccatgttccgcctgcccaatccgttgatcctgtgtgctctccgtccatactttcgacgaaatggtagtcgcatggcttacagctctcgttgcactccgtttcccaatttagggttgtgttgtctgccaagttgcagtttccggtcaaatagttgcaatcctgcaagtgtgagtagagcgggctgatcaactcaaaattgtcttgacggtaaaacagcgtcgccttctcgacaaaacaattcagcgttacgctctctcgctcccccgaaattagacttgagaatcttcccggaaattcctcgttcagtgggttgttgctgctccatcctcctccttcaatcggagtcattggcttatcttcgtacgggcatttgtgctgttcgatcatggccatgcagattctcttttgtactggcaagaattctttctccgtacgaacgaactgatcccccagaaggttagtataaaaatactccttcgttcgtttgatggcacatctgtaggccttcttcactttttgtggcttccgatacggcatgtaaagtgagatggtcaatcttttccactgagaggtgaggcctggcggtggtttgcagaacggtgatttatccgcgtccggtattctccacaaggatgatcctttgtgggcacaccaataaatggggtcggctccacggtgaacttcctccaattctcgattgagtcgtcgtaccgccggtttcgtttcatcggtcaccgtgccctcggttgggttcggctttgtcgttgttggcatggcactggcttgagatgggcgttccgtggttgctcagatttgatcagtccagcgacggcttggagtttgagtccactgcctccgtcttgagtccgtccttggttcttgattcgtagtcttccgctgtggttgcgtggtgactccctttgttttcgtcgtcgttctcgtggttaccgtcgtttcgggagttcgtagagtagtcatttctgtactggcactggtactcgtacgcactgtcgtcgttgctgccgaagtttgagtcgtaccacttgtttgcatccgcgcctttttgtaccattcccggatatgcgcaatggacatatccgccgctgttgtcggcaaagtgggcgtgatttgccctctcttgtcgaggctcagccgaggtaccgtcggctccgtaaatccaacgagttcctccattcgtagtggtcttccgaagggatttacaggaatccatctgccgtttcgttccggccgaatgacttgtccattgatcatcattggttgcaacagtgtgatcaataacatgaccagcatggtcaatcctgtcagacttttggttacggctcgcctccatccagttgtactcttctgggctgactctcctgactcgggatttgttcccgtgttggccggtgttcctctgatcgccgctgcgagttctccaattttttcgtattggtaaattccacagccttgcatctcggcgaattcctcaaactctcgtggcaaacgtgcatttttccgagtcgccaaatgaacttccagtcctgcccttgcaatatcttttatgtcttctttgaacacttccaattcttctctttcttccctcctcagctccaaattgaagataattttgatattccaattggccgggaacatcttttcacgcaacggtttgtcaccaaaatggacgaaccagctcgagccttcttcctcaaattccttggctaccagctcagcggcttcttggttactcacaaccaataccctcttgctttggagatggcagtccttccagtactccttggctctcagtttggtcaaggtctggccgaatctctccgtgagattcctgagccaactctcaaattgcgcctctgcacttatcacattcgttttcactggcacttcctccagaccaactggtccatagatttttcctttccactcttgtccaaaaacttggcacgaattgtcccatgccatcagcacacactcgagttgcttctgtggtatcgtcttctcattgttttggagcactttcgtccaccaattcttcaatgaatcctcaatctcgcttccgcttcccagcaaggcgcaccaattttcattaaatttcttggcgtgcatacgtcctagccaatcgaatgcgaaggcttgggccaggcagaccgcctttgattcggcttgcgggattttggttagccggccgtgggacagacttcccatggtgcaattcctttgacaaccttcatgtccctttacaccaggctcacatcgcgtaaacagcgaataattgatggtacgtcggtagccgggacttgctggtgccagctttattctgccagggttctcttcagcttgttgccctttttgccttcttttcaactgttcgtccaacggatctctggctttgaatcgtcgctgggaccgcacgggctcctttgactgactctcatcccgtgctcgcttgtcattccgaatttgcccttccatctccgaacttagagccagcaattcggttgtagcgccatttggttgccgtagcggagaaatgtcatgggcacgtggatgtcggtacttccgcccagtttggatctcattaatgtgccgtccacggtgccatttctgccttttgttgatcccttggtgcggggcataatgcccctttctccgaaccattccgcgtggtagtccccaacgcctccgatccttctcagcatttctctctgctcttcgtttttcgtacatcttcctttgttcaagtgccatttccctatcaaatttctcctggcgtgccaattcctccaaaggaacttctggttcggggtctccgggaagcacttccatcggttcgaaaggattacgtgtcgttccgcccgacgatgattcgacattcgtttgccgttgagaatccttcattgatttttccaatttctcctccgctgcctttctttcactctcagcgacgcgcctggcgtcatcttccatgaatttgactttatcttttcgcagcctttcttctcttagagccgggttagccttctcttgcagctctcgtctcacaaattcagtgccgcccaatccagcgaacaacttcctcaatcccgaaagatcaatcgtcctcccccgtcgtcgtcgatacgtgcgtgtttgctcattgtacgctacttgtgacggaaagaacgggtttcggcgaggaattctgtagttgcccggtcgcagtggatcatatggtccattcttcttcgatttgcctttgcctctgacttcctccgttggctgtctctttcgaattcttctctctttcacagcttgccgctccttccttcctctgacaggagacaaactcgattctgtcgtgacgatttgtgaatcctgcatcaccgtccctggaggcaaactggactccgttgtggctgcttgcgggtccccgccttccatcacagcacttggtgaatccataatggcagtcacttgaatttgactgacttcgtcctccgcagaagtgttaatttctagagggtacaaaaggttaatcgctcgaaccagagtttttccttttgtgtgtactcgtgccgtgcgcacgagtccatccctccccttcaaaagcttttcgacttttcccatcgtccaaatggaccgtgggtcttcctcttcttcaaccaggacaatatccccctctcttgggagacttccttctgctcggttggttcgatctctttctctgagtgaaagtaagtactccgttttccactgtttccagaatcgatcaattctttttattgcaactctcatcaattgatgcaattccccccttttccggggttggtatgtatagtcgggatccattggatcttcgtccgacaatggaaggcttgtttccacacgtttatatggcaataaaaaatcgacgggtctgagcggttgtgtgaattcttcttctgattggaatgtaagaggccttgtgttcaccacagcttcgatttcgcaaacaagcgtatcgaattcttgcctttccattaggctttttcccactgttcttcgtaacgcacttctggtgatgcccaccagtctttcccatgcgccaccttgccagggtgctcgtggtacgttgaatttccaactcactcctgagtggctggtttccaccagtatttctcttctccattcctcttttatgcactctgctccagcaataaaattggtgccattatctgaccacattaggcttgggaggccgcggcgtgagctgaaccttcgaaaggtcctcaaaaattctgttgccgtacaatcatcggccacttccaaatgaaccgctcgtattacgagacaggtataaagtgcgatgtagactttaactccgccttttatcgttaatgggccaaaatagtcaacgcccgtcttctcaaatggccttatcatcgcaactcgttcactgggcaagtttggcatttgtggataggcatatggtttaagcctctctttgcggcaattcaaacatccgtgtcgatcagacaatatcgtgtttctgatgaaccttcttcctttgggtatccagtacttttccctcatgtaccccaacagagtactgtgagttggatgcttcattttccagtgtgcttccagcacaatgagttttgtggtccatgcttcaggaggcaagaaaatcgggaatttcgtatcctcctttactgttgcttctccaatgcgtcctcggcatctccagatttctttgtctttgaacagacgaagattttcctttgttttttcctccgttggaaattgtcgttgtgcttcccatatcagcaaatgttcggatgcacataattcgggcactgacagtacacccttatcttggttcccgtgcttttttgggcccattttgctcagaattggcaacaaatttccattgtatccattttttgccaccgaatgtatccagcgtaagacataggcacccacggttttggcctttttccagctggagtaccggttcacatcaatggttggttggaaaggcacctcattcatgactgcggctgttttcacttcttcatcttcagcacttcccctgagcttctcttcatctgggtgataaacctttgctggttttggccacagggccttttcttctgataaccattttgggccatgcttccataacaaatttctgctcaactctcttggtgttgtgccgcgtgatgccacgtccgcgggattatctgcactgaccaaatgtttgacttcaaactgtccacgtatttttgctaatcgatttgaaacaaatcgatcgcatttcttatgctccttaattcgttcaacggaacacaagctgtcagtccaaatcgttgtctgtgttggtttgagtttgagatgttggagcacgtactttaacaacttcactcccagcgttatggattgtaattccatttttggaattgttgccgcaacatctgatatgttggagggcttcaccaggctctttgcaaacaccaaattgacgctcattttttctgtcgattcccggatgtaaatggcaacgcctaagccttttccgctcgcatctgcgaagcaatgcatttccttgtccacttcgtcttcgttgtcgactcttcgtgcgaatcgaatttggacctctgtcccctctttcgtttgccaagtctccatgatttgattccattcatgaatcaattcttcttccaatccttcatcccagccgtttttggcttcaaaacgtttttgcaaaaaatgctttgctgggagcactgcaggcgccactaaccccaaagggtcataaatttttgcaatgtgtgccaagatgttcctcttcgtgtgctttccggcaaattttttaaatcggaagcaaatttcatcatcctcattcgtccacggaattccgagaacttttatctccttttggtttttggccaataattccgcaggaaggcttcgtatggcgatcggcttactgcagaaaaattcctgcagcttcattcccccttgacggaacagctcgatcgattcgtggcaaatttgcgccatgtcttcattcttcttcacattgatcagtatgttgtccacgtacaaattctccattatggtttgcggtagaaccgtgtcgtagaatgagagatgttcacggatggttgcatttaaaagaaatggtgaagttgtcaatccaaatgagacccgacagaaccgaaacacaacggttctcacatatgttgggcttgaaatttctgtcttttgtggatcctccagccacagaaatctggtcgcgtctctgtcctcctctctcactgataattggaggaaggctttttcgatgtccgccaggattagatccttcattcttctccatcttagaaggatcccggtcaattcatttagcaacaacggccctgtgtgcaagcattcgttcaacgatggggctcctttgcggtttgctggcttcgcggatgcatccatcacaattcttatttttgtcgtggccttgtccatttttatcacgggccgatgtgggagataatgtaccggtccagttgtttgtgttggatccggcactctttcgattatcccgttcctctcccactcattgaaaattttttggtattcgtccaccaaatttaattctcgcaattttttcactgtgccacaaagtcttgccctcgcttgttgaaaatttgtcggcaaatcctttactctttcgttccatggtaggccacattcatatcttccttctttgaatgtcaagctttttctgaacgttctcatcacttcttctttgtcgttttcttctggattgtcactcaatccgattatgttcagcccgaaaaatgtctttatctgttcttcaatttcttcgtcagcatctcttctgctattggcacattgtaaggcacttatgagtgctccagtgtacgtcacttgcacactcatgtccattgggccctggacttggccataaccacttatcatccgcccgactcgagacgttgacaatgtgaatccacttggcaacttttctgtttcgtctcttattttcaggtcatgtctgacatccattcccaacagaatgtctggctgtcttggccgcgatggaagggaaagttttttcttgcttaattccgcttcatccatcgaattcagcgttacgatgggcatcgctttcacaatgaattccatttcattgagtgcgcatatatatgggtctccgttgactcccaaaaatcctacgcggacaacattgctcacgtagcgtttggcttctttctcgccaaaaccagtcaaatggcactcttccgtttcaatcaccggaaggcctaattgttttgccacattggcacggatgaatgagcgttcacttccgtcatccacaaaaactgatgcgaccatgcttctttttggattggatggattgaagatggtcacctctgctgttctcagcaggactcgcgaatttccttgcactgaattgcattgcgagggcgtgaacgaaacttctttgaattcgtcccgtttgtccggtttctcttctttccggacgttcatgactttgtttgccatgtttctccactctgttgccctttgtgggttgtttgtctgatggcataatgccgttgggtgtgcttgctggcacttgaaacatttcattgggcatgggcaatttcttccgatatgatttgacttcaggcatttgtagcataagcccttctcctggaggactgcaaatcgttgttgcaccgtccttgccttttcgcaactgtcgtgtctgtgtttccctccacagaaaacacacagaaacagttcaccttgtgtgttaactgctgttggattccgctgaatttttgggcttcttccttgtcccttacgttctcggaatgcggaattttgtggagtctgctgaaaacttcgttggccttgcctcggacttggcattttttgttccgggatttttcttcgctctccattgggtttcccgaaatgtgttgtggctacattgactgagcctccgaatctgttccgccttaattgtcgtttgaatccatgctctggatttgcctctttgccttcgaagccatactccctcatgacttctttgattgctagctctttgctcaatgcacttcctaaggcctttcggagggatgacgtgtcccaaaagtctggattttttgctttctcttccagaatttcacgcaggaaaggcttgtatagcttcttctcaagcattaaataaattggcggcccttcaatgtcttcttccgctgcttccaattctcttgccaggcgttccaattccatgcaaaaatgctttgtgtcttccaccgaaagtatcgcttgaggttcgacaactccgtgtgcaacctccttacatattcgcctttgtctccataggtgtcctttaacagcttcatggcaatttcgtaatttttctcttccaagcgtaggcctccgatgagcaatgcggcctctcgctcaaccagcgatttcagcaaatttagcttctccgttttgcttcctggcttttggtccacagccactttaaatgcttcttcaaacatgggccattcccgtttgtctcccccaaacggcttaattcttagtgttggcaattggtacaacgcggcagtcatttcattgcctctcgcacggttattccctttgtctgcttctgcatttgacttcgccattgcttttgcatgttctctttgctccactcgcgcgtctctgtccgctttggagcgttgcagctttgctcctgcttccaccttcatctccaggtccttaagctctgttagctttgtgttggctgcttccatttttgtgttcagtttctccgttgtttgaaattgttcatacgctgtctgctcactttttctttcgtccttgtccattttttgtatgacgtcatgccatttgcttgcggttatccaaatttgctcgattttggcattcactgcctccacctctgactttattctctctgccgcgctttccaggagaattgcattttccaatgaggtcagagtttggtccggctcagcatacaattctgttgccgtttttgccttttcaagagcctttagctctattgcgatttttgtacgcaaaaatcccgacatttttgctcacttttgggttctgctacccgacttccgaacaaattgtgtggggttcggggtcacaaaatagcagtaagttgaacaaacagtggacaaagtgagtttgacttcagacccaccaagagtcttacagtgtatgaagaaggacgctacgagttacgaaaaactcgatgggtccgaccgtgtaagcgggaggcgccttgggtcacaaaaaaccctaggagcgacctgctcacaatgggggacgccttgggttacaaaaaacccgaggggtcggtcactggagaaaggaacacgcctcgggttacgaaaaacccgaggggccaactgagcaaggaaaaagacgcctcggattacaaaaaatccgaggggccaaaccctggggaaggcaagcgacacgaattacaaaaaattcgtgcggccgaactatgggaccggggaagcgcctcggattacaaaaaatccgtggggccaaaccctggggaaggcaagcgacacgaattacaaaaaattcgtgaggccgaactatgggaccagggaagcgcctcggattacaaaaaatccgtggggctgcgctaattggcaagggaagtgccacgaattacaaaaaattcgcgggactcagctctgggaccaaaggaagcgctacggattacagaaaatccgaagggcaaccttccgggttcaaatcctaccgtcccctgtttttcccttttttgccctgcccaaatctcaaaatttcctcttcccccaatttactcactaatcccaaatgctcctgtgcgcaatgtctgttcggccgctttttgtccacgcacggtccgttgaagtgccagggtcgccacttgacgcagatgggggaggggtctgcgccgatttgtccgtttttcgctgccgccaattgcccaaatttgccgcccaagaaattgcaccaaaatattccacaagtttatggctcaaacttgggtaattaaacccatacataagaaatgtgtgagaaatacaatggggggaaattgtgacaatggggacaaaatgcgagggggaaatgcaaagggaaaaatggcacaattggggggcacaaaagtggggtgagtcgcggggaggggggggcacatcaccggagaaaggcgggaggggaagggtccgggcgaatttgctctcccgcaaattcgtaattttccatcaaatgatcgccgatttcatcggctgtccgcctgggtgatgtgtcgtttcgtccgtcgcaccgcgatggtccgatcggcgtttttgcactgcttcgggcgtccttcacgcggagaaggcgccacatccgctttttatcgctttccttcccctcattcacgtgctcgcctgctgccgtccctcccttcgccccctttttgtcctcccttcccttcatcatttcccgtttgccctatttttcccatctttccatccatttatcactccttgttcgcaacttcattcactcctccccgtcctcctcatttgtccgctcaacggacattcgcggctgtcgttcagccgcgacaccacagcacacaaaattgttttttgtaagcaacaaacaaaaaacttggtttaacttcaatttctattcattttcaggtgctgtatttgcaacaaaattgttgatgagccacagcacacaaaattgttttttgtaagcaacaaacaaaaaacttggtttaacttcaatttctattcatttacaggtgctgtatttgcaacaaaattgttgatgagccacagcacacaaaattgttttttgtaagcaacaaacaaaaaacttttgatgagccacagcacacaaaattgttttttgtaagcaacaaacaaaaaacttggtttaacttcaatttctattcattttcaggtgctgtatttgcaacaaaattgttgatgagccacagcacacaaaattgttttttgtaagcaacaaacaaaaaacttggtttaacttcaatttctattcattttcaggtgctgtatttgcaacaaaattgttgatgagacaaaaattgttttttgtaagcaaatcactttttttggttcattaattcttatttttattttaaagtgttttggtttttggtcccggattgaactggagcgaaaaaactccaaaaaaactttttatttaaattctttaatacttgtgtttaaataattgtcacaagttttattgaatttgaataaatttgtttaaatatttcaacatttgtctctactaattaaaatgttattgcgtcacaatattatctgcttgcaattcattccgtcttttcttcattccttgcttccttttttcccttccttccttcctcccttcctttcttccttccttaattattcaatttttagataaaatgtcaaatcctcctaatcctcctaattccccctatcattttttaaaagaattccaaatcccttggcaaccgccttcaagatccccatcgccgcttccttgtcctcatcaacctccttctacaccaacgggcgctacaactcccccgggttgcgagcctcttataacctggcctccggaggactggtcacctgaggaatgtatgcagacgaacaattttgatttattatggaattctaaaattaatataggttcttcgtcccagtgcatgcctgaagagccacaaattgtccaaactgatgtttaggacattgtgcaaccagttcatgaaattgaacggtaaaagagccaaaaattaactcgtgctaaattttgaaaaatctcttggtttagaaatgattcgccaaagcctccgccggtcttattgttctctgagtttaaaaaaaagctcgaaaacaaaaaaagaaacgaacggaaggccaagtatggcttgaactttaaacaaaaacaacaactttttaagaaaaaaactcttggaccgtgcagaaaaagctgaaaaggaggcaattgagaagaaaagaaaggaggaaacaaaagagtaatttgttatttttaaattagtaaaataaaaaaataattctttaaaattaaataaaagtttaaaaactaatttatttactaaatttaaataaattattaaattttttgtataaatataataaaattttagtcttcttggttggaaaaaataacttttttttgaattatttaaggaaatcttttaaaaaagtattttaattatacaacaatttattttatcacgaaaattttaatacagctacttttttattatttgacgaatgatattacaaaacattcaatattcctaattttatgccaattactcatgggaaaaaagaaatgccgtcgtaaaaatatgcctatagtgcctgtggttgggtaccagcatattttttggaaaactctaatgcttctctctagaatttgggtactatcattctcattaagaattataactgtttaaaatgaaatactttttgatactattcatttaacagattcaaaactgtaaaagagcgattttttgaatcaaactaaagtaatttctgaaaatctaaattaaagtcattccttccaacaaaacagaaccaacagtttaataaaggtaattatacaacaatttattttatcaagaaaattttaatacagctacttttttattatttgacgaatgatattacaaaacattcaatattcctaattttatgcaaattactcatgggaaaaaagaaatgccgtcgtaaaaatatgcctatagtgcctgtggttgggtaccagcatattttttggaaaactctaatgcttctctctagaatttgggtactatcattctcattaagaattataactgtttaaaatgaaatactttttgatactattcatttaacagattcaaaactgtaaaagagcgatttttttgaatcaaactgaagtaatttctgaaaatctaaattatagtcattccttccaacaaaacagaacaaacagtttaataaaggtaattatacaacaatttattttatcaagaaaattttaatacagctacttttttattat

SEQ ID NO: 902 - DNA, 6567 bp, Heterodera glycines
ttatttttgttgagctttttctttgcgtttttttttagtcgttaattgtagtaatttgttttaataatgattcgtggtaattgcggatatttgtgtgctgtggaataatcttgtttgtgttttaattgtgcagtcaattgcatttattgcgaattgactgagtcggcataattggaaagaagccgaacgaattggtcaaagtccctaataataatattgtccccaatctctcctgtcctaattaaagactgttcccgtgcccctgccctaattaatctaaggcaaataagcagcgaacagcaccgaacggcgagaagtttttactatttggcgctcctggacagaacacaaggtaacaacgacatcggttcaaatttttggaggatttcggcattttatcgatctctgggggagacgataaacttttcgacttttgatattgttctctgggggagacaatcaacatcaacaatcgttctctgggggagacgaaacaaaaacgcttaaaaagaacaaacaaaaaccaattgtttgttaagttctctgggggagacaaattcggaaatttttcgacactcaagtcacctggggggtgcaaatagtcgattttgaaatggaaaacttggaacggacactcaatcatactcgtttgactagacagcgagctcaaaatgaaggaatattgctcgacagagatggaaatgttttttttcgggagaatccaccaaatagaactttaggcgtgatgaaccaaaacgtggtggtggcggatcccaatttggagaattcggagcagctggactcgatggaaatgagacggcgccttttgaacccgaacaatgacagcgcacttggacagttgcgacaaaatgaacgtgccagccttgacgaaaacgaagaagaggaggcaaaccaaggttttatgcgaaaccgaacggactggacacaaaatttgggagagagggcaggcccaacccaacaaatttttcgaaattttgtctttggacattcccaaaatgaagatgacttcttcgatcatccaaacattagaagaacttcgactccggtcaatgaaaaccgctgtgttggggttggcccgcaaaaccttaatgaaatagggttgttagccgaacaaattgggagggtcatcgttggtcagctaaatagtgctcatcaaaatccgaacacaaacccggcaccaaatttgacgcaacatggtgttgaaatccaccagcaaatacaccattcggctgtttttgcgcgtcgagccaataacataccgtttcgaatgccgggtcagcaaaatccagcagcgattcaacaaaattttggtcgccctcaatctcaacaaattcaaccaccaaatttccaaccccgtcagccatatgcttggcaaatgaacgaacagtgcgttcaagtgcaacaaccaccaatgccgcagatgaactatcagccgcccccgacctttaacacacatcaaaatcagcctaattttggcatgggaaattttgattttgggattgtattggagcggatccctgacctctcaggcaccgaaggatcggatggtatcaaaaaattttttaaaaagtttgacttttattcattgaattggtcggatgcgcaaaagattagggctctagaatcaaagctgtatggtcgcgctgagcgcgcattccaaactgcgcaaagtacgcaaccctttcgctacgaaccaattaagcgcgaaatgcttaatctcctggacgaaactgacgcacgcaatttgaatgcgtttgatgaactgatgcaaggcgtgagacggggaccaaacgaaagcattgacgagttagcgaaccgtatttcaggcttggtacagagagcttacaacggtttgccacagcatttgagcaacgaatacgccattaagtttctggttagagcgatgggcaatcctgagctcgcgttaaacctcgagcttgtgagaacgccaggcatgaccctggaccacttcgtgtcacttgccgcgcgtgctgaatctacgcaaaaggcaacacaacgattttcgaggccggacaacagagaaaggacttggagaacgaacacaccgcaacatttttcccagacgaataatgggccctcaagaagcaattttgaggaacggggccagcaaatgcaaaaatttggaacccaatcaaaccgaagttggagttgcttcaactgtaacagcccaggacatttggccagagattgtccccaaggaaaaatttttcgcgcaattgagcgaactaactcttctacgacaatgaatcaacaaggcaaacaacaaatgggttataatcggcagcaaatgcctgagcccaacgaaaacccaccaaatcggcactaccagcaaaagaattatttgaagcaaaattgcttagttctgcaagaggaacaagttcatcaaaacaatttcattgttggtgaattgaagcaggacctggaagatttttttgacgaaataaggaaatgcgcgacggaagacaaaaattcaaatttttcaaaagtcggaaaagtaatggcagttttggttgaagtttttggaacgaagacgaaggcaatgctcgacggaggcgcacaaatttctgtaattgaggcaaagttcctctacaatttgataagggacaaaaaattggacgttcggaatttgagtgttttgaaagcggaaaatcgcatttccgatgcgaatggcaatcctttggaatgtttaggagttatttgtctgccgataaaacggcatgagaattcgagcgaggtcaaagtcgcgatgcatatcgccaaatcgtcgattggatttgaccttctttttggcacgaatgcgcttaatgaattgggctataaaatgtacgatgccatcagcgacactataattgattttgaaaaagctaagcaaaacaaaatcaattcactcgctgtgatctataaaacggtgctagaaccacgagccacgaaatttaatggatatggcgagccggatcaatatgaaggcagagaaatgttattgccgtctgatcaaggaaacgatcaaattcggttggagccaacaatcgcgattagccgtgacaagcaagtaatggtgaagaaggaagggaaaggtggagacaaaccgccaaagaaagggcagctgcagaagagacggacaccttatgacgttcgggaggacgaaggcgagcaaattactgccatcaccaaatgtaaacgcgtgaaaaatgtgtcgaatttgctcccggctgtggtgccgccacccgagggaatgtcttacaacccgccgattgacggttatttgagaatggccgtaataaatgcgaacgaagaaagacaaattgaaaagaaacggcggcggacagagcgaaggattggcattggcactgacgaagtgtcggcattgccggctttgcgggaagaagtgacatattccgtcagaggaggagtgaccgtgagaatgaaagaggaaaaagtgaaggaaatggcggggggagagaacgaaaaagttagtcccaatgagttgcgacttcaaaagcgaaaaaccacaaaaggaaagaaacggcagaagttgcgaataaaaaaaagagagaaagaaaacggtggaaaaggaagtggagggaaagatgagaagacaattggacagttttgaagtctgtgaatcagatggacaaatggcccattatgagcaattaggggcaattgctaatttaaagggtggcgaaggaatgattagaaaaatggtaaaggcggcgcaatcaagagaaattcccttttcagagatggaaattgacaacgaagatgaagcagaggacacgttcggttggaatgccaagtgtgacgtcggtcaaggcgaacatgaattttgtgccattctccgtgtcgcagaactcgatccagcgcttggaaatgctgaattgggctcaatcacagtgaagacaccactgcaggcacttttggcggtgttccttttgaaggccgggactgtcaaatcaatgacagccgcaagaagtttcgtcaaatcaataattgaaggagcgccaaaagaggaactccatctgttcgtgaccaaaaagggagactatgtggcgacaggacaatgtccaactgaagaagaccaaatgaaggcgctggagtgttggttcgaaaagtgctccgtggcaaagcatgctttggaagagagcggattcaaaaaaatcggcatgtacgaacccgtcggactcaatcatttggccgattctgagaagaagaaatgggaagaagcgatgggagagacaccgtgggtgctggagaaattgagggccaaaatcattcacaaggccacaaaactgatcgccttgccacgtgtcataatcggagattcgacagcccaccaattggccgaaatcttggaccaaacggcggtgatcgggccaaaaaatggaacattggcggagacagtgcgaagcctgaagcccgtggtgctctccagcaaagtgaaggccgcactgatcattgtcggacgagattcactcttgggcggagaaaccattgaagtgatgatggagcaatacgagatgattgccaatttgtgccgccgattcccgcaagtgaagttcttttggacatgcccaccgtacgtgcacgacaaacacgacgagtacgaagaactgatcgaaagcttggtgccgatgatgagccaaaaaccttttcttcctgtttgggtgacagaaaaagggcgatcgcttcacgaagtgttccgattcgccaattcattcgacaaccaaagagtgacaacggatggactgatgaaagaggccggtttgcgagcgctgaaggcatggctgttcacccaatccgacttcccgggcgatcagaagctgaaaattcggtcaattcgatcgaccgttcgtgccgttgctacgataggtctgggggaccatcgccaagcaagcacttcgtctttggccgtaaatgactcgataggtctgggggaccgtcgacgtcacacaattggatcagttggacatcgcgatcgtgatcagcgacgtcagagcttgggctcgattggtctgggggaccatcggcgccacacattcggagaagtgcccagccgtgaacgccatcatccatacagccgttggaacaaccgcgccgtgatgccgtaccgtggtcgtggcccgtcgcactctcgtcgttagccttgttgttctgatcgacccaccaaacctttccaatttgacggcagggacgccttttttgaggagcgggggatgtagtgatattttgactttgaccattcgatattattttaatttattatttttggcattttgtttagttatttttgttgagctttttcatttgcgttttttttagtcgttaattgtagtaatttgttttaataatgattcgtggtaattgcggatatttgtgtgctgtggaataatcttgtttgtgttttaattgtgcagtcaattgcatttattgcgaattgactgagtcggcataattggaaagaagccgaacgaattggtcaaagtccctaataataatattgtccccaatctctcctgtcctaattaaagactgttcccgtgcccctgccctaattaatctaaggcaaataagcagcgaacggcgagaagttttactattttgccaccattttcacttaattaacttttcacgcatttgttcggcagcagttgtcatgggaatcattgtcactatctgttgtaacattttgtacatataacatgtagatgtgtttatccgcatgccggccgagatgacactttcaagcgcaagaatgcgttatgctattcttttttttttggcatttaagtcaaggtcagtacagaattttagtaattttttgtaaaatttgtataaatatttagggatttttaattaatataattcccagtcctagttattattatttttccccgaaaagttttctaaaattttgccaatttttgtatcaattttaaaatgataaaaatttatttatttatttatttatgtattagttttcatttttaattacattttaatgctaaaaaaagaaaaaatttgttgcatttttttgttttcctctttcacacatacaaatagatatttgctctaattgtgtgtgaatgaccttaaatcccccgccccgcactcgtccactttttttttgaagtgtatcgatttccataattttgtgcggattgaggaagttcatgtttaaaccgtccaaaaactacatacctatttttatttttctaaaaaataaatagaattcattgaggcttaaccgtctttttttgttgtaatgctcgagcttctttattctcgggctaagttctgagcaaatatatttctgcatttaaactcttggtaatagtgtacatggtagcgcccttttttgaaatcgaaaattttcaaaaaagttttcgaaataaagttgttttataggttttcagggtcggagaacacgattctgacacctatttcgacaaatttcgaatccctgacccggattcgaacaaaaattcgaaaattcaattctcgaaaaattcaaaacatacaaaataa

SEQ ID NO: 903 - DNA, 972 bp, Heterodera glycines
  misc_feature (881)..(881): n is a, c, g, or t
  misc_feature (889)..(889): n is a, c, g, or t
  misc_feature (928)..(928): n is a, c, g, or t
  misc_feature (949)..(950): n is a, c, g, or t
  misc_feature (962)..(962): n is a, c, g, or t
tataaaacactttatttcgaaaaatctttttgaaaatttaatttttcaaaaaaaggggggggctaccatgtacactattattcaaatcaaatgcttttgtgtattttatatttaacgaatcatttaaacaaattttctatttgtgagtggttgtgtgtattcgagcccgaacccggaatcggatcctccgggattttcccgatagccctgcttttaatcaatttttgcattcttgatacaattcgatagcccagatgtttctctattatcctgtcaaatttgaaaaaaaattggtcggtcaactttcgaaaaagatgtatgaaaataagtactattatctatagggcggggaattatatggaaatccatatttttttcctggactgtggggggcctgaaatgcacgaaaaacatgtttttagcttgatttgaagcttctaggatggagttccatatcgatatttttccatatttcacgatttatgtccatatttgtccatattatggcatttttatccatattttatgtccatattttggcatttttccaaaaaacctctattagaacggcccccagcagctaaattggactttttgagcccaaaaaccggaaaattttccaaaaaaatcattttttcgccaaattttctcgggaatattgaataaatttaaattttcttaaaaattaataagtttatgtcaaaaataagcaaaaaagataaaatttcacttttctggttgatttttcgctaaaaatgagtaaattttagctttatcttgtttttttcttctaaatgatttttaataccatatttagccatttttgaagggctttactttatattaacaaatttaaagaaattttgggaaattataccctncatttganaaatttatgtccatatttttgccattttatgtccatatntctcgatttttggtccatatnntatgtccatatntctcgatttt

SEQ ID NO: 904 - DNA, 4638 bp, Heterodera glycines
ctatcatatgctgtattttgtttgaaaatagctaaaatggcggtttttacgagacggacaagcacccataaaaggaatgctttcgctccctccatgcaaaagaaaaggccaatttttggaaaaaatgactcaacggccgacggctgcagcacacaacaaaaacatcattttatagtgggaaatggaagtgtaaaaattgggaggggagaaagcgtagagagattgagagaagagagagagagagagagacagagagaattgagaggaaatcagaaagagatgaaagaacgaaggagggggagggggagagagagagagagagagatgtgatgagagaacgaggaagagagcaaaaggtatggtaagtgagcaacagagagaaagtgagagaggtaaagagaaagagagagagagagttagagagggagaggaaatgaaaaaacatttacgacaagggtgggatggagtggggggaggggttggaggaattggaacgaagtgaatgctttcccatcctccaacaaatctaatccattgcaaacagaattcgttgttggaattttctaatttgcattgaataagccgcattcatttctttttaatacagtgtttggtgaatgaaaccaaataattttttaaatttcgactaatttttaaaatttgagttagaacccacattctatataaatattttttatgtaggtaattttattttttgacctctgacaaaatttttaatcgcgaattctttgttcaatttcctgttcacagtcttgggttttttatcttgaaaaccgagaattttatactattattggtaattaagagttaaggcatggctcgaagatgaaatttttcaatcggagaaaaattttttttaattaaaaggaattttataatttatagcaaattttgatcaaaaaagcaaataatagctcaaatttttgaaaatctaaggcattggtggtccagcgatgcctataggcgccgctaggaatttttatttttatttttttgcaatttccttaagttaataacaaaatttgcctgaaaaaaatcagtcattttcgtcaaagaatcagcatttcaacaaagaaatcagctttaacccttcaaaagcagaaaaattatatggcaaatccaatatcagattcgtgatcagcatcccgaatatccccatataccatttttttgcttaaaaaaaatacaaagttaaattagggacacaattctccatgattgtccatattttttgcgattcgtttttttaattactaggacttccttttttaggcacaaaaaatcgcgaaataggcacctaaaaaggcataaaaaaatcgcaaaatagacacaaaaatcctcaaataggcactaaaataggcatataaaattttttattaacgctttttaggtaacaaaacactttaaatcttaaatatttcaatagaaattattaaatattttaatgtttttttcgaatatgaacaactttttaaaccaaaaaattaagaaaaaatattaagttttgggaccaatttttgaaaattttttcaattcttagggggtgtattttctgaaaattttttttgggtcatttcttaggggtgtgtgtttcgtttttattgcatttttgttaaggattttttttcaaaaatcctaaaataggcacaaaaaccccgaaataggcattataaaagtcatcgtagacaccccaaaccaagcggaaaacgcgtttttgtgtgcttatctatgcgtatcaagtacgcaaaatttctttcttttcctttttgcttaactattcattccttttaggtattttttcatcgatctttctttctttctttgtttctctctctctctcatcctatccttgctcctcctgtgtagcaaaaatctcttttttccttttcttttttctctcatttgtaccctgctcctcctcttctccccccactcttcctcctttccctccttttgccctgcttttatcccttcgtcattattctttttttctcccacacaatgcactcactcactatgtacataataatgtacataaatatcgctgctgctgccacgccactctcactcttaacatatcccctcttgacacatttttcggcaaaatgcgtaacttcccttccccctcccccacttcccacatttccctgccacttatgcctattacagcagcgacaggtccatccgccttggatcgatacggtgcttaattgagctctgcctatctgctcaatgtacattatttttgttaagatgaattgcacaacaatccaatcccttcaatttttttcttctttgttttctgtaccctcgtaaattttcactgaattttttttttttaatttaccaagcatatctggctaaattttgttttcagaatttcttgaggagataaatgtcttcccccggctgccttttgtgcaatatgttcataggtgtctcaagtttttctggcatatttgcttccccatgtcacaggttttttttttcttaattggtttaaatatgtgccgacagttttttctctcgtcgcaacgaaaaccaagattttcctcaaaataaggacaaatgcaacgaatttgttcatcttttgtgaacccttaaactttctcgcaaaaatttcataccaaaaataaaattagcatttaaataaacggcatccgattttcactgaattttttagtttttgtttgaaaaaaaaattcccattcgtttactcatcgatgtttgcatatttttcgtttcattcactcgcttctcgcattacaaatgatgtgaaaattgtacatagataatcgattaaaatggaatggctttgtgctgtttgaaaatacataaagcaaaaagcgaggattggatttaaccaatttttggaaaaccaaaattttttttatttccgtattactaaaccaatgcgatttattttttgctttgttaagatcggagaatttagatttgagttgaacggacggacaaagacccccattaaatttgcttgtaccataaattttttcttttttgatgacatcaccgcaattaacgacgacatggccaaatttggacaaagatgagaaatggcggagacgacggcggaagggccaacaaatttccgtgtgcaacaatgggaagaggaagtgggaaaaataatgaaaattttacatttgttttgtaaggggtaaacaacaattttttgtcgatcggtccaacattgtgaatttgtttagtctggatagtttcgatcagaggccaaacgcaatttttttttatcggggattgcttgaatgagtccaagccgacttttatgagtccaaacgctttttatgactccaatcaattaaccatacctgttttttagcttctttagactttgtgctctcgaatgataccaaaaagattgggtttgttcaagcatgaacaaagttttgtatagaaaccaggtatggttaattggttggactcataaagtgcaatagaacgaaaaagtcgctttttgatcgggtcaaccgaaaaagttcgggtcgtcaggaaaaaggccgaaattttcggatatcgagtttcaggcatggcaaccttgttttgatgaaaaattcatcccgcctcccacccaaattgatttgcacaattcttccacaggatgatgctgccgtcattcaatgctgctccgatcattggcatctgtttgctgttggtgttcattccgtgttcaacagcagcattgacatcacaacaaccgcatacaaaaaacaacaccaacaacgacactgacaataatggatcatcaacagaatcttcggtgttagggccaccatcacggccaccgtcatcatcggcggcaccatcatcctcatcatcatcaatgatggtgatggcagcacaaaaatcgcagctgacggtgaccaatgaggacaagctgtgtgtgatgcgcaaaatttgtggcaaggacggtgaactgcgtcagaattgcccgtaagtcagtcgatgatgtattactggcatgagcgtgcatgtataaatttgcaacaaaaaaaaatcactaaaaatttccattgtcttaattttttaaaatcaagtgtggcttgttttttcaggttgaccaaattcaagtccgtagtcagaaaacaattttggaaggaggatttttttttttttttggttgctcttcgggccaaaatttttttctcttgaaaattttttcattttgcgagggagggagaattccccccctggctactggcctgtctaaattgtccgtcttattagacgtggagtctgacattcatttcgcaccattccaaatctcggatttggatttaagcaaaattcgaatttaaaaattgctcaagacttacaaaaaaaaaaaaattaaaccaaaaaaaaagtcgacagacatatttgcccgtaacataaaaatattaaaaaaaaaaatttttttttttcagttatccttaccaacccttccccatcaatttgaccatggaaattgaatacaaagaattgtgcccgcaactgtttaaaggttggttggttggttgtgcgattaatggctatcgtccattttattataaaatttttttttttttttttgatggtaacttcgccttatgctgtgacaacgag

SEQ ID NO: 905 - DNA, 2469 bp, Heterodera glycines
attgaaagtgattgtatccgataatttgatccctatcaaattttgaaaaaattaaaattttcaaaccaaagaattattgtttctaataaagcaaaagacaatgttttcttaaatataatgctgtttaagacctccggattgaaaattttaaagtttaaacccgattttggatataggagccaatgtgggataacccccaaaaatttgttcagaaataaggaaatatatttttgaaatttttttcagttacgaacaattaccggtccccataaattcgagcatggaaatcgaatacagcagcgcgttgtgcccgcaattgtttaagggttagttgtttgcgcaatgaatagctgtcgtcgattattaaaaaattagatggcaacaccgacttatgctgtgacaacgaacagttcgatattttgaaagagcaattggaacgcgcgcgtactattctctggcattgtccgagctgttacgcaaattttgtcaacttttggtgggtttgaatttttttaaatttgcggatggggggtatcccttccgtccaatttttggacaagtttaatgttatttaaaataatgttggtatgcattccggcatatttttgaatggtgaatccgaatttgtgcctagaaaagatatttgcatttaattttttctcgaatagttttcgaatgaatgtgttaccactcaaaagcctattatgtgttctaggttagcctgcaaaattaaaaaaaaaaattttttttaaatgatatggtcaaaaaaactgattttccaacatttttgtctaaacttttttttgaataaaatcttaatgaatttttctaagaatttgcaagctaatagaggaaatttatagctatcaaatggtattaaattgatacaatttggactgattatataaggagttatatcccaaaaagttgatgattttggctatatttttgcctcaacaggtgccaattcacttgttcgccatatcaggcacaatttgtggacattgttcaaatgcgtaatgattccaataaaatttatcccgacgatgaggagggatatgtgtcagaagtcaattactacgtaatccttttatggggattttaaatatattttttaaaataaatttgtttaaggttaccaggcgctatgccgacgaactatttgattcatgcagaaatgtaagcgcgccttttttaaatttaaaactcttaattatttattgaatttcccaattgatcagccattaaaaaaaaatttttttttggcaatttgtgccatttccaacttttgtttcgtacaaattcaaattttctctttttaaaggtgcgcacttcgtccacggcctttgtgttaagcattctttgcggcacttcaattgaactgtgcacgccgaagaagttcttccaatacattggcacgtacagcaaggtcacccatgtgccgttcaccatcaacgtggtgatgctcaatgacagccatcctgtgaaacaaaacaacaaaatgatacgcccgatggacacgtaaggattttctggctatattatacaattaatgaatccgatcattcaatttacagcctatacacaaaaaaaatttttttttcaaatttctcacttttttgtggaaaatttttactctatttattgggttttttaatttcggatttaaaaaaaaataataatgataatattttgttattggtttattcaaattgcacaaagattcgaatgaattgtttcgtcagtgtggatttaattcaaatttacgaaacgtctaaaatttggccaaaaaactgcgcaaaaattaattttttggagaaattacgttttttttaaaattttgtaatcatttgtgcattttttgctttttgttatgtgtagtataaacaaatgagaaaataatgttataataaaatgatttttttttttttgccagggtcacttacaaatgcaacgaagtgccggataaattcgaccactcatgcgcttgcattgattgtcaacacgcctgcacttcgtccgcaccattcccacttctttttcatgtgagtgaattcaaaaaaaacaaatttaaatttttatcaatgttttttaaaaaatttgtttttccaattgagaacattttctaaactaaatttttttttgccttgaccccccaccaaacggatccgaaaaaaccaataaaatctttttattaatatgttttttattttgatttattactacaatttgtcaattttatttgttttttagtatttgatcgattaaaattgagaaattttaaatatttatttatcaggaaagctgcaaagtcgccggcatggattgtaagacggcaatcagagttttggtgagtctatgattattaaattatattttaaaataattttaaaaaactaatttgtactaacttcccccccccccccccccatgttcccaccatcacaggccatcggcgttttattggca

SEQ ID NO: 906 - DNA, 4527 bp, Heterodera glycines
  misc_feature (4495)..(4495): n is a, c, g, or t
cattaaaaaaattaataattttaacctattgaagcgcctccatccctacccacaagaacaagacgtgtgatggtcaatcgtcgaatttttaatgataaaaacattgctgcaaatattgcgacaacaaaaaacggaaatggagtaagaaaaaaatttttaattttaaaatacataattaaaaaagcattcaataaaataacatgaaacttcctcataaaggttcatcctcgtcgaaagttttcgctaccattaaatccggaaaaggcccggaatggaaagaatgaatgaaagaaaaaaatccaaaaaaaaattattattagtttgttgtgcgaattatatgcaattaaatgaaattataacagacactgtacagttttaaactttaagataacttatgaaaatgatttttttaattcaaaaaatatatatatttagaattgttaaagaattttaaaaaatacaaaaagacttctattacatctcatcataaaagcattttcgaaaaaagtaacaactaaaactcgaaaataaacggtgactgaacatttgcgcccctacatttgcgccccgcacatttgcgccccgcacatttgcgcccctacatttgcgccccgcacatttgcgcccctacatttgcgcccctacatttgcgccccacacatttgcgcccctacatttgcgccccgcacatttgcgccccaattatgaacaaaaaaaaatatttataaaattgcctttcccaagggctaacgggagattaatatgattgtttgtttattcaatccaattatcaattcctttggtggtcagacgaaatgaaattgcgtgcagatgtcgtagccaatgctgttcattgcgatcatctggatcttgctcgtcaaattgggcaaccaagtctcgaatagcacggtcgttttcaagatattttttcgaacgaggtacttcagatacaggtctagtttgatcaagttcatggggtctcatccggtttcgttggtactcatcttcatctttgattcgactaataaacctttaattgttttctgttttggtaatttaatgtttaaatacgttgccaaaggtggattaggagccgaaaatcgcttgttgaaactgtcatgaaagccttccaggccattatttgtgcgccctaaatcaccaaggaccgaatcatgcatattccacgtttctggcacaaataaagcaggtcgtcgatttccatttccatcaacacggaagagatatgtactataaaaaacatcagaattatttaaaaacatgaccataacctacgatgcaaagtaatcaaaaattggatgcgcttgtataggcgcatgatttctgagaatttgataaccttcttccacataaattaaaggtagaaacgaaatcgctgacaatgatctgacagactttctaaaatcgatatctactaagaattgtggtgctagtccttccctctgcactcttctgttgactgattgggccaagtgaaacagacaatgtctgatcattgtgttcggccaaacatcaagaaatgccgatctcgcagctaaatgatcaaatatttaaaataaaatcgattaaatatcaatataaccaggttcaaaatccagcataaaactgcttggtattacaccttcaacacgctgctgtataacagagaaggctcgacgatatgtttgttgcatccggtttgccattattatatatgcgcatggtatgcttgagtgttgtgcaataatgtttagggtatataattgcatgaaattcgatggccgagctacaaaactttagaaaatggtcacacccctgtcatatatcacttttgaaagtgccgtcgcccgcccaattttggtatgtccgtagccattcaatgcctttgtcacttgcaaagataaaaaaaattggctcctcaatatcgtgctcacgtgagtcccaaatcaaaaattggttccctcttttatccgtcgcgaaggcacccttgaaaaatgagttggaaaatgtcagagacagcgaggatatgagtaagcgtccaagtagggttgcgcgcggtcggttaaccgaaccgaaaccgaaaaccgggggtacgcggttaataaccggtcgtgcgcaacactacgttcaaggaaaaccattgtttaatttttggcacgatttttggtttttaatggctcacttctatctctatttccaaaggatttgccgcatttacagcatctcgacccggtatttgacgttgcctttgtatttttattctacttgcgccataagttggcaatcgaacaagttgatcatcagagagtccttctcttgacgatccaattaaattgcgcggggcagcttcaggttgatccatagcagcgtcttttagctgttcctgacgctgccttttctataatttaataaaattaaataggaaatattccaattttaacaacagatttcaccacgttagactctgggtccggcaaatggttatgatttgttcttccaattaagtttgtgctgtcgataggtgaatgggccctgcctgggcatgatttcttgacacatctccatacctatttaagatagaatatttaatatatacaagtactgaaaaatagcctgggtttggcctgctgctattattctatcagtacgcatttcatagccttcaaaaacagtcatcgttttgcttttcgttgtcctcttatcgggttctaatcggtctgaaaattgatttcgattttttttttgcttaaactacaaaacttgccttgttgtggttgaacatgacataattgaagcaaaattaaaaaaaaactttgaaatacattctataatatttataagtgggttggtaaaaaatattcaaataaaatcgtaaaaattctacataaaaacggtgtttttcttttcatttcccgctattttcctctttttgccagccgtccgcctctcttgttattgccagccgtccgcctctcttgttattgccagccgcccatttctcttgttattgccgtccgcccgcactttataactatttcttttatgaaacgtgaaaatattattgaactctaaatgaaaactttatttctattttctctgttatttttctcttcatatgaaaacccaattcgcaaacaacgagctgttcgcaatgaacgggcaatagctgggttagcacaattggcagcatcacttgtggccgtgaaagcatttattgccgcaaatgcagctttaacggcttctacagccgtagctttggcagcacttggaaccgatatctaccttgctattgagctcgtgagatgtaagtttatgataattgaaaaggcggttgtgactctaataactcatgttaagcctctgatcactatgaggaattgctcaaagacttcttcccgttaacatttgttttggacgattatgaattcactgtctcggccaaagattataccccggattatatttttggaaaaatatcacaacattttggccataagacagaggaaatatgcataaacagtatgttttaataaacaaaaatgttttttaataaattaaaatgtaaattttactcctctactaaagcaaagacaatggcgagacgaaaagtgaaaaattcaagggccgatcttggcctactgatgctgtacgcagtcaaaggagaaggaaaacaagagctattcggatgtgcatgatgattttttaataatataatcactcccgttagcccttgggaaaggcaattttatgaatatattttttattcacaattggggcgcaaatgtgcggggcgcaaatgtgcggggcgcaaatgtaggggcgcaaatgtaggggcgcaaatgtaggggcgcaaatgtaggggcgcaaatgtaggggcgcaaatgtgcggggcgcaaatgtaggggcgcaaatgtaggggcgcaaatgtgcggggcgcaaatgtaggggcgcaaatgtagcagctccagataaataatattttgttattgtaagaaaaatttaacccataaaattgaaggataatgaaataaataaataaacaatattacattaaaaagaagaaacaattattaaaagatattaaaatctgtaaatgttggacaaaaaataatgtttaaattatgactaaataaaatattttttatgtcaaattgtcgactaatactttgaaaatttatttaattaataaataactataaaattttttaattaattagaaaatattactattttttttatttccagatgttttaaatgattgccttgttttgattatcaataatttaattgccatattttctaagttaagaattttttaaattattggtaaataaaaaatttttttaatagatctaaaaatattgttttttggtaaaataaataaagaaatttaatttaattttacataaatttaagaaaaaaattaatataaataaaatattaaaaaataaaaacttaaattaaattcaatcttaaaaagacagaacaataaatattnatcagcatatttaagtttttattatacatttt

SEQ ID NO: 907 - DNA, 4633 bp, Heterodera glycines
atatgatttacatacagaacttgaagctaaaatcacctttttttaattgaatattctccaaattgaagacaattataaaaataaatggacaaataagaaaagtgttaaaataaaatatttaaacatagtaaagtatgtaaaagggtttacagcttgccatagacaatttaatttataaaataaagccaaaaattgaactatttcttttctctgcgtctgtatttgatttcgccagtaagtgaactcgccgtcgagagatgtcaccatatgataactgatcagcccgtggtgactctattacttcatgtaaacactctgatcactatgaggaattgctcagagactacttcccgttaacatttgttttggacgattatgaattcactgtctcggccaaagattataccccggattatatttttggaaaaatatcacaacattttggccataagacagaggaaatatgcataaacagtatgttttaataaacaaaaatgttttttaataaattaaaatgtaaattttactcctctactaaagcaaagacaatggcgagacgaaaagtgaaaaattcaagggccgatcttggcctactgatgctgtacgcagtcaaaggagaaggaaaacaagagctattcggatgtgcatgatgattttttaataatataatcactcccgttagcccttgggaaaggcaattttatgaatatattttttattcacaattggggcgcaaatgtgcggggcgcaaatgtgcggggcgcaaatgtaggggcgcaaatgtaggggcgcaaatgtaggggcgcaaatgtaggggcgcaaatgtaggggcgcaaatgtaggggcgcaaatgtaggggcgcaaatgtgcggggcgcaaatgtaggggcgcaaatgtagcagctccaaataaacaataacaaaagccaatcaaggtgtcactcaacaattgccctgacagtctacaaaaatattatcatcattaagggtgttttttaaaaaccaaaaaatcaaaagcagtaaaactggtacccccggctttcgggttccggttattggtttaagttcggccgcgaacaaccttacttaaagtctgtgccattctttaaggcgggttaccgactgcacaaccgcatcatcgaccttggcgtcttaattgaagcgcctgccgcgtaataaactttgatgaatgattgcttagcggtgaacttagttaagccatataatcagccgtacccattaattacaggaaggacatttctgaaaacatttgtagcatcgttagaaaaaaggatagaaaccttaatatggatgccgaaaaacaaaacggtgccatgggtgaatcaggcagaaattttccgcaattgttaaaaagacccaacaatccctttcgatattcaaagtatgaatctttcacattatttttttatgtttttaaaataagcgaatttttaaagtttttttttatcatttttgaggttttaaagctatttttttattgagttttggttttttatttggccattattcgtatttttatctatatttcaggggttttaaccttcgtttgaagcatgcattttcatatctttaaaatgagcttaaccctgaaacagatttattttaaaaaatcttaaaaaggacttatcagaagaaaaataattccgcaaatattggaattaagcttttattaataagttaaaaaaatgaaaaactaggaaaatcaaatatttgggagaaatcaatcactgactgattctttggcttaatcaaatgttttggcagaattaggtggaaatcatgagttaaaatcggaagccaatttaatttgccagtaaaacaagtatgggagcgcaactgtataaatactgagacataatttgtaaaaaacaccattcaaatcgatcatttaaaaacccaatttaataaatatgtcaaacattaccaaaacccttctcctgctgattttgctggtggccgtttcattccgtttttcggcttcgactaatggaaaaagtgagttatggaaaaattcattttcatttttagtctaatactcgcttgttaaggtctttagcttttatctgtagcaaagtcttttggcaatttcttctagtctcaagcatattaagtttcaaataatgttaaaattccattattttattggcacttaaaatattccccctaaatccatgtcctgtgggccttattaataattgaatataaataatatttattgaattaaagaaaatgctaatgatgggaatggtagcaacgcatccgttggcattgggacgaaaatcaaacgaattgtgaccgccggactgctcttcacttcactggcgacaggcggggcgggcgaaattcaacgaagcaatgttcagagaagaaatgtcatgggactgacgcacccaatggtacaaagaattatcagtaatagcaattaagcctaattagcatgatacgactgacactcaccttttctagcctcctcgacctccgccagagcttactccatttcaaaaagcaaaagcaatcatagaagaacatgctaaaaaaaataatttcactgagtcagaggtacaaattcgacttagccaattatactttttaaattacgatatatagcgcgagccaattatactttttaattacgatatttagcgcgagtcacccggaggacccgacccacaccatcatttcaatttcactgagtcaaatgtacaaattcgatttagccaattatactttttaaattacgatatatagcgcgagccaattatactttttaattacgatatttagcgcgagtcacccggaggacccgacgcacaccataatttcaatttcactgagtcaaaggtacaaattcgacttagccaattatcctttttaattactatatttagcgcatgggaccccaacgacccaatggacagcataatttcaaaaatcatactgattgagaggtacaaattaaacttttcaattatgcgtttttaattacgaattttcagcgcggctacgtatccggtggacccgactcactcacaatcattgaaatatagaaagaaatgatgcatcgagtgtgattagttcttttaagggtttattttctcttcttttcattataaactttctagaataaagtggactctatcaaaaatttatgcttttattgaaagcaaatttgtgaaacattactctgaccacctttcgaatgaaattagccttatcttactacacttgataaaattttaaagaaaagtattttaatgccaaaatatataaagtaaatattaaggttagaactctgatttcttttttaaaatttttctatttttgttcattttctacaaattgatactgtacacttcagtacagtgatgagtaaattgaaattttactgcttttgaatatgaagaggacagcaatccttaatgaagcctcaactcaataagcaaattgtttctcaaaaaagaaagttgaaagattagccaaagattgctgtacgactgatcaagccgaagttttgagccagttcaatacacttctaggctcaaattcgagccagtgaatatcaatgctaggacatcggagaacataaggacaggccatcaattcagcggagatttgccgatacagtaccaaatggccacacctttagactactgtatgaataatgaaaaattgagcggtcttccaattagagaaaaggcaaattatagaataaaaaattgacactaattaaaactgtttaaaaccaatgaaaactatctgtcaagaaaataaattaaggaaaaaattatcaaggtaccgatggtgaatttttcaaaattcctgtattatcagtaatagcaattaattaacatgatactaatgattttcactttatccagcctcctccgcctccgccagagcttagtccattggaaaaagcaaaagcaatcatcgaagaacatgctaagaaacacacttataacccgtcgttggattattcaaaagttattaattctgcttttttctttttttaattacgatatttagcgcgatgtacacgaaggacccgacccacgccaccattgaaattgcaaaagaaatgacccctcgatttagtgctttccttttaagctgctttattatttataacaaatctgtcattttcttttcatttcatctaaaatttttagtttctagaataaagtggactctatccaaaaatttatgcttttattgaaactccttaattaagtgcctttgttgtgtgcaacatttgctacggtaaaccaataaaaataaatataaatgatttaaattactttaatttaattataagaacacaacattttttgtggctggcgagaaataaaaataaacaaattacaaaattgaggaaatgactagagaaaaatttgggcgaccaatgataacaagaatgtaaactttttcatctttaagcaaaattatgccatattttgtgccgaaaaaacagttaaaattgcggattttacgaaacgacccagcacgtttttaatactttctaacatttaaaaccttgtggtttacttgtttaaaagctgtctctaagctattgattgaccatttaattattattacactagagatcggcattt

SEQ ID NO: 908 - DNA, 3815 bp, Heterodera glycines
  misc_feature (3795)..(3795): n is a, c, g, or t
tttcaaaatttataaaaacaaaatgagtctaatttcgatttttagggttttcggggtcgctgaatacgaatataccctttatattaccccttgcctaaccttaggcccatctgaataataaaaaactcaaattcgagacttggacatttcgtgggctggacattttgtgggtcagcggaaaaaatgggccgcgctctgtttgccaactgtgtctgttctgtgctatggtcaactgggtcatctttcctatgcactctctccaccagtctctttctgcgagtcacccggaggacccaacccacaccaccatttcaattttacgtatccggtggacccgattcactcacaatcattgaaatatagaaagaaatgatgcatcgagtgtgattagttcttttaagggtttattttctcttcttttcattatataactttctagaataaagtggactctatcaaaaatttatgcttttattgaaagcaaatttgtgaaacattactctgaccacctttcgaatgaaattaaccttatcttactacacttgataaaattttaaagaaaagtattttaatgccgaaatatataaagtaaatattaaggttagaactctgatttctttttaaaatttttctatttttgttcatttctacaaattgatactgtacacttcagtacagtgatgagtaaattgaaattttactgcttttgaatatgaagaggacagcaatccttaatgaagcctcaactcaataagcaaattgtttctcaaaaaagaaagttgaaagattagccaaagattgctgtacgactgatcaagcacaatttgtttcactcacaaatcagacgcatcaatgcaagatgttggtcctcaaatacgaccaaacaaattatagaataaaaaattgacactaattaaaactgtttaaaaccaatgaaaactatctgtcaagaaaataaattaaggaaaaaattatcaaggtaccgatggtgaatttttcaaaattcctgtaaaagtatgctctttcacactgttttttgtgttttattgtaaataatcaaatttttaaatgtttttgtctttttttaggatttgaagctatttaagattttttaatttggccattttcgtatatttatctaaatttcggggtttttaacctttgtttgaagcttaaaataggaaattacgttttttttgtaatagtttaaattttgtttacagtttttaatatagaaatcacttaattaaagatatttttttgttaatgaaataatattgaatgggaaattttacaaaatcaggcggaaatcatacgttaatgaaaaaataatacaacaacatgaataaatcggaagtcactaaattttccaacaaaacaaacatgtcagagcaaatgcataaatactggcctcaagtttgtaaagaaataccatacattcatttcacaacgacatagtaataaagcaaaaaataaatgtcattcattaccaaaccctttctcctgctgattttgctggtggccgtttcattccgtttttcggcttcgactaatggaaagagtgagttataaaaacaagaattaattctcagccttttctatcatttaagttttggcaatttattttctagttttaagtcaattagctttcaaattatgtgaaagtttcatcattttttgcctctgaaagtattctcctaatccatgtcttgtgaacattgtaaataactgacttaaaaagtgtaatcaattaaagaaaatgctaatgatgggaatggtagcaacgcatccgttggcattgggacgaaaatcaaacgaattgtgaccgccggactgctcttcacttcactggcgacgggcggggcgggcgcaattcagcgaagcaatgttcagggaggaaatgccacgggactgacgcacccaatggtacaaagaattatcagtaatagcaattaagcctaattagcatgatacgactgacactcaccttttctagcctcctccacctccgccagagcttactccatttcaaaaagcagaagcaatcatagaagaacatgctaaaaaaattaatttcactgagtcaaaggtacaaattcgatttagccaattatactttttatttacgatatttagcgcgagtcacccggaggacccaacccacaccatcatttcaatttcactgagtcaaaggtcaaattcgatttagccaattatactttttaattacgatatttagcgcgagccaaccagacgacccaacccacaatatttagcgcgagtcacccggaggacccgacccacaccatcattgaaattgcaaaagaaatgacccctcgatttagatgctttccttttaagctgctttattatttataacaaatctgtcattttcttttcatttcatctaaaatttttgtttctagaataaaatggactctatccaaaaatttatgcttttattgaaactccttaagtaagtggctttgttgtgtgcaacatttgctacggtaaaccaataaaaataaatataaatgatttaaattactttattttaattataagaacacaacattttttgtggctggcgagaaataagaaaataaacaaattacaaaattgaggaaacgactagagaaaatttgggctaccaattataacaagaatgtaaaatttttcatctttaagcaaaattatgccatattttgtgccgaaaaaacagttaaaattgcggattttacgtaacgacccagcacgtttttaatactttctaacatttaaaaccttgtggtttacttgtttaaaagctgtctctaagctattgattgaccatttaattattattacactagagatcgacattttgaaaaaagcctggacctgggatttcctggataaaaatccaggaaaatccaggtccatgaaaaggacctggactttttttcatatagaacggctccattttgagcactaaagaccggaaaaactcccgaaaaaaatcattttttagcaaaattttctcaagaatattatttatttaaattttattaaaatttggtaaatttatattaaaaataagcaaaaagacgaaactttttgggttggtttttcgctaaaaattagtaaattttagttttatcatgttttttcttctaaaatgatttttaataacatattagccatttttgaacgttttactttacattcagcaaatttgaagaaattttgagaaagtatacccttatttttgaaaatttatgtatatttttgccattttatgtccatatttcgcgatttttggtccatattttatggccacatttcgcaatttttggtccatatttttgaagccctactaattacaagactaaaattgcaaaaaaaaaatcgatttttttaaaaattaaaagaggaaatttctgaaaaatttggctaattcctaacaaaattcattaaaaattcttaaaattttcccccagcggcgcctatcggcaccgccggctccccaaaactcttagtttttcttaaaaattagccaaagatcgcaaattttggtcattttttggacagagcttgttaacaaattgcattaaatttttaaaaaatttcccctcggtggcgcctatcggcaccgccgaactctcttccctcatccatacccaaaaatttttcggaaaaatgcgtcgaaaaaattgttaaaaatatgtttttttaaattttaaatgcactgaaatttaccaattgcttatgtttcgacaaaattgttaaaatcttaaaattgattttcggaaatgntataaatttctctattttaa

SEQ ID NO: 909 - DNA, 1656 bp, Heterodera glycines
  misc_feature (1566)..(1566): n is a, c, g, or t
  misc_feature (1572)..(1572): n is a, c, g, or t
  misc_feature (1602)..(1602): n is a, c, g, or t
cttttcctccctgttcgaaggactcccaccattgggtgattccgccatgggacacttttgtgcaggcccagcagcatcacattgacacgcgacggcaccaacagacgcaagacggtggcaacgacaacgacgaggaggggaaggaggacggagtggtgaccaacaaacggtcaaaagtggtgagtatttgtaccatttataatagatttttctccgaaaaatcgctaatttgtggatttttggagaaaagttagcgaatttttgtttggaaaactgtaccaggggaagatttcatcccaccacccatcgagaaaaattgttgaaaaaaattcatttttattcaaatctccgaattacaaccccccccccccccccctcgttcgtcgtaaggggggcggctgtaaaggagggtggggtcgtaacgcaaaaaaaaaggtcgtcgccgggcaaaattgggggccttcgtacgaaaaattggtcctggcgcacaatcgtccgcgtatgggcctcgccctggcgcaccccttgttcatgtatgcccccgaaacaaaaaaaaaatttgagttcccattttattggatttttttttaatttttggttttggcttgggagtggattgtggcgacatgaaatgaatttgtccacaaaaattgggggcattttttccattttcaacaatttggcaattatttccctcccttccccagtcggtgacacttgacgagacggaagaaatttcggtgctcgacgaagaggagggcaaggaggaggaggcagaggagggcgaactaactgatgaggaggaagaggagaaggatgaaaacgatgcggacgtgctgtttgtggacgcacgaagtcggacaacgaagaagaaaaagaagggcaaaagcggcggcgccaatgtgtcgctggaggagggcgaaattgtggacgaatcggaggaggaacagcagcagcaaatggtcgttaccaaaaaattttaaatcaaaaaagaggaaaacctgaaaaaatttggctattatctaacaataagcaaaggcattaagaatttttaaattttgcccgtcggcgccttatgcaccaacggccccaaaaattctcctaaaattttgaagacgaaaaggggcggggaggggaaggggccttcgtaatcgagggcaggcaggatttaatttaaaaaaagctcgtcggttacatggcttggacccaccctccgctttttgggatccggttcccgaccctcggagttgtaaagccgcggaacccgactaaaaaaaaatcggttatccggggcacaaatggaccggggggcatcagtcatcggagggttgacaaatgcgtttaattgctgcatccaaaaaacaaaatttggtttcatcaaactctgaaaattcaaagttgttgccgaataaaaatgggtggaaatttacaaaaaaaaaaaaaaaagaaatttccatgtatcgctaaacattttccccagacatggacttgaggacgcacagcgacagaaacaacggcaaaacaaagccacagacaccgccgaaaatgatgacaaagtgacgaaancgaggnaaaagagaagcatcggcaaaagacgacganaaagttggcaaaaagagcgaaaggtgcgcaaaaaagtgcggaaaaatcagcacg

SEQ ID NO: 910 - DNA, 8398 bp, Heterodera glycines
aggagagaatggcaagggcagcggcggcagatgccgaagggcccgttcggcgagtcaccagtggcggaattgagacaattactttgttgtgaacaaaaaattgtcccaatccgtttccctcatatgcacgtttgacagactgaaacgcgaatcggatgtgcatctgtaatagtaaataaaagtctaactatttttttctaaactttttcgatatttttcaatgagtcccaccccattctcgccccgggtgctccgaaaaatttcgccgggacaaaattacgccaattttttttttgaaaaatttttaaaagaaattttccattccccagtttcaaggctaaactccattcatatttgtcagaattggctttgttagattgaaaaatttcttaaatttattaggtttctaaaaagttgtgggcaaaaactaaaaaaaaaagttgaccgataacgatttttcacggtggtgagccatcggaaatgagcaaggaaatttaacttcaaaatactctgaaaaaatgttttgcagcattttacactgatgccgaagaatttgtcactttagagaaaaaccataaaattttctgcatctcatttgttaaattcaaaaaaaaaaatttttttttcagggggaccctaaaaaataggcgactttaaacaatttttttgtgttgcaaatttttttcagaaataaatttgaaatttaccctcatgacatcgtcgatatttccacgcacaaccatgtcctcaacttgatcgtccggcgcaatttgggctctgacggtgattttcttgccttgaaaaggggaaaaccttcagattattttcgcgacctcaaaaattccctttattttacggcgtgtgccttccctgcgcttccttactccaaaatcccaactcctcctcgtcccctgccctcctaaatcccggttttttctcatccgaatcccgcattttgaccgaatttgccatcccgggcaagaatctcgatatttttctcatcccgcggtaaccctgcttctcttccttcctcccccccccgccccgttttactgcactttctcccctttccgtgtctcgtaatgcaaaaaccagtgcggggcaaacggcactttgttgggttgcctccccccacccccgcccaatacgaaattatgtccctttgccctgagcataaactttaatttttttttggtgtaaaacataccaaacggtctcgaacccctcctgttcacaacgcctaggccaacaacgtccacttgattttgaagcatttttttgacgaaaattttacttctaaataaatagaagaaattgattatatgtatctaacttttgttattaggttaatatgaaagaacaaaaaacacagtggaaatggataggtttgggaatcggagactctctgttcatgaacctgaaaagccattttgaaaaatgttttttttcagtgtttcaagcatttgcttaataaaaaaatgtcaaaaattccgaaataagggcaaaacgatggtactcttaaaaccctctgcttttttaacgaaaaagaaccaaaaaggaaacggcactttttcgtacggttatatttcaagaaattcaacaaaaattgtcggcgtcgacggaacctatctttctatttttaaagatggttcaaaaacaccccaaaaagcgttgaactttaatcaatttggacaaattctattaaaaaattgtctaaaattttacataacttttcccggaagcgtctaaaggccccgcctctgaccccatatttccagagttttttgtaaaagcgcgccgcataaaaatgcgggactgggtcgttttggcgcccacgttttggcgccgacgatttggcgcccacgttttggcgcccactttttggcgccagggtcgttttggcgcccacgttttggcgcgaagccaaaaattaaaaaaggtaaaaatatgatcaaaaattttacaaaaaaaagtgaaaaacttttaccttccaatgggtttttcaaattttcaaaaaattcacaaccccctagaatttttttcaaacttcccgattttgactgtgttttatgggtgtagattagagatcaacatgtacctggatccagccctgtatttttccttgatccaggtacaggcacaggccatttttcggcaacctggatttttcctgtacatttattttcctgtacttatgtacagaaaaaaataggtacaggccattttttgaaacaggtacagctacggttttttcaaaatgttgatctctagtgtagatcaacatgaaggagtgatatgatcaacttgctgtgaacattttgttggtcaacatgaaaaattgacttagcaagaattttttcaaatttttctcttcgctatgcttcaaaaaatgtcaaaacattttgaatatttttaaactcttaaattttttcggttgaaatttcaagagttagtgattataaacataaccttaacggtatatttaataaataatagtcactatccctaaatcagaatctggtaaatcattttctcagatttggacccaccatattaaaacatttgaaaaacaaaacagatagaaggcctgatctaatatgttcaaaaattgtatttcatttaaatcaagtccgggcttcgcaattgtcaaaatgaatacaatattcgtgattagcgactcagaaaactgacgaatacatattttcatttattcaaacatagaaaaaatttaaaaacctgaccctggcgccaaaacgtgggcgccaaaacgtcggcgccaaaacgtgggcgccaaaacgaccccgactctaaaaatgcacatgaggaaatgaggaaaaaacagcagaaacaaaaaaacatttaaatatggtaaaagtttcaagtgtcattgaaataatgaaatttcacattatgttttttggaaatcgttatgcccgtattttaaaagtgactttttccgatggaagactgaataaacaaaatcctcaaattctaaaatcacaaaaaatatcgaagactttttaatacaccattttttggggcagggagtacggttgtgcctacaggtgataacaggaatttcttttgaaatagaacaaaattaattaaatggcttttctttatatatgaaggaagtcatttttggagataatttgtgatgggttgaaaaggcgcgctgtcaaaatgtcgccgcgtcgaaatgtcgcccaagccaaaaatagtgaaaaagtcgggaaattgattaaaatttaagaattttaaaatttttctattaaattttaaaaaatgaattttatttctaaaattttgcaggatatagctctttttattttctctttttttttgcctatactctctctttgcatctctcttttcttttccttcactctcctttgtccctttccctcttttttcccaccagtgcatttgtctgcctgctaatgctcctacaaattaggaagggaaagagaaagacggagtgcaaaaaagtgaaaacttttcagacaaaagatgagcatagggcgatgaaatagcgcacggctctcaaggaaaagaaacgagtgagccttgggagagagtgcgctctctccccaaattttctatcttttctctcccttttccaccccatttcactttctctttttgaattgcatgtctttggctttgcttgctgctcgttaaacttacctggctggggagctcctgcgaccacgaaggcaagactcctgtggcgaggctccaccattgcactttcggtcggggctgacccgcagggcgatcccgaactgggattggcccacagctaaatttttgggtgagggggatggcgttcgcgcctccctttaaaatctgtgcatcgtttatttttttaaggcttttttggtgccatttgtagaggacatacagataaaactattaaaatgacatacctaatcaattttttcaagtcaaacttttgcggatttttcaatttatcaaaaaaaaaagacaataataattatgcgccaacccaaataattttttgtctaaaaaacggcaatacgaattaaaaaatgtaatttttcgttaattaattgtcctccgatttttcatttgtctatccgcttcatcttctttcttctcttctgtcttccatttgtcagatgtctttgaatcttttttgcacaaaattgtgttcgcattggcctttgggccaaaatttgtccaattgaacggtgtacgttttgaatgtgtcgctgtgcctttgtttgtgcgcaatttcgcacaattggcacagcggtggctgaatgccatgcccactccgatgcttttggtacgttttggtccaattgaaatagctaaataaacgtcacaaatttggtataaacggcaaaatttatctattttatttaccccgacttcaacatcttatttaaggaaattcgcattatcggatttttaagatatttttggaaatttggttgatacaaatttacgaatttctaataaatttatattaattttacaaatttttttttgtttcatttgaaaaagaatttaaaatgaatatttttatgtgttaacttttaattttttaagaaaaatgatgaatttttcaaaatgatttttgattttaatctataattttattaaaaatacaattatattccctctaattacccttttgacattaattaccctcatttacaataattgtttctctcaattacccttttggcattaattacctgcacgataattatttccctctaattacccccttttggcattaattactctcattaaattaccctcacttacaatcattaattatttcccttattggacaatcaatttccctaatctcatactaattaattacctcatgtatttgtctttgtccctttgcaattccttcaaatattccgccaatgctttcacactgttaaagtcgtccgccgcaatgaaagtgccattcggaatgccaacttcttccatcacttttctactcaacacaattggcactatcaaattgcgcaatgccttccaaaatttctccgtcacataatttgggcagacggcattctcgaaagcaaagtagaaaaagtgggactctgaaaatgaggggggggggggtggcaattgataagattgcgcaatgacttccgggtaaaaataaattccagtcggcacaggaaatggaagtgtcaacggtaggctatgagaaaaagtcggtctgcaaatgtcgcactagggttgtaaaaaaatagcggtttcggtctcgaaaatggaaaatcgatcgtgatcaaaaatgcgagaccgaaaaatagccgagacttttcttgagtcgtgtccgagactctcttgagctctcgaatctgtaactgatcaatgcccaccattattgagaccatctaataccaaattttcgacaaaaatagtgccaaagtcgctgacattgacaaatgaatgccaaatattcccagattcctaccttgttctctttggtagcattcttctttacagtttgtgttgttattgcatttcccaaacacatcaacttggagcagtctttggagttgtgccgtcagcgcatctcttcccgacggcacattgcaattggacacaaattggacggccgaccgcttcttcagcgtcatacgcttttgaatctgcgctttttttaaaaataactaatggcaatccgttatcccattttattagttttactgatagtgccgcgtgcccctgtgattaattaaatttttgtcataatttttaaaaattaattttattttaaataatttttcccaaaatttggaatctaatcccaaatttccagcaccgaaaaatctcaaatccccggaaaagccagtgttaatacagtatcactgacgcattttccgtatataaatttggcacttttttgaccacctccgcgtcggtccaaatgtattggggcaacgtttgagcagtgattggtagggatgcaatttttaggcaaaagcctatttttttcctgagctccccgtggcatgaaacgcacgaaaaacatgttttttttcgggtgttgttaagctacttttcgagttattagtgcctattttctaggcttttatttttagcgcctatggggagacatcaggagcaattgaatatgccgaaaaggcaacttgttatggtaattttttcctttcttattcaatttcggctaattttaagtcagttccgacgagatggaactcgatttaccgaatcgaatgttgaccgctttcaaagagcaaaaaaaagtgttgatggcaatgcaatttgaaagagaccaaagaaatgccggcgttttatctgcaccaaaaagacctcggatggccgagatggaaataatttcttcttcattgccgtccatttcattcaaagacttcgaacttttgcgccaaatttgtccaattcttaaaatttttgatgtggaaactcaaaaagtaaaatattttttaagtttatactaaataaaaaaatgtttttaagttatcccgcgaaaaatcaacggcgtctgtgatactgccgacgatcaagcgtctccacgattttttactggaagaaaaatttcctccattcattcagccattaatcgatggtttggttgactcattgaatgaaagggtgcaaaaaatggtccaaaatttgttaattcgtgtttgttctttgttggacccgcgttttgcctacgatgaatcaattttttccaaagcaaattggagtcttatcgaggaggatttaattgaatttgcgcatcaaaaaagtaaaaatgaaacttttaaatattttctaattactttacagtcaacagagaatgtagcacaagtgtggaagaagcaatggctgcgccttttgaagacctcgattctttggttgacgacacgggatcagcaagcgacgacagcattaaatgtattttcaataattcattattttttaactttatcatgctttaagtcgatatatggaagcccaagtcaccaggaagtgaaaacgaacttcaccgtcagcactcggcttgtgaaaaatgtatgaatgaccgttgtgttgaagctttgtacggttcttttgtgttagaattgcctgcattttctaatctataacttaaacaaaaaaatttattgtcttataattcacgagaaacatcaaaatgttgaaaataccctttctctttttgaaatttttccgtaaaatttcgaaaaaatttttggtagggaaatggcccaaatgccttagtagggaatggcggtagggaaatggctggtagggaaacggccggtagggaaatggcggtagggaaatggctcgatccccttaaactgccgattggttaatcaaaagatgaattgcaattttattcaaagaagtaaattttcataaaatggtaaaagcaataacaaatcaaaatgggaaaacaatagtctaaatcaacaacgagaacaaatcatcgacatcggccaaagtctttcggcttaactggtttcgaatccagcgatcgagcttcttaaactgattcagcttttctaacggaaaagccatcttcgtcatatttgccctggcggcggcgcaggagagaatcgcaagggcagcggcggcagatgccgaagggcccgttctgcgggtctgggttggcggaatggagacaattactttgtgttgaacaaagaaatttcccaaatttcttctctcatatgtccgtttgacagcatcaaacgcgaatcggatcgcaacctgtaaagtaaagaaaattgtactattttttcaacaatgttcttaaacagcagaataggcctctaaaaccaatgctttggcaccagaaaagattttctcgaccgaagttttttatttctggaaaaattagattctttcggaacacatcatgggttccataaaaaaaactttttcgatattttaaaatgagtcgcaccccattctcgcccagggtgctccgaaaaatttcgccgggacaaaattacgccattttttttgaaaaatttgcaaaaagaaatttttcataaaactggaaaatttttttcgcgatttttggaaaaatttacttgtcataaaaattaaaaaactttggcgtcgaatttttcctgtccgccttccccctccctaacttggtccccagtttcaagcctaaactccattcatatttgtcagaattggctttgttagattggaaaatttcgtaaatttattaggtttctaaaaagttgtgggcaaaaactaaaaaaaaaattggccgataccgatttttcacggtggtgagccatcggaaatgagcaaggaaatttaacttcaaaatactctgaaaaaaattttttgcaccatttgcgcagaagtcgaaaagtttggtcactttagagaaaaaccataaaatttt

SEQ ID NO: 911 - DNA, 3169 bp, Heterodera glycines
  misc_feature (36)..(36): n is a, c, g, or t
cgaaaaattttaaaaaaaattttcaaaaaaattttnttgacataatattaactaaaatttcttaaacgaagcctagcgaagaaaactttaaaattctaagcgatttttgaaaaattttagatgaatgaataagtatttcacaaaattttacaacaaaaaaaatcgctaaaaattttcttttcctgaaatttcattataaaaaaatttaattgataaaaaagtaaattaaaaaaaaatttttcggataggagagaaacgttgtgcgccgacaaaaacccaccttttggatggccgaccagcacaaattcaacaccactgttttgcattcgcgtgaagcggtcgcgcaaatcgaagtttccaacattgtacacttcagtgacggaaggcgcaaggactttcattcccttcatttgcatcatttgcctgtaacgatcaacaaagtctctccagttggccaaactgatctgaaagaggtcggcaatggatcatgtatgaaaaaaaaatatattttttaaatttcctaaaaaaatttttggaaaaatcgacacggggttcgtactccgccccgccatggacccattcacagtcgaaatttttttagggataaaaataaatattttgtgctgaatattttcgatttattggtactcactcaaaagaactactgcacccaaatttcccagaatttttaaagccacaaaaaaaaatttgttgaaaatcctaaaaaacggattctaaataatgtcccctcacattgttgtcgcggctgttgtccaccaacgcgatggcacaccagctgttgatctgtgccggcaacaggtatctgccggcacgccaccgacaggtgtcgttcggcatttccagtttgtcgtcggcatatttcagtttcattgggttcagaatgcgcgccggcacttccattggtcgttcagcaaatcggatggacgccctcgcaagatggtcactttggttcagcgcaagcacatttgtcagctgatccgtctgccttcgcagcaaaaatggagggatggcacaagctttgatcatttcctgaaaataggaaccaaaatttccaaaaaaaatgtgtatgaaaggggtgcaaaattttatccaccccccccccccccgccgtttcacgaaaaaaaaaatcgccaaaaaagttttctaattttttttaaactaagttcttgtaaaaaaatttctaatttttttttactttgttcttgtaaagaaaattaatatttttttgaaaaacttatttaaaaatgaaacatttgcctttttattcgtttttttcttttgtattatacgggacaaattgtgtgcacctggtgggtctctggtgtcatctgagcggagcggacacgttggtagtcgcaaatcttcagcagttccatcggataatgcgtggatttgccacgctctcgacggatcaccaaaggtgcacaaggcgcactgaaaaattttaaattccataaaaaaatttttccaaacctaagttttttcgaaatttttccaataaatcgataaaaaattttcaactaattgttttattgaaattctcatataaaaaaaaatttttcggcggcggaattttggggtgcacccggaaaaaatgggggacctcaatttgatgtcgtatcggcgggcataatattgctcaaccgtgatttgcccgtcttcaaccatcataatttctgttttggcattggttggcgaaaaagcggagatcggaaagcgttgaattgcttgctggttataagtggtgtgcacatacaggcctgtaaaaatggtatgtgacaggggaggaaaagggctcacaatcagctcgtttccgccccgtttcacttcctcagaattgttttttttaaaatatattcaaacttaaattttttgttttttttataaaaactttaagaaaaaaaaaattgaaaaattttcttacaatcaaattttttggaaattttttaaaataaaatcgcaaaacgctaataaaaaatttgtgagattgtcttataaaaattaatgttttattgaaaaaataaaaaaatttttgcgagggagggggagatgcataaggataaaagcaatttttaacgaattttaagatgatgttgtgcccatcccgtcctactttacctctcaacatgcgactgacatgggccaattcaccgttttccaacagtccgccattccatcgagggaccactttttcgaacttttcgagcatcgattcgaccaagtgaaacggcgtctgaaagtgaaggagcgttttgttcttgtgatgacaatgagaaagagtctttaatgaatgcgtaattaatcctttggaattttagtaagactcaaaaaaaaaaaaattattttccgccgggatactaattccgaaaaataccaatgaaggagataaaattcgaattaaaatcctcactttttgcacttggacgaccatcgcagcttttgctccagcgacatcgccttgcttcaagccgtctgcgaaaaaaaaaaaatttttttaattgcgacgtacggttcgaatttttgttttaaacccactttcaacaattcggacacttttgtccattccgatgccaagaaatgagctgttgctgcggaagtagggcgagtcagcggcggtgaagcggtgctcatccggacgcatcagataaatggaggacgcactgtagtgcatgaattgtccattcctgtcaaatggcagagtgagcgagtataaaaaatatgtgaaaatttaggccaaaaaaacgacgaatgaaattacggcacaaatttttttgtcacggcacctttttttgtttttgaaattttcttagagaaaatttttcaatttttttataaaaaatttgtttaaaaactttcgagagggggggggggggaaaggaatacttgggggaattgattcgggggtggggggacgtactgctataagaggcaaaaatgtcaaaaaatgagcgtacgggtcgctgaagacgctctgtgaagaggcgatgttcagaaattgggccaacgactggtccatttgggcgacgtcgttgggtgaggaaggcgaagtcgccgatggtcagttggccgccttcggaaaccaccggcgtaacggtgaccgaatattgcggaaaatgcttcaggagttcgtctctgtcggtgatttcgt

SEQ ID NO: 912 - DNA, 13265 bp, Heterodera glycines
  misc_feature (143)..(143): n is a, c, g, or t
  misc_feature (147)..(147): n is a, c, g, or t
  misc_feature (185)..(185): n is a, c, g, or t
aaattttaattttttttttttttttaattttggtttaaaaaaatttccaaagaattttttcttgaaaatttcaaggtttgagaaatcttttttttatttttccagccgggggggggggggtgacgagctgctcgcgacgaaanccancaactcgatttggtttgctcggttaggtcgataatcanctcttctccgcttcggagcataatgtgtccgctgattttcacttcgtaacggacacgggtcactgggcgtttcatgtcgatgccgaacagctacaaaatgggaaaaaaggtattcccgtgttttgctacccccccccccctcggaaaattcatattttggggttttcaaagtcactgatcacgaacatggtgtcatcaaaggtcgaaacaaacaccagaatctaccaaaatatgaatttttttttcaattttcgaagggggaggggtagcaaaacacggaagtatcggaaaaaattggtaaatgcccatcgtcagtcattttgttacaacgcctcacttacattggtcgttacttgggtggcaactgttgatcccccttttcctggttccttttttgcagccattacagtgctgcccttttcaatctgaaaaatgggtcatgtcaaatccaatttttgaaaattttaaaagttagaagcctccaatgcacttaggcgtccaatcttcagtttcttagtccgtaatttttccttatttggtcaatgcatagatttgtggtatcaaacgaaagcataaagtctgtagaattttctgtagaactaaatgctgggccctaagcaacagacaaaaagtagttacctattcataaatatacccgaaaaaagctaaattactttttctcagtttttttttttcttggtgtcaatatttgtctcttttctatgaattccttgcactttaagctttcgtttaatactaagaatgtgttaagtgttgaacaagtaaaaaaaaagttatatggccaacaaaaacagatgattggacacatttaaaaactgattggatgatgcctaaaccataagtttttccttatttggtcaatgcctacatttgtggcatcaaacggaagcctaaaagtcaactttggacgccgcctaaagtgcaacagaggcgctaaagcaaaaaaacttacgcctcgctgcaccaaataattctccgcttctctgttcttcagattttgggtgcttctcagcagctccatttgttgtttgttcgttcgtcgtataaaagattatttatacaatttttaattgttaaaagctggacaaataggtatgttatttgaaaaaaaaaatggttacgaataggaatagtaacggtgtgaaccagggatggcacggaattccggtttacgacatttttggagtctgaattccgatttgcgaaaaatttttgagcctcggaattttccgaaattttttggggcctcggaatgtctgtcatccctggtgtggaccagaaatttagtcaaccaatcaacaaactcggtaagcacattgaaagcccggcacttttatagaatgggtcccgcgtggattttcggggtcgctaatcacgaatttgagacatttctgtaatccaattccaaatcctaacttaaatatgaaaaaatcgaaattcgatgggttttagactttttttaattcgagtttttggtgctttccttctataaaagtgccaagtgaaatgaagatgtaaaagctttgtaagttttgcagggccatttaacgagtgacgactttaaaaagcttctgtaatactatcgatggtagcttaaaaaaggaaaatcgaatttttttcgcaattaggtagtaagttgtttttgccgttttcagggtcggaaatcctattcgggaatccatttcggaccccaaaccccgaattcgaacaaaaaatcttagaatctgtataaaacgaacatattttttgctctttttcaatgtattatagtgaaggtgctgatgtccagcccagaatatgaggaagggaacgagtgagaacgaggattggatttggggggaaaacggaataagccaaaatccgggccctggataaatggcctccccaaattggtaatcccttgggcgcccactagatcgaatacgcgtgcggggatgggcgagaaggagtaaaatataagataaatattggccaatcacataaaataataattccgccgcgctttgctctcggctctcgctcgccgattaactgcccactcaactgactccttatcgagagaatgctcccgattaaatagttggacttatggaacggaaaatggaatggaagagagcggggatatgtgcttgggaaagagataaaacggatgtgattaattgcgctttacacgtccacccttccttaagtttgtcctcaaactttgatttacttttgagttggaatgaatcaaaaaataatcaagcatcaaaacgtgacagattgaccgaagtcataggaaattaaattattgatacataaataattcgatttcgactgaatacccgaaagttggtgtgaaaactgacgtggattaatttattctatcaacagggatgtctagaaacaaaactttgttttaatgttgtaaacatagttttattttgtcataaaaaaaggcacggattttcaggcgcttaatcgcaaaataaatcatggctcatcatcaataaaagtatggttaagatttatttaaaaaaaaataaaattacctaattgcttgactaatggaccaaagtcctttctactatgagtgtttcattttcttaacgattctccgctcttttcacattgggattctaagaaatattaaaaagatttttgatttgttttaattctataattctgagtccgtttgcttccgtaaaagtttcactcattaaaataattactcattgtcaaccatgacgaatgacccaaaggtcgattttaacaattttacacagcatgccaaaaaaactccattaccaaaaagttgatttgtggttctggttaagatagtaaaggcaggacttaggttagagtccattccaaagcattaatattttaatatatttttttgagaatattagttttagtaaaaaaaaattgggagatcttggtatcactcaaagctattgaaaaggagaagttttttaaagcaaatgataaacgattgactcacatgaaattcgaattgggaaaaaaaattaattcgatatattcgatgcagaattttcttactgccgcaaaatttgaaaaaattaaataaaattttataaagcaaaaataattttgtttatatctattagcaaaaagaaagattataatttttctgataatcttctacaaatcagtggaatattcagaattgtctaaatggcatagatttgtatgtgtcgaaattgaaaattttatattatcatcgactttactgaacgatgtgaaataggggatttacgatatctgagcaccaaattttggtattaagacacaagagtaattaaaaatgtccgtctaaatagattccttttggccgattttttagtattctattaattaaaaaaacattcataaaatttaatgtatattaaccacaaggcccgtaatcttgacagtgctgccgaagcagagaacttttgcagacacgaattaacataaaatactgctacgatttgaatatttagctgtgcctcagttttgtgcttttccaagaattgcactttccttgacagatggaccgaaatccttgggtttaatcttctttatatttaacggcgatagtttcccaatacatttcgaaaattaaaataatttgacttatttttggttcaaaattttaatggtttattttaataagaaagaatttaaaataagtttttaaatgctgcaaatttttaataattagggaaaaaatcacatgactggtgacccgagggtacttttgttctcaatataattctaccttcggtgatggtagtcttgatcatggttggaagtagaccgttgttttgcgagaaactcacaccattgacggtaatcctcctctactggatcaatttgtctgacaatcttgataactaaatcaatgctggttccaatgtattggtgaggtactatttgggttggttcatcacttaacgtatttagaccagttaaagtagacagactgtcttcaaagccttgaattcgaaaacctaaggtaataacttctacccaagcatcatcaacaattgctgaaacatcaacatctgatccaaactggtgtgaatagaaacgttgtagtgactcccctacatcaaaacagacatcgacggcaattattttgccggttttttcgcattttagaattctttcaattgacccacagccatcctctgggagcaaggtaaaatttgtcgcaaatttgttagaagcattaagagaatttgactcattttccacaaattcttttatatctatgatttcacccaatcgaaaatattcatctgattgtgatttctttttcatcagcaaaaaatgaggccaagaactcacttcagttaatcgtgatgccaaggtccaatttatccctgtttgaataacaataaatttgtcatccgttgaaatagtttcagattttctattctctgattcactcagagatttgggctgtaacatagcccataacagagggtctgtcaaagttcccaaaatctgatatgttcgagcaaaataattttcaaaggttgtgaaaaagctattaatgtcctcaatattctctattgttatattgtttatagctaaattagctctgctatgcatgactggtgaccctaaggccgtcttagttgttttgtccaagacctcaattctcacctcactctcttcataatttggctcattatcgccaccacttttattttcaatcatgacggatgaccccaaggccgagttcacagacatttttttaatgtgttgcccgttttcagagcgagaaactcgcttcccatcctcatctgccatttcaggatcacccgaaaaaattcggtcaacgacgacattcgttgttggagttaatggcgaatgtttgtcgacagtggcggattcgcgcgatgatgtgaggtcttcataattttgtgccagtggcatttgtcgtgacggggccgccgagatggattttttagaactcttattctttttgatttttggcattttaaagctacattttatttttattatacaagcgaaagagaaataaatattgaaaataaaaggaaattaaaagaaagtgaaaaataaataaataaataattgtcgaaaatataaataaatgagcaagcatattgaaaatgaacaaaaaatgagcggagatctgtggattatgggcagagtttgaaatcaacgaaatggcggaacaatctcgtttaagagaaagcattagctcctgccacagagcattgagtggccatgaatcacgtgaaccataaatgaatggatggctaatacattaagaatagctaaaaatatgatgatggacagagataagttggataacggtggcaaaaagtatcaattataagtgaaatttgacaattataaattaaaaatatgtttaaaaaaaataatttgtctatctttattagtagaaagtgtaaggattaattctttttgttttttgagcaccttatttggatggttataagtcggacgagaatcaaccgaagaagtatttgggagatgattcaatagtcctaattctgctctttcgaatgagcatttatttgttcaaaactattaaaatttcagagactagttaagttttttgtaacagtaacgaaatgagaggacaaaaaacaaatacagaaaatgtttaaaaaatatgaaacatttaattttaattttgtttggtatttattaattgcaaataatgattgtatataaattgaataaataataaatattaaatggaaaaggccagcggtgtgagtaaaaattagcattgaagggacattcattcaccttaccttccttcacatttgcgcaccaaaaaaaaaattaaaaggcggccacaacaacggtcaaaggagaattatggatggaaatttgaatatgcatttgtgtgtgaataggagagagagaatgaaaaaatggtgttattatacagtatattatatataagaaagtgggaaacataataattttaatttaaatataaaataataacaaagaaaatattttaattactatatatattttgagttggattcattgcttttcatgacgagttctgcgaacagaaagtagaagtagcacagtattccaactttattaagatttgtttacatttattaaattcgcgccaataagttgaaattaaattaaatatttaattttttaagtgatttaatattctttactgactttaaaggtctaatttgtattttcagtgtagatttggccttcgactcagcagggataacttcggataacgattgtttattcaacatgccactaataaaagaaagaaatttgtcgttacctgctgcttaaaatttttttttatctttgtttcgaacatcatgcgaaaacccgctaacgggtataatcattattctcttttttaatcatttcttcacaaaaattaatgacaaaaaaaggtaatttgaagattttttttgtcaaattctttgtaaattaaaagaaaattgatagtacttaaatagaaaagcagacttagaaagaagattatgacttgtcaataattcgtcagttaagctgaaacttcgctgaatgaagctgaaataaaatgttagttatagattttgttcattgtgatacaatgaaaagcaattgaaaatgtcaacaaagttcggatattcataactgatttatttaacataataatttttttttacagttatcctagttgctaaaaaaataattgattttcttcaattattataaattaaacttatcgactaagcatgaagaggcatgcgaacaaaatgggtttttattatctaattttaatgatacgggtcgaatatacaaattcagtaatttgaaccagagattaccaatttaaagagtggcacggaccgcgggttaaaatatcataattaatttgagttaattcatattttctatccatgcgacttgaaattactttaagtctgataactttgttttagtgcacaataagcttgacgtggtccgcgaacggagaaaaaacaaataatgatatttttaaatattcaagctggcttggccaaactatgttagagttaactcataatggtggttatgtctaggttggcacatatttcgatgtgctcactttcagtacaattattatgataaaattagatcactgtggggaaaaaaaggaaaaaaacaatatgtataatgctttaaattttcaaaatagtcgtaaaagaaaacctaaattgtttaaaaaaataatttttaaaatttctttgtaaatatatttcgcccaatggtgacgattaagacaagtattgtaaaaaagctaaacaaaccataaatttctgtctaaacaactgaatattttaccgctttctcgatttaatctatccaaattaaaaaaaataattttccaattaataataacaccatcagtctgcctttgaagaaactcagattgaatttatcataattacttttgagttgcaagaattagggcatcgatggttcattaaacttgacggtcgccccgaaagacttttaagtagagatgtgtaaatgaaatacaaaaacaaaaaaaaaacaaaatttcgggcaaaagatgcctattttattttttgtaaattcgtttaataaacttatgcataagactgaataaaaagaatcacaaaaattaatcagcataaaaaaatttgtgtagcgttctgactggtaacattttttttatattacaaaaaaaaaactttgttaattcttaatacttctttgcttgcaaaaaataaaaataataataaacatccattttctcaacaaaattttgatgtcataattgaaaacgaaaataaaggcaccaaaaatcgcgaaaaggcactataataggcatctaaaaattgcaaaaaggtatgaaaaagactctgcaaaacaaatcagattatgataagccaatgaaatagtcgtaaaatgaaccgaaaaattctattcataataatgaaaaaaatgtttaacatcccaagattattctgtaataccgtttaactacatggttctcaagttctcagaatatattgaattttctacaacataaaatgtgaattgttcgttcacgcaaaaacatcagtttatgtgatagttttaaaaggaccaaaataaaattatacgcgtaatgatgatttgaaagcgcagtttaagtgagtgaatgcgcacgaactcctaattttacataaataatttcgagttaaaaaaatactatttgctcgattcttcaatttaactgggacaatgaatgcatgacgatttccccaaagggaataaattaaaatattccttataatgcataccaacatgatcatattttattagcataaactcatgttattggcatccaatgaaactaataagaaatgggactgaaaggccaaaaaaaaattgctcaccttctgactggcgttaaaagtccgcaaagataaaaaatttgtttttgttaccctttgtgtgttttaagtttatttcagcaagttaaaattcttttatccaaatgcacgaattgaaattaaagggatgcttagcatcattttttaaaataaaaatcaccgttcaatgctcattatggatcattaaaagaaccaaggtctaaccgcggtttgggttcaaattttttttgaattaagtatattttacctgtcaagcgacttctttcacttatcatagtaaatgttgaaattttttatgggatttgaggtttattatttcattcgaaatacttatttaatattgctataatttgcacattagctaagttattgacttcgtatttggtccctctagaactttctgattctgaaacacgaaaaatattctaagagttcgtgccacttcattcttgacggtatttcccgagggcatttgctctaaaagcgcaggatttatttaatgatttacgccttttttaagttttgttaatgagtaaaatattggtttcttcttccagaacatgcatgacggcaggcccgaaagccaaaggcatttaaatgataataaatacttttcatttttatattaaatgtaattctcccaaaaaaaaattgaaaattaatgccaacccgaataataatgatcaaataatacttataaaatcgaaccaattctcagagaaaatgctacagcatactctacgggattcttttttttaagtattgaatcaaaatgaagccatccgattaatccattcatttgttaaaaaattatcatggcagtttcaagtaagggatgaccaacttttcctctattaataattctgggccaaaatctttttggcatgtaaaatattatgtaattcatacatttaaaaaaaaaattgatccaaaaaaaactaaataatattttccccattatttctccctcaattaaaattaagttggcatggtgaaatcaatagaaaacagcctgagattaaaatcaaagaataatattttaaagactattcgtcgatttgaacatttagaaaaaaaatacataaaaaataactcgtttcttcatccaaacttttctttggttcatgttctgaggtataattttgactgcttagtttaaagaaaaatttcactgtttacaattattggactttattaaaatctctaagatattctgccattcatgcttgacggaatgtccgaagaccttgattttaaacactcgaatgggcaactgccaatattacactctgttaaaaaattataagttcaagtctttaagtacttcttatgatccatttaaggggaggtctaagcctctaactgtatcaaaatgcgaaaaaaaacaacttaagcaataccaaaataatccgttgaaaaaaaaatttttgtttttatttgactaaacccggaaactttgccaaactgagcggacttggcacatttttaaatgggcacatcgtttttattcggtaaaattggaaacaaaggaaaaaacctaggtgatttcaagagaaaaaaaaatcttagaaaattaatatgagatagtaccgcagtatttgctagaaaacccttttggatcattgcttgaggcaagtctctgttaagtgtatggggccttttgacggaatgcccaaaggctacaattttgaatgtccatttcagaaatcggcatagctacattttgaattataaattgtttcgtattatactcatcattattggaactcatatttttaaaatcatgactggatcctccatagatcgattgagagacgaaaattcttgaaatacaaaatttctttcgacgaattttacccgtaaaaaaaaaattatttggcctagcactcattgtgactttactttctcaaacatcagcattttaaaaatatattgaaaattttagatgcttttaaaatatgaattaatcagcaaggtttatatttttgtgttaattcgaacagtgaaattatttcaattaattaaaattattccaatattagtttgtctaatccagattcttcaatcggtttaaattccgttctttgcttcaaaaaaacatgaccgaatgcccaaaggccacaataaaatattggttttctaatgattgttacttcggcaatgtttggttaaaatgagtgatcactgatcagaaacagtgaaggaaattttgtttccgcaagaacgttcacatataatagataaaagctgcttgtctttagatggatgtaatggatttccggtactcggagaatgcactgtgagagaaaaaaaaactttggccgattaagcaatttaaagtgtaaagattaaagtttgtcagcataaaataaaacaacaaaataaatttaattaaaaatcaacaaaatgatactcagcaattagataattaaagcatatcgaagatttttatttgatctgacggattatcatggattgatttacaaattttaattttggcctcttacttgacggtactcccaaaggagttcaatattaaacttttttttgctgacaaaaaaaggaatacagaaaattcttatttattagcaaatattcgaagagagcgagcagaataaataaatttcttataaaatggtcacggcgaatggggcagagcaaatagaaacgaattttggcgcaataaaaaaagactcctgcttttgggcgcaacattagacttgccgtttggcgcaaaatatgtaaattggcctattatttttagcgcaaaatgaatttgacaaatttttttaataaaattcagtcttcccattttgggagcaataagaatgtgatgatcttcccattttggggcaaaataatagaattgtcgttttggcgcggcgcttgacttgcctttctggcgcaattagttctggcgcaaaaataaaattgttttttttttgtaattaaaaatcgacttcccatttttggggcaaaaattaaaaatattttcaaattggttcgaaattggccatttaatttttttgatccgaacatgactgatctcccgaaggagcggtgcacctcattccattctcgttccccaacacgcgcaaatcccactcgtcctcctggggatggattgccggcggcgtgccagcaaccatccaatacatacatagtgaaggtgctgatgtccagcccagaatatgaggaagggacgagggaaattggggattggatttgggggaaaaaggaataagccaaaatccgggccctggataaatgacctccccaaatttgtaatcccatgggcgcctattagatctaatacgcgtgcggggatgggcgagaaggagtaaaataataatataaatattggccaattacttaataataattccgccgcgttctgctctcggctctcgctcgccgattaactgcccgctcaactgaccctttatcgagagaatgcttccgattaaatagttggacttatggaacggaaaatggaatggaggagagcgtggatatgtgcttgggaaagagattaaacggatgtgattaattgcgctttacaatatataatatatatatatatttaaatatgttttctaaattactttaaaataattcgagacctttcttttttctcatgtgcttcaatgtacatttcaccatatggtgttgaatgaatttttttaaataaattttttaataattttttaataaatataagaacattaaaaattggatatttcttaattgatattataagaacataaactaatttcttatgtaatcatattttcaataacaacactaatcattcaaatatattcaacaaaaaattgacacctacagaatagaaaaaaaaattcttgatggaatatgtagaaattaaatagaagaaatatactttcattataaaataacaataccaggaatttaataattattgttaattacaaatatttagaagatatttaaaaacctaaaacaaatgaaactaaataatttaaactatttttttcacacaaacatttgaatagcatcaattgtaaaaacgaataaataaaatataaaatttttatttcaaatattttgtaaaccatcaaatatctaatcagcatttagcaagatagctccagtgcaacgaacaattggttccccaagatatcaatttttcgaataaaaattaaataccaaatgtaaatattttgtaagatgaaaataaaataataatatttatcatcatttaaaaaccaatatactttaatcaaatttatttatgaataatgtaatttgcagcattaaaaattttatattaaagaattaattaacttattctttttgatagcttctctagaaaattcatcataagttaataaatcagccaattttaaaaatgagctttagcttgtcaaatgcgctacatattggggaacatcactcattaatcggatacaaaaaagtcattagagcagataattttattttttttactggtttgagtgctgctgataaaaaatttaattttttagatttttggtaaaaatccacaaaaaatagctaaaagtattttttagctatttttttatatggaagaaaccctcccgttaaatggaataatatatttttagtatttaaattttgtcatttt

SEQ ID NO: 913 - DNA, 1547 bp, Heterodera glycines
aggggacaccctcgtttcggcgccgctcgtttcggcgccagcccagtttttggactataactttcaaccaaatctaacattattggtatcattcgaaagccctaagtgttctctattagcctgctaagtttcaaaaaatttcgttaatgctaaaaaaattatgactagaagaattcaaaaaaccaggccacatgtgtacttttggccataactttgttcaaaattgatcaaattttttggaattatgcaaaataatagagcatcagaagggttctcgaatgatatcaacaatattagatttggtggaaaaagaaaaaagttatagtccaaaaactgggctggcgccgaaacgagcggcgccgaaacgaagtggaccccaaccgcacgtataattttaaaaggatgtcattttacctctcctttgtaagggtggtcgcttgtctctgaacgaagagaaaattctgaaatttttcatgataataaattaacctaagggctatcgaatgataccaagattattttttaggacatatttaagaaaagtcatgacggatttttcttgaaaaacctgacctgtaaatttggcagttttacaacatatttttaaagtgcgttttcagtttttttgcataaattaattttgcgcaatttacttcaaaaattttcttagctttttgcataaaattatttcaaaatgtaaaatcaaaattaataaaaatgaattatgaacttttcacctatcactcccttccctaaaaggatcgtccctgatccatttttttttaaaaaaaatttattgccaaagcataaagtcgtcatttccgccctttttatcattcctatttatttccattgccctttgccccttggttgaccacgtcctgctgattgtccatccgcatatcaacagttctttgccaaattcccgacacgtttgcacacaaagcaagcaccacgaggacccgttggttcgcgacttctgacaaaaacggcaccgctgaattgtccaagacgttgctgcggcctccatgtctcatttcggcgtgcactcggaccttggtcgggctcatccgctcttctttttcgcgactcaaatgtggacgtgctgcttgaagtgctcttaatgccccatctcgaagactcgttcttgttgttaccaaaattaccaaatcactttcttgtgcttgatagccatcgaccgtcacgacaagtacctcaattcgctgcttttcgaattcagtttgaagtgattctttttgataagagtacaaacaaatcacaactaatgaaacatttggcgacaaaattgtgtctttcaacgcagttactatctgaattgccgcagcagtttgagaatcgttcgtcaacgaatgcgagagcaaggtcttgtctgcactttccgacaacattcagcaaaacaattggacaattttgaattgatagaggaaacttcaaagctgccaggagggaccgatcttcagctgctcttcctgggtcgaatgtatctccatttgaatcatatactgccgaatcaactgctatcacca

SEQ ID NO: 914 - DNA, 4117 bp, Heterodera glycines
cacaatcgtggctgaaccatcttcggcggcgagtgtcgccttatcgactaagaaagaggagaaaaagaagaaatgatggaaaatggaaaaagagagagagaattgaggaagaagaattaattgtgttaattggaataatttaatatttgtgattgattttcttattatctaaattgtgatatttcctattcaatgtgattttcgtgcttagtattagtcactcttttttgttgttgatcgttctgtctaaattgctccacctccgcttttcctctctatttaaacacgcacgtttttcgcttcaacgcattcttttcatctgacatttctttttcgcgactcaaatgtggacgtgctgcttgaagtactctgctgttgcatcgttcgccaattttcatcattcttttgtaaccactgtagatcctggactactctgccaatgccatcaattaattgcccatatcgatcacgcatgtatcgaccatttcgtaggatctgaagatattcctcaccaacaatttgagagtcctcacttgctgtttccaaaaacttattccacacctctccctcacttaaagttttgaaatcgccaatcaaaaataaaccactttttgctctgcttaaagctactgtagcccttctcgaatccttcaaaaattctgaattctcacttaatgccccatctcgaagactcgttcttgttgttaccaaaattaccaaatcactttcttgtgcttgatagccatcgaccgtcacgacaagtacctcaattcgctgcttttcgaattcagtttgaagtgattctttttgataagagtacaaacaaatcacaactaatgaaacatttggcgacaaaattgtgtctttcaacgcagttactatctgaattgccgcagcagtttgagaatcgttcgtcaacgaatgcgagagcgggtcttgtctgcactttccgacaacattcagcagaacaattggacaattttgaattggtagaggaaacttcgaagctgtcaggagggaccgatcttcagctgctcttcctggttcgaatttttctccatttggctcatatactgccgaagcaactgctttcaccagtgtcgggtgcattctgtaacaagtcgttagacgagtttgaacaactgtcggagacatgatcaactgatcaaccattgattcaagaccaaaaccggattgtagcaaaggcgggagtttctgcagatgaacaccaagctgcaattggtcaccagttaccaagactttctccaattttggcattctggctactaaatgtgctaagcagacccacgacccctgagtagcttcatcaaagattaagactgttgtgccgtctaaagctgtgtgaatcaaattttctgccatcgacactgtggtgaagacaatccgcaaatccgcaacttctgagtacaaattcgctacttttcgttctttcgttaagcgtggtcgaacttcgaaattcttacaataagtctcaatttccttcacatcgtcttgtgtctcaaacttgcttattatttcttcgttcgaaattttggaaatcaacaaatgccttttcaacttttctaacatttctttgtacttttctttggcataacccgagaagaatgcaactgaacctgattcttccatctcatcagaaccaaatacatcattcaattcttggactaattttgcaagtggcaaatttgctgctgtcacaatggcaatttttatttctttttctatcgacaaaagaattgctgcaacaattgcggcaacatacgttttgccaacacccggtggagcatgctgaaaaacaaagtgcgactccttgctcaacaaaagttttgctgtctgctgctgcttttcatttaattttttcatcaatgcgtgattaatttgtattgccgaagcattttggtccacattttcctcaattatctcctcagttctgcctaataccgcacgcatcattttcccttgttttgtttccaaatttgcaatttttgatggcaaattagaagcaaagcaatcccttctgtgtttcactccaatcggaatgatcgggtgtactacaaagacacctccttcttctgctgcttccaattcggcatgaacatcacgaaactttctctcttggacattggtgactttggccattatccaaaaattaaattttggttttccttcctctctgattctctcaatgtcaatttgtttgacatagccaaaagcaaagtgcggcaaatccaacgcagttctgaagaagacattcgcttcttctgtccaaacttctttcaattttttcattttttcggtatcaatttcagcaaatctcaaccaaaaagtgtcgttctgccattctgctcttccttcaaatttgcactcaacaattctcttttcctcatcttcaaagctgtaggcaatcgctgaactcatgatttgttctgacaactcaatttccggcagagtcatctctggcaaaagcggaaagaagacattgcgagagttcgattggtatggccacggcgcatgatttccgacaatggagagaactcctttgccttcctctatctgcttttcagtccccagtcgaaattggctttgaggtggaagtatgaacgaattttctactaatgtttgctctggaacaaaagcagtccaaacttttatcaactgcccttcttggagagactccaattccaactcagaaagctgacgccgataacatctcgaactcaactgcagaccaggagaaataatgatagcacaaagctttttcgtgacaccatttgagaccatttctctgattcttaagaccaaacccggatgttccctcagaattgcatatcttatatgaccgaggtcaatgactgttgcttgactgtttattttttgcacataccacattttgttgaaatgacttttgtcagtttctctttttgctaagtatcggtaatcatttttccactcaaattttttcactccaactatgtctcccatttgcaatttctttttaaactctcttgctttttcagccacctcatttgagattgctacaaaatgtggccagcctttgtttgccattgtcctcaattttcctccaatcactatattttcttctacttggcaaaccaggtattcaacaatttttccttcattttctctcacattaaaacttgaaaattcttccatcatttcttcagccatttcatccgggtttttgtcaaatccttgattcgcaaatttttcataatctcttgggcttgccgaagcaacatttttatttaatttttgattcttttcccctttttcttgcccactgttccctttttcccctccccaagttatttgacttgccgaagcaactaaatccacacttattgcactactacaggtttccttagaaatatttgagtttccacttgggcttgccgaggcaattttgttctttttccttacatcctccaatgttaacttttccaacggcgggaactcgctcaggtcccgaacatttggtggtgctgttggtgccgacatttctgtaataaatcatttgttattgcggtgttatttgaaaaaatttataggatttaatataattataattaaattattattattattatatgtaatattaaaaaaaatcttggatttatttatttattattttttatttatttatttatttttttattgtttttttttgttttcatttcaccagatttcttacgcaggaatttcttcatcaaggctgagagaatccgtccaaggatatttttaccaggccatcggtttatgtcgcggattttttcaacatccgaaagcgccactcctgcaccccagtacacgtcatttgctgtacattcaacaaattcaacatcgggaccaaaattgaagagatggcgcatcaggtgttcgttctgtctatatttgtgccagttggcgcaagtcatcacgaatatgcttatgcgtcgccaaagcagttgtgccaaacagccgaattcgcgatccaattcgcttgcactcctttggatttggtgtccgcagaattgcagatgccgcttcttcgtctccgaaagcgctcgctttggcccacatgtacatttgttcgctg

SEQ ID NO: 915 - DNA, 2695 bp, Heterodera glycines
tttttcctccactatgtctcccatttgcaatttctttttaaactctcttgccttttcagccacctcatttgagattgctacaaaatgtggccagcctttgtttgccattgtcctcaattttcctccaatcactatattttcttctacttggcaaaccaggtattcaacaatttttccttcattttctctcacattaaaacttgaaaattcttccatcatttcttcagccatttcatccgggtttttgtcaaatccttgattcgcaaatttttcataatctcttgggcttgccgaagcaacatttttatttaatttttgattcttttcccctttttcttgcccactgttccctttttcccctccccaagttatttgacttgccgaagcaactaaatccacacttattgcactactacaggtttccttagaaatatttgagtttccacttgggcttgccgaggcaattttgttctttttccttacatcctccaatgttaacttttccaacggcgggaactcgctcaggtcccgaacatttggtggtgctggtggtgccgacatatctgtaaaaaaatcatttgttattgctgtgttatttgaatgaatacgatttaatataattataattaaattaaattattattcttattattatatgtaatttttttggattcatttcaccagatttcttacgcaaaaatttcttcatcaaagctgagagaatcttcccaaggacgttttttcctggccaacggttcgtgttgcgaattttttcaacatccgaaattgctactcctgcgccccagtacacgtcatttgctgtacattcaacaaattcagcatcgggaccaaaattgaagagatggcgcatcaggtgttcgttctgtctatatttgtgccaattggcgcaagtcatcacgaatatgcttatgcgtcgccaagcagttgtgtcaaacagccgaattcgcgatccaatgcgcttgcactcctttggatttgatgtccgcagaattgcagatgccgcttcttcgtctccgaaaacgctcgctttggcccacatgtacatttgttcgctggaggaaaattcaagcccatcaatgacaaatcggcaggagaagtgattggaaaatggatatgctgatgtgaagaatggcacgagtttccttccatcttgcgatatgacaactttcgcagtcggcatgctgaatggatacgacactaataattttatttgtttccttattttcttattaaattaaaactgttttatttatttatatatatttttttaacccctctttctgaacttttacttgccaaagcaaaattaattatttaaactgagttttcttgctctcggatttttcctaagattatatctcggactgatttgctcaggttcatccgtttcttctacttctttttcaacttcagaatttgatttttgacctaatttgtggtaatgtcccggttcatttattaattcctttgcatttgcctcatgtaatgctttttcttcatcatcatcaagcttaggaatagtgcatgctggcccaaggggttctatgcattttttaagttggttaatatgtactactcttggattagactgaggcgaattacagcttagtattgttgttctgaccccttctatgtctatgactctaaatacacctttccaaggtaagtggaatttctttgaagtacctatttttcctgaataatttctgagtaaaactctgtctccaacagaaattgttggatttctaactaatttatcataagaagattttgttcttgcctgagcctcttgattggccaaatttgctgcttgccaagcttttctaagtgtgactacaattttttgacgtatttcttcatcatcactaaatgcgactggttccctaatttttggatctaaaattagatcaatgcagaaaatcggatctctaccatacataagaaagaatggtgtttcatttgtcgaacgatgtaccgaagtattatagcaaaagcttacaaagtctaaatgctcatcaaagtcaggctcatccttagaaatatatttagagagaatattatggaaagtcctaaaggatctctcagttacagcatttccttgactccaatgtggaatagcgtatgtcttatttatgtaaagcaaagcacataaacttttgaagaaatctgacgtaaatgccgttgcattgtcagtaattaattcagtacaacccccaaaacgcaaataacaattctttaaaaatgccgaggctatggttttagcttttgcgtctggtagaggcacagaaatcacaaacttagtaaaccaacaaataatatttaaaatgtgtttatttccattttccgttttcggaaatggacctgccaaatccaaaccaactttagcaaaaagtgtatttactggtggtgtgcacatttctgctctataaggaggatttggagaatgcctaagctgacaagtaatacattctttgtaccatcttaatatgtctgcatgcattaatggccaaaaatatttgcaacatttctttaatgttttactcaaatccatgtgtccaccacccagacgagtggtatggaaagagtcaaagataagagcccttaatgatactggaatgtaaattcttggcttaaagtctttctgacgaaaatagagaatattagactctatgca

SEQ ID NO: 916 - DNA, 5183 bp, Heterodera glycines
ttttgatgtgtttctgccttttttaatagaaaagctaatggcttgtgatctgtatgtaattcgatatttgacataaaaatgaacggtttgaattgccgaagcgcataaattattgctcctaattcagtctgaacaggaggccaatttctctcagttttagaaagcgttctgctacaataagcaattgcattatagactcggttttcagaatcccattgcattaatgcgcctccctgacccacagaagaagcatcacaaaatatatgaaatggcttagaatagtcagggaatataagaacaggcttttcagaaagaatttttttaattttttcaaaagctttttcttgctcatcagtccaattgaattgcttctctttcctagttaatctcgttaatggttccacaatagttgaaaaattcggaatatgctttctgaaaaagcttgccattcccactacttgcctgatttcctttacattggttggattttgcagattaagaattgattcaactttgcttatgcttggagtatatccatttttgtttacaatataccccagaaaattcatacttgccgaagccaaaatacatttttgtggtttaagttttaaattaaaccttctgaatctttcaaaaacacttttaagagagtctaagtgttcatcaaagtcatcagattttgtgaaaaccaaaatgtcatccacataagcaataacattttcaagacctgttaacacatgtgccatgactctggcaaatgcacttgttgcattttttaatccaaaaggcaaattaatcatctgaaaaattttgtcctcagtgattactccacattttctggatgcttgttcacttaattttatttgtaaatacccactggccaagtcaagtgatgtgtaatagcaacaatttcccactttttctaaaataacttctaaacggggtaacggaaaatgatcaggtacagtaacctcatttaattttctgaaatcaatacatggcctaagccccccatcctttttctgtaccaagactatgtttgacacccatggtgtgtctgactcaaccataactcctgaggctaaaagttggtcaatatgtttctgcagttcatccctatatttaaatggaattcgatggggtttggaagcaattggctcattagacgttgtgacaatttcatgttcacctgctatacaattgcctaagtcatattgacttttgctaaaaatgtccttaaatttttcacaaagatccattagcttgattagatcattccctttaactgaagttttcccaaaatctaacttaaatgccgggtcaatttcaatttctttttctatcaatgcattgaattcatactcactgtcctctttctcaatttcagtaaaaatagtgctattttccgtttttaagacttcatttgcattgccgaggcatgttcctttaaaaattctttttacagttgaggtgggatttgtaataattacactgattgtttctgatttgaaatcagataatgatggcacaaacccaattccctcatttaaaagttttttatcaatttcattaaaaacaatttcatgccgaagcttttgaagacttttggtttttgccttaacgatgcattgctcattaggacttaattcagtagtgtcagttgcatatattttaagtccatataaaattttatttgtggcatttcccaatggcaaagtagcatttcctatggatagccatttattttgaaagtcaaaagtaataggcggcagtgaagcaagagcatcacatcccaaaataaaattataatctttcattgtccatgaaagttcatcatcaaaaagacgaataattatgtccacatattcatttcctatttttaaagtcacacgagcagcttctttgacatgtactggatgaccggaagcactcattaaatgtgcctctgatttaaatgttttaatacctaagtaatcagctaacgcttttggtgcaactgaggtgcttgagcctgtgtccactaagcatttcatttggaaattattaagagagacgagagtggtcactgtcattttattattatttaacgacccaagctgtcccatcaaagaatttaattcaaaatgagtgctcatttgtgttggatttggtccatgcctatttcttttgaaaggtctggtgaaagattttttaaatgaatttcctgcccttctaattcttggtggccaattaatctgattaattggctcttcataaatttctccttgttgaattttagtctccctcaattttcttactcttctcccagctttctgaattgttgtaccaaataataaattgcctaagcgcccattccctgcaaaaattcacttaaaccaattgtcaatcttatcgccaagtcaattgacagaatggtaataattagagacataattattaaccacatttttctgtaatcaccaatcactgctttgatcatttggctttcaacctcttcccattcttgagaaattgtagctgtgattttggtgtccttttcatgaatctgataagtcatttgactcaatattaccatattgctcacaaaagcatgatctttttatgtctgtcagatttagtagaaccaatttgtgaaaagcatgtgcttctatttgaggaagcaaattgtttagcccaaattttatttcatgatgaatcagtttatttgggcttaccgaagtaatttttccttctatttggtcatttttaaaatttgaccttcaatttgaattataattcatctaaattcctcacaggaaccttttcttgatgatggagagattatcattgacttagggccaatgaaagcacagcgttaccactagcgtgcgttttcgacttgagtggtaggatttcgaaccactgtttctgtaatgacgttccgccctaatctgataatccgtatgcacccaatcagcccgtgccctaattcttcctttctccagtggttatgcggaagaaaagaaggaaatagtgcactgtctgactgtctggttacgcttttgaaaaatttggccaaaaatgtggatacaaacccaattagtaccgacgagttctctaaatggaaaattaattttgcgagaagctcgcccccccccgtatcagattcacccgagaaaatttttaaatgttcagggaaaattaataaaaagaaaatttcaagaaaaatttccagcgtatgaattggaaaaaattttaaattcgtaaaattcagcataaaattaaaaaaaaatgctagaaagttttatttattttcttgaaattttcttaagatttttaacaaaaattactcatagtaaaggttatattttttggcttttggcataacaacgtgtaagggcaaagttttagaacctatgatgctttaccattcgaacgtgtgcttcggcggcaaatgccgcaatccccgagccaccgaatcccttatccatttcattcagccaaatgacaaattccgccattttttcaggcactttttccgcggtcacttcgatcggtcggccaccgacgtttacatcgacttcgcggtacacaccggccgcttccgccccatccggctcgcgcacccaaatgtggtgatgcagggctttgatggtctcaaaaaaaacatgcttccgattaaatgcattacagtatcaccttgtagaattgctcaatgaatgagttaaatgtaaaaatgatgatcgataggccttgagaaaagcaattggaaaatttaaaaaaaaattttgtgttcattgaatctaatagaatatgaaaaaaataattagatgtgatttattgttttaaattttggtatatcgatggtgaactttgggtaaagccgcaaatgtccgattttggcttgggccacaaaatacaacaaaaaattgggccgcaaatgtccgaaaatggcccttaagaaatgggccgcaaatgtcgacgcaacgcaaatgtctgtaccaaaataccataagcattttatttacgggagggaatggcctaaaagaaagcaaagaaccatttacatttactttaaagccgatttaagcgtttagtgaataaatgaattttacaattggctcattgttagtgtttgaccgcaacacttttctcggaacttttatcgattttttctgatctgtttggcgctcaggaccaaaaaagccgaaagtttacaatagcaaatcgactatgactttacacgataaaaatggtcatgcattttttttcttaaaagtggcttaaaatcgcaaaaataggccatttttttggtgaaaatctgttaacaaatcgcattaaaaattacaaaaattttttggagaaccgcgccgaaaaaaaatgttttttgaaaagcaaaaaaagtcttcgacggcggaccgggtcgattgggccccgccggttgggccccgccgattgggccccgccgattgggccccgccgattgggccccagtacgattgggccccgccgattgggccccagtacgattgggccccgccgattgggccccgccggttgggccccgccgattgggccccgccgattgggccccatggggcagccacttttttttagtttcacatgttttaaaaaaattaaattattcataaatttattaagtatgaaattctatccattcttacaaaggcaataactcgtacaatagcagttcgtacaatacattttttttacaaaattaagcttatagcttgggccaaatctaacaagggaaccgtcagaactgtgtcagaaaatgcatgtatcataactatttgatagtgcagggccggctactctgaatttttaatgttagcggtgtgttgaagccaaatagaaaagttattggacctcaaaaatcaaaattttgactgtgttttccccttcagggaaggtggtgacgtggggaaaattaaaaaaaacggtggatcagtgggttaaattcctatttttcggaggtccaggttcgaacccaacatgaaaaaaatacattttaattaatgtgtaaccaaagttaacgattaaaaaccacgttttatttttaaaaataatttttctttagtgaaagtaaaccaaaagtcgactaaaaaagtgactgccccatggggcccaatcgtaccggggcccaatcggcggggcccaaccggcggggcccaatcggcggg

SEQ ID NO: 917 - DNA, 1500 bp, Heterodera glycines
acgtatttgcatacagatgagaaatgattggattggccagcttagaagaagcagatcaaatgagaagacaggtgagagaaacagagacagagaaaaatatacgtgagagagagaggggagagagaaagagatagtatgagagagagagagtgagaaaggggaggggaggagagagagagagtgagaaagatagagaacgctagaagaagagaaagaatgagacagagagaaatatagagagtgagagaaagatagagagcgagagagagatagtatgataatgactcgagctttagggtactcgaaaagtatcaaacaaaggaggatttagactgggtttccgagactctacacggtaggaaaaatcttttcacgcgtcaaaagccgacccgaaacccgagactctcgaatagcaataaaatttaatttgacttttatcccattcaaattaggcttattaatcgtctattttgcctcctttcttttttctgttcagattcatctgagactgccagaattggttggaggagaaaagcaaagggttaacgaattaatggaaatgttgtcaattcgttcgagtggaaatggtaagcatcaaattaagttttgttcaaataaagcgaactctttttaacgcaaaaacaatttttattttttatttactttatattttcattaaacaaaacttattttattttaatttaaaaaattatgattttcaatatttttttagtaattaaaaagaaatttattattgttgtttaactctcatattaaaattcatttattttgtccatttgttttttattttcccatttttacgcaattttaattttaaattaattaaatattccctttaaattggttataagatatgcttggtttggtccaattcttctacacaaatgtgctgttgtcaagtgtcaattctgtggccaatgaggcgaagtggcagaatgaaattgcgcaaatgaatgccttcgctttgatccatcgaattgacgcgtttcattggcgcaacggacggatcgccaacgattgggcggaagtgcggaaagcggtgggcacacttgtggacgaattgggcacagaacaaacgggcaaattgacatcacaggtgaaggaggaagcaggggacaatttagaggaaaaaattaaagcaaattaattaattgatttaattaattaattggtttaaataaattaattttttatttgccaatttttaccttaaatttttcggtactttaggttttgaaaccccccggaaattttgaaattagaccccataattagttttgatccgtcatgttgactaattgataagattttgattagcatcgttgactttatgccgcctgtttaattttttattttatttttaagtttttacgtaactcactgaaatgcataaaagcccaaaataaacggcatattcgtctctagcgcccaaaattagtctaaattttcttgtggagagcatacatgaaaagggggggg

SEQ ID NO: 918 - DNA, 1237 bp, Heterodera glycines
cccccccccccctttcgcccgcaaagtgccccaagggaccccttcgcatcgagggggggccggtgtaaaagaagtggaggggggggggggggggccgccggcgaaggggaaaagagggaaatgccccccaaaaaaactattttttttcttaaaaaattagcccaaaatctcaaaaaattggatcatttttagacaaaatatgttaacaaattgcactcgaattttcaaaaattttcccggcggcgcctatcgggcccgccggtcccctgttcccaaaaagttttttgacaaaaacgcgtcaattccgcctcaactttgtccaaattttctatgcttattattacgatgacattggcacaattctcgacatttgtcccaactctcggaattgtcgatctcatttttcctcaggtgaatttgtgcctttggactttgcattgggtcagaaatgagttggcacggagaaatgcgttaaatgagcagaaaaaatggtggtcagtgaatgaaatgagcggagaactgatgaaacacattgaagaagagggaaatgtgggagtgagcaaaataaaggcacaaattgttggcattttgttgcatatccatttcgaaaatttggacaaattaattgaacggagagagacatttcggcaaacattgcaaggtaataaggcctaattgatttaatagcccatatccgctggtctgatttattatgctcaaaatttttgggttattttttacgggtgccaacaaattgaactaacgctttatcaaaattctctcacatttttttaatttgccaaagtaccggtataaattcgccaattatacttttgattttgacaatatattttaaagatatgtttatttatttgcaaaaggttataaaaataattattaaaaataaactgattgagtgtcgtaaatatgcaattatttttcaaatttctatgaaattttcgggtcggtcctctgaaattcttaacagttttgggcaggaagaatccttccttaaataatatttatatacctacactttcttttctgacagtaaaatttaaaacaaaagcaaattaactttaaaatttttgcaaaaattaataaaaaaattttacaaatttttgccttccgtccactaaaatgcaattcgtttgagtgcaaaaaactttcactttccacctcaattttcgatttttcatattaattgcccacagaaatgagcggtgttcaactgttg

SEQ ID NO: 919 - DNA, 13126 bp, Heterodera glycines
  misc_feature (1799)..(1799): n is a, c, g, or t
ttaatttgccaagtaccggtataaattcgccaattatacttttgattttgacaatatattttaaagatatgtttatttatttgcaaaaggttataaaaataattattaaaaataaactgattgagtgtcgtaaatatgcaattatttttcaaatttctatgaaattttcgggtcggtcctctgaaattcttaacagttttgggcaggaagaatccttccttaaataatatttatatacctacactttcttttctgacagtaaaattttaaaaccaaaagcaaattaaatataaaatttttgcaaaaattaataaaaatttaaacaaatttttgccttccatccactaaaatgcaattcgtttgagtgtaaaaaactttcacttttcacggtaatttttgatttttcattttaattgcccacagaaatgagcggtgttcaactgttgcgcaatttgagtgcctttttggagggtgacttggcaaaaattgtcaaattaattaggaaatgccgacaaaaggaaggcgtcactaattggtttattgctgtccacaaaccgggctttgttcagcagtgccccagcgaattgttcacagcagacgatgattcatatccttacaaaggtcgaattaattagtcacaagcaattaatccaattgatttattaataaagccaaatgcaatggcattggcacggacttgcccctttttggtatgaaaatgcttttccaaattgattggttcgtcattcgcgaagaaatttccgcttttcgttcatgtttaaaaaactcagcctatgccttaaggattttaaggtgttttggtctgctaaattaaaaatattctaattaaaaataatgtttttttctctcatttgcattggattttctgatatttatttattttctattttttttgaaatccagccaattattgtaaattttttcctgaatttccgcatttttcagactccgatgctgaacaccttgcccttgcctatgaacaattgctgtccaataaaagctatcgcttctcaaaccaagctgaattcgccgaccgtataaacagtatgccaattgctgttgctgctccgttgtggcttttctccgcttttgtcgacgatttgctggtctatttggaggcaaattttaagatggacgaatactacgatatgccgatggccaaggatacggtaatgaacgaactgtggacggcatggggaagactgcagttgctacaagcgacggcacaaggcggcgaacgcgagagagagaaagtgaaactgtgccaagtttattgcttcctaggtactactgtcgcacactgtggggttactgtatgaaaaatgagcctaaggcattccagaaaaataaaattttagagagaagaaatttaaaataaaatttcgaaactttatttattggcgagaaatttttttggatgatttgctcgtttcgtttccgattaaaatggacatcttcagcaaaaaaatgctataacttttcgctagagctcgacctggacctgcatccgaggtctgagtttttcctggatccgagttccagtcgagtttttggcgacctggtttttatgaacctggattttccacgattttggccttcaggcctaggcttttttcgctagtagtttttttgaaaaattgccgaataatcgagaccatttgcggagacgttggatgataccaaaatgtttttaaaaaaatttttaacggactttaggggtcaccgatcacgaatctaacatacatttcgacaaacttacgaactgcggacctgcattngaaaaaagttcgaacaaaaagttgaagataaaaaaatgcgaaatttgaaggtttgacttaacgcacgagtttggttccggggttcgaaattggccgaaatggatgttatattcgtaatcagtgaccccaaaaaacttttttatcatttaatatagataatttaagtacatttaaattaaaaatatatatgaaattggcttgtaaactaaaaaagtgtctttttttgtcagcaaatgcatttttttggtttagccaattaggctcataacttgaggattaccgccgatgttttaacagtagtcatttaccgtaacagtcgcaccacttacagtacaccaacaacaccgttcgtcctttttcagattgggcaattcgcaaaagttggccacacattggagacacggcttcttttgcaatcattttagacaacattcattggaaagattttgaagcaacaacactggtaggctttttctcgagcttctgcggaaatccgccagtcccgaaatcccaatcccttcccattttctggtcttttttgcccggggcactatttttactttttacgggaacggaggccaatcataattacgaaggacaaatcggacgaccaatcacacatttggcatttgtctccaaatttatcgttacgacaaaaattaggtcgtttgtctctgtcgtcaaattgtccgtaaatttgtcgtcatttttctttaaaatgaaccaaacatttaagataaggcaaaaaattaaaaattctgattggtgctatgtcattattttaaaaccatcattatgtgcgttatttaaaaaaccatcaaaataaaaattttgcttataacttttctttaaaataaccaaatttttaattcttgatatcattcgatagaactaagtgttctttaagagcctgcaaaatttcaaaaaaatttataactttaaaaaaaagttatgaccaaaaatgttcgaaaaccaaggttttttgagttcctcgagctataacttttttgaaacttaacgaaattttttgaaattttgcagactgatagagaacacttagggctatcgaatatttcaagaattaaacatttatttaccttagagcaaaattataaataattattcgacaaaaattttcataatgatggttttttaaataacgactccgccccttctgattgaccccccagggaaaaggcgggaaaggaagaaatttcttctttgaaaaagggttccattatttcctgctgaaaaacatacctccgatttagcgatttaggagcataatatttagtggattttttgcgcaattttttattgccaattaattaaataataaatatttgtttagcttaaaaatttgaatctcaattcccaaaacggtgcggcgcctctgaaagggccgatttgtacagaaagtgtggctgatcggctgttcgctgagctgaccaacgcgcaaaactttggttttttgcacactcatgccattttcacactgatcaaacgacggaccaatggcattttggcatttctctgctcaaaaaagaagctgaacgaaatcatggaggtcaaagagcgcattcaaatgctgacaagaagcgtagacaaattggattggttggaaatggcatttccggacattctgcacataggcaagcggaaggaagcggggtccaccgatgcctttgtggcggaaatttcattgggccgaaatgtcattgacataacccatattgggatgatcaatgacagcagaacccatttattgtccacaatcgacattaatgcctttttttggcagggttggcattggcattactttatgacctaattgttggcacaatttgcgagcactgaataggcattggcacccactacaaaatttttcgtttctctcgcctttgtgccattcactgtcatgccaaaaaaaaaagcttaaatccatcagatattttcactccccgacttcgcgtcgctttgtatcagtgccttttgtcctcccgcagcggctcaacgcccgcgcaacgtgccgaggcgcgcattgtggtgccgttgttgtacggcgagctgagcaaccggtacgcgctgtattatgaagaccgaacgaaatggccaattgtgggcaatgccgaggaaaaattgttcattgtgtgggaccaattttggcaacgcattcactccgaaatagacaccatgacgggcatgtgcctaaccatgtttatgatgacggtaataaagaagcaggcggaacgaacccggccaaaaggccagcggagcaaaaagaaaaatggggggggacgattgttgaataattagcactaattatatattaatcttaaattccaaaattttttggcgttggatctcccctaaaattctgtagcattaagtattgggtacaaaagtgtcaaaattgtataagataattctgattcgtccattaagttttttggaaacgttcaaaagcttagaagaaaattattataaattagagaatcgaattttccgaatttgccgggccgggtttacattttcaggtttccgggtccgggtctcgcaaaaaaccggtcaattacgatcaaaaagctaaaattgtatgcccgatccaactcaatctgatcaatcaggttaacccaagagaagacacgaccaaaattaagcggaattctgttgtcatagactgacgggatatttattcgaaaacttttcgttgttttttcctaatttttcatcaaattccctcaaattgcaccaaattgacttttctaatcagatgatgcccccaccccctgctggaaattccatctgatcatgccattccattggccattcattcattccttggccaatcacttctcggcttattcccccacccctttcacagatgaccgacgattggtgcgccggagaagcggtgacgattgcctttccgtccgatcagcagctccaaaattgtgtccttcggagggcacggctgagcttcttccagcgccaatggcaacgcatggagcaaaatcatttcgactttttgcgcagttttattcttttggttttccccgagggcgaattgccggcgggcgcaaagcgaaggctgacaaatttagtgggcccaaaattattcgacactttgtgggcccattccgcaaatctgctcagggacaaacaaagtcagtaatttaaagaccaaaaaatataaataaatttaaaaaatcaaatttaaattaaatctttgcctttttacttttaaattatcaccaaactttcaaaataatgagataaaaactccaatatttatttttcagttcattttaaaattgggaagaaaaaccacaaatttaaactgctaattgtttagtcgaatacatttcgaattaaaaaattattttccaaaaattcacacgcagaagaataattaataagtgaaaattttatgtgtgaaataaggttcggctttaacatttgtaagaaataacggaagaattaattttattaaaataaatatttttaatttttgatatttttacattttgtcagtgtttgacaatgacatcagtctgatgagtcattatttggtcgttctgtgcccatcgccgggtgctcacactttcgccgatcaattggcccacaaaatggccgctgatatcactgtgttcgtccggctgatcgaagcggtgccccggggggcaaaatttgacaaaatttggaaagaaaaaaaggaaaaccaaatcatcgatttgtacgacagctttttcgagatggactatagcaacgaatatcgaacacaaatgcattttacgtggaaattgtttgacgctgtccgatcagagctggccgatcttggttttttgatcaacgagaaaaagctgagacagaaatgggacggcatggaaaagcgggcacagcgcgacgccgcggaccaaacagcgagcgacgatggcacagtgccaaccgcgccaattttggtggccaaattacatgcgcaaacgctgcaaaagttggcatttgaaaatgccgaaacggcgaaacggaagacggcagaaatggccaaacatttcagggaaaagctgaagacaggtgaactcataaaaggggggaagcaaacattcggaatttttgcatgtgctaatattggcacaatgacatcaattagtgccaaatcccgctgattatggcatgggcattttggtgccaaagacctctgacgttatgacaactcatacaaaaggcattgtattttattgtacgagttgccttttgtatgagttgcaaagaatttgccaaatgccgacgagaatttcggtgtgtcgaacaatttggccaaaaatgtccatgtttatttttatcgctaatcatggcatgctgttttggcgttagtgtcatttccttgggactctttttggcaaattattttcttttctccattttaaatctttatagaattgagcgaatcaactggcgcaaggcaccaacttttgctttttttggaactcagtgacatcaaagtgctgcttgaacagcttggcatagaattcactgagaaggaatttgaggacgacccaatggaagaagaaggacaaaagagtaccagtgatcagcagcagacagagaaacgaaagaagaaaaagaagaacaggaagaaaggaggcatgaaaaagaaggcagacaaagcgggagagactgtgcagaatggagagagtgcagagaaaccttgtgatcagagtgggagagagaacgtgcaaattgaagagaaggccgcagaaaaattggagaatggaagagagagcgtgcaaaacgaagaaaaccgaaaaaattcgccagcagagaatggcgaaaagagagtgaaaaacgaagagagtgcagagaaaacagagcaaataatctgtgacctgcagagaaaaacaattgagagagcagacagtcatccgccgataataagacaagacagagaatgaaactctgttgatcagaagaaattaattgaaaatgaaaagagagaaaattctgatcagaaaaaagaaaaagggactgaaatgggacagaacggaacttgggaagagactgatcaaagccgggaaattgatgctcaaattggcaacaatttgctgtcattttcaaatggggaggattcgaaagaggaaaaaacacctgcgaaatttttcaaagtttcgggtgaatgcccaaatcggtgtcaattttattagttttatttattttttaaatttttgatagatttaaaaaaacataattttttggccggcaaatatttggaattgatggccgagccgagcaaattcgagagttttacagcagccgaaaacccggaaaggattttattggatttgagtgtttttgcgaatgaaatatcgcgcagatttgaaacactgcaacaattgggacaaaatgcaaaaaaaattgccaatatgaatatgaaagtgccaaaacagttgataaaatattggaaaaaattggaagagaatgcccaaatagaaaatgaaataataaaaatgcgaaagtttagggcggaattctgcacaatgttaaaggaaattctgctgatcggaatcgcattgaaaaatgatcagacaaataagatgaaaagtgatcgaaaagtaaataatatggtaattacaaatgatggcaaaatgccaattaatcggatttatcatgaaaatttaattgataatcagcaaaatcatacagtaactgatctaagtgaccggaaagaaaatgggaaaagtgatgaaaaaatgcataaacaaagtgatcagaagttacggaaaagtcatcggaaaaagaaaacaccactgcctctaattacgttaaattatcaacagcagaatacagttgatgagcaacgaaatgatacagtaaccgatgcaaatgatcagaaaacgactgtgccagcaactgaccaaaaaatgaatgggcaaagtgatcaaatcgaaagcgagccgcaactgatcgcaattcgtgatcaattgcacaggaacaactttgcccgactgatcagtggggatgacgaaacggcacgcgcagcgtggcacaatttgacggaggaggcgcaatttggcgtcattacggtactgttgggacgaagaggtggcagagacggtggcaaaaagtacagtaacactcgggcacagttcctcaaatatttggccaaatggaagaagttgcgcgaccagactgagttgggtcagtgttcggttattttctttaattaattaaataaataaataaaaataaataattttttaaataaatttacaatttttgtggccttttttaatatttgttggcacattgtaaataaaataattattaaattaattaattttagatgaacgtttatttgatgaatataacaaacaaaattcagaacaaattttggacagaaattacgtacaaaatatgcagcaaatcaaatataacactcaaacggacatttacacaaatttggtgacgaaaaaaaatcttaataattaatgattaaattaatttttgttattttattagctcatcaagattctgcgggcaaatggctttgatggcattgaaatgcataagcaaaaacaaattgaagaagaattggaaaaaatcagagacactgtcgccaaatgggtgagatttccaaaacccattccttcgtggcttaattcggttttaaaatgccagaaatttccaccaactactcgcccttcccccattaaaatgcgaattaaattttaatttaaaatagtaagagtgaaatgtttttgtagtcaaatggcaccggtgcccttctgttgggcggctcctctctgatgggcgttcaaacggcggactcggacattgacaccgtttgcattgtgccggcgcacattcatttggacgccttttttggcactttgcactgtttgagcagcggcgaagaaaaggaagggcaaaagtgtgaagatgactcattgttttacatgcttggtcaggtaatatatttccggcaattgatcattttgcttttgttgggtgaggggattttcgtttgttttgctaattttcgctcgcctaaagacaagcttcaccttcactgtattgcaaaatctcgacttacatctgttgccaaatcgtgcctgaatcaaaaggccgtaaaatacgagttcagttcattttccgcttccctccgtcgtttcccccaccatttccgccccctccccacgaaaaatttttaaaaaatttaaaaaagatttacaaaaaaattcacagggaatttttcataagaaaattcaaaaaaaaaattttttttaatgcataacgatttttcagagaactactaagatttttcaaaaatttttttccaaaaaatagaaatttaaaaaatttcttgaaattttcttatgaaaaatttccctcagtttttttgaaaaataatagtttaataatcccgagtggttcttctcgcttaaaagcatgcttcattctgcttcatcctccccgttcttcagcttgccgactttggctctgtccgtgccattgccaacacttcggtccctttgatccgtctcatttcccgctccggccaccaatttgacatcgttttcgcttcagttgcgcagatggaaagcatttcgatggcacaactgctgaacggaaatgccgagacatttggccaattagcgcaaaaaatggccacagaattgatggaagagggcgatggcattttggagagggaggaggaggaaacggtgaaaattgcaagaatggcacggtcattgtccggtgattagggggggggggcaaaaataatttaaaaaataaatttgtaaaatattttaattaatgagtcaggtaaaaaataaatgatagataaacaattagttttttaaatgaaataaattctaatttttatacaaaaacaacattcattaatatgtcatttaattaaaaaaatttatacctaatgcataatatttattttaattaattattttatttattgcatttatttattaaattttatttcatattcaattaaattttctcggaaataattaaattttcccagaaaataatttaaaaacacttttaggctaccacgccgatttaaccattctcaaaatggtgccaaacattgacatctttcgactgtttgtgcgtacactgaaactgtggagcaaaagtggaaaataaaaaaataaaaattcggaaaatatatattttagacaattttatttacaacaatgtgctgggctttctgcacggactgtcactgtatgtgatggcggcgaaaatttgcatactgtacccaagcggaacggtaccctttttggtgcaacagttcttcctcacctattcactgtggtgaacacattatcggacaaaaatgaactaaattgccgaaaaaggggacgaaagaaaaataaaacgattttaattccgtctctggtcataagggctcccggacaatccgtcagctaattttatattgtgaaaatgaattgaaaaaaatttaaataatatttttttatattataaagtaatgaaaaagcattttaaaaaatttaaacgatactttcttaagaaaataaattaaattgaattattaaacaaagaaatgccgttaataaatctaataatcgcattcgcaagattttatttttaattattgctcaacaaataaaatttgctgacgaattttgcactgacggagattccgtagagacattttctaagacgaatatcaccttttttgactcaaaattttcctcagcatttttttcggctttcaaattaaaaaaaattattagaattcatttcataattccttaaaatgccatttggccattggctccctcagggaatggcctttccccgactaattggccgcagttcggccccatttgtgggcctggagtgccgacaaagagcagtcagtgctcttccgttggttcggcgtcggccttttctcttcgctttccatgccaattatttcgcccggttttccccaacaaaatgccggctttaacatcaattttcacacagcaaaaatcatacagaaagcgatgcgcgaaggtcattcattcattcattcattcattcattcaaccatcatgaaatgcttttaaattaaattgcattttcagcattggcacaattggggggaaatccgtcggtacataaatgagaaaagctgcttcagaagagggcattcagcgacatggtagtctccacatttaaactaaagttcgatttccggcatttttagaatgaattctaattgcattttttgcatatttaattttttatttttctaatttttagaaatcgctctatctctatttcatcttttaagaattcaattaaccagcattgaattttgttcttttaaattactagagagagatcggctcttccccggaaccccaattaaatacattcattcattacggtatttgtttttactttcgtttacagtacccgcacagtttcgccattgaatgtgccgcctcgagcagagagctcagcgacgaattttgcggctttgttagcacccgaattcgcgtccaattgctgaggagcagcgaatgcgtaaggggcgaagtgaacttttgccacgcccgttcactggtcgaatgtcccgggcacattctcgacaaatacaaagcgatgtgaggccaattattattttttaaatttaattatttgttttattattaaatggacatttttcgcatgctaaaaaatagattaggtgaaaaacccatcaaaaaagcaccagaataagcacaaaaaatgaaaagtcaacaaatttagcgattttagagaaatttatagcatgcaccaaactgtaaatgccgaattcatatttgtcatttcatttttatcaacaaatttcactagcgcggagatgaaggagtggcacaaccaaaaatatttgcatattacattttttgccaatttcagctctcccaatgcgtcctgcttggtttggctggtgggcgtcgacttcaaacagtaccccttcccctccgtccaatctgccggcgtccgtttggccaccgaattggacgccgccgccgcagcgacaccgccgcccattgatcagcagaatttgtgggaagaaattgtgacaccgatcatggccagcttcaaaaaagtagttctaggagaacagcaccagcagcagaagaagaagaagaagcagcctctgttgagtgcggaagcgaaaaaaatccaaaaatttttcgcaaaatttaataattttaaatggaaaatggcggaagagatggccaatagtgccgaagactttgtccacttggaagcaaattatgtgcacagagaacaactccgaaaggatgggggggggggtgaggggaatgaatagaataatgtaaaaatgaattaccgtatgcataagcactgtgccttttgttaatgatgcacttacaatgtataatttttgaaatttaattatgtaaaaaaaagcgagaatggaaattaattgtctttttttgtttttgttcacgatgaaaaataaaaatgaactacaaaaagttgagtgttattttaagaaatcagaacgaaaaagccattttgactactagatagtcaggttctgagttgggaaatttatctgtttttagggaaatggttccggctcgtgggatcaatgttttcagctaactgataaaatataaaaaataaccattttttattttattcatttttgctcataattgataattagggttgtaaattatatggactaaaaaacgcgaaatatggatcaattatgcgcaataaaactgaattttagtgaaaaatgaatttttgtattttggttcaaatccgggtccggggttcgaatttggtcgaaatagatatcagaatcgtttttccgaccctgaaaacccctaacagttcattatttcaaaaaatttgaattatttgaagtctgagtacagatagttaagaagtaccaaaagttcgtagtcaaaatgtgccctgtttaattctattgtttggtgctaaatgtttcatataaaataaacttgctttttttcgctttccccgcttcatcatttcacaactcaagcacatcgaatggtggccacgcaaacatgtgatttcgtgccccttattatggaggcacatcaattttttgaggtaaaagaggagacaaaaaactatttgttaacattgatagggatatacatatactatctggataaaactaataaattgaatttgtaacaacaacaatgataaccttcttggctctttaaaattaaataattgcatggcttattaaataatagaaatagaagaaaaatgaatattcttcaaataac

SEQ ID NO: 920 - DNA, 1435 bp, Heterodera glycines
gggattcccgttcgcctctcacgtcccggaaaatcctgaactcccgatcccgctcccgctcccggaaatttttacccaaaaacgggagtaaaaatgcactggtaagaattgagtttctttggtaaaaataatgatttttcattgaaaatctgttaaatatatagtcaaaattcgaatttggtcgaaatagatatcagaattgtttttctgaccctgaaaacccctaacagttcattatttcaaaaaatttgaaattttttgaagtctgagtacagatagttaagaagtaccaaaagttcgtagtcaaaatgtgccctgtttaattctattgtttggtgccaaatgtttcatataaaataaacttgctttttttcgctttccccgcttcatcatttcacaactcaagcacatcgaatggtggctacgcaaacatgtgatttcgtgccccttattatggaggcacatcaattttttgaggtacaagaggagacaaaaaactatttgttaacattgatagggatatacacatactatcgggataaaaactaataaattggatttgtaataccaatgataaccttcttattgttagctcttgaaaaaagaataattgcacggcctattaaataaaaagaaatagaagaaaaatgggtattcttcaaataacatttatgcgacaaaagaaaatacaactaattcgtcaacttcactatttcgtccataaaattattggcccaaatttttcattcatgcgcaccaatgaataatcctcgggcatattgaaaaatgcctgttcaaccatttcaagtggcactatttttcccatcatcactactcgaagacaactcatgttggtggttgattctccaaaactaaataacccaattatcaaaataaatgtctttttgctcgagtccgggtccggaattggttgaaataaatatcggatcctaccctgaaaacccctaaaacaaattcattgttaaaaaaagtgaaatctgattgtgagtaccgataattaaaaagtaccaaaagtttagtcaaaaattgttctctcttgattttctattttttcctttccttgcatgtttggtgccaaatatttcttataaaataaatttgcttttttcgctttccccaattcgtcattgcataactagtttggaaaatcgtccggcaagcacaacgaatgctggccacgcaaacattcttattgccaaattcgttatgcaccattgaaataacggtgccaccctcgccgctgcaggcgcaatcccaaactcccttcatgcttgccccttccactaaagatcaaggggatagacccgtctagatatgtataacctaatgggctgaatctttattgcattaatttgatcttttttcgaatcttatttttgaactcaaattaaatcagaggtttctcgttgccata

SEQ ID NO: 921 - DNA, 7178 bp, Heterodera glycines
ctccacgcagagtacgaaaagttggaactccacctttccaccacagtgaacacatctaggaaaggaagaatgtcgacacctttagaaaagtggatgagttcatccagggtggcagtgttgtcatacacccggtccctgccactgcggttgaggacagactgttctgtttccgctgcaacgtcccatcaataattgctgatgaagactccccgaggggaaggataatggcagtcctactgggccgtccagccatggagggcattcgtatggagaaggaaagcgttgatgactcaacggattcgtggatggaagaagagggaccgctccaccctgcaattcttgctctcaactcgcggcagagagtgactgcacgcctaatgttgggaggaggtctggtgcaacaacaggcgccgccaggcaccggcaaaaccaaagtcgctgcggcgatcattaaggcaatgatggactcaaatcccgggttccggattgtggtgatggcttgtgccaacattccagttgcaaagctggtacaagaggcggaaggcacatgtgctgaaaaggatttggatggagcacgagcaattgccttattttccggttttgccagatgcaaatacacggatcaaataaaagatgttcaacggcatacgctgccgaacaaagtaaactctgaggagttcgtcaagcagttatcgcccaatgtacagaagcaagtgaaggagtaccttgctcattgtgagaagaacccgcgcttggcgcctgagagagcgattggaaaagtattcaactcatgtatggcaccgaaaatagtcttctcaacagctgccatggctgcgaatttacttcatggtgaaggaaacatcactgatgcagacgttttgctcttgatgaaagcactcaagctcagtgggcagtggtggttcacttggttgcgcggatgcccaagctcaaggcattgcttttgacgggcgatcgtcatcagctcggagtgcatctgcaagaactgcctgacatcttccactcaggatatggattggaaagcgtcatcctacaagccgaggcttcggttgggacgaactacactttcctcacaaagatgtacagaagccatccatttttggcaaagctcatcagctatgcctcatatgagttgcacaatgaacaactcattccagcaagaagtgctgaagaacgctcactcattacgggctcaggctttcttatgccagttcaagaatgtcctgtgggacttatcaatgctttttcatcattccgtgtggacccaaaaagcgactcgctcacagatgaccatcaaacagaagtggcatcgttcttggtacaagcacttttggaacattttggcaacgctttttcgtccagaattattgttctgtgtatgtacacgtaccaaacttcggaaattgaacgaaagctgaagcactgcggtgttcgtgcactcacagttgatgcctatcaggcacaggagtgcgacattcccaaagttatttttgatcagtcccaccctgaagggcacacaaatggcacatttcggtcaatcagtaccatccatttttctgatcaaatggtgcccattctcttttgatcagtgccatttccccatggcacctattatctgttgatcagtgccattccccaattttttttttgatcattaggcacacattatcttttgatcagtgccattccccaatttttctttgatcattaggcacacattctcctttgatcagtgccattctccttttaatcaattggcacacatttttttctgatcaatgcctttccccttttgatcaattggcacatattatcttttgatcatgccattcccccatttctttttgatcatttggcacacactctcttttgatcagtgccattccctcatttctttttgatcatttggcacacattctcttttgatcagtgccattccctcatttcttattgatcatttggcacacattctcttttgatcatgccattccctcatttcttattgatcatttggcacacattctcttttgatcatgccattcccccatttctttttgatcattaggcacacattctcttttgatcagtgccattccctcatttctttttgatcatttggcacacattctcttttgatcagtgccattcccccatttcttttgatcagttggcacacattatcttttgatcactgccaccctaattttcgtttgattaaatttgtccatttattttatcagcctccttttcggccatttactttgatcagtcccaccctgaggggttcatttattgcttcacatttacatgttatatttgaatgtggccactttatactttatgttgatttattaatgttaatatatttactgaatttcatatcttgattttatttcacaaattaaaaaaaaatagcaataataatcttaaataataattaaatgcacataaataaaattaaattaaaattaaatattgatactcaattaaatttaactcacgcattcgtcacatctttatacaaattaattcgaatcgcatattcgaatatgtaggggtcccattcagtatgaatccatgcatttttcatagatggctcaaatatgcccttcttacccgtgccaattatcatgcatgagtcttcgctcatgcttgcctcatctatttattcattcatgccatgtgctttcataggatcatgcattcataaactattcatctattatctaaattagcgtatctcatttagatgcgaaccaaaaatctgccttctaagcattcaaatcacgaagtttctgaccaaatagacgacaacgcattaacgagtgatgctaggtcatcaagtgttgagagccctgcggggaccatttatgaatcattcgaggcgttgagcattgatagctcaaaagtagcttcaagccccgaggggtacactaatgttggggctgaaatcgttattgaagggactgaatccaatgaaaaccctgaggggtccggatatgatgaagtgagaaacgagggtagtagcgttacgtttaaagcgatggaagtgacccttgaccaggtcgatgcagagggttttgcgaataatggctttgatgatgaggaacctgaagcatgtcctccggctaaagatgtgagcaaatcatcgcttctttatttggtttcgcaagccggagatggctacgtaattgcttgcaagaagtcgcctaagtcgaagccaaattggccattcttcatgaacatcgaagacaagctgattgagtcggccccaggctttcagcgtaaacttgaagttggtgactttgtggcggtttcatcatttgagtggaaccagaagctgcgatatttggctcaacatcgccaagatgccacacagtcctgcaaattttggttcaacgaaaacacgcaactgttgccaaagcaggctgatgacactggcgtggttcaactcatgtacatgaacatcggacgcaagcagatcaccggggtcgtttactggataaagaggaagatccaaagcgttccatccagcttcgttcacgcaaacatcgcgtgctgtggtctagcggtttcggcacgcataaatcggcgtcatcttgatggcatcaatccggaagacctcaagctgggctcgcttgtgacggtggttgttgccaacattccacaggactcacttgtatcaatgggatacattctgcctgatgcttcaccgtacaaattgggaacggaaagaagagccgaaacaccagaattcttcggtgcaattgcgtctgttcgtcctcatctattggagtggccaaatctgaatgcaaacatgacgcccaaggtttatccatgctccgcggagcttactaaacatcatgttgtggcgatggagcatgttgttggagcagctctccagattgagatggagcgagaggttgacatgatgattgaagcatgctttgaaggaagggctcggaagttcgatggtgctgattgtctgattgtctttggttcgagatcgaagaaagaagtgaatgagttggccaaggtctgggagccggagtcccaagtgaaggtcttcaaagaattggatgagaagcattttgctctgggagtggtcaaggatgttgaggtgctccacgcagagtacgaaaagttggaactccacatcgtcatcttcttgaacaacatccaggaaaggaagaatgtcgacatcgcaagaaaagtggatgagttcatccagggtggcagtgttgtaatacacccggtccctgccactgcggttgaggacagactgttctgtttccgctgcaacgtcccatcaataattgctgatgaagactccccgaggggaaggataatggcagttctgctcggccgtccagccatggaaggcattcgaatggagaagcaaagcgttgacgactcaacggattcgtggatggaagaagaaggaccgctccaccctgcaattcttgctctcaactcgcggcagagagtgactgcacgcctaatgttgggaggaggtctggtgcaacaacaggcgccgccaggcaccggcaaaaccaaagtcgctgcggcgatcattaaggcaatgatggactccaatcccgggttccggattgtggtgatggcttgtgccaacattccagtcgcaaagctggtacaagaagcggaaggaacgtgtgctggaaatgatttggatggagcacgagcaattgccttattttccggttttgccagatgcaaatacacggatcaaataaaagatgttcaacggcatacgctgccgaacaaagtaaactctgaggagttcgtcaagcagttatcgcccaatgtacagaagcaagtgaaggagtaccttgctcattgtgagaagaacccgcgcttggcgcctgagagagcgattggaaaagtattcaactcatgtatggcaccgaaaatagtcttctcaacagctgccatggctgcgaatttacttcatggtgaaggaaacatcactgatgctgacgttttgctctttgatgaaagcactcaagctcagtgggcagtggtggttcacttggttgcgcggatgcccaagctcaaggcattgcttttgacgggcgatcgtcatcagctcggagtgcatcttcaagaactacctgacatcttccactcaggatatggattggaaagcgtcatccttcaagcagaggcttcgatagggacgaactatacattcctcacaaagatgtacagaagccatccatttttggcaaagctcatcagctatgcctcatatgaattgcacaatgagcaactcattccagcaagaagcgctgaagaacgctcactcatcacgggctcagattttcttctgccggttcaagaatgtcctgtgggactaattaatgctttctcatcatttcgtgtggacccaaaaagcgattcgctcacagatgaccatcaaacagaagtggcatcgttcttggtacaagcacttttggaacattttggcaacgctttttcgtccagaattattgttctgtgtatgtacacgtaccaaacttcggaaattgaacgaaagctgaagcactgcggtgttcgtgcactcacagttgatgcctatcaggcacaggagtgcgacattcccaaagttatttttgatcagtcccaccctgaagggcacacaaatggcacatttcggtcaatcagtaccatccatttttctgatcaaatggtgcccattctcttttgatcagtgccatttccccatggcacctattatctgttgatcagtgccattccctcatttcttattgatcatttggcacacattctcttttgatcatgccattccctcatttcttattgatcatttggcacacattctcttttgatcatgccattcccccatttctttttgatcattaggcacacattctcttttgatcagtgccattccctcatttctttttgatcatttggcacacattctcttttgatcagtgccattcccccatttcttttgatcagttggcacacattatcttttgatcactgccaccctaattttcgtttgattaaatttgtccatttattttatcagcctccttttcggccatttactttgatcagtcccaccctgaggggttcatttattgcttcacatttacatgttatatttgaatgtggccactttatactttatgttgatttattaatgttaatatatttactgaatttcatatcttgattttatttcacaaattaaaaaaaaatagcaataataatcttaaataataattaaatgcacataaataaaataaaattaaaattaaatattgatactcaattaaatttaactcacgcattcgtcacatctttatacaaattaattcgaatcgcatattcgaatatgtaggggtcccattcagtatgaatccatgcatttttcatagatggctcaaatatgcccttcttacccgtgccaattatcatgcatgagtcttcgctcatgcttgcctcatctatgtattcattcatgccatgtgctttcataggatcatgcattcataaactattcatctattatctaaattagcgtatctcatttagatgcgaaccaaaaatctgccttctaagcattcaaatcacgaagtttctgaccaaatagacgacaacgcattaacgagtgatgctaggtcatcaagtgttgagagccctgcggggaccatttatgaatcattcgaggcgttgagcattgatagctcaaaagtagcttcaagccccgaggggtatactaatgttggggctgaaatcgttattgaagggactgaatccaatgaaaaccctgaggggtcctgatatgatgaagtgagaaacgagggtagtagcgttacgtttaaagctatggaagtgacccttgaccaggtcgatgcagagggttttgcgaataatggctttgatgatgaggaacctgaagcatgtcctccggctaaagatgtgagcaaatcatcgcttctttatttggtttcgcaagccggagatggctacgtaattgcttgcaagaagtcgcctaagtcgaagccaaattggccattcttcatgaacatcgaagactaaatgattgagtccgacccaggctttcagcccacccttgaagctggtgactttgtgccggtttcatc

SEQ ID NO: 922 - DNA, 1814 bp, Heterodera glycines
ttttcacaaatattttccaattaattttcaaatttcctcctccacccctcggggcccaattggctgacttcgacagttgccaaaaacatcatcagccgactcatccgtcccaaggaattctctccgccgcccctttcgcttctccgcagcaattcgctcaaacagttcaaatatctgtcccgtgccctttccaccgtttctctgccattttcactgagacggggcactgaaaataaattcaaaaacatttaaaatgcaagttgctaattaacatttaatgacctggcgaaaacaggcacagagcgcggagaatgacatattcggactcagtgagacggagcttccgaaacgggagcactaattcagtgaatgccatcgtggcactgtccagaaacatccgtttaagtctgaaggagtggcaaggcatacgcgaggatgaccagacactaatctctcaatgagtgatcagaaaacggatcatttacactacattgatcagcagagtgaccatttccgcgagattattagcagatcactcccgcggcactaatgagcaaactcatgaccttcgtataactgatcagccgacttccgggaggatctgatcagcagacggattacttccgcgacactggtcagcggactgttgcgattactttggtccactcactccgggtccagcctttcgcgttgttccggactgtaggggaacattcgctcgcaacagcccgcaatcccagcaatgttaagcagcgcggaacggaaagagcacagcagccaaacgcaacgcattgcccgctttacggtcagtgtttgctaaatgtcaatgaaaggatcagaagatcaatctcattcggcggtaaaatgtcgtcccgatgttcttccccagcttctgttccactgtagggttcgtttcgtttacttttgcccccccatttcgccccgaaaactccagggttttttgatttattatggccataaaggagtgcaccctccgccccctccaactcctccaactttcccaccttgtcctcctccgtcagttcgttcatttccggcacgtaactgacccaatcgaagtaatggaccatcacccgacagtacgaccgtgccaatgtttcattgccgatcagatgcttcccactccagtcgaccttccacagaatgtccgtctcattttccccctctctctcaccggcgttctcactgacactttgcccggctgtttcagtgccacttccaccggcacttccaaactgtacagtgcggagatgccgcgagggtcggcacacgaagggggcttaggcaattcgacgtacaaatcgcaaagtctgaggcaaagaaaaagcggaagattatagaacccagcaaaaggactgaacttttcaacggccaaaaagtaatttgaaagtgccacgcaatcattgccgacggggccaaagccgcccctattggaaaagcccaacgcaacggaggacaaatcacgcacattgaccagctgatggtgctgcacaagcgtagtttcggcacttgggccaccaaatgcgggtggaagggacaaaagttcgcaattggcatggaatttggccatctttggaagggcatcagaccttcaagggggggggggtgaattaaaggtagggtgaatacgacaaactttgacgattggccaagagaaaaggatacggtggtggttccgttttgaccccaatcgccgtgaaccactgaatacggtatactcaagggatacggtaggagacggaaaatgattggtacagtttgggtccattccaatgcgcaaacacttccgaaag

SEQ ID NO: 923 - DNA, 6717 bp, Heterodera glycines
  misc_feature (22)..(22): n is a, c, g, or t
cagcaaaaggtccgggcagtgnaagctgttccatttgccaataatgaaacttgcttttccagattatcacagagattttaatggcatcttcgcaatgtttggcctaaaaagccatggaaacggcggaatgaaaggccaaagggccgactgagtgaatttgctatttgccatcactccccatttagacaaattgccaattatttgcaatttcctcccttctcatttagtgcattaataggcatttcagtcccccccccgcccttcaaaaaagatttggtcgagcccatggcttcgtttgtatgctgggccggcagagggggatttgtaacgggtttttttaaatctttttaaaatttacttaaatttccagtgttcttgacgcaaaatttaatggcaaaaaatgtctccaaattttgggaggtttaaagtaagtcttggggtgccatcgaacatacgatttcatttaacaaatttcacaactttctttttaatgacgaacaaagaaaaacaaaaaattttgaaatggaaaacgaaaataaaatcaaaggaaaggtttgagccgtgtgaacacttccaccatcaaattcctctcacgaaaacgcgcatcttttggcaacaagttgaaaagcactttcagttgcagaacctgtgaacaaatccccaattattccaaaccaagggcttacaattcgacaggggaatgactgacaatggaggggccactccccgctaaaaatccaaggcaggaggggggggggggggcacgggttcgtccccaaatccaattctcccgacctcgtggtcttcaaatgatcgtccctttgccaattgccacctgttccatgaagctcagctggtgccgttcgacctcctcaaattggtccctcgagttgacttcgtccattagcaccacactgtccacgcattggtttttgctgttgtacaacgagaaaaacacagtgttccctttgtggtcgtaaaagggctgaagaagacgctcagcgcactgaaaaaagcgatgggagaatgaaaagaatatggaagaaaaagccatcactaattgacgttaattaattagccaaaagggcaaaatccggcgacgctttttacacactcattcaattcccttgcccttattcactcacatggtcccacggtcggtggtcgttgtccgacagaaaatagcgcaaatcgtgcggcattcccatcaaataatggggcaccgtggtgacgaaacatccgtgcatttgcccactccgccggtcaaaccttaaaccgaaaattgggcaattaattagtccaatcaaattccaatttttcaaatggatgatgattcaatgaccaaccattctttgctgtttgtgtgtttgaaaaagtcggccatcctaaaaagcgtcacttttgaatgccatcaatcaaaaactgtgccaaaaattcacccgttctcttcgatcgttttcaaattccttttgtcttcgtccgtcgcttggaaaatttcgtcgcccattggactgaaatgttgggaaaagcacagaacggtgcggtggccacgcgaaatccaatagaaaaggcaacgaacgattggcatgagggggaaactgacaatgagaagggagtgaaggcacggcacaaaacaacaaagggaaatgccgtggcaattactgcaactcgtagggatggcttcggtcgggcaattcgttgttctccgtgcagcaggcgcggtacgctttgatcagtccgaccccgtcgaggaaaatgggccgcaggaaagggtaactgagcaacgcacggccgtccgaatgggccgggggcagaaaggtgcgtttgtgctcaaccactccgatgggttgcgtggtgtagtcgtaaatgatggcctgcctgggcaatttgtcggcacggaaggtgctcggaactgtgaactacggcgtatttgaagggaaactccagttcctccgatgaagaatgccataaatttccagaattcgctggcattggccatgccccgaagcaaaaatgctgggctaatcccccggatgatggaccgactccggaacagatcgtccgcccacccaccatttcccaccaggaataccaaaaaattcaaacttttgaaaccccaaaaaattaaagttcgaaaattttttttcagaaaaaatcttcttttgttactttttttcgggtagaaaaccgcggggggggaatgaatgaagcgtccgcccccagcaggccgacttcgtaccggtggcggacggggccatcggatggactgtccatcccgcggacagtgactcccactgatctccgccgtttgaccattccaagtcgtcgtcggtggaacatgtctcgtccccgtcattgtttttgtaatttccttcgttgtcgccgtttccatttttgtcgggcgaagggtcactcaaatcgatcaaatcgccttaacatttagacaaaataactgaatttactgaaaatgagttaccaaattaaattagcattttttggggagattagcttagtgagaggtttaaaaacctccgaatcgtaaaatttaggcgattacgaaaaaattgttatagtcaattggtttggctcattaagggactctgccgcccattcgatggaagcgaattgttcccccaatttcatccccccgccgccctctttgcgttgccttcggcattacagtaacacgtcccctatcaccgtactcacattcctccgctttgcgtcgcatctccgcgaatgcgtcgatttcttcatatgtgctgagaatctttgccggccgcgacgggggcggcggagcgccccacggacaatgccatcggtcactggccgcagaaaatgaactctccgtaaagggagggcggtggggagggagtgacgacgacgtaacgctaaagacaacacatacagtaacaccacccacggaacggtaactttcaaagcgaaacaatttttaaaaccacccgaatcgacacactttccatccaaattgattctgctaaatttcgtcgattggacttcgccggcgccatttcctttgctattattacttttggtacagtgttcaatgattttcctttgctgctccaagaaaaaagaaaaggacggcgattggcgcctttgcttggcgttgtgttgcatttgattggcattatgtttcgtttggtttggctttccgtcgctgccggccgattccaacggatcgaggcccaccccttggccaaacttcggtgggtcatcaaatgggtccataccaattcattgccgtagaaatcatatgcattatttattcactcgcaattaaattaggcaatgggacaccgcccaatgggataaacagacaatccacgaattggcaatgaaaaacaaaaataaattttgaaacacaactttatttggaggaaaacgggaaaaaatgcaattgaatgatgaatgaatgggcaattcgcagaacaatacaaatatgaaaaattaagtgtaaaagtatgaaaaaatgaaaatgcttacaaatgtcactggtaaaatagaataaatgcttttgggtacttgtgtggtttacctgacagatttcacatacattttcagatgcctataaatttattttataaattcatggaaataagttttaagaggtttttggggtcgctgatcacgaatacagcaccaatttttgtcaatttcgaagccctgacccgaactcgaacaaaaataaaattaaaaaatttgtatggaaaatatcctcattggcatcttgcccatgcgggtacccttggtacaggaaaaataaaattcgaaaattgtacggatgatatcctcatgggcatcttgcccatgagggtactcttgatacaggaagtctatcaatttctcgaatattgaagtcttttaataattccatgcttaaaaaaactgtaaaattaatacatttataggcatttgaaaatgtatgtgaaatctgtcaggtaaaccacacaagttccggcttttgttagaaatctaatttgatcaaaaattgcaaataatgttcactcactccgttttgatttcgccactggcactttttgtgccctgcagcgattgagaggacagcggctgcatttcctcatgattcttcgtccatccttcgacttcgtctatcgtttcaagaaacttcatgccagtcgtttcgggcaaaaaaatgatgacgacggcggcggcacaaatgcccaaaatggcgaaaggataaattatctgaaaaattcaaccatttcaagtgtatttattgcgacgattccaaagaagtggaagaaaatctgaccacatttttgccgaattcatcgaccagccaaaacataagcaaagaggccaaaatggcgccaaaccgagccatcacagaacaggcgctggtggccatgttgcgaattacggtcgggaacagttcctaggtaagaaaacgaagacagtaagaaatgccaagaaatactgaacaccggtgtgatggtgtacagagtggcgtaagtgacggtactcgaagcttttccggtgagaaattgggcaactgccaccattgtgttcactgaaaaatggtagaggatgttaaggaaagacatgggaaatggtggaaaacataaattagtggaaaaccgttatgggaacgggacaaaaccttgctgcagaaattctttaaaaaattttgcatactcacaatcagaaaatttcaaaaaaatctaattcccacgttttacactttttctcacaaatatggatggaagaattattcgaataaaatttaaatgaactgctttacctttttcaccaagtaacaaatttgagatcatgcaaagtgcagcgattgtgaaccctccggcaatgattggcttccgaccgatgcgatcaatcagaaaatacatcaaaaaaagagccggaatttcaaccaatccgccaaaaatgaatgtcatgtacatgtcaccgcctagaaaatcagtctaaaaattgaaataagcgagaaacagaaaaacagaaccaaacaatgtaaacgaacataccttcattgacatgccgtagtaaagcatcgaaacgaccggcctaaaaaagcgaggagaaataaagtaaaaccaaatacaaataaaaaaggggaccaattagaaaagttaaaagccgaccaacaaaagaatgccgtgaaggaaatgcgccgtattttcggcgttctcaaaaggtccgtgtaattatgcttgcgcgtcgtccgcttctgtgctgtgcattcatccgcccttttttcccctccgccatttgcttcttcctcaatgtcgtcccaccatttgtccggaagttcccttttgttaatgcgtgccgcatttcgcaaaatttggtcagcttcgacgtaacgcttttgagagacgagccaacggggactttcaggcacaacccttaaaagaaaaggaagatttggggaataaacaatgcttaatagagatggattaaaagacgcaccaccaataaaagaggaaaatggtggcaaaagcagcaattgaagcatgaaggtattgataattccgaataaaaaaagccaaaaggccgagtaaaacttggccaacagcaaagaaaacgccggtgaacagcgaagcgattttccttttgcttgggccaaccaattccattcctttgataaccgtaaattggggttaaaagaaacgaaaaaaaaaaattaacaaccgatgatgactgcgatgacaaaaatacctaaatacataaattattttcgacatattaatttaaaataatggtaaatgaccaggatgggcaaagccgacacaggcgcggtaaacggcatacatttgccaaaaaggggcaactgccatgccggaactgccgataatttggaggacaatggcgatgaaaaacacctttttgcgtccaatcctaggacagcgaagcggtaaaaaggaaaatgacatggccaacaaaatacaaaatgaatgaaacctgtcgccaagaaagccgaagatgagcgaacccatcatctgaccaatgtaatacgatgactgaatcatcgccttgagatattgccgatcgcacacgaattcccactgaaaaacgagaaaaataaacatgaacagtcagagagagttaggcaaatgtcaaaccctttcaatggcggaataagtgacgatggaacggtcaaaaacgaagccattgcccgtctctgtgcagcgggggccatccactcccaatgaacacttttcgaactgacattccgacttgttgaggaccccttcgcagttgactcgcgggatggagaagcccagcgggacggaggaataatccgtatcagtgaaattgttgacgcggcatctgccgggagaaaagggacacgaaaccaatgaatgaatcaacattataagtgaaacaaccgatcaacctatgtttcacgtcggccccggcaaaagtccaacttaatgcgttcatcgaagtgatcagtgcaggaagacataccagaaagagttgagctttttggtacaactgaaattgatacgaaatgcaatagtgacaaaattcaaaacagcaaattaagtaattaccccaaattcgccaatgttagtgataaggtcgtcgaatttcattatcgatattagttatttcggtgttgagaatgttagtagcatttttgttgttctaataaaaaaaattgaattgaacgaaatgttcagaagtcaccctaattctgctgaacgacataca

SEQ ID NO: 924 - DNA, 6559 bp, Heterodera glycines
acatacatatcataattaaatttataatttccttccagcggagtcacttttaaaactaataaatgagtgttgatttttatgacccaaaaatgttccagcattattacataaaataaaacgaacgtgaacatttgcagtaacaatcgattataaagccattaatcataacgcagcattaaatttccgacctttacggaaccatagataaaaatgatcgttccctcgcaaaacaccgttgttatggaaaagacggaggaaggccaattcctatagagagcgcttctctctccattctcaccattcacacacacacacagccactcaacaactcctacgcttaaaataagccgtccatcacatgcactctctttcaatgtcaaaaacagtcgagcgaaaaggaaaaaataaaataaattcaaggacttaaacagatgaaaagtacatctgccaatgaaatttattttgagaatttcaatgtcgaagtaaagtacgattttgacaaaatatgtacggagtaatgtacagttgtgagacacacaatgactagcaaatggaaaatttttgtttgcgttaattgtgtcttctgaactttgaccaatcctttggcacgtagttgatgcaattcgggtctttaggttttacattaacaaattcatatgaaaaagggaaacccaccaattctcagcggccgcttttcttgggagcgacttaattttgtttactttttatattaccgatgaaaatgtgatgtgtaaataaaacctactgataagcctcgatcatttcgtttgtcaatgtgagtacgtattccccgcgaaggtaattgttcatgtcatggagcttaagttgcgatttacaagtgcctttcatgaaaaaccacctgaagtgtagacaaaacgtcctccttgcgaatgctggtcaactcgcaaaggtccatgatggacagtgacacttgcgtgtcctcctcctcctcgccgtcctcgccctgcgacggaatgggccgtccttgttggctcacaatttttagcattgtctcaaggattgtttggaaccaataagagcggtaagaaagcttaattggtcatgttatttgaaaaataataatgtgaaatgagtaccaatccgaggtcagaaagaggcttttctggaacacattgttactgaaatgccgcggatttaaaatgccctacctggagatcctgtcctgccctcaatcttcgaaagttcgtaactgaattcaatcaacaaacggccgtacccgcgtttttgatagggtggcaacaccaaaatgcaggcgacgttatactcctcggcagactctttttcctaacaaaatatagatatttttgacatttagaagaatgtaccttggagaagtatcctacgatatgaaagcccttctggtcgtattcggtcaacacgtaaaacaggaaagggtccgtgtcgtaataaagtgttttgtggtccaaaaaaagctttgccagcagacacaaattttgggcataaatctaaaataaattagagagaataacaaaaagatcttcaattccaccttatttttccgaccgtcaatctcataaaatgaaattgaatctttccggtaaatttcgtttccaggcgggtaatataagttgcattttttcttcacaaattttggacattaaagaggatgggcaattagtctcacaacgtgtctggcgagtgccgactgactcttgagataggtcaaacaaaactcgcagaggtaaatgcagggcaaatgggtcatttccttggggtagggcgaaaagtaccatggctgaatgatgtttcggcccagctgaactttctccacattgcgaatccgagtgagcgcatcttcactatgaccgacctggaaattcaaataatagttttagtcgtcagaatttattattttaagggaaaagcaaactggcctttgacatggaaccacgcaaactgggaacttaaatagtgggaagtgaaacacagaaggcaattgttcagtgataccgcttggtgctgtggaattaggtagaccatttgtggtgacggaaggacagcattcggaagaggttgaattggcatcgacgtattcgatggtgtgtcctaagtgcttcctctttcgacttccggtcagtgatcgagtcggtgttcgaaacatttcaatcactttttcgggagttgagctacgtgagctgaaggaattgtttaagaaaaacatttataagtacttctggtacctttgtgcgtcacttatcgcaaaattttggtcgaatgattggtccaacgactgagcaattgcctgctgtgatgctgacttcttcacgcgttggggaatacgaacagacatgagatcgatccggtcctccgctacccactcgtccaagcgccgattacaatccacgtaatgcacataaaacctgtatgttccatccggctccttccgcttcgatataatttcggcatccactaaacttattgtcagtattagcccattttccagcggtatcataagtgtgcactcactcattaaacccgatcccgtcattcgcactttcatccgacagctttcgtacagcgcttccacagtccattttttgcttccacaactcccactgttgtacacctggacaatcgaagagcaacaactctcggactcactgccctcctccttaaactcgatgccattcggttcacataccatctcttttagtcgttttaaaatgatataaagaacacttattaacgcgtcaatatttaacatggattagaaccattacaaagaattgttccaacaccaattggccaacaatgaaaaactgtcccaatatcaatcaactccaaaataatttggtctaaacattaatcgtcttccaatatgaatgagtattaatttgtctcaatatcaatcagtggacttggtctcttttttgggtgactcttcgttggaatcggtgatcgcttccttcggcggctccttcttaagcacattgttcacgttcacttcctctacggctctgagctcctgaaagtcatcgtagagcttggagaggacttgagtgaattgcggaattgctctgattgaaaggacgacggaattgcgcactcccatgaatgacttcaactaaattagtcgttcaaattattactcaaaatattattagctacaaacaaacatacctcggtgattttcagaaagtccccgcgagaattgtggccaggatcaaaaaaaaagcttttcccatcagtacgaatcatctgagaatggggaagttcggcttcctcctcttaaggaaaaagtttttgtaatcgtagaagtgagttgcctaaccaatgaacccttcgccatattcctccagaattgagtccagtgcatcgtgcaattggccgatcccctcaaatggcaatgccactgagttgcgaatcccggaatgcgtctcgagctgagtaatccgcaaaaaggaaccacgccgattttcgcgaaggtcgatgaaatatcgacgtctctcggtcacgatagattcagattgaatggtcacattctccgctttcccattcacttcctcttaattgtttgttcggcttgcaagtagtgttcaataaaaaaaaatgttacccgacgctggcacgtgcccctcaaacttccccaacaattccttaatattcttgcaaattcgcattgacatgaacaaacgattctttcgaccattcatagcaacctgaaacaatcagtcaaatactggttggtatacaagcgaagtgcgtaaattacttgtaattttttctattaattataataagacctcagccaatttgacgaaacgtccacgatcattttgcttgacgtccaaataaaaacgcttcgattgaatacttaaagaagtaaaataatacacaaaaggagaaaggccaaaatctcacttaagtgtcttgctagcaatttcttttcctcccttcacttcttcctcgccacgaacgccattgcgtccattacccttttccgacccgctggacgatggcatctcctaagcagttggtatccctttgcgaattaagcactttccttaatttgtgattggcaataaagtttttagatcaaaatgaaaatatacaacatagtgtttaaaatgtcgttaatttggcaatggtaaagaattgcggtcaataattaaactcttttattttgggatcaaaatcaatttacgagggtactgatcagtgatcacgaatctgaatctcggatttgctcaaatccgaactctggacttgcacaaaaattcgtttttccccaatttgcattaaaataaatcaaattttggcgcaaatttgtgaagcaattgttttacaccaaaataaataatgttaaatgaattcgaagcttttaccccaggaaaatgcatattttgaaaaaattcaactttttgttcgaattttctattccctaatgattgccattgctactattttaatattataccaatatttaatatgatactatacgtgtgtaagtaggtaaatatatggatttgcataacaatgaaaaagtcaaatgtagaaaatgtaattttaacgtttccaaattcgattttataaaacagacaacgaaagttgagatatcttatctttaactattttatttctcgctcatcaatacatagtccatacggtccaaaaattcttccaaattgaaaatgggtataactaattctctgagattgttgtaaaatggagtcgaatggcctactctgagcacacgaagaccttaactaatttgtcaagcaagcctaaaaattgattccgaccacactccatgtcctcccaaattcgcatcgtagtttgatcgatagacttttcaagtggctggatggttttctgtccctcaatcagaacactttgctgtgacttcaccgactcatataattcacgtaactccggcaccgtcaagatgagacgagcatttatagaaccatccaaatgatactgaattgtgattacctaattcacgatatccttttgaagacttgcctcagctatttgaaccgcctttccgacatcagattgttcgacaaacccaaaagtaacaaagtaatttttcagtatacaaacagccgatggggaagaaattttgctggtcggttgcaaaaaatccatttcacgcctcatgaaaacatttttttgtcgtacaagatctactggagagaccgctatttgtcgttttgaatttcttaaatgatgacccagaaagcggtaaagaaacggcaacttagcggtcacattattcattttgaactcttaaaacaattaataaaaaataaaaagtaaagcaaaaataaaagaatatttgcacagagaacaaatgtttgttgtaaaattacacacagaaataaaattatgatgaaaaagtaacaaaatcagaaatccactcgggttcaacagaagcgacatttcttacacattttttatgtgccatttgtacgatttcttggtacaggacataatcgggctgttctttatgaagcactgaactttggtcaatgaacacgtaacccttaattattttttacgaaaccattggtttgccatttttactcaaaaatgaaaccgattaaacttttttcctgcatattctcgccagtgctcactcacctccaaaataagtgttttatatgcgccctttggtgcatccaatgactgaactttctttgccaatttatccggatggcatttcaccattatatgcctaaatcgaccatattaagttaaggaattgaattaattcagcttcactcaaccttaatctcctcagttgttcttgggagggtgcatccattctgaacttctcgggcaacttctccacagaatcggatttgttcagaagaagcgtcagctgatgtctctgtttgttgatttcctttagggccttagggcgaagtcctagggcttcgattgcgcgagcgttctgtttgaaaatggtacctcatttttcataaataaccaaaatttatggtcaaaatggcaagaagaaagagttttttgagtattctggttatgagtattttaagatgattttttttgcgcaaattaatagtgacagtaacaaatgtttattctggaaatctggctaatattcctttacaaatctcctttaatttttcgtaaaatattggctcaaaatcacaaaattagcatttttggaccgattctattaaaatactctaaatttttaaatttgaagtgcttggtctgtggcccacctcttcctcatagtcagcagcaccaacagtgttcagaattactgtcaaatcaccaaagagtcgagcctccccaacagcacaccaaagaaatctttgcttaatcacttcggacattctttttcgtctctcttccgttccgtcctcttttgtgcttgaaatgaacaataatggttcacgaacggagagagccgacaccaaagtgacggcaaaaggaagaagtccgccacgaattgaactgatgacgaccttcgcaaaagaaggagaagaggcagctgcgcaagtgattgtccaagttgtgtgat

SEQ ID NO: 925 - DNA, 2034 bp, Heterodera glycines
aaattcactggtaggagagaatagagagggatggccagcagaggagggtactttttgaacgattgcgaagcattaagtgattcatcgtcagacccaaaaaaaggtattttgccacgcctcatcttcaaggtccatatccgaagttccgaactcgtcgttgtcaagcagtagtccctcttcctcctcctcttttgtctctttcttccgacactttttcattttctcttttctcagtaattttgatgcagatatttttgtgtatttgttttctagcaatttgaccaaatgtgtgacttcacgttgacctgtgacgaacgcaaggatgccacccgctgggtattcctcgtggattttacacacttttttgaatgttgcttccaaataatttgttggagtgcgccgttcaaaataaattgtaactggaaactgacgagcttggacactgacaacttttggttgactgatggaaaaaagtctaaaagaaagaaattggcactgtaaaaaaagtgaattgacctttgtcgaagaaaatcctgaagtttcagtgttgccgacatgataatcagttttaaaggataaccgcgtttcattctgagcgcacaaatccttgacaaaagcccaattaaaacgtcactataaatggaacgttcgtgcgcctcatcaatgacaacgactgagtaacgcgaaagtgtaaagtccgtctgcaactctttcaagagtactccgtccgtcataaatagtatttttgtctcttcacttcgattcccttcatgtctgatctataaccaattagtattgtaattaattagtgattcgtaattcacctggtatgatgccaatttttcgttgtccaactcgtggccaactcgcgatgccatacttatcgcagcaatacgccttggttcggtcactccaattaagtgtccattggaggtgtagccagcctcatacaaaaattggggtatttgcgtagttttcccggaaccagtctcgccgcaaattatgaccacgggatattcgttgattgcctcaacaattggctgttcctcagcattaattggtaattgtcgtctcttcttttcaatgttttcgtcccgtggaacaataatttggcgtcctttgatgcgagaaagggcgttggagcattgcaattgtcctttggcatgctgtttattttgttttgacgcagcctcatatctttgttctgaaatttaaaacagggaagaattaatggtttgctcaaaatgcgctaattgaatgatcaattaatagaaaattaatcaaaataaaataccgtttttgtcaattgggagattctgtgcagtccgcgcgttatttcctgccagcaaacaagtttcaatttgatgcgtcaactttggcattcgttctatgcttttcccaggttgttgctgttcaccattcccactaaagtcctcttcacaagaactgctgtccgtttcaatgtgattgagttgtttcgatgttgctctgatatttttcaatttttcaccggaaacgcatctcagctttttcacaacttcaattttgtgtctgaaacacatatgagatatttgacaaaacacatggaactacttttgattgcctgcttctttttggctacttgcaatggaagttagtaaattcatgttcccttcgtcaagctgatattgttgcaacatttcgaacaatgattcacgcttaaaaaaatttttttttttttttggtaaatgagaaatataccgtttgctttattttctttcgttcagcaagttgggcaagtttttttgatttattttttgatattttcgtttcatttttacgccgaagtcgttcgatattctccaactttttcttgttgattcttttgtccggaactggatcagacattgtgctctcactttaatcgactcaatttgtgagaatgagcctgtctatgccttgctcttaaatttttcaattttttttttcaagacacaaagccaaaataaaataaataagaaaaattgatgattgtgaggtcactaaagtgaagga

SEQ ID NO: 926 - DNA, 7786 bp, Heterodera glycines
tttgtcgataagaaacccatgagtagacaataagcaaaatcttaaatattttaatttctgtagagggattgaaccaggggaaagaagaagggaaagtcaagggactagcactaggccatttgcaaatttaatttttttttcctttcactctaatttttatcactaatttttcactcagacccccattcttaccagtgcttgtttttcccggttcccggtcccgctcaactctaattttgacaaatgaatgacttaaaaaacttcttatttttcttagaaagaccaaaaatcgtaaaatttaacaaacttttacaattaaattagttaaatttttgaatttttaataatcctttgcattcaaaactataatttttaattcatcaggaattttcataatgcaaatgtttcagacgcagcgaaaaataaacattgactaactgagaatcattcggtataaaaccaacaccttaattttccaagactttttttataaaataataaaaaagttatgcaaataaaatttaaatatcttaatttagattttttgtccagaacttttttttcaagaaatgggaaaattagtctgttttttcttgataaaatgaccttttttaacaattctttttcataaaaacatttgaaacagtcgggcctatgtaatattaaaatgggttgtaaaaagtaagtccgtattttataagggcattttttgccaaatttccaaaaatggtaaaaacctttacaattaattcgctgatgccttcatgattttttgtgcatttttgccattttgtacaaatgtttaatctcataaataaaatgacgaaacaaacaaaaatgaaatgaaaaaatgggcaaaaataattggatgaggagggggaagaaaacgcacttttaaaatggctaattgaatttaaattgaccaatgatcagcagagacgaaaattaacattaaagaataaagaaaagatttggaatgtaagagaggggcaattaattaattaattagttttagcagaatggtgctcaaaaatgttgagggaacagcaaaaaagcaaaagacgtttctttggtgtgccattggcttaaacttcggatacaaaactgttcgttgtgcgcgtactgcgcctgaattagtgaattaatttgctgtccatctggtcaattaattctcctacagatgggaaaatgacatttgccgcttcattgggtcggccgtcgccaaattttccacccgaatttgttaatggaaatttctgagctgcgtgaactccttccgccgcccaaatttgtcgcgctggcattttggcactgcgcataatttgcgatggcgccggagacggcgaaaaaggcggcattgttataaaatggtaccaagttaattagccaaacaaatttcgatcattttgtgcccactttcttctgtgatccatgtaacccaacggcggaggctttggtggaatttgtgtgccgcaaggtaacggggaaagattggcacattctctttgacgccaaaagttgtttttgtcgacgaattgtgcgagtattacgatggaaactctttgaaggagtgcttttggcgctaaacattttttgggctttttatttttattattttgcttttggcctttttcctaatcacttctttttgtatctgatggtgggcttaacgcatagaatgcatttggccagcgaaatgctcaaagcattttggggagcagcgaacaaaaagagaaaacagaaatgggtagaagtcggaggaggacgaagacgaagaggagaggccgcggcacgaaggaggacagaaggaacgggtcgcaggtgttctgcaagttcagccaattcaaaaggacagagcgacggacgcacccgcggattcatttgacgtttgaaagtctcgtaaagattctggtcaaagatgcaaccgaatcggtgttccatctgagccaagcccccggggttaaagtgaatggcatggtcgagaaggacaacggtggaattgggcagcttggaaaggtacggagagacgagcaaaacaaacagcgacacctccaccagcgcaaacagaaggccgagcagaaggaacacctagggatttgtaaggattgggccagagtttaattggaatgccaaattggcattttgcaatggcattttggagtataaaactgaattcagtaaatcacccaaaaaggacgcggatgaggccccttgaggtttcggcactgaagtaaaagaaggcagcgatggcgaagatgagcagggaacagaggtcggccagcagaaaggcccacatcagcgatttgtactgaaacggcggcgaaatgccaatttgggggacgaacaatcggtactgaaccaaaaatgacaaaaaacaaacaaatattacaatataagtaagtttttacccaaataatcgacgggttcttcgtaaatggttctatcccttagggcgtatttgaaaatgaaaacgggggagaaaagaatggccatgctgacggcgatcacgaacagaatgccaatagattcgcgtacatttcccatttgatttttttgctgtgtgagggaatgcaaaatcagtctcacaactttttttacgccccgcgggggaattggcggcgacggatcgccggatgggccaccgaacgcacttagcattaattaagagagagaatgttcagtcttgaatatatacaaaagttagccgaaacaaaggcactaattagaaagaaaaatgccaaaaaagaggagaattaaaaatcgaaaattgaagccgaggaaaagaagtgaccttaagctttaaaagggaagataatttattattatatgaaatcaaaagatttgtttatacatgagattgtgaacattcttcaacggaatgaccgcacttcggaggggccgtctcttgcgcggattctgagtctggcaaaagcaaagattgaatagacaaacgagttggacacaaaattgttttttgtatggaagtgtgtctctaattacaccttacaaacaattagtcttctgtcgaatcgccgaactccacacaacgggtggatgaaattaacaatacaatttttagacaccggaattccgtcgaaattttggtaacccataaaaaacattttttgtaaggaacaatcaaaataaaatgtgtttttaaatatgactccctttgcaataattacaaaatcagattctaaaaaaattgcaatagaaactgtctcaacaaaacctaaaatatctttttaaattttggtgtttcatgtgcatttactcgtcaaaacgctcaccttcggttcatttcctccccatttgcctcatcaaaatgagagaattcgtctccgccgctcacgaaagagggcgactgcacactttcgctgctctgtcgcccgaagttggcccattctgcgacttcctcctcctccccaacaaagttgaccagctcaactttgcccaccgcgttgttatggcaattatcttcaattaaagagttcgtccctttccggtccgttccttttccctttggcactgcccaccgcttttgctccgattcgccatgccgtgctcctcatcctttgggctcgcttcgtccatactttccgactcgcccagcccattgctctccttttgttggtcgaccaatgctttttcctccccattttcaactattagcagatctgtcgtttgtattgtctttttattagttaattcccatttacctttacattttgatatttatttgttgcttgctgcttgcttatggtcggtttgaatccgcattacattttcccaagttgacgaaaataaccaatcatatccaacaaatcttgatcattttcaatcacaatttcgtcgtcttaaatttgagaaaatctgttcatttctgaatttcgccaatctctgtcgaccaatataacaaattgagccattgaatgccgggacgcgtttttgcaattcgagaaaaagtgcgcagaaatccaatgagaccagctcaaatcgtctgaagtgactatcgttaagccattttatttgaacaaacattgacgataaattgctaaataaaaaaggaaaatattcctttttctgctgatgcatttgaaacatttcgccataattgtttaattttttcaaaattatgccgatttcgatctttttttggttgattgatgccacataattggagatgcctgtcctttaattttcaagtaaaaagcagtaaagccatctaaaaaaggaatttgtatttcgtttcaaagacttcaagacctttctttgaatttccccgtaaaatgttcctcgtgtgttaatggatgtaatgagttttgtgccgcctctttcgtgggcttcaacttcagtcgatggaaacaacatttttcaacacgtgcagtgcgaatttgccatggttaaatttattggcattttgtttgaattccccccaatttctcgaagaaaatgaactcaacaatttgcttgccattttgcatcgcgtgctaaactctctgctcgatgactcaatgcgttccaatcgcgtgcttttggagggagtggaaacgcgagaaatcagcgactttttcgtgatgttcgagaaagtgatttggcacggttttcggactttttgtaaaattaaaatttgaaactgaggcaaaaatgtaacatttatgcattgcagcttctttgttggccaaaaagaggcccgaggcgcaactttggaatttaattgggcagacaaacgaaggaaagggcgaaattggcaatttatacgaaagcgtaaatgagatgagcaatttgaggtgtgattggaagaaatggtttttattggctattgagataacaaaattcagttctccgctcgccaaaatgagcaccttttggcgtttagcattggtgcagaaacggctgtccgattatttcaatgcgatttgtgaattcaatgggaaaaagtaagttttggatgggaatgatcagtttcaaaggccgggaggaaatttcaaagcaaaatgaaagaacaaagatcactttctttgattttacttagccacattaaaccacccgccaaagacaaacattagtaaaaccttaatttatacctaaagggccttcattgtttgaataattaggaaccattaaattttggccatttcggcccggcatggctaagatgtctgctgatcacttgtgctttactctttgaagaaattccgcatttttagccctttttacgaccatttggcttttatgtgctgcgacagttgctgtgcttttttgttttggctttgaatgctttcgatttgtccattgaaaatgtccatggaagtataatctttctcttttacatctcaatactgctaatggcacttttttttcatttgaggagcaaataaattcgttcgaattgtccccttatctccgtctgcccacccttcccggccatgtgccaaattcggccaaggaattattcgccaatgaaagtgccggagctggagatgcttctatcagtggccattattgaaaagatagtgaattttaacaatggcccaactggtataaaatctgcctttattttcctggtgctgcttggtaaacttcgtgtttttgtgccccaaaaattccaaagttttagtcggattttgcattatctttttaacaaaatccacgcatttttgagtcgccggggaatttaaaaagaagtgttctaccacactttgccattattttgtaattgtttgaataattttatatattttccaaatttgagagccgacgacaacgccatcggcacaatgaggccccaacaattgtcggctgcatcagcctaaccgaggtgtacctgtagcagaacctgatcggcgaattgcccagcaccgtcggggatttgaaggcatgttttggtcaggcccgtatcaagaaaaaatttcggggaggacatccgaagtaaataaaatagtttttaaaatcacacacagacatttctaggggatttttgttgattgatcacgaatctggcatcaattttactaattttgagccccggacccgaatccgaacaaaagtaaaaaattaatttttcaccaaaatgcacttttattttacatagaatctgaattgaattcaggtccggggttcgaaattggtcgaaatgggtatcagattcgtgatcagcgaccccgaaaagcccatagaaaattttttaaactaccaaaatttaatgggcaaatttttttaatcaaaaattttttgtaattgcatttattaaaaaatttccggcggcacctaattcggcatcgccgaaccccaattttaacttttatttttcaaaatgtaaccattatggcaaaaataattcatttttgcttaaaaagactataatttcgtgcttttttgttccaccggtgcttaaaattttgaaaaataactggagaaacaatatgacccaaagagcaaagaaaaggccttcggattcgaacccgtaatttttttttttgatattgacctggttttgggaaagttatgttgtactattactttcacatttttccttcatccgttcctatttttacagacaaaaaaaaatgcttttttaactcttaaaaaaggagaattttcaaaaatttttgtcagacgccaaaacaaaacaaaaaaaaatccttggcaagtaaatatttggaaataaaattcgaaaatttcttgcgtacttaaaataccacccatgcaaatttcccggaaatccaaaccctcccccccccccctcaaaaaatacattttccatttccatccgtcgcgtcgcgtcctttgcgctcagaagcaacatatttttaattcgtaatatcactagattgtttttctattagcttacatagtttacaaaaaacgtcagacgacaaaatgttagataacgaaggttctatggttgatctagatcacaattgtttgaatcaccaagaagatccgaatattgaaggagacagttatgctagaaataaatgacatgacaaggaggtatcaaacatatggatcatgaacaagtagcacctgtatgattctcaagtcatctgaagacaggaatcctcgtgatcaatcgtaagatgggagcagtcagagagatctatgatcggataagacatcgaatgaaagataacacatggcaatagacaatgacacagtcccgtcctcgtagactgtaagatagagcagacagccatccagagctagctatgccgtcaaccagtgtcatctcatatgatgatagaatcagtcttatagacaatcgtaatgatccatcagtataagcagctccactgcgaatacaccgaacaagcctgtcagtatcagcacacaattatatgataagcaatgctcaggtagcgtatatcacaatcagaaggacaaattcaaaagataacacgccagccacaagttagccatggccaagcacaactacaaattggacaatatagattaagcggacaatcccaacgacgatggtcacacgcacagctccatgcaggacaacgaagatcgaggaaatcatcgtaacaactcctggtaacgagagcaaggacaaggatccagatatgtcaggcagggcaagaacgacagaactcgacagagccaacaacactcatcaggccggtcaaatcgtgcaaacgagacctcgggatcatccgagatgaccatgacattttctggtgttaggatcgcggaagcaagatttgggaactcaagggcacggaaaattctcctttcaaacgcccaccactcatcactctctgctcaatggcacaacctg

SEQ ID NO: 927 - DNA, 1173 bp, Heterodera glycines
tcgcgtccttgcgctcagaagcacatattttttaattcgtaatatcactagatgtttttctattagcttacatagtttacaaaaaacttttgacaaaaaatgttagataaacaaggttttttggtttatcttggtcacaatttttttgaatcaacaaaaatttctgaattttgaaggagaaagttttggtagaaataaatggaaatggaatcaaaattattaaagttaaaaaatttaaaaaaatattattttgaatatttcacaatataattttcccagatgaatgcactttaaaattctgataaattgtacaatcatagagaattattttgcttcggaattttctctgatgagtaagcatccagtaggccctgtcagctgcctttcatcgaacacactaagagaaatttgatttcatttttaattcagttaacagttaccaatgtattcgtaatatttaataaataatttttagttaaaaatgaaattatgtttatttaaaattatttttgctttttatctcttaccatatgcttgcctgtctttggaatcattggaatctcttttcgattcggaaggtttgtcgaatgagatgtgttaattaattaagaaagatccatttaaattttaatttttgaccttatttcaaaagtattacgaatggaaaaataaagtgcaaaatacatattaaaatacggaaacgccctaaaacatgaaaacaagaattactgaaaaattctaaattttttgatcaacaatttttgatcaattttttttatcattagggatgtcaattttatgtaaatacatattttttcctggcttctccatgctctaaataggcggaaaacactttcttttttgtgtttgcgaacaaaaatctggacttttatttacatattcggggtttttatagttattttggactttttcatacatttttttcttacatattttgaggattttttactgttttggaaattctcaaaaaaatccaaaattttggctattgcttatttttcatttttctttaatttttgaaaatttatagaatggctcgtgaaaaaataaaaattaaccaaaaatcaatttttcaaatacttatctggttctacgcctatttagctaattttatggcattttagcaaaatttgcaattttgagccattttta

SEQ ID NO: 928 - DNA, 3973 bp, Heterodera glycines
agcaattatttattattaaagcttattaataaagcgtcccacacgggaataactgttaattcctacctaatgggagcgccgtgcggattagaaccccaaagcatttaatcaaaagcgttaaccactatgctacggcgctcccattcgctctcatcatatttttcatatataacacaaaactattttgcaaaaaagtctcatcaaataatgatttgtcattgaattattaatatttttgacatgaattttttaaataaatatgtgcactcctttatgtaattattattatttttgcataagacaaattgatttaagcatcagagtcaagcacaaaacggcgcatacaaatggcacaacgattttggtgcataagccaatctctagcgcatgacaaatgataaagatgtttacatgggagttcggtagcattcaatgaccccaagtcaaatcccatttggcaaataacacatcgctcatcatttcggaccattgcctcgttcacttccagattgggaagtatactatcgcattgttcacgtgttaaaccttggccatgttgaaccactgatggagaaagtatttggaccgtttggggttgggacgactgaattcgttcgctttggggctgttgacgagcattctttatttaaaaataaacaaataataataattcacaaaatgtttttttaatcttcattcattcatgcgtctcaccgctctgcgtctggttcctcctcctcttcctcggccacgtccggcattggcattgtttcggcgacgagatgaagatgctgacgaagaaatttgtggattctaaaacaaaatggaatattagacaaataaacaaaccaaaaattcttgctaaccatattattgttgttgttgttatccaaggcgataggttgcatttcagcggaagtggtgagatcctgtaattggcatgtcaattgctggttattatttttttattttgctaccaaaaaaatttggttcaaaagctgatcgtcattgtcgtggtcaagtgccaaaaactgatgactttgctgctgctgctgctgcgcttgaaccatgtttgtttgcaaggtggcgtttgcccggatttgtggatgttcaccctgcgttggttgtacactctgttggcgctcgttcagcggactcggtacagttggttgttgctgctgtacattgtttgtttgtggcgacagtggtggcggatgttgctcagcttgaagtgtcggcattgtgtctctaccttgcattggttgctgattatgtggacgatcattgtgcgaaatcgttccactgtgctgctgatgttgagggggtagggaatttttttgaccatcgactattttattttatttagttttttggacaaacaaattgaggaacccggtcgctcggacttcgaagagttaatggattaaatgctactgtcggccccttaaactcattaaattcaaaatgacaaataaataaataaaacaggataacccgaatcaagtgaactgaacttccaaatgcgaaagataaagtgtagttcacagattgtccaaaatcgcgcttcggtctcacattcaaatgcatgaaccggtaagtgcctccaaccaagagagtgtttgataaaagggtagccctggcctctctagcacaaatatgaacacgcaaatgttgctcattttccaacaaaaggtttatgccgggcgcggatgtgccattgcgaaaaggaattctttccgcaaaattaaattcaagcagcttaagggttagtccactaaaaacacaatccctttccttcaatattaaaaaaaaggattacggaatgtatgaaccaatttgccgattgaagtcgagaaaatcatttgttgtagtaccatcctggtaaaattcctcctgccatggtccaacgccagcaattccctcattagtccttggtacaatttgttgctgttgctgttgtgcaatgttttggccatgaacatgtgtagcaatgcgttcaatttgttggcgatttgaaaatgttatccctggcgggaggggaaagggagaagggctcgatgtgtgaacaaaaaccggatgggggaatggccccataattggatgagcaaattggttcagaaatggaagatgtgggaattgatgtggcattggcatcgaattaaagaatgggctttgaacaaatggcagcatttgtgacatatgcggcgaaagcaacagcggtggtgctggtggtaaaggcattaatggatggggatgagccgtcagtggaaaagtgaatccatcacaccaagtagcaggctgaatcagggtaggaattgataaatatttaaaaccataacagtacaaaatctgtttgtccattattaacaccagacggtgccctaagaccagcgaagttctaaattttttaatatgaagataagttaatgacaacttgcccgcgaattggacattgtcgagttggtgaacaaaaaaaaaatctgaagtttaattttgtttttgatattgaaaaaaatgtggtagtcaagtgtcataacgtttttaaatacggaattttttattccatatcaattgaaagctgcagtaaataaaggtgtaatgctacaaaaaaaactgattttcacttcgccttgttgttgtttaatgtttatcgaggaaagaaatatgagtatccgagttcaaaggtcatcaaggcaattaggatgaaggggggggggtgaaagtttatataactactaccttttttaaaagaaaggacgctcaaatatttttttttaatatttattaccatggaatggcatgacatgtgatatttgcaatgccatgtctcgatattgttatgaaggacgaactgtatgaccaaatgacatggcatggaacagcatgaaattatcatgaaagaccatggtaagttaggaatgtgacctttgaataccaaaaacatattaacacatgcaacggtttgctctttttttgaaaaccttaattagcaacatttttaaaagcaatcaaacaatcacattgtaatcattgatcactccttctagaacggcacaagattcgacaattcgtactggaaattcgggccaaaattcgcctgaatgcgatcctcaaaatccaccagcgtacaacaaccaaaaagatgaattgggtcagcgtacaaattcccagtttctcaaataataaaaatgaatttgtttaaaaatatgttgtttaataccgagacgggtcccattgatcgtaaaaaaaattctgcggttaaacaaatcaatgccgcatccaaccacgtccccctcgccatattgcgtgtaaccatccaaaggagaagacaacgagtcacagcaaccgtgaatggtgccgtcgctccaatatgcgaatgaattttcggtgtgtccaacaatttcgtgcatgcccatccaatggggtgccagcccaattccgaaatcgcttaatttgggattagaattatttagattgttccatgatttttttttttgccttttcatcttgaacacggaaatttcaaagtaaaaaatgccgtaagtgcatcgcgccggcaccaatgctctcagagaaacgaaatctttaaaaaataaaattcaatttttttttaatttttttacatttttgctgggacgcgtgttcagcaataagttcgtcatgcaaaaagatagcggagtgacaatgactgatgtcccattcgttcagtttttgagtcgtcagcaactgaaaagataaatgagttattttatttacataactaaatgacgctttgacaaccgagaactggtaagtgcgcatcgcctcgactgtttcgctcaaacggtcctgaaatattggcactttggaaagatgtgtggtaaaatcattgaataaaaaattatcaatttaaaaaaaacttgaaaattagagccatccacgaaaaaaaattttgaaaaattaagtaaataaattaatttgaccaatcaaaatt

SEQ ID NO: 929 - DNA, 4072 bp, Heterodera glycines
  misc_feature (16)..(16): n is a, c, g, or t
aaaacaaaaaaatttnttgcgcttaaataattttattaaataatgattaaagtgagatccggtaacaaaagcaaaaacaatctccccgctttatctcatctatcatctttgtcggaagatcaaagcattttttcaacctttggactttaaaacaacctttaaatgtttgtaaaatatgatcgggaattttttaacgtttactgtaaaaaaattaaccgaaatctacagttcgaaatgtaccacttacgcatgaaatggcgtccaaaaagtttgttcaatgtcaaaaagaggccggaaatttgttcacgatcatgccaggagaggaggccaaccacccgttcagcgacagaatgggtcaatgcattgctttttgaacaggaacagcaaaagcgacggatgaatggtctaaggggaaaagtgaatgaaaaaggggaatgccaatttcggagttttacccttcgaaagtgagaaacacagttcgccatatttgctaatgtccccttcggcattgtcctccacgttggaccgtttccattcgactaaatttctttttcatttttatgaccaccgatcaaaaacaaacaaaagaaaaacacaaaaattttgccaaagttctctgactaaacccttctttctattcggttagttaattactttttagaaattaacatctttcattgtattttccccccccccactcgaggacatttaatgcatagcaataaagcatcataatgaaagccaatgcctgaagacgatgttcgatgcgttcaaaatcaacacctgcaaatttgagttcacaattcagcaatcaaaaccaaatcgaagcaccggatttattgggcaaggaacgccgtagacgagtcactgcttcaatttcagcctggaccaggtcaatctgagggtgttgttgcgttagaacaacggacccctcaatttgcgtcacttcacctgcccattgatccgtttcttccgctcttccgtctcgcaccaatcaaacaaacgctgtcctttgaccttcgcctcacacacaacttgcggattgtaagcattgcctgtgggaaaagaaaggccaatcaattcgcattttattataaaagcaaaaagttttacccggttcaaatttgagatcactaaattgcgattttgggccaaatccctcgagagagtcgagcaaatccatctcgagcacttccgcaatggataccattccaaaagacccttccgccccaaccgaaaaaggcgattttggagaaccgggggattctgaaaaatatgcaatttggtcaaagaatgtttaagatggatgaacagtccaaccaatgtcactggtgctgttctcattctccgccgactgtcccttttggactgtccgtcttcgagaatattcctgcacactctttaaggtaagtgctgaaaatgtttgcaatctctcggcaattcgccgccttcggcagttggaagaagcgtttttcccatccgaacatttttccgatggcgtaggtttttgttcatcaactgtcgattgcgagacgttggaccgtttccgttcggctaaagaaaaacaaacattttgccaatgttctcccactaacccttcgttctattcggttagttaattcctttttaggcttaccaatttcatcactggctaatttgatgaaagtgtcgtcatcgaaagtgtattggtcggtcgattgacattctttgctttgtgccccctccaaacaatttgtatggcacaccaaatcgcatttctcgcattgatttgcccatttcagccaaattttcccgccgcagactccgcaactcatattgaaatctgaaaactaaaaaataaattaatcaattcattgacaacactttatttgtgtttcaatggcacccatcagtgtttgtggttagccaaacttcggcacggatcatccaaatgatgtgtttatgggcgggggagattgtgagagagaagcacattcgcccaattcaccgggtaatccgtcggggaaaaatataaagagatgagcaaattgccgaagtataaacgccggtcgaacccattgtgacgaatcaattggtcaaactcagtagggacaaatcactgaaggggagggataattgaacaacgaatgaaattgaactcaatgaggccaaagagattggccattaattgggttctgaaaaatcaaaggttttgcccggcttatttttttgattttaacaaggcaattatcaaaaaaacctttctaaataaattccgctccaaattccgtaatgtcgtctcaaattgctttgtacagttcgttcagtttggctaactgtatcttctcataatttgcctacatttcaacacccaaggccggttttggcgttgccacaacgccaatcgcaaaaattctgtctccgtccttcaatttgtgctcggccaaccgccggtccatcggggcgataatgtatttgcctaaaaattaaaaaataataatctcagtacaatttttttttgtaaatttttgtgaaaattttagtgatacctcctctcataagcaaatatgctaaaccatctttttcccgtgaaattaaacgtcatttataaacagtgtttaaagttttatagaatatgtgcaccgtccccgtctcaaaattcagggcaatatcaataaaacaataaatttcattggtaaatgccaaacttcaacaaaacccatccaccaccttttctcacttccattggtatcatttacctttgtgtatgagcttcattgtaccatttccatagccgatctcctcacaaattcgctctctcaattccccaaaatttgttggcatttgctgcctcacttcgcttggtttcgcccccgcttaacaattgtttagtgtgcaaaaaacctcctgacaattaattcaggaaaattattgtgacataaattaatgataattattgcaaaccttataaaccaacgcgttggcaaacacggcgcctcgcgccacaaacgaattggcaaagttgcgcttgtttatgcgcttaaattttttttccaaaaattatggttaatacctgaaaatataaataaattaaacatattttaaaatatggtataaacatttaaaaataaaaacaattctacaaatttattaatcatagtattgatattttttagccgggcaaaaaatagcacaattaatttatttttaatggctaccgatttttctctatttctctaacacaattcttttcattttttctctctctctctctctcacttttctatttttctatcgcacactctcctccctcactattttctctctttatctaactaccgtatttgatctaattatcccccatgggggattattttttaacctcctcatagactggggataattggagactgtgtgattatgatagagagattatttttcaaacgcctcctagactgggggataattagagactgagggattaatggagattggtgggataattagagcaaatacagaattttctctttctcaaccccatccaataggtttgggtttgtggaaggggatgtcagagaaaaaaatctccaatcaaattatcgggcgaaaatcaatcgataatttgattgggaatattatctactactaaccaaaaatttttccaaatccctcacctaattgacttgaaaatgcaactctctgtgctttcttttgcattcgttgccctgtttttggtcggttttaatttaactagttgtttctttttttgcgttttaaaatttccggggatattttttgacttttttagtgcctcgggttttcagtgagtccaattccgattccttaaatatgttcaaataaaaacttttgcggtaatttttctttaagacttctgcgctaattgagttcaccgaagcgaatgcgccaaagcagaacaacggtaccgacacgaacgcggaaaaggaggaaaacgtaagggcttgtaattaattggcttattagccctaattaattaagtaattaggtttgccttttgaaaaacacgaggggagcggcatggaccatcagacgatggtggcatgacaaagcggac

SEQ ID NO: 930 - DNA, 5849 bp, Heterodera glycines
  misc_feature (5829)..(5829): n is a, c, g, or t
cggctaacgccgtaacacactacggatgacgacttttctgtgcttgcgcagttggtccatccggttgccgaaagggaagtgggttaacattcccacgccaggctagggaaatgacggttcgcaagagctgttttgcgcggtaacgcaaatgaactcgcagacgtcgtgtggagtccgagccagagttctcttttctggtttagggtgtgcgtgcctggaagtggctcagcctgagatagggatgttgcgcccgtaaagcaccgcggttcctgtggtgtctcgtgcgctccacacggcccttgaaaatgcgagggaagctatttgaatctcctgcctgatcgtaccgatatccgcagcaggtctccaaggtgaacagcctctagtcgatagaataatgtaggtaagggaagtcggcaaattagattcgtaacttcgggaaaagaattggctctaaaggtcgggtcagccgggctgttgcgtgaaacaggcggcttttgcccgtggctgcgtgctgttctttcggggatggtgcgtggactagtggtgagagctgcttgtggagcgcttcagctgcgtgtatgctcgtcagggtatgcacttcggttggcgctgaacgaccagtttagaactggcacgaactcggggaatccgactgtctaattaaaacagaggagacggatggtccttgtggacgttgaccgtgtctgatttctgcccagtgctctgaatgttaagccaaggaaacttgattaagcgcgggtaaacggcgggagtaactatgactctcttaaggtagccaaatgcctcgtcggctaactaccgacgcgcacgagtgtggcgatactcggaacctccggggagcctgttaggagttggcctacaggtcgcgaaagtccctaggtgctgcacgggttgcgctaatccgagggcgctgggttaccttcccatcggccaaaaacgtctgggccttcttagccgcgggtccagtatttctgttgagcctgacagttcttcccggatatggcgaaagattacagggcggtatttcgtgaaacctaaaaaaggtcgggccgaatggcacggacagactcacttcggagtgagctcgggggcatccgtgtgttaccccgctgcaccacgccgaagctgtcatagcgagcccgaaggggaatggccatggagactccagcctcaccctgtaactcgaacctaagtccaggcccctttctggtgttggctcgcactggttagggaacacgacagtctcgtataatcccacacgcaccgaaagccctagccctcgtaggcaaaggctgcgttgttggtttcagaactgtgagcaagtggggttcggatggccgagtgtaccaacctgcttgctaacaggtagcatagagtaatatgctagtaagcagggcacgagaaagggccgtaaaggctccggctatgaaggaccttgcgaccatgcgtgtgtctcccacgtgtggattcttgaagccagagtcttgcactgcgcgcaggatggagcctgtgcaactcctccctcgctgatcgcaggagtggaggatcaccactctttttaccttgctagcttggggtaccaccttgagctggggccggccttgctagcttggggtacgaccctttgagctggggctggccttactagcttggcgcgccacccttggagctggggtggcgcaaaatcacttgtatacggtctaaccaatacatttgaaaagcgatcaaaagcgaaatgatatcctgtgatttggaaagagaaaccttaacccaaatggctctctttagagcccgcagtgacaagacgccgacccacgccgggataccagcccctgatgaggtccgagagggagggtgcggccaaaaccgaaccaatcccgcggccccccgtggtaaggcggcagcgattcaaaggcaaaacggcataactattcctataaaagcctgcgctcaatccggcctagtccggacccagagggttcagcagtggtcagccgtggaggagtccgccttaaaagatgtggtggtgcgaaacacagacgaccgggggctcattaattgggccaaaggtgtgctccctgaatggcaaagattgtgccagctcaacccgaccatgtacatggctcgatcgtctccatcgctgtccaataagtgggcatctctgcggcggacccatgttggtcctggatgcccttcgaaagaaggctccgggccctcacaagacctttcagatgtaaaaatccaaccagccaggttggcccatgatacggtagccgagctacctcaacgtactgtcccttgcggcacagacggtcatggtgtaatcgattccgatgagatcgagattgccttagcagaggtatcccggtcgagtccctttgaagaacgcgagccgttcgacttaggggcgacagagaggatcacgcgtaagcggctgcgcaacgccgttcgcgatgtggttccacctcggaaacgcagggttccatccaccccttcacgtaaggaacaagatttggttccagaggtggacgggcctgcacctacggatgtgttgacacacccacccacagaatccgaaccagaaccgatgcttgacccactctcacttgtccaactggtaaggccgcaattaggccgggcaatgggatgggcagccgaggagatggaactcgggaatgtcgtgatggacgtggagctgaagagggagttcaaccgggaggtgaggcgtgtcggaagaacgcctcccgaccaaatgtataagcgtggcgcaggtccaccactcccacagaaacgagagcccgaacgagtagccctacttgagcaactcattgcggcgcgcgtggaacgtggcatcaacaggggacttgattggttccttgaactgaatgtcgcggtctttgcagccactagggttctgagccgccgggagagagtggaaactcttgctgatcggctgcacatcaacgattctgccactctgtccgaagtatccagacggcgagctaaagctgaaaggaaactccggtgtgcacgggaacaaccatggatgagcaggcggatcaggaaacttggtgtgagggtcgagagactcaaacaactagctgacctggtccggcaaagaatagctgggagaggtaatagatcgtcttacgaaggccctaggcggagattccgactaagaccctctttacgttctgttactgaagcacctgtcaatccaccccttaacgggaatgaagtttacacgttctggcacagcctttgggcgcagagcctccgtgctaacacggatgactgtcaattgaggaaattcaaaaaccagctttctgctgcgcgacacacggatctgacgagcgtcggaaccagctcattggttcagatgttcagcgcggcccttcggaaaatgaagaagggcaaagctcccggtcctgatggtatccgtgccgcgtggtggggagtgttccggcgaattgcaccgtatgtggctacgtgggtggtccgagtaatacgtggggcagaaccagtagctaactggatttgcaacgggctcactgtcctactgcccaagagtagtgacaatgccgaccctagtaattaccggccaattacatgcctaaatacctgctacaaactcttcactgccgttatcgcacaaataaccgcaagttacgttgatgttcttggtggcctacctagacaacaagtagcactgcgaaaaggcgtttggggcacctctgtgtccctgatgatcgatgcgctaacggtggctgacgcgagaaaagctaaacgcccacttggagtctgctggttcgacttcaagaaagcgtttgactcagtaccgcacaacttaattcgctggatcctgagagtcatcggactccccccggtcatcttgtctgtcattgtctctgtgatggatcaatgggcaacgaggctcaagataggtggaaaggtcatgcccaagaccatcccggtgcgaaccggcgtattccaaggggacaccctatcgcccctgctgttctgcctatcggtgtggccaatatcgttcgccctagaccaatttcctcagtatcagtttcgttgtgcaaaccatcttcagcagggctttagtgtcggacacgtgttttacatggacgacctgaaatgctattgcccagacagggaagtgttgacagcagttattcagcaggtgcagaagagcgcttctgccctcggtctgacgatccactacaagaaatctgcgtggctcgaccaggacggcgggaaaagtggcaaagccgtcttgggtgtaccagtacttgtcggcacttacaagtacctgggaatgcacgagagattcatgattgtaagcaaagacagtcttgagtcagtcaggggaaagttcatggggcggcttaaaaccctgtggacctcgaaactgacattcggacaggcaatgcttggcacaaagagcatctgcatgccagtcgtgcgctacgtgctgcagaatctattcctaccaaaatcggaattcaaccagacccgtctggtcctgagagagtgggatcgtcagatcagagacctactggatgaatgtaatatccggcaggttttccgaagcaagacggagttatatgtcagccgcgaagagggtggctggggtcttcctagcatggaagacgccctcgaggaagaggtagtcacaaaacttgccatacttgttgcaagacaagaaactgagccgttgttccgggtgtgtgaagctcttgaaaggaaaaggtgccccacccccctgtccctaggattgcaaatactgaaggactggggagttggggtagagttacagggccgcacattgctgctgaacgggaacacagtgggcccatctcaggcaaccagaaaactcactggagaactggtcctgaggagggaagcggaacggctcagtagatggagaagtaaagtgaaacctggctgtggcatgactggaggggcatggcgggatgtgcccggaatcgatgtccatcttagcaataggtggctcgtcaaaggtgcactgtctccgaccgttgtctcaaacagccttgccatacgagcaaacacggtgattctgagagggagtggcgggggctacaccaaaggtaccctcctccggtgcagaggatgtggtaacacgggagaaacacgcagacacattgtgtcagcatgctccctgggaaggcagaagggggctgcctcccgcaggcacgacaacgtctgcaggatattggtgcgagccatctgccacaaactcaacattgaaccgcccaactcagccaacttcccccatgtcgttgtgctggaaggcagtggtgctaagatgtggatagactttcccttcgtggtgccacataagatccgccacacacgacctgacatcgtcgtcttgtttgagtggaacggggtcagacgtcttagtgtcatcgaagtggctgttagcgatgtggcaaatatgcaaacacaacacatccgcaaatcccacagatatggcaccaactcgactgaacccttcgtcgcgggggtcacgcctacgtataggaatgactgcctggcagcgcagttgcgagcgaaatttaaagcccagcaagttgatgtgatcccgatcattgtcgggaccactggtgaaacattggatggcgagtttgggcggatccgaaagggtttgcctatgctcactaaactgcagatgccaaggctgtggtcagaaatccagcgggcggtgatcctcggatcatatcgaattttggttgaacatcttgcgctaccaaaggggggcgcttgaggactcanaattgacaatacacctcaga

SEQ ID NO: 931 - DNA, 1046 bp, Heterodera glycines
ttgagtggacggggtcagacggcttagtatcatagaagtggctgttagcgatgtggcaaatttgcagacacaacacatccgcaagctccacagatatggtaccaactcgactgaacccttcgtcgcgggagtcacacctacgtataggagtgactgcctagcagcgcagttgcgagcgaaattcagagcccaacaggtggatgtgatcccgatcacggtcgggaccactggtgaaacaatggagggagagtttgggcggatccgaaagggtttgcctatgctcactaaactgcagatgccaaggctgtggtcagaaatccagcgggcggtgatcctcggatcatatcgaattttggttgaacatcttgcgctacccgaaagggcgcttgaggactccaattgacatacacctcagaccaaattctggaatcgattcagaccccctcccctaaagggcctggtcagctcaacccaagtaactaaattgtgaaaaggtgcgtcctggggagggaaaggctacaggctttgggattcattggtgccaacctccggatggcggcttttcagtcggtccgaaggggaagcgccctcgtgatctgatatccaatgctgaaccagtgagggcccgcaatcactgggtagatactgtcggcagggccgataggtcttgcgcaacaaccgacgcgcacgaatggatcaacgagattcccactgtccctatctactatctagcgaaaccacagccaagggaacgggcttggcaaatttagcggggaaagaagaccctgttgagcttgactctagtctgactttgtgaagaatcatgagaggtgtagcataagtgggagccgcaaggcgccagtgaaataccactactttcatcgattccttacttaatcggtaaaacgggagtgcgcccgaaagggtgtccattttggtgttaagtcgggccacccggtggcccggcgacccgcgccgatgacagtgtcaggcggggagtttgactggggcggtacatctgtcaaagcgtaacgcaggtgtcctaa

SEQ ID NO: 932 - DNA, 6224 bp, Heterodera glycines
  misc_feature (60)..(60): n is a, c, g, or t
cccccccccccctcccaatgttcaaaaaagtttttttcgaaaaaaccagcgccacaaaanaacagtgatttaaaagcaaaaaatttataagattgttaatttatttaaaaaaacccagagttttagacagaaatttcaagatccccccgtgaaatgaaatttttaaacattttactcgaattcgtcccccaaaacgaaaatacaaaaatttatgggtacatttttgaatattggctattttcgtaacaaagtgtactcaattttcaaattaaaaaaaaaatttctcttgggaaaagggaaaaattttaaaattttagtgcattttgttaatagatttagtccaaaaacacaatattttacgattttaattgttaaaatgtgattgaattcccatcggaaaaaagaatatttttgaaaaatgagaagaaaaaataactacttggaggggaactgatccaacctccctctggaccacacatatgttaacaaaattgaataggacctaaaatttataaaaatataagtttaccaaaagccaatcattaggggtgtaaaacagtctcggtctcgagtctcgaaaatcgagtccgagattaaaaacccgagaccgaggctaaaaacccgagacttttctcgattcgggactcgagaccgagactctcggacatcactacccctgtggccaatgtccgttttttctactcatacaatttgcacctaatttaaaaatagccaacttttctgaaatttccttcttttccccttcaccggcaaccccctccccctcccccctcgtttagacatcgatttttgttgccctgatttcatggcagacaatgtcaaataaagcaataacaaaagtttggaaaaaaacaacaaatttttgtggaacagccgcggtattcagaccaaagttggcacaagggccgtgaaaatgttgctaagttggcagaaaaaagttcaggttggtttcagaaaaatgatcagcaacagatgtgacagcagcacagagagcgaatcgctggccaaaagcggcggatggatttattcggaatctctctgattgtatatataatttgtgagtcgctgtataaatgtcgaatgaatttgagaaaaactcggaatttttgctttgtgtttttaattgaagccattcagtcgaacatcactagattttggaaaatttgaatttttgtaatagtaaatggagaaaaaacagcggcaaaaagtgatcagaagcagaaaaaggttgctatggtgctactgcgagttgtgcggaagggaaacggtgggcatttgaatttggcacttaccgtatcgaccgattaaatactgtcggcatcctttgatggaaagaatttcagtcaaattgattttcaaatttatttttatttaaacgccctattatgcaaaatatttaaaaaccaagaaatttgatctcaccgcaacacaactggtaatttgcacattaattaacactattacgaatcgaatttgtttgttgagtgttctcattttagcatatttccccggaattcatccatggattttaaaatctaatgtaataattaacaaacacatttacgaacaattaaattttcaaattgcattcgcttttctgagtgaattcaccgactgagtaccgtccgtaaactgaaaaaaggtggtggaaatccgaggcttttttgctttttggacaaaattttttagattttaggcgtaacgggtgaaaaaagcattttttgggggaaatgatcaaattttggatttttgattcttaaaacggtaatagttaagatgatggtagcccctatttttggggtaaattttaaaactttaaaaagtcgttcaaagcaagtttctaggggttttcggggtttctgatcacgattctggcatccatttcgcccaatttcgacctcgaacccgaattcgaacaaaaagtagaaacttcaaatttcgtttttttcgtctgaaaaggatttaatgatcttttatttcaatatttgtggttttcagatgttccgtttatttaaatcatttttaggcgaaaaaagcaaaatttgaagtttcgactttttgttcgaataaaagtgatcagaagcagcagaagtgtgatcagaagcagaaaaaggttgctgtggtgcctccgcgagtcgtgcggaagggaaacggtgggaatttgaatttggcatttatttattatttatttggcattttatatatatcaatttatattttatgggacaagaaaaagaagaatatttcatgactgagtacagatctaaaacttttaatttctcagcgtaatcataaaaatcccaatttttgaggcgctttttcaaccaatttttatttaaaaagaaagaaaaaacttttaaaatgatcattttcaaattttcaaaaatgaatcaaataaaaaattgcggcaatttttgatttaaaattttaatgtttaaaactttccccattagtctccctcaattgacccctttttgtcccccattccccccactccctcctcacccattaacacgctctttctgttaaagatatctcccctctccccaagcacaagtgcactcacaatgcacccaaaataatcgaatccataattcccccccccccccccccccccattaattgtcaattggatgaccaaaaattatttagcaaaatttactaattgtaaaagtggaaattcttgcaggtatgaacggctctaaatctgacgaaactcgtgcgaaaattactgccgatgtggttgagcaaaaaataaaggtggtggacaaggaaaaacaacaaataaatgaaaacttatattttgcaggaatttcaacaaaaaaaacggcggaagaaaatgtaaattgtattcgaatttaattgattatttataaattgaaggccgagctgaaacgtcaaccatttgccacagaacagcgagtgctcaaactggacgtgaggaaattgttcataaatttaaaaggagcgaaaaaaagaataatttcgacaattatgaagaatgggggttggtcccatcttctcttttcttattttgggacaaaaacatgactcttgggcttttcggggtcactgatcacaaagcgggcacccatttcgacccattccgaacccctgatacgaactcgcacaagaagtcgaaaactcaacttcgaatttcatatttggtctaaaaatagttaaaatggttttttgaagcaacgataactttcgctttcgtttctatatgggaccgacccccattcttcattgttcgtgattgcgcaccacaatttcgtctcccttttacagaaagaactctggacgaaattgaaagagttgagaaaggacaccaaattggccatggaacaacaaaagttggcaaacgaattgcgcatttccaagttggaagcagaattggaacgacaaaaattcgaattcaaggaacgactcatgaagatggaaatcgaacgcgtaagttttattttaatttatttaaataattatgagaaaattgaatctaacaattgttttaacatttaaaatgatgtgaattaagttgaatgaacgactcatgaagaccggtggtacggtagcctatccccccttttccaactattacactttgttttttaggtgaaaaaaatgatgattgggtgattgaatgaaaatttgtgggagtatttttttaaattaattaattttttcatcgttttttccttttattaataaacagggctcagatttctggactagaaagacacgaaatattaaaaattatttcaacacgaaaaaccaatttttaatttctaataatttaaatttaaaatttgactaaattttctattttaataacagcatattttgatgaatgtttaagccaaaatatgagtcaaacgctccaaaaaattgttttaatgggcaaaaaatagaaattgggctctgtttatgtttttttaacttttcatcataattattaatttattttgttattttaattaattgtatggccgtaattctatttgtttttttaaatttcttatcttattattaattttttattttctttttaattgtttttttacgtttcaatttttttcattatttttctcgtattttttcgttaattaattttaatagtttatcacttttatcttatgttgttattaaaccgcttctaataaaaaacaagatcaatgaataaattttatcctttaatatagcatcaaattttttatttttcatctcccattattgattttaacaatgttggagagtaaattagcaaatcctatatttcaatgtaaatcgtaattgaaaaatcagatttttgacatttttttgcggcgcatttttccaaaatcattgacctatcaaaaaactacaaaatgaggctaaagcctcacatcagatctgggagccctgcttataaaggtatatgaatatgaaccaaatttaaggattttgctcgccaatgtttgcgctatatttgtcaaaatgcgtgccaattgttcggatcggacgaatttttgcagattgatcaaaacgtactttgtgaaattctcgacagagaccaattgttaatcagtgaagaactggaaatttggaaagtagtaattttaattaaaatataattaatatataaatgaatttgtttgatttaattaaggcactccgttgggccgacgaaaaatgccgtgaaaatgccattgaatgttctgctgaaaatcgtcgttctgcgcttggccgggcactgttcaaaattcgtttcccactcatcgtattagagacatttgggaaggaaattggtaggatctaatttatatgcgttgatttttagattaactttattatttattttagccatttttgccaaaataaaaggaaaaataaataaataaataaaataaacttttaattataaactagagcccggtgggagcgggagtttacgggagtcccgatcccgactcccgtacttttatgcccaacgggatttttacgggataaatatatagccaaaatttaaaaaaatttctcggcggcgcctatcggcaccacaggacccttaaaatccttaatttttttaaaaatttggctcaaatttgcaaaagttggtaatttttgggcaaaatctgacatgtattgtattcaaatattcaattttttcccgtcggcgcctatcggcacctccggcctccctcctccctggtcctgaaaaagttttttcaaaaaatacgccgcaaaaagttaattaaaattaataaagggagtagaaatataaagtttaaataaattatgaaaacaatttatttgaagcaatttgaaaaaattttctgattttcgacccaaaaatatgatttttttaatttcaaattctgcttattaaattttccgtatattttttctttagtaaaaggattatccttcaaattttatgcatttaaaatatttttgtgagtttttaattaccaattcaattaaataataaaattaaattaaaaaatcataattaaggaattgatggacccgaacaaaggcttttactaccaaagcgaggacaaagtgacattggccattgatgtcattgtgaaataagcaaaaactgaggacaaatgataaaaaatgtgcacttttccgattgtttggccatttttcggggttaatctcgaccccgaagctttcaaccccgacccttaccccccccccccccccctccaatgttccaaaaaagtttttttcgaaaaaacagcgccacaaaaacagtgatttaaaagcaaaaaatttataagattgttaatttatttaaaaaaacccagagttttagacagaaaatttcaagatccccccgtgaaatgaaaatttttaaacattttactcgaattcgtcccccaaaacgaaaatacaaaaatttatgggtacatttttgaatattggctattttcgtaacaaagtgtactcaattttcaaattaaaaaaaaaatttctcttgggaaaagggaaaaattttaaaattttagtgcattttgttaatagatttagtccaaaaacacaatattttacgattttaattgttaaaatgtgattgaattcccatcggtaaaaaaaatatttttgaaaaatgagaagaaaaaataactacttggaggggaactgatccaacctccctctggaccacacatatgttaacaaaagtgaataggacctaaaatttataaaaatat

SEQ ID NO: 933 - DNA, 3800 bp, Heterodera glycines
  misc_feature (1543)..(1543): n is a, c, g, or t
  misc_feature (1641)..(1641): n is a, c, g, or t
  misc_feature (2335)..(2335): n is a, c, g, or t
tgtatccgcccattacgcgcgtgtcaccgcccccccccccattattttgcccattttttcattgattgattttcaatcccaaaaaatcccatttttcaatggaattttattggaaaaaataaaaataaaaaacaaaaactaaaaaaataattattttttttttattttgggcaatatttgccatgcacatcattcttttttcgcgcacaaattgttctttttatggtccgttaatccacttgaaaatttataatgaaaatgaaggattaacacaaacaatgatttttttttattatttaatcattttattatttttatttttaataaacaaaataatttatattttaataaattaatttgttttaagttgttttatgaaaagaaaagaaaaataaaataaaattttcccttttttaatttttatttattgtaaatgaaattaatagtttctctttttttataatttgaatattattttttaaaacaaaatatttttgaaattttttattaaaattcccccttttttttaaattaaaaaaattataaaaaaatttttaaattcctttttgatttggaagaaaggaaattaaaaaaaaattccaaacctttttaaaataaaatttataaatttcttggaaaattttaattccgttataaaaaaaaggggaaaaaaaaaaaaaaaaaaaaaaaagattttttgaattttaaggggggttttaaaacttaaaaaaaaattttattcacttttttttaaatttttcaaaaaaaaaacccgggggggggaaattttaaaaaaaaaaatttttaaatatattttttcaaaaaataaaaactttttttaaaaagaaaaaaattttttggcgccccctttttttctcttttttttttttggcccaaaggtttggagagggggaaaattttttttttttttagggaaaaaaaaaaaaaaaccccctttttttttttttttttttcttttttttttttttaaaaaaaaaaaaaaaaatttaaaaaaaaacacaccaaaaaaggtgtgattcaaaaaaaaaaaaaaaagggtttgcttgtgtgcccccccccgggggttggtgggggaagaggggaaaacgggggggggaatatttttttttgggttcaaatatttttttcaaaaatttttaaaaaaaaattttattaaaaattttgggctcaaaaatcaaaataaaaaaaaaaaatttgtttttttttcttttttaaaacccaattttttcaaaattaaaaaaattttggaaaaatttttccctccccgtcactcgtttcccccccaaatgggtcaccttttcccctggaaaaatggctttttccctattcatatattctcttttaattattatatttttagggtaggaaatgggctttgtttttattctcggaaatttgtgttaaaagattaatgtgacaatttttatatttaaattaattatttattttggtagtcattcttttttgttgtgccattttaatttttgggtcctcaaatgtcgaccctaaaaagtttccgganccggaattagaatttttaaaattttcctttcaatttggaagcgtaatttttataattttttgcattactcgacctttacctcctaatcattttgtctnttagagaatatgcgagcaaaaataattttatttattttaatattttttaatttggccaaaattttcgtttgtttgccatacgaatgggaaatgaccaacagctcactgaaaaatgtgctcacatttgctaattttatggacgatctttttttggactacaaaaagaacgacaaaatgggttagttgagttcaaaagttaaccaagaaaattttgacgaagaaactttagtttatttttttaaaattgaaaataatttgctcaatttttataaaattcttcgtggattaatcaatctgaaatttagcaggctgaaatcccttacgttgacatattttcctgcaaaatttcaagcattctgaaaccaaaaaaagaatatttaaaaattaacgtgccaaaatccttgatttttagtgccaaaaaaccacagccctactgataaaataacagaaaattttctatttcgcagattgctcatattttgtagatatttactccttctttaatggttgtaaaaagaattttaaatcgatttaatttgatcttttgttccagcattgaatacggtaataaatttgacacaatttttcagattccgtcacaaatgaggcaccgtatcccagggacggatactgtgagaagcaaaagcggacagtgtttaatgtcacatttgttaaatgggccgccgaacttgcncatttccatggcaaaagcagtgaagaagaatatccgaattttaaattggtctctaaggaattattccgctatgaattcgttggatttgatggctttttctattttgaccaattgcttggccagcaaatcgccaacaaattcaaaaacgaatttttttctccccaaaatccgatggcaaacgttgtgaagaaccaaattttgcaacttaccttatcattggctgcgcgaattctcctctgtgtgatgttagtggtgaattataaatttatgaaaatgaatgaaataaaataatttttctgtataaatacgtaaattttgggaaaatatcaaatcgaaaaaattattgaaacatttatttgatttaaaatttgctattttctattaaatgattcggaaaataaatttatctttcgaattattataagcttaatttttagaatttttccatttcaaattattcaaattggagatggccagcatttgtggactcaatttttaagtccaactcaaaattgggtagaatacgatacggaacaacagcaatatattggtaaacttttgaatttttatcgaaaaattatatagcaaaatttgagtttttcaagagatggattcacagataaaaatgcataaattgaatttaacgaggattttgcaaaaatttaggcaattaactccacccccacaataaaaatgcataattatttttagacaattttaaatttatcctcaaactttctgagtttaaattgacatattatgaaatgtttaacgtggtcgacacaataatgaacagagaaaatgaaaaaaatggtcgaagtcagacatcaccagcaagagcactttacacatttataaagctgcattttgcttcattactaccgccaccatcattagcattatcattagcaaacggagcgctgcggaccaatcagccagggtcgggggcttttaggtttatgatttttaatgaaaacatcagaattaattaaggggattttaaaacattacaattaattagggggattttaagaccccgttttcaaaaagattattgccaaaaattcggatttaatattaattttctgataaagaatatccatgagctattgagtaatacgatgagatatttgacaagttatgaattttttatgtcacactttttgtttttataccccttggtggatttacgaaaggacctagcaccaaaaaaatccttaacaaaaaagcaacgaaaaatacacccctaagaaatgagccgaaaaatttccaaaacacacccataaaaattgagaaaattttccaaaaaatttctccataaaatataatttttaattcttcataaaaagtccttagtcaaaaaaaagctttaaaatatttaagaacccaaaatttagttttcaatttgattattacttgaattttttcaaaaaccccgtgcccgtgtacggaccccgtgtcatcg

SEQ ID NO: 934 - DNA, 1018 bp, Heterodera glycines
atatatatatatatattttatgtaaaattcagtgtgagtaatcgttgataaaaatggcttatgaataaaagcgagttgaagcattctttcctttttgatgatctcaagcattgtgcaaaaatactacatagtcctggtcaaaattttagaatccagaagtctggaaaaagtgatttgttaatcctgaaaaccggaccttggtcaaaattctcttattttttccggaattttttcaaaagtccgaactctacctctctctcattcgttaactgcaaaataatcgaatttttaatttaaagaatttttaaaaagaaagcaagcataaataaattcctgtttcaattagcaaatccaaaaaaggatcggttgatcatttctcaaataataatccattcattcattccgctgatcactgcttggccccgcggcactcgagcacacattttcgtggtgctaagtcgtttcgtaaaatccgccattttagcgaatttttcgagaaaacacggcataactttgcctaaaggcaaccaattttacattcttagtactattggatattctcgcattttctctatacatctgcaaagataatctttacatgatcaaaattaatataagactggaaaacaagcagacgatgttgcctcctacgtagttttatcaaatattttttgtttacgaaccttctaaaataccaattagaaacattgcataaattgatgagaataattatgaacactcacaatggtcccagtgaaagcaaaacgaacaggagtatatgacaaacatctaagcgacgaggacagtgagcgtacgcattgatacgaaccagtttttggagttgttaacgcgctcaaacgaatcaaatgcctcctgaagagcactgaaagcgaattaacagaattatcataactttcatcaatttaatatttcaatggaagaatttgaaagcctcgcgtgaatgttctgctccaatttttgtgcgaattgctccgccaactcgggaccgcccattttc

SEQ ID NO: 935 - DNA, 1396 bp, Heterodera glycines
tattaacgctttttagttaaatctaaaaacttaagaacatttaattttggttatttttaatataaatgaagttattaatcattttaaagggtttttgaaaaaagttaaattttaaaccaaaaatttttatcaagaaaaataattaaattttggggatcaatttgtgaaagtttttttgattcttaggggtgtattttctgaaaatttttcgggtcgtttcttagggatgtatttttcgcttttattgcattcttgttaaggtttttttttgaaaatcctaaaataggcacattaggcataaaaaccccgaaataggcaaagctttgatgcttctacgttgacttttatatatatgtgtccgaatactgatttggcttcattttgttgatttatgggtaaaattttacgcttttagcctctaaattttaggtttacatcgcccgctgaaaaaaagaaaaaattttcctccgccgaccattgcctaatttcatctgccaaaattggtgaaaatcagcaacaatcgttgggttcatcatttgagacaacatttggagaagaacagaaaaagaaaatgaatgatcgaattttgaagaggaaaatgtgagacaaatttaaataattaattaataaaaaattttatggttagggttaatcccttcggactcaatcctaaaaggctcccccaccggtgtactcaaagccaaaaaaacgtaatgagggtacctttttggattttcattcaaaaattatttcccaaccatgaaaaaatgggttaattaatggccgtacatacaagattaatttcttagcatttctgttctgctacaggccaaaactatggaaaacccgaaacatatgctttgtatgtaatcgcgcagggaggggggtaaaaaggccataattacgtacccataaactaattaacaaaatttcattctttcagttggatttgcagcgatgttttgatggacattctgcccttttttgaccactttaaactcggcctcaaattggcactgatttctgaccgtttcgacattttagtggacacacattttgatggcaaatcagaattgacaatttggaggccaatcacaattcgcaagggccctgagccagacttatttgactgtggttccaactctgtgccgtttccgtcgcctgatgacagtccgctgcaactttttgtgaagggcaaatctgagggatttccattgccgcaccgtccgctgcccagcaaaatgcactttaaatgccttcaaattaagtaaattatcaatgaacatttcattagcttagctgataaaaagcggaagcacccccaaaaacgttgccggaaaactttttggaccataattttgttcaatgtgaatcaaattaagaattgttggtgttg

SEQ ID NO: 936 - DNA, 1953 bp, Heterodera glycines
  misc_feature (74)..(74): n is a, c, g, or t
tccgagcaaagatgccaacccaagcgatgtgtccccaaacagacgacgaaaacttcgagtggatcaacatttcnaaggaggtgtcgccatgttttttgagattttattcttgattctacattatcttattagcatgcactgatgtgattttggttaagacatggaaattcgttgaaaaaaaaatctcgcgatttatcgcattgcgagtttgcttcacctggaaacaagacaaaatttcgcccgtcaaaattttgccgggaaaacattttaaaaatataatatttaaaaattttttaagcgatttttttttgtttgaaatttatgatgaattagtaagtttttttgaaaattttttctaaaattttttcctcggaatttcatataaaaaactcaccttttcttaggttttcggggttgctgatcacgagtacggcggtatccatttcgaccaattccgaataccggatccgaaatcgaacaaaaaaaaatagaaaatttaacttttagaattttatatctttagtctaaaaatggtcctggattcggaattagtcgaaatggatgccggatccgtggtctgtgacctcaaaacccttagaaatatgtttccatgacttttgtaaatataaaaaaattttcgaaaaatttatgggggacaacctataatagagccaaatttctaagattattttcttaaagtttttaaatttgaaaattaaaaaaaaagtctcggccggctaaatttcgttcgtctcactgttcaggcatttctccgtgccaccactttggccgcttacactgttcaattttcattggctgatacaacgccaattgtgccatttgaattggtgaacgaacggacccaagaaaagctgacattgatgtacatcataattgaacatgcggattataatggctggcagctgaagcgatgcccaattagtgaaaaggcggcggatcaatgggaagacgaaattttggacgatttgaatggtgtgagcattgatttgcatgagcactttgacattgggtgagcaacgacggcattttttgcaacttttgtcaaatccaattcaaaaattatggcactcattttaggcaattgtctcctccaccagcaacagcaacagaagaagaagaagaagcggaccaaagcaattgaaaggtcggcgggagacaatgaccaacccgaaagatatcccttagaattttttatctggtagctgaaaaattttaaaaactttaattattaaatttatgtccaaaaatattcgtaaaaagcaagccgcttaaactgggaaatgccagtccatttttgacattggagccctctttgtccgggatgcgcaattattccgatttcgggtgttccaggcccggcccaacaaatttcggaattcctttacatcattgggccgggttcagtttccgatttcctgctcctgaatttttgaattttccaaaattcccttaggtcgtctgatgaattgagggccgccctttgatcaacggaaaagaagtgaattatttgaaaaaatgtccgatcattttgaatcacactattaatggatgggaattgatttgttgctctttttctcgctgaaatgattacttttatttatttaaatgaatattttttcctttgatttgatggattttcattcgaaattcaccataaatttctaaaaattttctaatatgaataatcgaattttgcttaatttatacatttttaagcgaatttaattgaattttcaatggcatcgcccgtcgaaaaaaagaaaaaattttcctccgccgaccattgcttaaattcatctgccaaaattggtgaaaatcagcagcaatcgttgggttcatcatttgagacagcatttggagaaaagaaaatggaaaatcgaaatttgaagaggaaaatgtgagacaaatgataattaattaatgtgaatttta

SEQ ID NO: 937 - DNA, 2020 bp, Heterodera glycines
attatttttttttttgagattttcagcagttttttttgaaattttatgataactttcataaacttttcacgaaacaacttaacatattttttccttgaaaaatttctgtttggaattttttttttttaattattgctaccagattccggagtttgacattattgggaatgcaatatgtaccatttatcacatacattgatcactccgcgctcactatttcaccgctccaatcactactatttgcgacaggacaggcatgaggttaccctggttgtctgcgcctgctgcctcatttgaagctaatgtccagccaatttgggatgtttttgcccgcgaaatttggcccatttttgcgccaaacattcgccacttgctcttgaccgttcgcgatcatttggacaatttgcgtcgctgcacttcgccaacaattctcaccgatctcatcaatttgaattcaatctgttctttttgtctgcgccctgatggaattgccgattttgatgggccaaatttaaatgctggccaagcgttggccaaatggttgcacattccgcgcactgatggccaaccgaagcgattgcgtttttgcaaagatttggaggaacaacataatttcgattgggtcaacagtttcaaagaggtggccataataattatttttgcgaaaatttgccatttgatttgatcaatttggctttttgtttaggcatttctccgtgccaccactttggccgccgcttacattgttcaatttccattggctcctacaacgccaattgtgccattcgaattggtgaatgaacggacccaagaaaagctgacactgatgaacgtgatcagaattggaagtgttaatggttggcagctgaagcgatgcccaattagtgaaaaggcggcgcttcaatgggaattccatattttggacgatttgaataatttgagcatttatttgcataatcacaatcaaattgggtgagcgacgacggcacttttgctgcttatcgaatattttgaatctctgctgatggatggatttgataattaatgttcttttttttctttaaaatgattaaacttttgtcgattttttctttcgatttgacggatttttattcgaaaattcaccttaaatttatttaaaaaaaaatattatttggtcggattaaacagtaatttgcatctgttgtatatttttacatgcacaatttgacttagttttttttgattatctacagcaaatttcattgggttcttttgtgacatcatttgatgaacagcaaagaagaaaatgattaatcgaattttgataaaaattcataataattttatttgttaagcgaatttaactgaattttcaatggcatcgcccgccaaaaaaaagaaaaaattttcttccgccgaccatttcttaatttcttcaattagtgaaaatcagcagcaatcattgtcgggttcatcatttgagacagcatttggagaagaacagaagcagaaaatggaaaagcgaattttgaagaggaaaatgtgagaaaaaatattattaaatttaaagttaatttaacacagtgttatggccataacatacatcacaacatgggaaaagcggataaaattctaacgtattaaaaaacatgggttttccaaaggcaggccaagatcccggcgcaggattttgttgggttccaccagtccgttttttaaaagaaaatgatggaaaagcgaattttgaggaggaaaatgtgagacaaatgataattaattaatgtgaattttatgattaaggttaaatgattttcggactcaaatctaaaaaaagatcccaccggtgtactgtatttggggggggggggataccctcttgagattgaacttggaaaacatcattacatcaaccgttgaaaaaaaataaaataatttattaaactcattgaaaatttttttaacaaattttcagttggatttgtaacgatgtttggatggacattttccccctttttcgccgtccccaactcggcctcaa

SEQ ID NO: 938 - DNA, 4991 bp, Heterodera glycines
tttggcccatttttgcgccaaacattcgccatttcactttcaaagatggcgatcatttggacaatttgcgtcgtctcatctcaccgacaattctcactgattgccatcaactgaattcaatcaactccaattaccttttgcccgatttgaacgctaatgatgggccaaatttaaatgctggccaagctttgtccaaatggttgcacactccgcgcactgatggccaaccgaagcgattgcgttgttacgaagagttgaacggaccgtcaaacatcgattgggtcaacagtttcaaagaggtgtgtggccacataatcggggcaaattttttaaaattcacacaaataaaaaaatttaaaacttttttaaggttaaattaaatttttgaaaatttcctatccatatgccctgcggcatttgtcgtttgatttgatcaatttggctttttgtttaggtcagggctcccatccgtccttgaatggcaaggacgtccttgaaattgggccctctttcttgaaaataaaaaatgtccttggatgccaaggacgtccttgaaaatgaacatttagaaaagttttaaaaaaattcaaagaaatttgagaaatctttgtaattttcaacgatattttgattatattatggcattatgtaaataaaatgcaaattttcaaattttctcatgcttgtgaatgaatttgttacgcaatttttcgcgtttgcgacataatttatattttagaatgttcccaaataagcgcaaatgttctttcaatcccgattgggaaaagcaatatacttttgtcaaaagaagccgaaaagggaatggatttttttattgtgctttttgccaaaaagacatcaatgtcgagtcgatgggagtttcggccataaagtcgcacacggaaaacaaagaacataagcaaattaaagaggaacggcgtaaaagcacaacaattgagaattttgttcgatccaaatcgacgcttaattcaattgaccttcaagttgcaacggctgagggtcatttttaatcttttttaagtgtaaaaatttgtttttaggcacttttgcttaccatgtgtgtaattttaaccatttttcattgcatataataaaaattttaaatgtccttggatttcatgaattttccccactatgtccttgaaaatcggcatacccgtccttggaaacggaggatggacgatgggagccctgctctatttcatcattactttctatatctctcgaattcataaaatgttaagacataaattatttatttatgcattttatataggatatgaatatgctcaatgataaaatgaaagttgaaattaattgcttgaactttatgggtttaattaataagattaatttggttatttttatgtgcgatgccactttaaaagtgtgctttttgaatacatcaaaaataaaacaatagggggaaccttttggtctgcaaaattttttgtatatagttgtaaattattccctgggcgtttttgggtccctgatcacgaatcttgcaattattttgaccaattccgatttcctaatataaattaaaacaagaattcgaaaaattcaaaagtttgatttttcaaaattcaaaaaagacccgccaaataaatttgaactttctaaacttttgtccacatgtggacaaatgaaacgaacggaacggaggggagaaaagaagagatagagagagacagagagagagagagagagagagagagcaccgaagacagagaaggaaagagcaaagagggagcagaggaagagaaaaagagcgcaagagaatgtggagacagagaaaacagacaaatcttttgcgactgaaacgcaaattttgaaaaatttggataaaaaagaggcgggcggggaaatgtacgattggggaagagataatggaaaaagcacaaagcaatgggaaaaaataaggacattgaataaaagaattcatttaaaaatgtgtaaaaaatttaataaaaatgggctggttaattattttaatgtatatttttctatttttatgcatattttgtgcattttccattgttgtgcacttgcattcggttgccaaaatcatacgggcacagattgaaagagacaacgcaccttaaaaaatggtaaaaaagcgaaagggaaaaaggaaatgaggaaaaggcattttgagattcagattttagaattttgtgattaggtaaactcaaatttcatttacaaaaagtgtaaaaaactccttttatgggcatgtccgttcaatcgtttcctttctaaattttctttggctcgttcattaattaccatttcccggcgttttgtctttgtcgttttcatcctttccattcttaaatgtctccccccccccctttatgcattgtttccttctccaggccacggcaacgtgacaaaatcaatgccatcctcgccagctgtcaattaagcgcacgtcaattcatcacaccaatgaacacaccattttttcatcaataaatggttgaatatgcaagggcagtcactcaaaaattcgtgaactttctgttcaatcccttgtgattttgctttcattttgtgccttttttggaaaagaataaaaaaggctttttccgccgctttccctttgtctaatgtcagggccattcaaaggagccgggaggggggggaactgcccactcggcgccgggaggcaatgcaagggtgatcagatcatttactgatcactgctgatcggcggattatttccatttccagtttagtttttctttctttgcactttctcttttcttttttgtccttttctttttctccattttttccgttgctttacttaattttttcaccttaaacattttaatactttcccaataattaacaataacttattttattcattgtttcctttatttttattgtacgttcaactgagtaaaatggtttttcgtttcttgttttgcttgttttgaccgtgactgtaatgaaaaatttagagagagagagagtgagagagagagagagaagagttgggatggcgagggagaaacgtagaaaaatagcgaaaaatagggataaagaaaggcattcatcagcagacgtaaataaattgttcttctttctgtctgtgggcagcatagcatttctgttatgtgaattggaagttttttttctaatttatattttttttatataatttattcattaataatttcgcccattttgaaggctatgtgaacgagggtgacacgcagaagaactaattaagaattgccaatcggccggtgacaacgtgttctctatcctttaagctaatattttctatatattttttaattgtttgattttacctgatttgcttcaactccaaatgagttgtccacactgaatttgctttgaataacagaaaaatattataaaaaaaagaaacaagaaaaatcttttttaaattaaaggtgaagggcgtctagcagccgttggttgccattcttgacgtgactatgtacggtgtggaagtgcctggccgagatggacggcgggaatgatcgtactaacattggtggagggcaatatttattagatagattattataaaaacaatttttgtttttttttaattctaacgttatgccaggcactcattgaccaactgtccgcccgtctcaatgaccatttggcattgtacgctgtgccggtgttcatgcgcatctgtgatcaggtggaccggaccggcacgtttaagctgaagaaaaccgttctacaacaagaatgtgctttggccgattaagaaaaaagaaatgcttgacaaattatttatttaaaataactttaaattaaaaaaaatattattgaaagtattaaagaattttttgatttccataaagcacaaaaaaagtattgcgcatattcattaaaacttaaattccaaatgaactccaaacttttaattgaataaatttaatttaggcgggccgcaaaaagtacgtacgagccgctgactggagaaatgcagtcgcgcatcgataatggcacgtacttcaatttgatgccgattattggctggcattttccgatcagtggtggcggtgtttgatgatttaaaaactctgatcagtgttaattacactgatcaaaataacatttttatgtttaattgaaaatgacattttcacttaacaatttaattttaaaacctaaccttccattttttcttttccctcgcaaattttttacgctgctcaatgaattttgtgtggacaacagagagcaaaaccaatttgccataattgtatgcctaattcattcatatacaatataaataaattatgaattgtttttaatgctagaaattttgatggatttactagggttataaatttaaaaaagtgaataatttattattgatgagagaaagaataaaaaaggctttttccgccgctttccctttgtctaatgtcagggccattcaaaggagccgggaaaggggggaactgcccactcggcgccgggaggcaatgcaagggtgatcagatcatttactgatcactgctgatcggcggattatttccatttccagtttagtttttctttctttgcactttctcttttcttttttgtccttttctttttctccattttttccgttgctttacttaattttttcaccttaaacctagatttcacatatcaatatatcgcagtaaattatattagtacttctttgcgctgatcgtgcatgcaaatcggtgaaatatcacgctaattaatttatttttttttgatatttttttaagatgtttcccaccatctcaagattcacttacggagaaggaatgtcaattgcctttggggttgttgtcataatcatatgattatattggatttataggtatcccatggaacgcaagtccgcacagggatagtattcgctcatagtgatgtgagaagtcatccatagcaatcagcagtaaaatgttataaattatcaataa

SEQ ID NO: 939 - DNA, 2003 bp, Heterodera glycines
gatcaaaataacatttttatgtttaattgaaaatgacattttcacttaacaatttaattttaaaacctaaccttccattttttcttttccctcgcaaattttttacgctgctcaatgaattttgtgtggacaacagagagcaaaaccaatttgccataattgtatgcctaattcattcatatacaatataaataaattatgaattgtttttaatgctagaaattttgatggatttactagggttataaatttaaaaaagtgaataatttattattgatgagagaattttgcgtacattaaatttatttagtcaggtaaaaaatttattttatgaaaatgcaaggaaaaaactttgaaataagattaatgaactttttctgctcacttattttcaaatttacaattagcacgatacaaatgcataaagggggggggggagagacatttaagaatggaaaggatgaaaacgacaaagacaaaacgccgggaaatggtaattaatgaacgagccaaagaaaatttagaaaggaaacgattgaacggacatgcccataaaaggagttttttacactttttgtaaatgaaatttgagtttacctaatcacaaaattctaaaatctgaatctcaaaatgccttttcctcatttcctttttccctttcgcttttttaccatttttaaaaatttatgctcaaattatgaaaataattcaaaaaatccatcattcgccgtcgccaagggcggcaaatgtttctgcactgccgcactgtgtaagaacagctcatgcggcgcaatcaatgccaccttcttgacaaaaaaataaaacaaattttttttagataaattgctacttaccttctccctggaatactattagattcatttcgtccatctggggtttttgcttagtgccaatgattttgatcacaaaaactacagacatggctacaattaggatgaccattaatttgagcataaatatgacgttgttgttgttgttgttgttgttgttgttgttgttgttgttgttgttgttgttgtttttaatgttgtcctgaagattatttttgactaataattcattaattaaatctagcattttaatgtgataactttgattcattttaatttatgaagttagggtacggaatggcagttttgtaaatgcgatagtactaaggaattaattataaataaataataaatgagcaattaattctgtgctcgatcttttgtaaaaactgtcaaatgggagttttttaataatattctgcgtctgtaatcaaaagtcgattaatcacacatagcagacaaaaagctatataggcataaatgattaaagagatgagaaaatcaaattaaatattttatttttttaaagtaaattaaaattaaacaaattaaaattattcaaaaccaagaaaaaacaaaaatttctttttggcattaatattgattctaccagtataattagctttatcccacctttatctgaatgtttataatttaatttaaatatatatttataaatacataaatttaatgatgtgaaaatcattttaggcattgatttatattgtatagaaaaagatttgaaaatttaaagaatctgaccaagaccaaggattgtcctttcatctaaaacctgtcatttgtcttgtttcgatgaccaaaataacttattttagacatttacatttttggaaaaggttggaaaaggcaaatttcaattagcaaaatagaatgtgatcaatattatgaatagaaattgtttattaaatttaaatgacttttttttactgattctaaattgcggtctgacattttacggacagctattctggtttgaattaaagtgccattatatttttatacgttccgagacaagcagttaagtgcgaatgtaaatctgaaaagtatatataaaactttcctaaaaatttcgtttcacgtccgcttgggctacgaaaaaccggttagttaggggtgagtgatctaataaat

SEQ ID NO: 940 - DNA, 3283 bp, Heterodera glycines
ttcctgaaggattaaatggttaattagataattcctttatttttgacgaccttcttgcaaccattaattatctaattaaccatttaattccttcaggaatggcacggcccaattaggtaaaattgtcagaatgtttagctgaaaataacccattgttcttagatgcgatcttttatcaaaatgggaaaatgaagcaattgatgatgccacaaaagaatggatccaaaagaacaccgtgccctcgttgcaaagtttcgaaatacaaaaatttgaaatttttagttaatgtagatcgaaattgagattaactatggctgcccccaaatgaagtgtcaacattgtgggtaccagttctgctgggtctgctcaaaaacctggtcgccacatggtaattaaaaaatacgtgcattgtccttttttccccaaaccggtggcctttgtgatggaccagagccaaaaaagcaggggttggagcagaaatcggcggaggaatttaagcgctatgaaaaacaccacgattcctacacacagcaaaaaaacaaaattacagcagaagaggaagtaaaaaaacgcataattatgaaaaacaaaaacttttcttttgcaggttggcaaaagaatatacgactatatcaaaaaacttggtgggtttctttttgaaaaatatttaccaaaattacctaaatttaaagatagtaaatcgaaagaagcagcattggttttgcaggaggcactcgaaaagctgctcgaaggccggaaaacactgaaatatacgtaagcggaacaaattgcttattttgatgagtggttccaaagacggtcctttttggaattgatttgtcaagtttttaaattgtttcgaaaggccccaaattgcaaaaatttggatttgggattttgggtcaagatttatttaaattaccgagttaaaatttaaaagttgcccattttttgggaaattttgtttcaatttcgggggcagtgccccaccctccttcccctgggtagagcatgcccctgtttgcattgtctaaatccttttcttaaaatttgttttagtgtcggtgaatttttccataatcacataaacacttttagttacgtattttcattttgtcacattgacgaaaaaaatgatgaattccacaacgcccaatcagttcttgaaaagtcggtaaaagcggtatgcctatgatgtttgaaattttcgttagttttattcatatgtatagttgagtgagcgcttgacgaacatggattttgcaaaagtcggcaacgccatttcggacgtactcttttttttttaatttctagttttattattttagctcaaagaattgtgccagaaatttgaggcagagaaaagagcattgattgatttatgtgacgaaaaaacagttaaagagatgatcgctgaaaaagggccgacggaaaatgaaacgggcacatctgctggcttatgaaaaagcaaagtgaggaaaaagaaacgaggtggagaagcggtgaaagttacaatatttattccataaaacagcacccagtgccttcatttatttattttattgttttggctatacaatcttcaattcatgcgggcttttccatttacaaaacattccataatattcgacacacacccatttcatttgttttcttttattttaaactactttatttgaatcaaaattgttctttttttccatttggttagaagtcctgaaaatacgtatccgggggttctcgaggtcgtcatttcgaccaatttgggatcccagaccagaattataacaaaaagtcaaaaattctcaatatttctctaaatttatttttaaaaaaccaaaagtagtcaaattctcttttttttttttttgcttttcaaaaccgctttttttgcggcgcgctttttccaaaaaacttttggagaactgggggttccggcggtgccgataggcgccgccagaaaaatttttgaaaattggagtgcaatttgttaaaaatcatataagaaaaatgaagtcctatttgataaaaaaaaatacgaaatattactcaatttcgtaaaatttttcaattttttatataaaaatggctaaatttaagagtattttgttaaattatttaaattctcttcgtctttacgaagtcgcctctctcttttcccttcgtctccgacccttccccagattttttcactagccccccccttttttcggcccctcatacgaacgaagtcagagggggtcgactcccccccccccatttaaggtatgccgttgggtttcggaatcaaattttgtaggtgggtagagcacccagggtttttaagaaaagtggtttcaatttctgcgaaatgattcccatgccgagttattaaatgccaatttttttaatgaataaacaaataaaataaatatatgaacactttaacactgtccattagtgtagaggtagtgtgctggtctcggttttctttttttttaatcgaacaaaccacaaggtgctatgcactctaacagttgcgtaaaacaaaataaatgaaacgaaaataaaatataaatggtagtcaaaaatcacaaaaataagtgtcaaatcacaaaataggtgtcaaattaaacaaacaatagacataaatgaaacaaatcacacctttcaatagcgaaaatatgcattattgcttaattattccttttgcaatttctctgaattttttggggtcatttatttccataatatttttcggtaataaattccattaattaataaccctattaaaaaaaattattttttgtttttgtaatatatatcctattttgtaataaaaagggtttgcgaatagcccgttagcaacagcaaaaaagttagatggtttaagatgtgtatgtttttttaggattttaaaagtagttgtaatatcattgattttacgtctaatttccaatgtcttaattccgcaaagatttaatctttcttcatacggcatgggaacaagcccacattttttgaaggcttttcttgtaaaaaattttttgaactgcttcaattttgcggatatttttttttaatggattccaaatttctgtggcgtattctaactgtggtctgatatagcttttatatgctgaaattaatgtttcgagcttccgagtttttaacgctctgagaagctgaaaaaaagaaaaatatgaattttttaaaatttttttaatatggttagaagaaggataatttttgatcgattaagatacccaaatcccttacacattttgtttctggcaatgtttcg

SEQ ID NO: 941 - DNA, 6019 bp, Heterodera glycines
aatccattaattaattaattaattgttcgcctctcacatcgatttccaccatggcgcccctggccacatggtattccgccaaatgcttctccatcacttccatttgggtggtcaaacaatatttgtacgcatcttcggcaacgtcctaaacaataaaaattaaataaaacggagtccgaaaattcaatttttactatgaaacaaatacttaaaaccgaccaatttgcccattcgcgtgtaaacgtcggccaaacgcaacgaattttcgataacttccggggaaaggccggacgaacggtgcaaagtgaggtatctggagagggaaggaccaattaatttactgttcaaatcgtataattcatttcgtcagttaaaaataaaaatttttttttgataaaaattttaaattttcgataggaatgtttctcttctttcaccttccgtgcagcagtttcagtaaatgctccgcgttctccaattggcccgactcccaaaaggtggtggccaattcgtaatacatccgtgacacgaaaatttcattgcccaactcgaccgcctcgttcaacgcctcgttgagcacctaaaagctttttaaaattaaatttaaaaaaactgtttgctttaatgaatgtttctgtcggttggcggacgacgccttggaattttgttttgaaataaagtaaaaataaaaaattgaattttaaaattcaaaaaagtaaccaggtagaggttgctctttgaaaattatgaagcatttagattattttacgtcatgcaacaaacctgaaatcccacttttcatttaaaaagtttagaagatggatgacatgaagggagcagctcgtttccccctgccggttccccccccccccctccattgcccgtctcccccggaaatttaaaaaaaatttaaatttattgttaaaaatttttcaaagagaattcgtagggcccccgaaatgaaactcgtccctccccctttccatcgggaccctccctggatttagtagatttttacccataaatttatacatccctttcctcccattcccttttaatttatacgtcccctttcctcctcccccttttttggccacctgaacagccgccgcccattcgccgtactttcggtgcagcatcgcccgcttcactttgtccttcagcgggtcgtcgtccagcacgtcggttcggttgaagctgaacaactgtttgatgctgaacgccatcagaacgacggcaccgccacggccaaagggaaacaaacggcgcaaaaaggcggagaagcgggccgagaaagtgccatggtggtggtggtaattgtgctgtttttgacgagaacggacgtcaaagaggcggaggggcaactgtcaaaaggagggagaagagaatgaaatgggaaaaaagtcaaaaattgaacctaataaaaggcatttgatcattgaatttaaatgcaaaatttggaccgcattttaaggtaaaaaaactgccaaaatatagttatgacctataagaaaaagccatcgccaaagatcactaatgggaaaataggacaattcccaattcgatgtatatttgatttcgtttttgcattttttcaccgattgtccggcgacggccgcgcgttggcacaaaaatgcggcgacgggagacggaaaagaaacgagcgaaggatgggcgaacagaggaacagaacaaacggaagaagaagagacggagcagcagcaaaaggggggccaaaggcggggcaaaagaaacgatttcaagggagacaaaggcaaacggacaacgaaattcatcggaaaaagcgaagaaaaaggcaaattaatggacgaatccaaagaaaaatgatcaaaaaaatagggggaaaaaaccgttcaaaacgaaaaaagaaaacaggaacattaaatccgaattttattccctacaaatacaccggcagtgaaatgcacacaaaaacattgaaacaaataaaataataataaaagtaaaaaagcaatgaccataaaaacgaagccccgtttccgtcctttgcttattcgatttgatttttcggtgcaaaacttgcaccacatgagcagcccaaagtggccaggggattgtcctgaaatggatgacaaaaattaataatttttgttatagtgaagtaaaattgctaggaaatgcctggaaggccaaaaaaaaattggaaatgagtcaggcctcaattcttagaaaataaaccagaaaattttgaggatttttaagtcaaatccagtgataccaattaattttcggcctaaaatcccttttttaacctccctctttggttattttaagggatggaataatgctttttcggcccccatggtttgtaatcgccacttcctcaactgaccgttattctgaacgcggaccgcatcaaatcctcagcaaaatcaagctttgagccccgcaaaaattgaagcgataactaagcggataaaaattttaaaaataattcgtcaaaagacggtttttcaaaacttgcacgaaaccttgtccacaacaacgatggctccctccgacgctttaatcacttcgtcctccgcctcgtccaatcgcttgtcgagcgtcaatttgtactcgaaaccggaacagccgcccgagtcgacacaaatgcgcaaatgctcacccggggcggcgatgcgacggagctaaaatgaaaataaaaatgaaatgggttatgaaatagaaactttttggtttctttttttaatgtttggtaaggcactgtctctttcaaaaagaattttcaaatctgatggcctgagtaaatttgttcaaaatttaaaggccgttaaatttccgagcaaagtatcaaccaggacacacaaagaaagcaagaaaatctcatcccaattcgtcaaaaaaaagtcacgattatttaagcaatggattttcaacttggtccgctgccctttgtgtgataatgagcagaggggtggaagaaacgcttgatgaagcggtggaaggggacgatgaaaatggggaggaaaatggcgagtaggaggaagggaaaagtcggaggaaacgcgattttgatgaaagacggacgacaaaattcataattctaaaagcaaaaaagcgcaataattgtaattttaagtttttaagcttttaacacaccgcaaggaaaaaatttcttttcttctctttgttggcgtttttttcatgtcttttacatatgaaaaaaaatgaaatttgcaaatgcaaataggtacctaattttggtcgtaatggtacaaaatcaaatttgaaagctcataattttctaattatgcgtctttttgcttagcattttctttaaaaattcttacttttaaaaagttttaaatgaaatacatatataatgatttatttagttgtgataaaagtaagatatggctaatcagtgatcaaaataaacaacacaaaaaaacggaacccgtcagttgggcgccggcacgtttgggcgccagcatttttttggttacaacttttttctttgtcaaccaaatccaatattgttggtatcattcgaaagccctaagtgtcttctattagcatgccaaattttgaaaaatttcattaaggttcaaaaaagttatggtcagaagaatttaaaaagccaaattttccaacttttttggcttgaactttttttaaacataacgaaaatttttagatttttgcaggttaatagagcatgcgaagggctctcgaataataccaagattgttgaatttggttgacaaagaaaaaagttatagttttattatcattcgatagctcttgagattctctattagcctgcaaaatttcaaaaaatttcatccgtttacaaaaaagttatggccaaaaaacctcaaaaattgactttttcttggctttttcggcgccgcgtgccataacttttttattgttgaatcattaatttctattttggcatgtaaatatagagcacacatagagctttcaaatgatgccagaatggctaaagttgactgacaaataaaaaagttatagcatttcaaaatttgcggcgccgaaatggtccgcgccgaagtgaccccgacccaaaaaaactaatcagggattttttgaattagcgctcatataaaaatggcgttaaaacaatttccttaacattgaaatgcgacgcaaaagaatacatataaaagagaggtttttattcagtccttaattcattcgcattattaaaaattttttgtccaattacaattaaaatgacaacatttattctatttaaatttttgtcaaattatattagctctaccgaacacatatatacatattatacaataatccatctctgcaaacacattgtttcaatggcccgcagatcgaatgccaccggcacgaggaagccgcaccgttaccgtccaggtacagtaacactgcactcatcatctgctgaccccaaatgctcactaatcccatctctccccatatttaggcaccgttgcccgtcgcgagattcgccgttaccagagcaccactgaacttctgctgcgcaagttgccgttccagcgtttggtgcgcgaaattgcacaggacaacaacttggagatgcgctttcaggcggtggcctttgcagctctgcaggcaagcaaaagcttgttgtttaatcattttactaatttggcatccatttcaggaggcttccgaagcttatttggttcgacttttggagaacaccaatttggctgccgcgaacgcaaaccgtgtgaccatcatgccgtccgacattcaaatgtcccgtcacatccgcggagagaccctctgaagagccgaagcgagaaaacggagatgcgcaagaactattgggaaatcgaatgtgatcatgatcatatcctataattattgaatgtttgtaaatatacatataatcattcgtatgtgaatttattgtatgattaaagaatgtgctattattttgagtctatggcaattcaaacaaagtttacagacccgggattttgttattccttggttttactggattcctacaaaagaaaaaaaggcaagaagggggttgagcggttttttggagtttttgagggcgctgatcacgaatatatgacactaattcaatcaatttcgagcccctaattcgaacaattaacattgactgttgctggagggtgttggccatttgaatgctacatcatcgacccaatcacccacagaagattctgaccacccgatctccattttttaaattagctttttttcaattcgcggtcactgaccagcgcctccgaaagcacaaagatcacaaaccctccccttttttgcctcttttgtcggactaaaatcgatgattaccaatttttgactttcacaggggagtgagtagccttccgattagcaaaaagtggtccatccccaatttctttccctggtggaatgaccatgtacagcagcagaagtgaactgcctccagcagacatttattaatcgcgagcatcagaatggacaattacaatacaataacataggccaacaataaatacaataatttcgcaatgagtgcacacacttacaaacaaatcgcaacagaatagaattggagatcaaattgagttcactccatcgcgtcagtcattctttgccattagtctcttccgtataatacagcaaacggtgttccctcgactatgcttggctcgattgcggcgacaatgaagaaaatggcgaccaaaatgatgacgaccgcagcaaaaacggacgcagcgattgccgctcgatgagtgctggtcgtttgtctgatgctgctaataaagccgtaagcgtccgacattgtggattatttgttgaaaaaatatcgctaaacttttataatattatggttgtttatatattatagggtatttttctaatttaggggacagatttcacacattttttcaatattcatttacattcatattcatttttgtattgaaacactttgtctggttgttttcagggtcgctggttatgattctggtatccattt

SEQ ID NO: 942 - DNA, 1453 bp, Heterodera glycines
tttttcggtttatttcgattttttttgaatctgtttattttttttcaaaaaagcaataaactattctattaatagaaaaagcaaaaatttcctctgagtaaaattgtagagctattgaaactctatattgcgagctcaagccataactttagggccggcggtgctgataagagccgccggaggaaaattttaagaatttttaatgattttgttaaaaaaatggccaactgatttgtcaaaaaagtcggtcgattgtttcggttttttaattatttcgtcgaacggtttcggttaaaaaaccgaaaaaaaccgaaaccgaaaaaaaccgaaaaacaaaaatttctcgttcggtttttttcggttaaaaaccgaaaatcgaaaaataccgaaaaaaaaccgaccggtccgatctctaaagtgtatgaatgaatgaatgaattgcgaaaaaatgtgtgaaatctgtcccctaaactagaaaagtactgaataatggcgctatttgccttttctaattcgtaaaaatacataggtacgtacatatgttctgaagcactttgaacaaagtctcaaaaaagccacttgggcaaataacgccaatttaaatgaacaaacaaaaacacaaaatacataccatcaattattaattattattaaacaaaaaatgaaccgcaacaaagaaatgggaaaattaacacagagatgtaaaaaaaaggtccaaaaatccagaaaaggagaaataattgaaaagtcagttaataaaaaattttttttgaagtcggaaataaaaaaataaaataaaagcttatgggcagatattgaggaagaattgaaaaattttgccaaatcaagtccatgaatatttatttttaattttcaattttttgaattcagttgagggccaaaaaaatgtgtcggtcgatgatgagtatttggatgatcaaaatgccgccttttctggcttagttcacaatgataacgtcgatttaagtgctttggacgaaggtggaagcagcgatgagtgttcgatgttcgaaattttagctattttttgattttattgcatttaaggcaaattcgcttagaaatcggttcaaacatttttgtgtcttaataaaaaaaaaattcattttaaggctttctggtgaaatggctcaaaacttgttgatcattaaagcaaacatgaacaaattgtttttgggaccatctaatgatatcgatgacgaggaaaaggatgatgaaaataatgataacgaggccaaatagttatgagaacacatcattcataaaaaaattttttttgtgagattttttggagtttattcaaatgaaacccccgcccccgtccccgggggcgagaaatttctcacccccgcccccgcccccgtgactctgacccccgcaatcccccgcccccgcgaaaagacgcccccgcccacggggtccgaaccctaat

SEQ ID NO: 943 - DNA, 5508 bp, Heterodera glycines
  misc_feature (112)..(112): n is a, c, g, or t
catcagttgttcaaaagacgtcaatggttttgcgtcagtgtcgtccagttgtcggatgatcgctcttttaatgagctgataatcatgacggtttgcgtccacagctgaatanaagctctctcagcctttccaaaacatttggagcgtagcgctcgcaatcgtttatcttcgggccactcttctgtagcaacatcaaattgctgaagaaagcattcaccgaatcagaacctctgtgccgtccaggttcggaattgcgttgagtgtcatcgtgtatgaaaaaccgtcgaggcttcgaatggcctgtgccatcatgccatcgaataccagcccagggtgggggaccggttgctgattgcactcaggacgattttgttgattggctcttataggtaggttttttttgaaatttgggtgttgctgtccttggtgaaactcaaatccttcgtcctgggaccgacggtgtccttgtgtataggcatgtggcggaggaattcgccgaacgtgtgattgttggtcctcaacaaccggttgctgtgtgagccttatctgctgttctctctgccgctcaaaattaaccgcagcattttcgtacaactgaccattgggtcggcaagcaatcggattgactgcttgtgggtgattcaatgcagggaaattatgcgcgactgggtttggcatttgattttgcatgaaattcataaccctaatttggttttggatgacgctcaaattttccggaagttgcattcttaggtctcgctgcagagcgcttagattttgctcgttaagcggcgttgaaaacgctcgcaacccatgtgcgtccaatgcatcgtttccaaaactccctctatccccagcttcaactccattttcgaaattttgttgcaccataccgttgacattttgttcgtcgccgttttccatttcgtcgtactccaattgttcctcaggtgcgctttgttccattcctccgtaaagcaggcgacgacgaatctcagtctctgctaaaacattttcatgattgtcgtccagtcgctgattttcgttgttcgctaagggcgagatcggcctgccccccgaaactccaaaattttcagccctaaatgcgtttccatcgcggtcaacaatgattccctggttgagtgccctcgtccgggttagtggtggcgttcggagaacaggcattttgtttgagctaccgcagaggtactactcaacaaaacaaaaacaaagttaaacggcgatcctcgaaaaacggcccgatttgtcggtgatttgtcgatgtccacacttatcgcaacaatgcgttatttgtgggacacaaattcaactcgaagaaaagcgcaacaatgcgttatttattcagaatcgcagctatgcgtttttctgaaatgtcccttgctcctcgtcctcactttgttgctttattgcccctggcagacaggcaagcaataaccggcgagataacgaaccccggcaaacgggctattcgctttgatgaacaactaagtaaagctccgacagacggactacttcacttttgttgaattcccgtgaaccacaaatttctcccttccaattttgttcccgagctcgcccttttccgaaaaaccaaaaattcccggcaccgcttactcagttgaccaggagcgccacgtgcaaaaattggagtccaatttgtcggaggggctcgtctcttttgctttgcttcgttcggcttttcctcttctcgggccaaataattaattagcacagaaaggacaaacggggccaatgcttattaattaaggacggcgaaatagtcggggacagttcaatttatttaatttaaattcaatgcgaagacgacgaaaattaagagtccacacacaaaatatttagaggagaaaagtctgaggtccaaattttgtgaacaccaaatagaatgaataaaggaaagcacaagggagaagaaaagcaaaggaatatcgattgagaaaaataggaataaattagagagaaaaacaaaaggaaaataacatataattagagaattgaattaaaagaataaaaggcagtcagaggcaagggaaacggcacataattagagaagaaaaatattatagaaaagccaaattatttcccatttaacacatcacaaccccccaaagaaaaggcgtccctgccgataagttgattcggcatccgatcggtggtggtctgagcaagctagtgccggcggtcgcgtgtcacatcatctcggcggtgtcctcctcgaacgaatggttgcgattggcggttgtcgcggcgtctaaacggcgatcgagaacgagaattcgggcggcggtcgcatagacccaaccccccacgagccgaagaagaagccgcagtctccgggcggtcgcatagacccaacccatagactctcctagtgaccgaaacactggagcggaccgttcgaatcccaagttgtctgttgtttggccatttcggaatttgtgtgctgatccacgccgacaatgctttaatgccattttcagtcatccatccatctgcattgacacgactccgatcaaaggaatcgccataacgccagatttcaatcaaactcctaccaaacggagtcacgaaaacaaaccaatcgccgagcagttcggaaagacggccgatcatttcgtgataggccaaatcgtactgacgaacatacggtggaggcagccaaatgaacgaaacggacggaaaacgggaacacagttgttggatccgttggcactgttccatgatctgatcaacggtctcgtctttgaccagcgaatcacgaccgaggatgatcattgcggcgcgcactttgcttgagaagacgcattcgctaagtggacggatcacttcagttaacagccctcgttccgtgccaacaaattgcgtttgtgcccgcatttcgggaaagagttggaaagccgttgagtcaccgatcagaactcgtggagtctcaactagtgtgcggctacgatgaatggcgatggaacggactttttccagaatccacccggtctgttcgaacaatgtgctccaaccgtcacgctctgattcgggcaatttgggcaccgcttccggcatttcgacctgaatagtttcgggcttttctttgggctctccgtcggaattttgcactcgaatcttctcaaatcctgacgattggagaagctttttggtcaccgcgcacttttcacaccacattgaccaaattttctcgacgtcttcttctcgtggaagggcaccggcacgaatgttgtcttttcggactccctcgtaaacgaccaactccatcccggattcagagccaagtataagatgaacaaggctttttgccgccgcggaagagactgtggcaacggaacggaggatgaaaaggcacaaaatggcctgcagaggagtgccaatttccacgtttccgggctccgtttttgcgtccaaaaccgggtctaactccgcgcacagaagttttccacagaattcgtggctttcgccttcgcacttcatggtccaaataagcccggcagtttcgtcttgttgcatcttccgcccacctaaaatgtcagttgtccctaactgattttggtcgaaattttctgctgagttttttgtgattccctttttttgccattcctcactcgacaccggagtttcgtctgtttgttctcttttttgaactattatttctaaatttgcaagcaaaatagtagccaaaatgttccggtatgggttttttccgtgtgggagcgttgatatgtcgggaactccgactggtacacggacgagacgttctattgggacggtaatcggttcagctgaacttttatcaactgggacaacgtctgcggacgattcgaacattttaacaattttgtacggcccgaactgattccaatgcagttttttgtgctgtattcgggatttcgatccgggataaatgaccatgcatttgtcgccaatcgcaaatttgtttgcggtcacatttgggcgagaatcgtaccgattttttgtttctgcccgtgaaatttcggcatttttacgcgcatattcgagaattaactgcaaattttctttaaatgcttgtaaatatgtttcctcgtccacggtgtagaacgggtttccatactttttaaagtctatttcccctggaaaatttgcaatttttccgaacatcagttgaaatggcgaaaatccagtgacttcagacggtgtagtgttgtacgagaacacaacgaaaggaagtcgttcatcccaactccagtgcgaggacgtagactttttaagcatattaagcaaagtttgatttgcccgttccgcagctccatttgcttgtgggtcgtacccagcagttgtggtcttttcgacgcctagaatggcggaaatttcttttagagtttcgttgacgaattcctttccttggtcactatggaatctttttggtgccccgaacagcaacacaaactcttttacaaatgcttttgagactgtgtctttgcttttgtccgggattggggttgcgacgatgtattttgtgaagtgatcgattgagacaagcacataccgattaccgttttcggacattccgatcgataaaatatcgacacagacaagttccaacggttcggacgtctggattatccggagtggcggttcatttgaccggggttttctgctgtgtgcacaaattctacaacttagacaggttttaacgcagtcgccgaacatatttggccaaaagtacttttccgacaattgacgaaaaagtttttttccactgaaatggcccgaacaaattcctgaatgacgctgatcaataaaagtttgcctgaatttgctggggacgaaaagttttggtccttcaggtttcgatggtataaaatacagcaatccatccattatggaaaatttatgaaaagtatccaaaattttttgtttcttccggatttcgtctggcaaaattcgtttttgcaagaagttgtatatttcgctgaattcgctgacctttgtcgcttcgacccaatcgattctctctttttccccgatctcatccacttccagattcttttcgccttcattctcttttaatttacagacaaaagctgaatccgtgtcaaaattctcagtgacttcacttattaaagcaccggaccgtgataaaacatcagcaacaatgttggatttcccaggactgtactcgacagtgagagtgaatcgtgcgttcaattccattaaccagcggtcaactcgagagtttcctgtttgtttcttactccgaaacattggcggaagcgctttatgatcggtgattattttggtcggaattccggtaataaattgtgcgaatttccaggcaccaaatcgaactgcaagagcttccagctccgttgggcaataattactttcgtgtttactgcattgacgtgatgcgaagaaatttggacggactcgtttgttctcgtcagcttggcacaaaactgcggaaatcccaattttact

SEQ ID NO: 944 - DNA, 4969 bp, Heterodera glycines
ttttactcgcgtcggtgaggatgatgaaacatcgttcagcatcattcattgcgcttttgaagtccgggaaatagagaaccgcatcttcaagaagtttttctttcaatttctcgactaccaatatttccttctctcccaaaacaaatggtgtgttcttttttaggaggtgaaacagaggtgcagcaatctctccaaagccatagatgaatttccgataatacgtcatgaacccaagaaatgaatgtaattgctttttggtcgacggcaaaggcagttcaatgacaggccttactttatcggcattcattttcaaaccacggcgagttaacacatgtcccagaaatggcaattcggaggcagaaaaacgacatttttcaattttcaatttcagctcggaatcttttatccgctcgaacacaatttctaaatgctccaaatgctgttcaaacgattctgatgcaaccaaaatatcatcaatgtagacgaaaacaaagtcattaatcagatcctcaaaaagccgagacatgaaccgttggtacgtcgcaacggcattacaaagcccgaatggaagaacggtaaactcgtgcaacccgaattcagtaacaaacgcagtcttttcaacggacttttcgtccattctgatttgccagtagcccgaaaggaagtcgagagtcgagaagtatttcttttctcctagtgcgagaaggatgtaatcaatgttcggcagtgggtatgcgtctttcactgtgaccgaattaatccctcgataatcaacacaaaatcttaagcttccatcacgtttcggcacaaggacaatgggacttgcccatggcgattttgatggtcgaattaatcctctgcttaaatagtcctggagcattgacgaaacttttttacgatgtgcaaatggcagtggacgcatccggcctcgaattggtgaggcatcgccggtgttaatgaaatgctgagttatttcagtttgtgtcagttcgctgtcatcgagtgcaaaaatttgttcgaaaccaattattaaacgttccaatttgtccgcttcgtgttgctgagacatgccaatacgagttcgtaagatttctttgatttgttcagtgcgtatgttttcattttcgtgtgtgacgctgctgacgaagaacggagggaaaaacgaatgttccaattcgtgccattcatcgacatgctcgaccaatgcgacactttcattcgcttccagtgtaattggaattgacgaaaagtttgtgatcggcacagcgatttgtccgtttttgcaagatgttaaagtaggctcaattcttagttgctcatccaaatcatttcttcctattacagtgacttctttgtcttcttgtccattggccattgacaattcgacaagtgtggatgattgaggcagaagtgtgactcgatagattatatgtgccgaatttgcatgtgtttccatcggggagaattcaacaacattcatgttgactttgtcgatcagtttaaatcccaattgattcaaagcattggttccgaagagaaggtcgtaaccaaatgaggattgagcaacaaacatgcgaactcgcgccgtctgtgttcctctcgtgattggcagacaaacgattccgaaacatttcacttctttaccatttatgtcaacaatgcgtcgttccaaatgggaaataatatcatttttgtccactttgtccatgatttgtgcaaaaaattcggctgaaatcagtgaaatttgcgcacccccgtccaacattgcatccgactgtcgttcgaaaacagagacttttgcaacgattatctttccaacaagagggcttccatcagaaccatcgacatcacttgtcttgttcactgcattttgaaagaaactttcaatttgcggcccgtattcggcattcacggcaccagccagtaaatcattccgttttggtggctcgttgttttgctcaacgaggtaattatgacggaggaaattccttgacgccgggaattgttgtccatttttgttaggggcttgcctattccaatttaaaggcgcagcgttagcccctgaaccttggtgttttgcgatttgatttcggttctcttgaaaggaacaaaattttggtggagtcgtacaattccgagagacgtggccattttggccgcagttatagcatgtaacccgatatgacggatttgagccaagctccggtttgggccaattatttgagcgattatttggtgcataattattggctggacccgttgagtttgtcattgggcgttgatactgttgattaggtcgcagtgcacttctagcagctaactgagttgcttcagctcgtgcggcttgcgcgataaactcatcaaatgttgcgcctggtctacgcgtcatttcaagagtgatcgctaactcagggttagacatggcccttataaagtgcatgattgaatactcgtcgtattgttgttcggttagacccggataagcacggcgaaccaatcccgagattctgtttcccagctcatcgatactctcgttcggtcgacgccgaattcctcgcatcagttggtcaaaagacgtcaattgttttgcgtcagtgtcgtccagttgtcggatgatcgctcttttaatgagctgataatcatgacggtttgcgtccacagctgaattgaaagctctctcagcctttccaaaacatttggagcgtagcgctcgcaatcgtttatcttcgggccactcttctgtagcaacatcaaattgcttgaagaaagcattcaccgaatcagaacctctgttgccgtccaggttcggaattgcgttgagtgtcatcgtgtatgaaaaaccgtcgaggcttcgaatggcctgtgccatcatgccatcgaataccagcccagggtgggggaccggttgctgattgcactcaagacgattttgttgattggctcttataggtaggttttttttgaaatttgggtgttgctgtccttggtgaaactcaaatctttcgtcctgggaccggcggtgtccttgtgtataggcatgtggcggaggaattcgccgaacgtgtgattgttggtcctcaacaaccggttgctgtgtgagccttatctgctgttctctctgtcgctcaaaattaaccgcagcgttttcgtacaactggccattgggtcggcaagcaatcggattcaatgcagggaaattatgcgcgactgggtttggcatttgattttgcatgaaattcataaccctaatttggttttgtatgacgctcaaattttccggaagttgcattcttaggtctcgctgcagagcgcttagattttgctcgttaagcggcgttgaaaacgctcgcaacccatgtgcgtccaatgcatcgtttccaaaactccctctatccccagcttcaactccattttcgaaattttgttgcaccataccgttgacattttgttcgtcgccgttttccatttcgtcgtactccaattgttcctcaggtgcgctttgttccattcctccgtaaagcaggcgacgacgaatctcagtctctgctaaaacattttcatgattgtcgtccagtcgctgattttcgttgttcgctaagggcgagatcggcctgccccccgaaactccaaaattttcagccctaattgcgtttccatcgcggtcaacaatgattccctggttgagtgccctcgtccgggttagtggtggcgttcggagaacaggcattttgtttgagctaccgcagaggtactactcaacaaaacaaaaacaaagttaaacggcgatcctcgaaaacggcccgatttgtcggtgatttgtcgatgtccacacttatcgcaacaatgcgttatttgtgggacacaaattcaactcgaagaaaagcgcaacaatgcgttatttattcagaatcgcagctatgcgtttttctgaaatgtcccttgctcctcgtcctcactttgttgctttattgcccctggcagacaggcaagcaataaacggcgtgataacgaaccccggcaaacgggctattcgctttgatgaacaactaagtaaagctccgacagacggactacttcacttttgttgaattcccgtgaaccacaaatttctccctccaattttgttcccgagctcgccctttttcgaaaaaccaaaaattcccggcaccgcttactcagttgaccaggagcgccacgtgcaaaaattggagaccaatttgtcggaggggctcgtctcttttgctttgcttcgttcggcttttcctcttctcgggccaaataattaattagcacagaaaggacaaacggggccaatgcttattaattaaggacggcgaaatagtcggggacagttcaatttatttaatttaaattcaatgcgaagacgacgaaaattaagagtccacacacaaaatatttagaggagaaaagtctgaggtccaaatttgtgaacaccaaatagaatgaataaaggaaagcacaagggagaagaaaagcaaaggaatatcgattgagaaaaataggaataaattagagagaaaaacaaaaggaaaaataacatataattagagaattgaattaaaagaataaaaggcagtcagaggcaaggcaaatggcacataattatagaaaaatattatagaaaagccgaattatttcccatttaacacatcacaaccccccaaagaaaaggcgtccctgccgataagttgattcggcatccgatcggtggtggtctgagcaagctagtgccggcggtcgcgcgtcacatcatctcggcggtgtcctcctcgaacgaatggttgcgattggcggttgtcgcggcgtctaaacggcgatcgagaacgagaattcgggcggcggtcgcatagacccaaccccccacgagccgaagaagaagccgcagtctccgggcggtcgcatagacccaacccatggactctcctagtgaccgaaacgctggagcgga

SEQ ID NO: 945 - DNA, 1045 bp, Heterodera glycines
tagaaaaatattatagaaaagccgaattatttcccatcttacacagctgttattgttgtttttgctccccttttttgttgcgatgtttcggcatcgccccccgcggcggtgtttcctttgctccatctgcaaaaaaaggtgtaaaagtgcgcgcgatcactgctgctgcagcagttgctgaactgatctgtcatggccagggtggtattaaatgatggatttggggagggatttggcaaccgatttttccaaaagttttaatcggcctaaaaaatgtgcactgtggtggctttttcgtttggccataacacaacaaagagcggcaatggcgctctggcgggggggggggaaatttcagatgatcatccgaccgcatggccacaaaggcatttatgggccacacaaaaacatatgcgcccctgtgatacattggtaatgcgattggattgccgacagcaaatgttgacgaatggcaccgccgcacacccgcgcggctttctcccgctttgcccccatcagcggtgcttattttttggttagtcactgatgccgaattaaaattcattttcaattcttatgcagctcattaaacccgaaatttccaaagccaatgtttcgcgaacagagctgcaactcctacacattaacctcatttgtcagcacgctttagtggtccattttacagataatttgtgggcaaaaaatttattccatttgctgggagggcagcaaaattgacggatcaattcgaactcatcaaaataaattcaaaaaaggcattcgtggtggtaagtaacccttatcctccgcgattcccaccaacatcctgcttaataataactagggttcgaagttgtatgcgctaaaaaatgccaaatatgcgcataaaatatgcactaaaaatgcttcaaatatgccctaaaacacaaaaaatgcccaaatatgcactaaaatatgccttaaaaactgccaaaatggcttttaattctcaaaaaatgccaaaattttgtgaaatttcataattaacttaaaaacatcaaaacaa

SEQ ID NO: 946 - DNA, 1135 bp, Heterodera glycines
tggtgccagtcttggtaatgatgcgtatttttgcggttagcacgcaacaaatcgagcgcattgttctggcacgacccctccccctcccatccccccaggggagcacggggaaaagagcagcacaataaaaacaacaagttgttgtgtgtgtgattgttctgattggtggtggtgctgaccaaattctgcatctgttgctgctgctgtttttgttgcttgacaaagaaaattggaagcggcgacaaaatgagcccccgtggggagaattttcccgtttttgttatgctgtttagggccgggccgcccgcgcttcgctccgcgccctccctcctctatgttcaacaactattttagagggaaagagagagagagagttagaatagtcagagagtggaaatacaaaatgtaaaacatcatacttttaaaaaacttgatttttggaaatttttgcgctttccctgcccaggggggggcggcggggggccaaggccatcctcacattttcacccctccgtcgtcgagagtgggtagaaaggcgcgcaacaactgatgaagaatgatgatgatgatgatgatgtgggctgggcggagtcgggcgagggcacaaattttgtcctatttaaagtctgacaccccggaggggccatttttaaacggtggcacccgtcgctcaaacaaccgaaactgaggacggaacgccactagcaccgaccgcactttttctgttgttgcgcgctgctgctgttcacgccattgccccaagggatggacaaaaatggaccgaccgatcatcaattattttaattttttaaattttgattttaattccttttgggaacatttttatcacaaaaaacaaccacaggcaggagaaatttcacttttatgcactgttgaaatttttctttttagaggcttttcatttaacacacttttatgccaatgttttctttggccaagattccggcatcgtatgaaatttttactgttccttagactcagccaatagattaaacgacgaatttcgagccaaaattggccagggatgatcaaattaaagcagatttctgcttctgatcaaggtgaaaataaactcatattatgtgaatataagccacatcaattgagtctttgc

SEQ ID NO: 947 - DNA, 954 bp, Heterodera glycines
aaattttcgttgttttgtccctatccctgaatttttacttcatgtgatattatacttatgaatttttttaaagaatttcatgcaactctgttttgaaatgaacgacctctccaactgtcaagcggtggtccgttccattgagaagctgtacaatttgcgtatgatttttttccatttattttttaaatgtaatttccctcacaatgaaattaattgatgaaattaataaattttataaagactccatagtttttaaaaagaattttattttttctttgaaaaatttaaagatttttattttaaaaaaatttcaaaataaaaaatccgaaaattttttttgcattttttgaataaatttggggtttttaagcccattgggtattttttttgcaaaaaaatgcattttggttacttttttgtggttaatttttctaaatcattttacgcccaatatgacaaaaaatttaattagcaaacaaatcacgatttttctgaattttttaatgaaaattcaaatgttttttgggaataaccagggattcgataaatgtacattttatgcatttaaataataaatttacttgatacaccctgaggtcacctgcaaatatccgggaaccctggtcttgtcccatttcttttactgaaatgaaataaaaaattcaaagattttcagtcgctttgcaatttcccgagggcctcacaatgttcgcctgcgtaatcgtcgacattcgcagcaagcacacctgcgctgagttcatcattcgggacgacattcacaaattttttgggttccagctcgaggagaatgtgagtatgttacttacaacctaagtattaagtgttttgtctatgccgaaagtgttaatcgtacaattaaatgttcaccttgataagtgcgaggaacccagtaacgcggaaagtgccgcaccccctcccctgcccccccccccc

SEQ ID NO: 948 - DNA, 9959 bp, Heterodera glycines
ataggatatcgttgaatgaaggatcgccctgacgaatctatactgatctcatgactattagctgcacatggagatggcagttagacccgtcagagaaactcttccattaagtaggcggaatgcacgcgacttccttgtgtggagtagcccatttaagcaagaaaaaggttaccagcggaactgcctctcgctcccaaaactccacataagcaattacgttggaacgttgcgtctccgtgtccgtactctgtgggaggagtctggtgtctcggaagtgtgacagcactccttcctggcccccccccccgctgtgcgaggagcccggtaacgcggaagtgccgcaccccctccgccgccccccccccccgctgtgcgaggagcccggtaacgcggaagtgctgcacccctccctgccccccccccgctgtgcgaggagcccggtaacgcggaagtgccgcacccctccctgccccccccccgctgtgcgaggagcccggtaacgcggaagtgccgcacccctcaccgcccccccccccgctgtgcgaggagcccggtaacgcggaagtgccgcacccctccccgctcccccccgctgtgtgaggagcccggtaacgcggaagtgccgcacattatttttcaggaattccgacaacgtggacagtactacgcacacatgcatgcgagaaccgtgaatgtgagagtgcttgatgaccactgtgccaactgacatgtgtaacagcttccattctcttacccactatttacaggagctgtgcggaaagtgccgtacacccccccccccccgctgtgcgaggagcccggtaacgcggaagtgccgcacatctatcaaaatatttgcttttcatcaaaatctcgtgacataaatgcattaaataagaagtttttattaatatttcttttgtgcgagtacttatgttgtttcacatctaactttttagagtgggtgactctgatttatcttcctaaaaacgattaaattaaaacgcttcactttgaagtaaatttgtttgctgtataattattctatatttataataaacattttcttttgtctttcttttattggttcatttccacatatctttgaaagacgaaattacttttctatttaatcgtgtttagcgattaaaatgccttcaaaagaacagaaagcgagacaacgccggaggtcgcgaactgcggaggatgatgatccctcattggggttaccattacttcaaagtgaagcgttgaccggttcaaattcaaaaaaacagggtcgccctattaaaagacaaagtgatattttggaaagttcggtatcgtgtgaaactccaaaaagttctcgcacaaagggcaagtcacaaggaaatatttcgcccgttcaaaaacgagcaaagacttatgatttatcgatagtttataatgcaattatgtcacctggtcatgattttaaaaatatcgtttttgcgaccgagaaaaatcatagttgccagatctggcgtaaagctagccttaatctttaccaaaatgactctgacaactctggctttaggcaaattgaaaaaaattggaataatttatcagaatggctcaatgattcgtttatttattcatttctctgctatattagcacgctatcgacgaaaaatgttgttgttgttgaccccttgtatactgatacccagcaaatgccaaaaattcttttatctaatatgaaaaatatagtctttattattgaccagcagtctcctccagagatattacttatgccactcaatttcccagggcattggactttacttattcatgacataaattacggcacttttttaatggattcattgcaaataagcgagttaaattttgatcgggtattgcgtgtcaaagatataatttgtaaattgtgtcaaatcaattctgatgatatattaatacaaaattttcctgcttcaaaaatgactctgcaaaatgacggttgcagttgtggtttttttgtttgcttatatgctgaggcatggctgattaataatcaatcgcttattttaccaaaccttgatataaatttggaaaaaagaagaattctttggcatataaacggtctttataatcgtgataatgtagtatatcacccgtgctcattgtttgttggcagcgaaaatgaaaatttgggttctttgcatgattcgcgtgattcatctatgtccattgattcaaacataaatcaaactccagtcaaaagaagaggacgcccagctaagaatcgttctgggtcaggacggccaaaaaaaacagagaataatcaaatattaatgccagttttttcgcacaattcttcccttgcaactgatttaaattattcggactgctctgattatgttagtgtctcttcaaattgtagtagtaacagaggaggtcgtccaaaaaaaaggagtggtggtccaggaagacgacccaaaaagactgttcataccaatttaaaagaaaatattaatccggcccaagaaaatcacacatcgaatactcaacctgtaatttctaatgaattattgagcttattgaattctgattctattgatgtccctgactcgcaacctgtagccccaggacgtgtttgtattcaatcaataaataaagatctcattaaagagacgtggtcttctcctactgatatgttcagtgatgatttaatctactgttttcaacgttatcttgcatcaaaaatagctaacaaaattgttgcagtagtcaacccacaatacacagacttacaaagttttcatgttggtcctattgctttcccatacaatgtgattgataactgctttaattattcagcgaactatgacattttgttgatgactattttctttaatggtcattttgctttaatcatttttgaccgatctgaccgagataatttgatttgtctatttattgattccttgcctcattatgatcggctttttgatcctcaataccctggctatgatgtgagaaggattgaaataattaaaaacggaatttgtgaattgacacctggtctgactcatgatgatgtggtaattagggctttaagttcatcagaatttacaccccaacatgacggaattaactgtggcgtatttgttctgctttattcggaggcctatttaaataattgttctctgaaattcccaaatttaaacattaactttgagaggcggagaattttgtggcatttggcccagctgataaataatgataatgtagagtatattggaagaaatgctaatccacatcctcaatcccttcctttatataatgtggagtctaatattgaacaatcatgcccaagggatggagatggagcgtttatttgcgtagaacctgatatagatagaacccctgatgttattttgaggccaccttccacggtttcttcgattacggcaacccgccgatctatccgacttcaaagaagtgttagtactgaaaaatcttctgataacaatgtgaatactcttccaaaaattgagcgaaatgacattacacagcgttgttatgtgaaacaccaaggaaacccatgcgcagatgtgcgtgcaaagcacactactgagtattatgattcaggaaatattggtgacaaaatatgcgaatattgtaacgcacttttattgaacagcgaggcagaaaaaaggaatgggaaattttcttcgagtttttgttgtaatcacggttcagttgttttgccctcctataaagagcatccaccaacacttcaacgatttttgtcagggcaagattcagagtcaaaagaatttttatcccatcaaaatgtatacaattcattgctggcctttgcatcaatttctgttggctattacgaatcgtctcttgatggtgacaaatgttatttattgaatggagaatttacacgaaaaattgggttattacctggacaatttgctccgtcttttgcgcaattgtatatacttgaccctatggcggcatttatgcaaagaacaaaaaatatcgaatatggtggggatagagtaaatgaaaaaacaataagaaagcttgattttataattcgcaaataccatccgcttgccaaagagctattgaatttccatgcacaataccaaaagactttagacgaacacggtccagaatctgttctcaatttccgtttgacattggttgaagctcgtgaagcaccattaaatataaaggaccctttcctccatccaagacaagccaatttacccgacgaggggaattctttattttccatctgggctgaaagcgatcagccaccattattaaaaggtatttggatcactacagatgaaggaaagcttcaaaaattccgtccacatcacccacaaaccgattctctttgctatcccttaatatttccaaatggcgatgacggtttccatccaaaaattccttacaatatcacaaataaaaaatgcgaggatgaagctatggaacttgatgtcgaatctgatgaaaacacttctgattctgacgaaaaagcatccgatgataatttatctgttgcaagttcagttgattcggttgaaaagtgcggaaaacgtcaattcttatcagttaggtcttatatccgatatcgtattgcgctgcgaaatgacaagaagcttcaccatatttggagtgctggtgggggcctgagtcaaaaatttattttggattattcagctcgtatcgatacaaatgttgcaaattatttgcggaagcctgaattaaatttacgcagtactttacctgaaaatgcgcttcgctggctttctcgtaatgcggggcttaactcaaccgaagaattaggtagcgttgttatgttccggagatctgcgcctggaacacgggcatactttcaacataaattttacgatgctaccactattatgtcaaggtttaagaggccagggtttgcatcattttttttaacttttacgacaaatcccagatggccagagatttctcgaaattttcttcaccaaggtcagaggactgttgatagacccgatttaatttgtcgtgtttatgaggacaaactaagacacttgcattttttgctggatagtaaaaatattttggggaaaatgattggccaggaatgcagggaatttcaaaagaaatacggcggtccacatgcccaccgcgtttatcataccgatctgctcgcaattcctgaaaatattgacggattgatatgggcacatattcccgccgagccaaataaaaatgacagatctgattgggctatttttattcgtaaagtgcgtgaattattgccaaagtatcagtttcatgactgtgggcgtcattgcttaaatcgtaaagggaaatgtaaaaaaggttttcccaaaccgtttagcaaatttacaattttacatgatgaccggccagcaatatatttacgcccaagccctgaagatggtgggcaaacattgactgttaaaagaaaaaaaactcaaataacatatgataattcgcgagtgtccgcgtacaatccttatattttggttcactttgaaacccaccataatttggaatatgcatatgggcaaagcacaaatttgaaatatttatacaaatacccgttcaagggtcccagtttctcatacgtaaagactaacgaagtaaatggaaaaattggtattgacgagccggcatattacgccaaaatgttatatcgttcatctcctgaggcctattgtaggatcatgtcgctaaagtatgctaaattatctcataccgttattgctttgtcaattcatttgcctggtcagcagaaaatttattataagaaaaatgaaaaagagtcagtcgctcaacaagtacagtcaggcattttgcccgaaactcctttaacagcgtattggaaaatgtgtgaaacggatcctgatgttaggaaaattctttttgaacatatgcccgagcaattttcattcaacagatctggaaaatattggaagaaacgaattttttcaacgaatccaaaacggcaaaagaaccacgcgaggaagccaatcattggacgaatttacccggtttcaccacgaaatcctgagttatttgcattatatttattgacaaaacattttcccggaaacccggagcaattaaaaatgttaaaccccacgcatatctgtaaaacatttctggaaacagcccgactcaggggacttattgatgacagcgatgtgtgggttcggaccatggaggagggtgctgcctcgcttaccccagcacaaatgcgtcagttgctggctaatattttaatttttggttcaactgaaaattgtctcattgatggagcactactctgggaaaaatttgtttcacacatgtttgacacacgctgcacagatgctgagcgtcctgctcgtattgaccatgctcttgctcttttagaaaaattattagttaaactaggaaaacagtgtaaagattatggactgccaaccccaacaatttcaattataaatgatccacagcgggggcttatcgagtttttcttcccccagcacttaaatgatgatgatgttgatgacatagttgacacaacagcatttgagcgtggaaaattgaacgctgaacaacagaaattttttgaaatgataaaaactgcttttttgaacccatcgagttctcgactattttatttatgcggcgatggcggaactgggaagacatttttgctgaattacattttatatcaattgcgaaagatcggtgctaaaattattcctaccgcatcgaccggcatggcatccacgcgcttttatgttggtggtactactgttcattcagcgtttaaatttggaataaatgttgaggccggaatattgccttcaattccctttgatagtttctttggtcgacgcataatagaaagtgatatcataataattgacgaaatgacaatgttggagcggacagtttttgaaaatattgatttagtctgccgtcaattgtgcactcaaaaacagcatttacctttcggtggaaaatgtgttataatttctggtgattggaaacagtcacttccagttgtaatcggttcttatgggagtgcagcgcaggttgcagcatgcatacagtcctcaccgctttacccaatattctcaaaatataaactgacccaaagcatgcgagttaatccaaacgaaatagagtttcttaaatggcttgatgatgttggaagaggagtaaatggagacacggttgcaatcccaaaagatatggttgtcgattcacgagaagaacttattggttgggtgtttgatcaaggatttaatatgccaagtagcgaaatgcttaaacgccttcttttggctactacaaatagaattgttgacataaataattcccaaatttctcagtccatgtatggaaattttcttgaatatttctcggttgacaaggcaacagatgaaaacccgctttcggtaaatgcagctgactttgatgtagcccagctaaaccagctgaatccaatgggaatgcctacccatttgttacgccttaaaattggatcaattatcgtcttactcgtaaatttaaatacttcaaaagggctttgtaatggcacacgtcttcttattaaaaaattaactgacaatctaattgaatgtgaaaccattggtaccggatcttctggaaatggtataattattggaattccccgaaaccggcatacatataaagacaaacgtccggacggtgtaagttttgaaagatttcaattccccattcgccttgcttttgccatgacggttgtgaaggcgcaaggccaaacggcagttcgcttgggaattgattttacagaagaaccttttgcccacggtcagttgtacacggcgctttcaaggtgtacaagtcgtgataatataaaaatttttgctcccaacaagccaaaagacgataatggaaaccctttgattagaaatgttattgcccctggtcttaatttggattaaaccttttaaatttaatatcaatacattttaaaaattttctcatcaatgtgcgaagagccccggtaatgcgggaggtgccgccacccttaaagtgcaaggagccccggtaacgcgggaggaaccgccacccttaaagtgcgaggagccccggtaatgcgggaggtgccgccacccttaaaatgcgaggagccccggtaacgcgggaggtaccgccacccttaaagtgcgaggagccccggtaacgcgggaggtaccgccacccttaaagtgcgaggagccccggtaatgcgggaggtgccgccacccttaaaatgcgaggagccccggtaacgcgggaggtaccgccacccttaaagtgtgaggagccccggtaacgcgggaggtaccaccacccttaaagtgcgaggagccccggtaacgcgggaggtaccgccacccttaaagtgcgaggagccccggtaatgcgggaggtgccgccacccttaacatgcgaggagccctggtaacgcgggaagtgccgccaaatcttcagagcttagctcctcgccgggggcactaaaaattaaaaataaattaacaaattacagtaaaaaataacacacccccggcgagtggggtccatggtttttgccagtttcccaccgtgctcctccgcgtggtggaccctgggggttggacaatttaaatttacaaaaaaaattgtccaaccgctaatgacggttaataaactggcctcatgtccgcgcatgaactagcaacgaagtcctttgcgcgaagcgcttatgtcaataccgattatattggggttccagaagtattttttctactttaaagccaactgtgcaccctagttaatatatacgttatattgacaaggagtttcgtttgcaaaaacaaaatctcccggccgaaggccgggagcgccctgaaagtagtggaagggtcttacaactttttgaggcgcatccgggaaaactatagaaaaaaattcagcgcggatgactgagtcccggggaccgatttctcactttttcttgcagtttttcttctacgaaattttttctttggaccgggatcgcttagctcttgctggtaggattttaagtcagactatccccgacaactttgccagcaaaacctaagccctacgttgggcgcccaaggctgtagccttggctaattttttttacccaaaagtgtacacttcagtaccaggcgaataactcgccaggggttgctttgaacgaaaaattgtttctgagcaaaaatgtatagtatttgaaaggctatccaaccaagttttaaaatttcgaaatttttgaaaaattttcaagctaggcctaaaaaacgattttttggtttttgaattttatgattttttaacgaattttcccagaaaaacggagaccactttcaagcaaccgtttttcgagctctatcgattggtgacatttttagaaaattttcgatttttttccggaaatagaaaaaatttttggcctgagcgggacatttgagtcccgggcccataactcgtcaggggttggttttagccaaaaatggccttagagcaaaattgtagagctttttaagctctatcgaacggtgtacttcattttcgaaaattttcaaaaattttcgagctaggccccctagaaattttcaaaatttttttttgggttgaaaaagaggttgaaaaaattttttctggggtaaattagggtcctgagcacaaatatgatgtttattttaagtttcagattttttggaattttttaaaaattcgaaaatatttttaatttttttggtccttggaaatttgggttaaaatttgaaaattcataactcaatggaggactggtcaatttaagtgaattaaagctttaaaaatagcaaaaaatcgggagaattttatgagatttatttgaaatatgtatcacaaaaacaaaaaaagttattccagaa

SEQ ID NO: 949 - DNA, 6543 bp, Heterodera glycines
cctaaagggaaagcttccgtaatcaaaactttatcaagatgtaaaagtacaagaatgcataccagctttcttcggtttctatcattgtgacatccgcttggcagattatctgtttctgtcggtacgctgttctggccaatttgcgcgtcatcactttctcgaggctcccatatttgtccccaagatcgcagtcgttgtacacataggggcatatgcggtccaagtagggattacgcgatccctaatttattcaaatgatgcataattaattggaaaatcaattcgcatattagtattaatggtggggccaagtatacgtgcgtatactgtcgaccattttcattagtcatttcacggtcagccatttgttcaacagtcactgatcggaaatcgcatttgccactttgagaggtcgataattcctacatatttcatttcaaaaataggtatgtgcacttccgaattttgcgtagtgtaaaatgcagcactattttcttatcttatacagtgctttttataggcaccgaaataaaagtcgatctatctcagcgggcctaaatcgtagacccactattccaaaggcaattcggtagcaaattttgtgctctataaaatgggcctactcaaaatttccagaaaaattttcccaaccccctagaaattttttttgaaatttacccctcgttcccagccaaaatgggctgatcagatcaccatgaaggagtgatctgatcaacttggtgttgctaccttttttgatcagcatccaaagttatgcttacctgaatttttttagatttttttaatgctgatccagagaagcaatattttaaaaatgaaatgggacaacacttttgaccacctatattttgatcaaattgtgaatatggtaaaataaatcaaataaatgtttatgtcacaaatgcaaatatggtatcattggaaagcccataaaaaatgctatccaatggtatgctacttatctgttgaaattggaaaatgacaattttatacgcaattatttttttcaaagcatgatgggacaacacttatgaccatgactgtacatgaatattgcgaaaaagtcgaaattttcaagtttttttcattaaaaattttttcaggcttgaaaaactttttgctttttgctaaggctaatagagcattttaagagctttcgaatgataccaagattgatggatttggatgccaaagaaaaaagcttaagtggaaaaacatgctggcacccaaccgtgcgcgcccaaccgtgagcgcccaaccgtgcgcgcccaaccgtgcgcgcccaaccgtgcgcgcccaaacgtgatcgcccaaccgtgcgcgcccaaccgtgcgcgcccaaccgtgcgcgcccaaacgtgatcgcccaaccgtgcgcgcccaaccgtgcgcgcccaaccgtgcgcgcccaaacgtgatcgcccaaccgtgcgcgcccaaccgtgcgcgcccaaccgtgcgcgcccaaacgtgatcgcccaaccgtgagcgcccaaccgtgcgcgcccaactgagcggttccgggcaaaaaccattgaaacatcgaaaaataattttctgtacagatatgaatgtaaaagtgaattaaattattaccaaatttggctcaaagtcgaaaaaattgattatttttttgtgaaaccagttaacaaattgcattctaattctctaattttcaaaaatttttcgcggcggcgcttaccgacactgtcggacccttgttcccgaaaggttttttgtttttcaaatcatcttttttcgcgtcgctctttttctaaagacttttaggagaagggggtccggcggtgccgataggcgccgccgggaaaaattttgaaaatttggatagatctctaacagattttgtcaaaaaattataaattttttcgattttgagcaatatttttaggtttttggggtgccggagatgccgatatgcagcgccgggcgaattttaaaatttaaactttattttctaagagattttcaccaaaaaattgatgaatttccgtgaaatttttatttatttttttatattttgtcaaaaatattttgaaaaatatttacttatctgatttagtcaagaaaaattaaattttttaattccaatgaaaggaaaattgtttttaaattttgccaataatggccaatttttatgggtatttttgtttaaaaaaaccctattaatcacaaaaaaaaaataaattaaaaaagcagtcaaccaggatagaactcttgacaaaagtagtgtcaatgttaacgcaccaaccactacaccactactacatatgaatgaacaaaagcaaattactttatttaataaaaatttggcaaaatggttaaaaaaaattcaaatttgtataatttttttgccttttctctcacgaaaatgccattcttaggggtgtatatttaaccccgacccgagtcggggttagggtcggggttcggggtcgtcggggttggaagcgtccgggttcgggtcggggtaaacctgaaaaatggccaaaaatgtcggggttcggggtcggggcggggtcggggatgcaaccctagtttttggctaacgtcatagcaccgctcctactaactcgccagcagagtgctacagtacgaacaaccgtagcttccctaccatgtggtggtacagatgtgccaaacggctagagaccggccacctacactcggcctgcatgcccgcagaagccgtctagttgttagtatataaaaaaaaatttccttccatttctatttgattttattttcgagagccaaatttcaaagtggcacccgaaaatgattattttcgagaccatcctcgatttaattaatttttataaatattaaaacgtgcacaaaatggacaattttgtgaatttaatacattatttatttcatttattttattctaaatttcataaaaataccttaatttaattatagtaatgaaatgttggacctattgattaaatttacaatacatatacatcatgtaaataatttctttttacattgattaaaaaagaaaattatccaacacttttacatttcttaatcataaaaatatttttattttattaaagataatttgaattataaaatacattacaaaattcatgaattgtaaaatgattttccgctatttttttgtgtcgattatttttcccatggaaattaaatgcatcgtaatggaaaatcaaaatggtattattattgttaaatataaatatttaccattttaatttattagatataattgagacgggaaataatgatctggttaacaaacttccaaatacctttcttgttgctgatttccagtcttttgaacagcaaaaatttattaatgaatttttatgccgtgaggaaaacgaaatcggaaaaaatttttcaaaattgggaaaaaaatattttatatgaaaaatcagaaaaaatgcgaaaagatttttgtgaggaattgaagaagggaaaaagcattgaaaaagcaacgcaaaaagtgggaaaaacggcaaaattctcctattatatttcattgcctttgtgttatttggcaatgaattcatcaaagaatgcaccggctgccttcgcaacaataataaccaaattcactcaatcgaattggcagagaatggtcccgctgctgctggtgctaatgggcaataaattggtgtcaattagggaaagaaaactgacgatgtgtgatactgtgttccttatatatcatagctctgtggtgaagtcaatattagtgatatttttttcaaaccttttcttattctattaaatgtttgttgactttttgtttgtttgggaattaattattattccatcaaatttaaaatgcgaaattttaagttttactcaatgtatttttttattctattaaatgttacttgacctttttttgttcggaagttattattatttcaacaatattaaaatacgaaactaaacaatatcaattaccgaatcccgacaataaaggaaatcgagttcctaatgctgctggagaacattcactgagtcaccaacatcattaatacgggcgtacgccgattaaagtgttcaattgatgtatgtgttttttgcatcaatcaattatattttaattacgaagctaacaagagaacatatctaactgtcagtatccaaatcttatggatatttctctcttacatgttagcccattgtcatgagttcggatccgcctgacagatggtgaattattttgatttttttctaagtatcattccacctagcatttttccccattatacaattttattttttgatactattggatagaggaattcttgttgaatattataaaagaaaattatggctcttgcacaaaaattttctatgaattttggaaaattggccgaaaatttacaatcgcaaatcgactatgctttacacgatagaagtggttttaaaagtgatttggacactgacagttcgctgtattcccctgtaagagtaatgcttggtttttctataccgcgtctggttggctcgataagagttcggctttttggtcgaattctttgggttttggtctcgatttgcgagaaacgagacagaactttttacataataataaatatttttgttaaattaaaaaaaaattgttttaaataaaagtgtaaaattttaacaagtttttgcatttttggggatagttaagtggtttgattttaggtttatgtcaaaatttttaaaaatttccattccaaaatctttcgttggcgtgagacggaatgatgtacatttcacttaattattgaataaatctcattccaaaaactttaaaaatctcaatttaatgtttaaaaaaaagcccgtgtgaaaaaggtgaaaagtgaaattgcccaaaaaattactaaagggttcacagcacttattcaaattcaaaaattttgaatttgaaaaattaataaaataaaaaatttttgcgtttttgtaaatatatgataataattagggttgtaaattatatggactaaaaaacgcgaaatatggacattaaatatggactaaaaaagcccgaaatatggactaaaaaggccaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccctaatgataaagcataaatattagcccggcaatagtattgttaaaattcgaaatctctgacaacttaacggacgggcacgactgggccccgccaactgggccccaaccaactgggccccggattaactgggccccaccaactgggccccaagagacagtaatttttccaccattattgtataatattatttatatatttttcattacatacacatatgtatgtgtgtttcgtttacaataatctaatttgtgtttatatttttttcgttcagtgcctaactacaataactttccttcagctattttttaaatttaactatcatttcatggcaaataatatattatcgcagaataaccacaaaaaaattgagcatgaaggtcatctttatgttttcgccaaactcagtgcggatggttttatcaaatttttgaggtgtgagaacaaaaacaataaggacatgaagtgccgagggcgtctgcacaccaatttgaatgacgtagtgttgaaacaagtcaatgagcatgtctgtggagcaaaccctgcgcgagtggaagcacagcgcgtcgttacaggttaggttatatcaaatgctgaagattttgaatgcatatttgacaattttaggaataaaatgtagagccattgaaaccgccgagccgccatctacacttcgctcaattgcactccaaaatgtgggaacccctgtgttgtctgaagtcccaacaaaaaatgcaacaaaacaagttgtgttaatttctctgcgatgattgtattgccttttttagctaatcaaaagggcccgcggtgggggaattactcccgccaatgccgcttaatctaaacc

SEQ ID NO: 950 - DNA, 2532 bp, Heterodera glycines
aaatggtaaaaattgaaatttttttataaaatattaaaaagtttttcacataaaatgggcaatcttgtatattcatttatttaatttgtcagaaataacattaataacaatttattagcgaatgttgagacctaactgattaaatttttagacattagacaaattacatcatgtaagcaggatttccttttttacattgattaaaaaagaaaatttatccaacacttttacatttcttaatcataaaaatattttttattttattaaagataaattacattataaaaaaagcattacaaaattcatgaattataaaatgattttccgctatttttttgtgtcgtttatattaattatgagaatgaaaagcaacgaagttcaacatcaaaatggtaattattattgttaaatataaatatttaccattttaatttattagatataattgagacgggaaataatgatctggttaacaaacttccaaatacctttcttgttgctgatttccagtcttttgatcagcaaaaatttattaatgaatttttatgccgtgaggaaaatgaaatcggaaaaaatttttcaaaattaggaaaaaatattttttatgaaaaatcagaaaaaatgcgaaaagatttttgtgaggaattgaagaagggaaaaagcattgaaaaagcaacgcaaaaagtgggaaaaacggcaaaaaaattggcaacagaattggaaaatgatgaaaatattaaagaaaacattcaaaaagcattgaaaaataaaaacgaaaaaataaaattggatgacacaaaattaattgaattgaaagaagaattagccaaaaattattcggaagaaaatttgaataaactaaagacccttttttacttgaaactccatgaattttttgcatcaattaaaggtaattaataattaattatccattgaataatgggaagagatgtttaaaagtttattgtacttttttcaattggttctttccaagcgattactgtatgagtgtttaaattttatcttttttttcttttcagattcaaaaaatgaattcttcgaaccccataaaattggccgaagacaaaagcgggtcaatgtccgtgaaatatttcaagacgcatttcaacgaattcggcagcatggcacccaaatcgcatgcgttttttatgtgtttgtcgcgcttatggcactttttggagtgatttgtacgattgcccgcttggctttatttaatccggcagattatttggcatggcttctgatgctctggcttttttatgtctttgggcactacatcaacgcattcatcaaagaatgcaccggctgccttcgcaacaataataaccaaattcactcaatagaattggcagagaatggtcccgctgctgctggtgctaatgagcaatgaattaatgcccattagggaaaggaaacggacaattgtttgatactgtattcaacttaaattgtagttatctgattcataacgttgtattttcatagggaaaacataccaattgtcctccaagtatttatagttaacaaaatatattggacaaatttcagggaataatatagtcttacactgtatgggtaataaaatgtaaattcgaaattttaacttgataaacatgaacataaaatttctctcaccgatttcatgccgaatttattcgaacgtctttcaaaaatgaatttgcattcattcgtcagtttcattaaaaactcgagactgaaaaggccagaaatatataaaataattaattaaatttaaaggtccatcggtggaggttggaggggcgatgctcacattgtggcaaatcttttcagcaaaagatgttcagagaaaaggcatgacattttcttattttttcgaattacattattttccattttgtcatttttggtcgtccttattaattaattaattaattatttgcctaaatgtttttattttttaaaccgtttgctgcaggaagtgatcgcgatcacctgctcctggtgcaagcgctcctaccacaacaagcggcactgcttctcgctggcacgcttcgacgaccgctgcgaccggggcgtgctgcgcgagctgatccttcccccgggatggctgcttcggctggccgctccgcggcggcggagtgccaacccatcgaccggctcaagaagtaattggcatataaaattcaattttataaaatcaatgcctttttcagtgttggcatacgctgacgcggcggcacagaaacggtcccgacggcgcagcaaataccgtgcgtttgtggttaagccgccgcccgcctcgcgctgttcgtccgcgcaggcgcacggcgtcgccaacgggtacagccgctgggcaaccgcggcccaactgcagccgctgcccatccaaccgctgctggtgttcgtcaacccgaaaagtggcggcaacaaaggagccaaggcgttgaacacgctgtgctggttgttgaacccgcggcaggtgattgattgctaaggccaccttttttgcccttggctggctgtcaattt

SEQ ID NO: 951 - DNA, 1435 bp, Heterodera glycines
tcgtcgtcctcatcgttgctttggatgagcaggcgctgctcaccgcttgtgaaatgggggggggggacggttgatcaccattttatgtgattgggcttccggtcaacttaccaacgctcgtgttcacttggtccgagcgattggtaagttgtgccgacagtgcgtcattgatgacgctatcattgttgttgttggggttgttcaaatcgtttccgccccggtcgccgccgccaatgattgtgccgttgctgctgtgttggtgctgatcatttgcttcaacaatgatgggcgtgttgaaattcggagaacacactggaaaagggacagaaaattggattttttgagtcaaaaaaccctccccaaaaaaatagcaacccttttactcacccgcatttgtcactgccgcaggcgcctgtccgagcacacggtggcgcgactcgccgttgtacagcaacgtgaaggggaaactccccttcacgtttccatttcgcccttgttcgcgcactttcagccgcgtgaattcgacgatttggcccgggcaaatgttgttcatccgcgcaacgcactcttgccatccgtgcattgccaattcatggtccatgctctgctggtcaaaaatcagccgcacgtcgaagccgctgatgttatattccaattataaatgaagttattaattattttaaaggtttttggataagaaaaaattttaaaccaaaaatttttatcaagaaaaaaaaattatattttcgtaatcaatttttggaaaaaaattttttcaattcttaagggtgtatttttctgaaaattttttgggtcgattcttagggggtgtatttttcgtttttttttgaatttttgttaagaatttttccgaaaatcttgaaaaaggcgccaaaaatggcgaaataggcacaaaaataggcatttaggcatcaagcacaaaaagtccaaaataggcaaagttaggcattataaaaagtcatcgtgacacccaccccaaaccaagcggaaaacacgtttttgtgcttatatgagcgtatcaagtgcgcattttaggcatttgcctaaaaaaagaatccctaattctaatatatgaaagtgcaaacatcacatggaaacaatcataaagaatgaagaaaaagaaaggatagcacaaaaagaaaaagagtattttaaataagcgaaatataatggggaaaagaaaaagagcatttttatttaagaaatagcataagaaaaagaaaaaatgcattattattataagcattcaaaaattgtattcattcattcacacgtttgcctggttgggcttcaatttttatcaatcattatcattataatccacgtggatataatggcaaacaatgacagaaggactgcgtaaaacaagggcatgacgggagcagaagccaccattttaaaattaatagaccaa

SEQ ID NO: 952 - DNA, 2105 bp, Heterodera glycines
  misc_feature (46)..(47): n is a, c, g, or t
  misc_feature (51)..(51): n is a, c, g, or t
  misc_feature (56)..(56): n is a, c, g, or t
  misc_feature (88)..(88): n is a, c, g, or t
  misc_feature (93)..(93): n is a, c, g, or t
  misc_feature (95)..(95): n is a, c, g, or t
  misc_feature (109)..(110): n is a, c, g, or t
  misc_feature (117)..(117): n is a, c, g, or t
  misc_feature (129)..(129): n is a, c, g, or t
  misc_feature (131)..(131): n is a, c, g, or t
  misc_feature (137)..(137): n is a, c, g, or t
  misc_feature (145)..(145): n is a, c, g, or t
  misc_feature (153)..(154): n is a, c, g, or t
  misc_feature (166)..(166): n is a, c, g, or t
  misc_feature (195)..(195): n is a, c, g, or t
taaaggaataattgttgataataatgaaattcatcttcaagaaagnncaanaaaanaaaaaaggaagagagaaagccttaaaaagagnaaaananaaaaaaggaacaannggaggangaaaagaacaangnaaaaanaaaagagncaaaaagnngaaaggacaaantaaacgaagaaccatttgaaaaagagtgntaatgaacaagtggatcagaatatttcgtatgctgaacaaagcaattctgccaatgaagaagctaccaataatacggtaatatgaccgataaaagaatatcatacctagaaaataagtatttcgaaaatcgataaattctaagatcgtaattaaaaataaatgatttttagaatcgagaaacaagaaacaaaatggagattttaaacgaatttaatttgatgaaaaaggaattgcgaaaagaaagtgtttataaaaatttgtcccattctcaattggaatgtgaaattgcaaaaaagttgggaattagtcgaaagaaaatttataaatggaagaacgaatttggtaagaaaacaatggcatatttgaattttactaattgtctcattttaaggtttattaagggaattttcaaatcagcaaaaaatagtaaaagttaaacaatttgaaaaagtgaaaaaagaatttacaaaaaaattcaattcaaaaacgaattggaaaattaatgggaaaatagctgaaaaaattggtgttaaatttaatacaattcgtgtttggaagagaaacttaaacttgacaactcgtaaatttgtttaattttatacttttatttaattataaataatgaaaattaatttaaaaatttgattttttgataaggaaagaccaaaatttacacggatgctgataaattggaatatgtgaaaagaattgaagaaatgacagaaagaaacccaatgatgaagaagaagaaaattgccgaaaaattaggcattccaattggcaacttaagccgatggacgaagaaattcggcaccaaggcagaaggtttagccactagaccacatttgaatttgaataactgctttaaattaaataaataatttacagacccccattcttaccagtgcttatttagtcccgccgggaccgggctttctttttttcaaaaaccgggaccgggcctgaaaaaaccgggaattcccgtctcggtcccgctcagctcaaatttttctgttatttaaatttaaacaaaatttaaaaagacatcaagctttcgtttcataaacatataattcttttaaatggtaattggggatgtcaattttatgtaaaatacatattttttcttggcttctccatgctctaaatagtaggaaaaacactttattttctgtgtttgcaacaaaaatcgggacttttatttacatattttggggttttatacatatttcgagattttatacatatttggtacatattttggtttttttttacatatttatatacatattttgactactttttgtacatatttttgacatccctactggtgggtgagctatttctaaaaatcagtaaagtcgatccatggcccttttagtacaggataattgagcttcggtacaagtgcgctggtttatagcttaatttgctaaattcattgtttttttgaaattttgaaaaatttcaaaaatctcattttaacaattaatttggtcccatttaagcgaaaaggacattttacacagctgctgagaaattggaatatgtgaaaagaagtgaggaaatgacagaaagaaacccaatgatgaagaagaagaaaattgccgaaaaattaggcattccaattcgcaacataagacgatggacgaagaaattcggcaccaaatcgattcattagcattggtgaaagataattttatcctctggacacttggctcaacttcactatgtagagaaaagcatatactatttatttataatgcctttttctaccaaaaaatattaatttttaatgaaaaatttcatttcttgagccttggagctttttatcagaacaaaatgagcaataaatgataaataaaattttgttagcactcatgtaaatcagtttttttgtttattatga

SEQ ID NO: 953 - DNA, 6270 bp, Heterodera glycines
cgcatttattatttggtgtgttttgggtggagaaatgctttttgcttttacttcccataaattggtttcaggacattggacttaaacatcgaggcttattcgcttctgctttacgccgaggggttgtacaaagcacagagatacgggttggaagggatcggcacagcttgggttgggttaggggggaaatgaagtgcacccatcgatggcacaagtttcgttgaccggagagtgccattgtaaatcgtcgtcttttcacaaatgcgatgccattagcttccagattttgttgtttagtgaatctggcgaattggatggctttccgctcctttttgtgccgggtaatgccggttcggggcgacaagtgcgttcattgggctcactgctgcagaacaaaacggagaggctgggaacgcacttccatttcgacacatttgcactcgacttcaacggagtaacagcaaatgagcgggcaattaattgaggcaattagttaattgcaatattttggttgaaggaaatgaccgcgctgaacttcgattacatcgaaagtcaagcgcagtttctggccgattccgttgggcacattttgtcgctgtattcgccgcacaaacagcccaaaattgtgctcattggccattctatgggcggaattgtcatccaaaaaatgttggcggacaatgccaacagatggagcaaacatattgcatttgtactcacttttgccactcccttctcacagccgcgtaagaacaaaatgagtggggggtgggcgagagaatggcatcagacaaatgccactgattgaggggcgggagagaaatgccactgattgaggggcgggagagaaatgccactgattgaggggcgggagagaaatgccactgattgaggggcgggagagaaatgccactgattgaggggcgggagagaaatgccactgattgaggggcgggagagaaatgccactgattgaggggcgggagagaaatgccactgattgagaggcgggagagaaatgccaatgattggttcgaatgccaatgttgattttgaagccgtgcttatcgagaagcgatttttgcgtttttgggactcaatgaacggcgatcggcggttgccaatgagtgccaaaaacgggggaagtgccgccgctgcgctccctccgcctgcaattgtctcagtgagcgggggccttttggacgaattcattgacgagggatggactctttcgcgtgcggtgagtgtccacgcgcacagcgcggcgatcgaccgaatttgggcggaggcagaccatttgtgcattgtttggtgcaatgaaattgtacggtcagttggccaacgcaacgcacaaacattgcgggatagagaaggggcggggggggggggggcttttaggttggaatccaaaagggggggggggtaacatttctttaaaatctatttaaaaagcttcccaacggctttttcgctcatttttcagagcctataatttagaaaaattaaacaaaaaatatttttaatggcgatgtggaaaaatatcttcgaattcctccgtccgaatttttttgttcctaaaatatgaaattttttgttgtaaaaattgctcaatatgtgccattcactggtgccatccctccaacgaagccccccttcaggcaaacttctcgctttcttttcgattacgccgcctctccgactgattttctggagaagttccacgacttcgcccatttgcattaccattcgcttgggctccgactccgtccgatcacttcggaatcggtcgctttgactgatttaaatgtcagcctttgtaccccaaaggtcattttgcgattcgtccgatcactgatcagtcggctgatcacttccatttcccctgtctctttcagtgtccttcgcaatctgtgcatcaaaaattcgatcttttggccaattccatcggaaaacgccgcctccttttgttggccattgccaatttgactgatcgggacaattcggtcccaaaatttgaccttttaacggcgtccaaatgcggacaaaatccacaaagtgttggtggcactcgctttttggacaccgatcatctctttgccgttgccaatttatcaaattgcgagggacggggaaacgttttggtcgcaccgaacactaatttatgggtgctaattgacccccattaaatataattaacaaatcatttttcctaaaaggtttttgacgactccgccgtttttctgccggaaattcacttgtctttcggtgattttatatggcacaacaacactcgcaatcagatgcatttctcaatggaaatgaatccgttggccatcgtcccaattcattttccacgcaatgaaaaagaatttggcattttccgtgtcgaaatttggcgaacaaattgccgtgaaagtgagcagcaaattagcccatctaattgcattttccatcgctttccaatgttcagcggcggaaggtgccgtccatcgacggattgtcttttccgtcgacggagtgaggcgacggtttgacaaattcggcggcgccgattcgaattcgcccgcttctctgcttatttacccaataataaatcgtcataacccggccgaaatgggcggtatacattaccaactgatgctaattgacactgcgcaatgtgccgaatgtttcctccgtttttcggtagaccttcgcttctctctgattagggtcatttttgcatattatttttatttttaaagggaattttgctaatttaagcttttccgtcaatcccaactccttttgcctgcttcgtgcgtctttgcttctgtttttgtccatttttatgttagcttagcggtgggaagtcgtcgctttgtgaatctgtttgtgctcccgcttttactgtcggccgcaattgccttttgcgggtaattaaattggccacctaattaggcctttaattaggcttttccctccctctaagcactgatgtccttctgctgcttctcctcttcgatgccgtcgctcttttcttcttccatttgctccttttcacccttcttcccttcttttctgctgttcatcgtcctttttgctctttcacttcgtctctttctctcagtgttcttttcttctttctgtttgcgctgtccacgacgttcaccaacaacactttccctctggcggtgtttggcctttttttgaacattgccgtaaggaacaaatttttgtatttaattggcacttgtctgagcgtggaggatcgtagtggctgaactaaaataaatacaacaaaatttctaagcctgaaagccgagacctaaacacaaaaactgaatccaaataggaggatataatcacccatgagctaatgatttttaaatccgatcacttttgcatttataaatgggttcgttctatggtcccaaatctgtcggatcagttccctttttgacaggctttgcaccggcgtttcgtctccacgggcaatgccatcgctttttcctccgcttctcttctgctgcttctgcccgtctttgttttccaatttcctcacattttcacttgcgtatggaatttggccaaatatggccaattttggtccctttccgacccctttttcgtctccaattttgcgttgtctctcttttcctttttctccctcttcccttttcccctcttaaatttgtccgttcttttccctcatctctttttcaaattccttacactttttttgttccttttttctttgattgttttttccactttttctgcctttatcactccgatgagctttcttctctttgacgatctctcccttttgtctgtttttgcatttgaaattactttcgttttaaatcattttttgtcttttaggtaattgctaataattaaatttgatttcttcactctgtctttatcacaattttattagcaattttctttttttgtcttccttttatcaaatataattaaatatatttaattatcagtaattttaaatgaaaatctggtccgattgactgacttcgcatatttaatacaaaaatacaaactgaacgccctttggtagcccaaaacgcacaaacgtgggaataaattatgatcacaaattcagcaataaaaagaaagaaaaatccgaaaattaaaggctataagaaaaataatttgagcaaaaacataaaagcggcagagaaaatgccgcttacggggaaagtgaccacccaagcgaggaacacattgcgaaagaggggccaattgacgggcacggaaccgcgcacggcgcccactgcgacgacactgcccacctgaaattgcggggattggggggagtgatcagatcgataggaattggattggaattatccggttatcgaccaattattggcaattaagccataattgtctttgatcattgatcctttcaatttgtgattttaatcactcgatcgctttgttttttggtcattattccccgatcattcttctgtttctctgctcgctattcccctccttacaatgcacagtgtcatcgagatgggaatgcccaatttgctggcgatcaccacggtgattgcggagccgagttcgatgcaaaacccgcagaagggatttatctcagtcagctcttggccaaccgttctgatcacacgatggccaagcatccaaaagccaatgcacgtgcccatggagccgtagaacagaatccacaggggtgtctcctgcggttgtggcacgtgcacattgttgtagacgaacagcagcgtggcctgacaacgagaagcattggtggaggaaaagcaaagcatcggcggatcagaccaaaggggcgattgtgttcggaatgtccttggacccgtgcgagaagccggtgaagcagccggtgaacacttggaccgcactgaacagctgcagcgtgtcccggtcgtccttgcgcttcgggtcgggcaaaatgcgtttcaaaatgcccgggggatgcaattcgatttgtttctgtttgctttgctgctgatgctcaacgtcatttctgtccgtctcttcatccgccgttgttgataaattcggctgttcagctccgatcgttgccatcgcttcgccatttgcaatttctgcggagaaaagcaaatttaaaaagccatttcgaaatgccaaccgtcgttgagcttggcatttctctttgctgaattttttatccatttgagcagaaaaggacggacggccaattggaaaaagagggcactgaataaaccgacgcaaacactgagcaaaagggcgaaccaaaagggcgttttgtcgaagccaatccctgaaaattggacaaataaacagggcacattttaaaatgaaaagcaaaagtgtgcacattttgagccgcgaaagacgaccataaaagtgataaagctgagcacagcgaaatagaaaatgggcatcgcaataaacgcacttcgaattgggtctttctgaaccgaaagtgccaaaatacaaaaaagggaaaagggagggacccttcggaggacggcaatatcaaagaacacatagagaagggcggagattaaaccggcgagcaccttaagaaggaaggcacaaatttgctttagcattgacaggtaatcaccggagaaacaatccatgaaatgatgattttgaccacgttgtccatgtgaaggccggcggtgccgcgcattaccatggaaaagccgatgatgccaccgatgtgactgtgcgtggaggagacgggcagacggaagcaattggaggtgagcatccaaagggcggcaccttcaaagagaaagagaaagtgccgggggcaaatgccaaaggcacggacccgcaacaatggcaacttggcccagcaaaagttcgttgggagtgttctcgtacatttccaattcgatcactttgaaacggagagtctccaacactttgtaaccttaagggggattaaattgaatatttaattttaaacattcatttttaaattctaacccagcagaattccgcccgcactttcgacgaccgtcgctaaaacataggcaacgcgcaaactaatggcaccggaacaaacggaagttgcaaatgcttagcaaaagaaatcgaattaattgaaattttgatggtttataatgttttgagatttaccgttggacacttcgttggcacccatcgcaaaagcaaaagcaaaggacaaatgaaaagcgacgacgagggcccaaagatgagaagcctaaggggaggggggggggagaaagggacactttggcacacaaagttaaaagcctaagg

SEQ ID NO: 954 - DNA, 6383 bp, Heterodera glycines
  misc_feature (6110)..(6110): n is a, c, g, or t
ttaaaaaaaatgatttaattgcctgtgaaaaaatcgtggtataatttaaatatttatcgctgcatttatagtgagtgattaacgtcattgatccaaactctgtgcacaaaatgggaaaatggaagtgaatcgacggcggaggggggggggggcattattaggttattagggacactaatgaataatataataataataaaattggaaatcatttcgaattttggaatccattttcatttgtcactgtttttcccttaacaatctaaatcttaccgagtttttttgtgttattttcgcgtaaatgaaaaacggacgtgcggagagcggcggcgcactccgccgccattcgatcgccgatttttacgaaaatattggcaaaattaatgtacaaaataacttcaatttacaacttttctgtccatcgaatctatttctcgataaaaacagcttcgagcaaccaaaaatgggcaaattgcgcactttcgccccctctttccccccccccccttttgcggtgaatttcgccaaattgttgttttcaattaattcgcctgttttgcgcccccccccccctaatttcccttttcccattagtctctcaaattgccctttcgtttcccttttttggtaaaatcaaaacccattcccaaataaaaaataataataatttggttttattattttagttctttttcggttttcgcagaattaataaagtcaacgaatgaatgcatttggccattaattgccttaacattcgctgcaattggccgttctttctcttatcagcagaaggaactgtccttattaattaattaattggtgtatccggaattttattgaagcaaaagagcgatgggatgaaagggaatttggaaaaggagcaatttaattaattaattaattaattaatggggagaggaaggaaagtgatcagcggaagagaccaattagcaaaaggggagagcaaagaaaaagagagcggacgaattaatcgaaggaagcgatcgctttaattgttgcaaaaaaagataaaattaattgatgaattaattgctttattaaacatatttgctaaagaaagacatttcgtccacaaaacattcacagctgaccctaagaaaagaaaggcattttaagaatgaaattcaacgctttttgtcctcttacctcacatttaagttaaatttttcccaaatttggcaaagtctaaaatcatttattaattatttaaatgattaattgtttcttttattttcacttacggcgtaccgacattcttcaacacgacgaaattcatgtgcttttgtttgcatttcccatgggcttaaattcgcttttaattttccatggtttacggtattcccccggcttacggtagtcgtaaaagtacagacacgctttgtcctcgtcacacgcgacttcgttgatgaaaggcgggaaaaactcatcgggcaatttgcgaatggtctgacaagcaccgcacaagcgcaaatagccatcctaagaaggaaaagcacaatccgaaaatgatattatggacaaaaagcatcgaaaaaaggtttttggttcttctggccataacttttttgaaagttaacgaattttttgaaattttgcaagaaaattgagaaaacttttagcattattgaatgatatcaagaaataaaattataagattattttagataaaagtatgaataattttttggcaaaaattaaaaatttccatttgtattttttgagtttttgccaaaaagcaccgctcacttccgaatcgccgcgtttgtcgcagccgaatggcacggcatggacatcgcctgaagggaggcggggtaattaattggccacgccttttctgttggtcatttatttaacttttgccattctttttcctggctaacttttgcttggacttttctttttttggcatttccctttccttctcccaccgatcattttctgcttttgcttttgctttctctgctgctttctcccgcccttttgctccgttttgtcctcctttttcgtcgcccttcgcttccgccgtttttcgtcgtttttccccaccaaatgtgccaatacggagttgcgtttgtggcgcatcagctgaaactgatcctaaatgctgggtttttcgctatttatgccaaaaatggcgcgccttttgctgccgcaacgacggcgaaatgatcgaccgcttcgattcgttcctaaagcaaaagcaccaaaattcattgaagctgtcgcaaagcttctcatttcgtcttgcattgtcaaattgccgagtcgcgacaacacttcgggggaacgcacgtccttaaaataaattatcctttagacaattaatcaaacccagtaattaagcctctaattgattaataagttagttagttagttagtcaattggctttttttgcgttaatttgtgactttcccttccttacacatcgcaagttcagctcactcagcagtcgttccaatgcttcaacatttctcttcactgcttggtcacttgactttggggcttttgattggcgcttaatgcaattatgttaattcattgtcccctattaaattttaattgcccaatttcccattttaattgccccccccctccgatcacttcgtattggtcagtgatggttttgtcgaggaaacggaacactccgctgacatcctaaactcaaaatgactttttcggcactttttcgcttttccgatcgcttgcccatgccatcagttcggggttgtaagtgcccttctgcttcaactcatgcacgaggtcatcctgtgccaaatgtttgcagtgatccacggcactgatatttcgctaagaaattttaaaaataaaaattaaacattttaaaataaataaataataccgaccaaaggaatcaatgagaaatatttggacgagaagtgttcggccctgaaaaagcccgtcttcttcggactgttcgaatgtggccgttcgtcggagtcggattccgaactgaggggaccggcgatgggttcaagcgaatcggagggatgtgctatttaggtaatattcacatttttgtctttttctctctttaccaacatgtctctgtcccttttgccattgtctttcttgtctctgtctctctcgtctctatcccttttgccattgcctttcttgtctctgtctcctcttttgccactgtctttcttgtctctgtctctctcgtctctgttgtctttcttgcctctgtctctcttgccactgtctctcctatctttgtctcttttgccattgtctctcttgcctctttctctcctgtctttgtctcttttgccattctctctttttcagttgtctcttcttccgtttctttcttttcctcaactgtattccctccttttttgcccactatctcctctgtatttgtctcttcctctattgtttttgtcttttggcccattgtctcttttccgtctgtctctttctctcggtctattttttcctttttcgtcttttccgtcgtcgttaaaattggcattttttccatttggactgttatggcctccgttgtgcccattttcaccggacttttgcgaatctcttcaaaattggaagacaccgaaaccgaaatggcatttttacgggcgatgaacaaatcggaattgcgatttggcatcgatgccgaaatggaaataaaactgaaattgggaaagggaaaaggggaagttggaaggggacggaggagaggaagaggaaaaacaaaagcaaaaaggaaaaggaaaagggtaccgtcgggatttgggaaagtcggaaaagtgggcgagttggccgggccatttggacaacaccgattcgacgtccgacagaatttgccgcaaatgctgccgatactcgctcagctcaacaactgaaaacagaacgaaatcaaatgggattcttctctctcttcctctctctccctttctctttgtctctcttctctctctctctcttcctctctctctcctccccttctccctaatcaccttcattacttaatttacttctccccacccctttccctcctccttctgctcacattctgcgtcatcaattcgcatttttccttccaccttccgcttcaactcttccaatgctcctccctttatgccttctcctgccgatgtgccattcgcttccttcccttcctctgtccgattgctcatttcttcaacaaaggtatcggtgccattcgcttcgtaatttatcattggcaattccgtgggaggcattggcgaaagtaatggcaaagaaagttccgactccaatgggtaaagaattttcaattctgttgttgattgtgaggtattagttgtcagattgcttttggcattttccgactgatttttggctaatatttccgtttcattttcatttttaatgcttttaaaatttgacggtgccatttcagtgccaaccaatggcattgtaatgtttgtgaattcaatgctcggttctgtcgatttatttagtttattttcgctgtaggtaatcgttgaaggtgatgccgtgccaatgcctaaagcttcttccaaaatgccgactgatggcatggcaatttgaagggaagggaccgttggggcggaagaaaagggcgaaaccggaagaaccgaaccgactgaaagagaaaagcaccaatcaaaagcaaaaaagttgagatgctcccattaatgcccaatcactgacccttctctgttcggttggctttgttctccgtctcgtccgttggcatttccttttcgtgcccgttttcttccatttttggcactttttcttccccttccgatgaattgccttttcgctctccgtcgtttgccactttttcccattttcgttgtgccatttccgttccgttcacttccctctccaaatcggcttttgctattgaatgattgcgttgtgaatatgccgttgtttcgcttgcattttccgttgccattgtcatttccgcttgttctggcgtcgtttttgtgactattgtctccacttttgtggggccattagatgctaattggtcgtattccgctaattgctgctgctctttcgcgggtcccttttccatttgaatttcgcccgttttttcgccacttttcgtcgtccattcattggtcgaattcgctgaacatttaacattttggcattgaataaaaaacattcacctgctgatgggtccatgctgaactgcagctgttccgtctccaattttgtggcttttgcccaattaactgaaaaaggccaaaccaattcaattcgttcgttcgttgtgccaattctccctccccccccccaccgtttgagccattcgaatggtcgcccctttgtgtgtcaattgtccgattttgtgccttgtcccatttgtcctcataatcaaacaatgccaaaatctcccgcgttaattcgtcgtcctcattcattgaaaaggcttttatgtcgctattgcttctgctcacatttattttttgcatttcggttgaattctgaaattaaatttggatttttaagattttctttggcattttgccactctctttctccgtttttccttcgtctgtgccattctgtcgttccccaaatggcaccactccgtcgagcaaattcagagagaccagcacacaaaagaggatggacgacgagcagtgaaagtgccacaaaaggcggcgatgtttcgtcggactcggccaaaaaaagtctctccagcgaagcccccggtgatttttgtgctttggcatttcgcaaaacgccaaaggattttttggcatttttcaaacggcgagattaaaaacaaagaaacaaaatttaattttaatttatcatatttttatcagtgaaaacaaaaatatggtaaaataaaataaaattaatgacggaaagcgaagaaataaatcgacgaaaagggagcaaatgaaatgaaacgaattgggcgccgaaggggcgacaaagcggcgccatcgccgcgtctcaggaagagctgaacagtgaaaagatcgcaatgaccggaaggaatgggaaggcgacggacaatgacaaaacaaatcggcgggggcaatcggcggaaagggtaattaggaggggaagggttaattanggagggggatattaattagtgatattaagaataacctaaggggggataattgtaaaagcgaatgcatttggtgggggaagggaatttacttattaaaattgagatagagaagaagaagaagaagaagaagaagcttccccgagaggaaaattaatggatcaattgatgagtcattttattgatggtcttttcataattatttgaaactctaaaaaagtaagcccaatttataaaaaagtaaaagcacaaaaaagaaagagaaaaaagtaccga

SEQ ID NO: 955 - DNA, 1478 bp, Heterodera glycines
tcccccctcccccgggagttgtgcccttttcgctaccccgttcattggcattggcaccgtccgtccccccccccccccggcaatacacttaattaattcattttatcgaaaatgattaataaagctcgaatttactgtttaatcacgaattctaattaatctcagattataatacataaaattgcttttcaaatggattttaattttgtgctcctttccctggaaaattggctgatcaaagatgcgattctcgtggaaaaggccgcgttggaattggcagtgatcaaagaacaacggcaaaaagtgaacggaacggcgactgatcggactgagtgcgcttctgctgacaatggcattggcatatgttggagaaaaacaaaaaccgcggaattgaaagaaggagaaaattttacgacacgtttcggaatttcgtggaaatttctgacaaaaatgcccaagggtgaatttgaaaaactgaggcggactcaccaggtgagcaaaacgccaccaaaaataaatttgaacatggatacagtattccctcatttaggtgtcaaaaaaccgaggcgtcggctacggggtacggtacgcgtgcacacgaaatgccaaggcacgagacaattgcccctttttgatgctgagcagagaaagtgcgttgtggcaaattaaaatcaaaatcgaacatatatactgaatttagccgaggacgggtcgctgagtgtctattaccgtaacgcgcacatacataccgtaagacaaatccgcggcagagaaaagagagcagtgggcatggcgtcgtcttcctcctcttctgctcggcccccgtgttcctcctgctgttcgtccgcttcttctccctgtcattccctctcttcatcttcctcctttttttccacttcttcttccttttcctccctttcctcttccttttcttccttccccctttctttttcctcgtcttccttttcctccccttcctcttccttttcttccttccccctttctttttcctcgtcttccttttcctcttccttttcttccttccccctttcttttcctttttcgtcattgtccgcctaatttcgctttcctttttcattcatttttcatcgaaaagcataaaatacatatcacagattttacagtttttgctaaatcaatcaatggatggttaacgtaaaaaatataaaacattaagggaggaggaggggggattttctgattttgaatatttatttggctttggcattcacccaatcatctccaaatttgccaaaataaatgcaattcatttggcacggcatcataaatttacgtttcgtccccacgcgacggagggacggaccaatgaataaatgcagaaaatgcatgtaaaataatttgttgacaattgccatgatttgctggcatcaaatgccatcagaagagtgtgccctttccttccttttccctcggtcgtttctttttggcactgcgct

SEQ ID NO: 956 - DNA, 2018 bp, Heterodera glycines
  misc_feature (44)..(44): n is a, c, g, or t
  misc_feature (129)..(129): n is a, c, g, or t
gctcggcccccgtgtttcctcctgctgctcgtccgcttcttctncctgtcattccctctcttcatcttcctcctttttttccacttcttcttccttttccttcccttcctcttcctttctttccttccncctttcttttttcctcgtcttccttttcctccctttcctcttccttttcttccttccccctttctttttcctcgtcttccttttcctccctttcctcttccttttcttccttccccctttcttttcctttttcgtcattgtccgcctaatttcactttcctttttcattcatttttcatcgaaaagcataaaatacatatcacagattttacagtttttgctaaatcaatcaatggatggttaacgtaaaaaatataaaacattaagggaggagggggggggggattttctgattttgaatatttatttggctttggcattcacccaatcatctccaaatttgccaaaataaatgcaattcatttggcacggcatcataaatttacgtttcgtccccacgcgacggagggacggaccaatgaataaatgcagaaaatgcatataaaataattgttgacaaattgccatgatttgctggcatcaaatgccatcagaagagtgtgccctttcctttcctttccctccgtccgtttctttttggcactgcgctttcttttcacttcgccaattgtgccgttcgttctctgttagccctttgctgagctcatttggaaatttagacaaattgaggaaataaaacttaataaagtaaaaataaaaaagaaaatgataaattaagtgatcattcgttttttaattccttccgtaaaagaataacaaaaactgtgtgaatcccccctcttccccgggggtaatccccgcgtgaatgttttccttttcaatgtgcgggggtggtcttttcgcttggattatcgccgattggattttgtgcatatttttgttggtcttttaaatgtttcgcgcatttgccaattttcacgcaataaaatcgaataacactacttataataataattattattaccacaataattacaattgttccttgtgcccaaatgcaatttttttcgttggcatttcttttccttccgttgtccgactttggcatttccgtcatggcatatcaaaaccgaaatgtccaaagacattccgtgtttaaacgtcaggtaaaagctaaacaatccaattaatcattcgagactcattctcggacaagtgcttttctcagagtaatgcctgtcttttcggcatggttcctcctttgggcgcttccgtgcagtattcccagggaggcggcatcggcaccaatgccgtcaatgccgtgggtgctttgcctctgtcgtcctcttcggccggaccctttccctccggcacaaccgccacaatgttttgcattcagggcggtatcccagcgggtagcaaaatgtttgcttaactatctcttttttgattatcgcgttatacaatgcttctccgccttttgctaattgctcttaattgcccttgattaccattaattagcctcttttcccattaggccaatcaacggctgtttgtttgaatggcatttggcaacctccgttcttctccgccggctgttccctttcctccgccttcggcggtgtttccccctcagttggcctttcgccttccctcgggggcttttcctccactggccaatgtctgacgtcgatttcgcccctttcgcttggtttgggtctgttattttaaaataccatatgccaattccgcaaattccttaaggcaatgtttattactcaaacggcgagaatcaattctcggggccgtatccctccggcacaatcgcaactttgcaatgtcccgcggggcaaattccgagtggggcgacaacggccacatgtttaaacggtttttggcagccgaatgtgctggggagttgttcgcagactttgaacggttataacgcaaagagggcgcaggaattcggaccgacggggcgggaggga

SEQ ID NO: 957 - DNA, 4324 bp, Heterodera glycines
  misc_feature (4287)..(4287): n is a, c, g, or t
aaaattaaatggacaaatttaattaattaattataaattgtcacttattcaaaaggtctcttctgctgttttcgacatttgttggaatttttgcagatgcagaaagaaaaagggaaaaaatcaacaaaaaagagaggacaattaatggagagaaaggacgagcgcggaacagcaaagacatttttgattaagaagagaaaatggcaaggaaattaagggggtggccaaacatttaaggggcaattagggggggggggcaaaggtaattaaacaaaataaatatttaatagaccaaacccaacgcatcagcagcagagggcgaaaattaacactttacaaaaccaatgggcataagagaaaagcaaaaaacgaataagtgacagacaaaaagggacgaagtaaggggcaaaaggaatttgaatttaattgatgggcaattaacggaaaatgcgaagcatttgcaaaaacgcggggagagagtgccaacaaacccattttaaagggttttataattcaggtaaataatcggataatatgcaaatgcaccgcttcaaaatcagaagacacgaccaactgtattgtgaattcaaagcacaaaactaattaaaagaagcagatcggagatgccaaaattaagtttgagaagatgtgaaaaaatggaaaataataaaataagaataatccgaattatctttggttcattttgttttcccatttgctgaggaaccgtttgagaaagagcaaaaactgacaaataaactgaactcagagaggcagaggagttgaaacaaagccggcattttattttagtttttcttctcgttttgttgggaagaaactgcgcaattctcatgaaggattggcatcgaaatatttatcacgtcaatttaaacaaaagtgtggctcctcaaatactacaataaataatacctattgaagaaacgattgaataattcatccaatttattaaaaatgtgcttgggagggaactcccaatcccttcgtattgtttggtggccgttcaatccctgtaaattgaacccagcgaaagaatgaattggatgagtgccatttgaatgcgcaaatcgctcgcgtcgtccgaacttttgaacagaggcaaaccggcacagatcaaagtgctttgttgctcgtgcgcaatctgacaaatggaaatatagtaacaataaatcgctttcaaataaaaccccaattttcagaagtttcttggaaaaaagcgcaaaaaactgttgcgatgtaaaaaactgtctgttctttgatacttttttacctggtcaatccgctccaaaatcgctttgtcctcatttgtctggcgttccttctcatcagaaattccatcgcaatttaattgtgagggtttttcttcacgttgtgcccacaaatgtctgaaattgtgaaagaaatgagcctaacaaaaagaactttaattggaattttatcttttgttttttaacattccgacgaaaagggaaaccgaaatgaatgtcttaaaaaatgtgaaattactaacaaaacttcttcacctccattgggttgttaagctaatcttacagattttgtccattttaattcacttactgttcttggattgtttgcaaatcttttagcgagtctacgattgaatggacagtgccgtcgagaagcgactgggccaattgggcacgcattttttcttcttttaagcggtccaaagtggcggagtcaattggaaaagggacgggggacgctaaaggagtaaaagggaaaataaaggcaaaatgaaagaaatgccaacgtccaaaagggacagccaaaaagtgactcattttcagtcaatttatgcgtttaatttttgaaattggcagtcttttttgttttactccaaaccataataaattatcattttcaaacccaatttgccaaatttggttcccttttgggtcactaactttccgtttgatttgactcttccgttgcaattgtcgtcaggaaaagatcccatcgctgaagaataaattgtcgccgtaaatccatcggtcactgaataaaccaattccattgttaagcaatccgtcgttttgtctttgtttgtggtaattcttctatttttttttcaccgcgtgtcggtgttcgaaacagaaattgggcggtctttggtcctgccaacggctttcgtctgcctccaacaaatagttgagttccgagtcttggtccgggatctctttgggtgggatgggaatgtcgtccttaagcaaaagatgaccatcgaaatgaaaaaagcatgaatacagttggcaatttatgtcgaaaccactcgcgattaatgcctttgaccacaaattcgtatccaatccgcgtagaaaatgatgaaaaattggatgtcataaactaaatttctgatgagctttacaaagagcacaaactcacaaatggcggaacaagagaaaagtgtcaataaatcattggcgtaataaataaaatgccaataaattcaaatataaatcaaagtgtcttaacttaaaccgtagtcattgatcactgatcattaatcaaatgttctttataaatcacaaagtaaattatccttattaacggtagataaatatttaattacatattaaatatgtaaagagaaatacaaaaaataacagcaaaatcaagcaaaacagtcaaaaagttacaacggagtgatcaatcattgatcagagttcattggcatcgaaaatggcgttcaaaggtcgattttctagcaatagaacatcaaaatatcctgcagatcgttttgtttgccttgcacacgaaattatcatttaataatgcgtgaaatttctctaccatttgttcattaattaagacaccaaaagccatgtaatttagcgaatttaggtgaatgattgatgggactttgttgttgaacagtggcggcgaaagtgctgcagccaatgacacggaattggtcagaaattgttcggaaatcagcgttttagtcagccgaaacaaatcggcaatggcaaacgattggagttttgacaagagagtttaagagtcattaaaatgttgtcgcaacaaattccgaaccgactgtgcctcttgccttctttagtaatatggctgggatttttagggtaaaaaccccgaaataggtagaaaaatattttagggactcaattttagggaaaattttttcaattcttaggggtatattttttaaaaaatttcgacttattttgaggttcgtcttttttctttttattgaatttttgtttgtacagattttgtgatttttccaagcataatttttgtaaaaaataataccaaagtccatagttcactggacagaatggaccgtgtgaatattcaaacgcagcgaaagatgtctccaccaaaccgaagattgggaaattgataatggagaatggactaagtaaggtgcttatctcatcagcagcagagacaagtttaagtgcatccgaactcattttacccccataatcgagggaaagtgatctgtccatttgtccatttgtccttggcacactttgcgaaccgataagtcattcctttccatccatcggcccatttcatttcccctcttctgctgcttcacttcctcgtccgtttgctgcggggggggggggggagaacctccgccgatcacttcttttgttttgctttgttttgacgtcgaccattatgaagctgcggccaaaatgatgtgtgagcacctgttaaactctatattggcagcatattttatcataatatttaaaggacaagtgcaacaatccgcacgtgttttcatagcccagaacaaccattattttccctacgcttcattgtatacactgttctctcagacaaccgacgcaaacattgaccgtgctcctactcactgccgcgatgttgacggacgaagaccagacccagcgctcaatattgtaatgactaatatgctcaagatacagtaaatgaattagtccaaaacatgtgagaacatgggtgttggagagatgccaatcccattcccatctgcactatgttgggtgcgaaaatggtgagaagcttggatccgggacatggaccggtccgccctctttagggcctacaggtgaattgccatttagcgctcaacccaataacgtgccaacgcctggactaagggagggaggagggccatgatgtgcaacgttagggcacttccggtttccattgcattatgcgatgtgtcaactccaattattggaggaaaccaagtgcatgtcggctgacgcaaagaccctaacagactanaaccgcgcctaggtagcgaagctcaaaaagcgcgcag

SEQ ID NO: 958 - DNA, 6183 bp, Heterodera glycines
ttttgtaaataataataccaaagtccatagttccctggacagaatggaccgtgtgaatattcaatcgcagcgaaagatgtctccgccaaaccgaagattgggaaattgataatggagaatggactaagtaaggtgcttatctcatcagcagcagagacaagtttaagtgcatccgaactcattttacccccataatcgagggaaagtgatctgtccatttgtccatttgtccttggcacactttgcgaaccgataagtcattcctttccatccatcggcccatttcatttcccctcttctgctgcttcacttcctcgtccgtttgctgcgggggggggggggggggagaacctccgccgatcacttcttttgttttgctttgttttgtcgtcgtcctttttgttgttgtgtccaaaatgttgtgtgtgtaccttttaaactttaatttgggagtttatttgcccttattatttaaaggaaaaatgagagaaaaaacaaggcattttcgaccctaaacaccaccatttcattcattaccttcggcgtcgtcactgctcacaaagaccgccaaaccaacgctttacactccgccgatggaatgtgccgctgctctccgatggaatgcgcacccatccatcatccatttgatgggggcggggagtaaattgtgacggataatttggcgaataaatgaaagagagggggcgggggggcgttgggtttgggagggtacgccacgggttgagcggctggggcggaggtgcacctcccccagggaaaggggtgcgccactcgcccgtcctccgatcgctctgcccaggatggacccgcgatggtcgccgcggggtgcaatgggttcgaatgcacccaaaatcgccctgctgagataagccttctcatccgatgagtcattcattctccatctttgggcgtgtcacttccttcatcaacggcaccatttattaagcgacgaccaattaacttttatttgtccaatcggtctcccatttgccctttcgccagtgatcagattattttatttgcattttcgcactttgatcatttctctttcataattttcccatagcacattattagagcattctcttgaattccctctcaaatgattaactctgatcccttctcgggaatgtttatttttaaatataaatatttttatttttattttcatttattaatttatttattatttgtattttttattagtaagccctaaatattattgtttttagaaaataaatatgttagaatcagttcttttatcatcagcccactctcttctgctgaatgttttttaaaggcggcccatcggcggaggaacggcggacggaggaagaagaggaggaggaagagaagaggaggggagggaactcgtttttgggtttttcttcctcgcccccttttaatttgcccaattcgacgactgataatcgcgcaatcacttttttaaaatatttcatttattctgatgctaaattttgctgataaactcagtaattagtaattgtaagccgaagaggtaattagtaactaataatgctattatgatgtgctcgtgattgttttatgaaattccctttttattgcccattttgtacttttcatttattcattccatccgacagatttcgttaatttatttctgtcactttccgtttcttattctctcgaattgaaaatggttctgttgggtgccattgaccaggggacttccagcagtcgttttctcgtcttcgattccgaaaatggcaatttggtcgccggccaccaagtaaaaaatattttaaccttcgacttttgccaaaacactaaattgacaccttccaacagttggaagtgcagcagcaattcccgaatcccggctttgtggagatgtgtcccgagcaaatatttaagacgaccgtccgatgcatcaaaagcacttgcgaggaactgaacagacgcggcattgacccgaagaaagaaatcaaagccatcggcataaccaatcaaaggggtgaggcgagaaatatgccgatggcaaaaagagtgaaaaacttatcaaaaccaatggcatggccaaatgcatgaaagaatgtgatcaaatggaccaaagctaaaggaatagccaaattggtgatcgtttccgtcttcagaaacaacaatcgtttgggaccgagagacggggtgccatctgagtaatgccatcgtttggttggactgccgaacgcatgagctttgtgacgaatacattcagaggacgtcgacacggtgaatcagtgaaaataactgaaataaattcggaaattttagggacaaaaaccatttcaaagcgaagaccggcctgccaattcacccgtacttttgtgccctcaaacttcgttggcttctcaacaatgtgccagaagtaaagaaatcgctacaaaatggtagaactttggatcattttgctgatgcatttaaattatttgaaaatttagggactttgatgttcggtacggtcgactcgtggcttatgtggaaattaattggggtaattaatggctaatctcccaaaatgcttctctccatccttctcaaacagatccatgccaccgacgtgaccaacgcgagtcgcactttgttgatggatttgcagaaccgcaaatggtctacagaaatgtgcaccttttttgacattccgatcaatgttctgccggaaattcgaagttccgcagagatttacgggcaccttcagaaaggtcgtgttggaatatttggtcgaattagccaatttgcatctttaggacctttggaaggcattcctttggccggctgtctcggagatcagcaaagttttaagcttttgttggctttaaaccatttctgacccccaaggtgctctgcttggtcacggctgtttgcaggcgggcgaagcgaaaaacacttacggcaccggcacttttatgctttgcaacacaggacaaagggcgtacatctccaagaacggacttttgaccacaatctcttaccaagtggacaaagtcgcccattagaaggtctcattttccccaattcgttcagttcggccaagcgtcgcccgtttgctacgccctcgaagggtcggggtccatcgggggaaacgtcgtccgatttttgagggacaatttaaaattcttcgaagtaatcaaaggaacatggctcttcatctcaatctctaacgccctaatttcgttcagaaaaccgcggacattgagggattggccgcgagtgttcccaacactgaggacgtttatttcggtaagtcttggcatttgccaattgtttcggtttatcggatatttgccatttcctctccatttctggtaatgcttcttcgtccgttcagtcccctgcttcaccggcctttacacgccccattgggactcgacggcacggggaatcatttgcggactcacccaaagtgccacccgagcgcacattgccctcgccgcattaaaggcattccaaaaataattcgggatgttcaagaccgacttgttcactttttcaggcagtcgcatttcaaacggtggaaatggtggaggcggtcgaggcggatatgtccgatttgggcgcgactgtcctttcgcttcgggtttttgttcaaatcgtttcacgaatgaattcaatgattaaaggctgacgggggaatgacccaaaatgcgctgttcaaccaaatccaagctgatctgcttgggctcctcttggaatgctccaaaatgactgaaatcaccggatggggcgccgctttggctgctgcaattggggcgggacagataaagtgagaaaagggcaaagcgaaatgccaaagatgaaaaacgaccccatttaagtgcgaatacaatgatcgaattgcaacaacgcattcgaccgcaaagcacaatattttaccagccaaaaacggacgaggaacagagaaagaaggaaaacggacggtggaaagaagcaattcggaaagcattcagatgggcataaatgataatcaccaaataacagcagaatgattgatcattaattaatgaaattataaatatgtacaaatctaattcgggaaatgcgccacaaaaataattgcccaaagggaattcattcaaatttaaacagtggaacaattcgagtcgctttggcataatgtgaattgtgcgaatttcgccgcttctgtgcccaatcgacccaagaatatctaatcattttgttataaatgaccacaaaatgatcgatttattaattgatagagaaaacgatacaattcgccgctgtcagtccattcatttccggattcagcggcagaagagaaaggggaagggactgctcattgtcagaagattgacagccgcagattaaattgagccgaaactctgtgaaataatccgcgggggaggggaaaatcggtggtcattttggcgtagtgaacaataaataaccaatcacttcttccccttgccattgcttcttcttccctatgcttttcctccttttgtgccgtttcgctttgctcggcttcgccagtgagtgcccccgccccttttacggcatttgacatttgcatttggcacttccgaagtcagtcagcgtaattgtggcctggactacaaatggagttgcggggccaccgagtcgcaaatgagactttcgctaagtgagcaaatgtcgtgcgccgtcgcagtgcctttgtgcccgcggacactcagtcagtgaggctaacttttggcactttggccaatgctttttgtgccaattttgccaattggtcagatgcgataaacaactgctgtgtgcgccacgacgcgtgctattcccagaaaatgggtcaacaattctgcgacgatttgttctgccaatgtcttgtacattgaattagtcaatttcaataattaatttacattagtaccgtaaacattttccttaattgttgaaattgggtgattaattttcactaattttgccatgccaaaagtgcgtctcccaattggacggtccgttgtgcgcgtcgcaagtcggcgctgccttttgtgtgttggtccgcgtttttggcgttttcatttacaacaaaccggtgaactcttcaatttataaaaaataaatgacattaaaaatgagttaaaattgctttagcaatgaatgaatggtaaagcatcggcggacgaatgaattctctccgccccctccattttttaccattgcgaaaataattgctgtgataatttgaatttaattctattcttttaaattttgtctataaaattgaatttcttaggttaatcttttcttttttcttttctttcccccaattttgttccttttcatttcattttttcaattagttttgcgttttttttcttcgaaatttgcccaatcaaagtcaaattttctttctttgctatggcaacggatgttttgaacggatttttggagcgaatgaatgacaaacggacgaaaggacgacactcaaaaggaaagcagcgacagaaaacaatcagtgccaattgaatgtcaatttatgtcaaaacgaaatgtcatccgccgtttttgtttcattcgttgacatttaaaaaaaaatttttttttttaatttttacaattttttaaatggaaccgaatgaattgtccgaaaaatatgtgctcaaagcgtacgcggacatcaaaagacgtgccgaagaagaaaaggccaaaagcggtgacaattggccttcgtcgtccgccgtttcggcccgaaaatttccctttgttctcgctcaactgcggtcgattaggccaaattcactcattttggacatcggttagtctaactgaatttgcatgttattactttgtcaaaattggccaattatccattaattacaaaagtcaaaaataattatgaatttattttggggtgcggtgacaatttgcacacgaacgaacattccttcacaattggaatggatgtgaacgaaccgcggaatggcaaagaacaaaacagtgcctttgtgttggccgatgcgaatcattccccgtttcggttgaaacatttaaatgtttttcaataattctttaaaattaaatccatttttgacttttatcgaataattaattaattttgaattattaaataaacttatcaaatattcaaatcagaaaaaattcattattaaatattaagtaatacaatcaaaaaatgac

SEQ ID NO: 959 - DNA, 2814 bp, Heterodera glycines
ggtgctccatcacataccaagcgaagtccatcaaattaattgctaatttccctcgctaatttgacttttttaaggaaatgcgcttaaaatgccttcgaaattgcctttggctcgcctcgcctcgaaacgggcgaattgtcaccgccgtatgggccaaagaacaaaaagcggcaaagtttccctcaaacgatgtaatttgttgctttattgtgtgcggtgagcatgccaaacactttagaagttcaggtgctgatcccttacaatttggaagatgcgcacaaattgggcgagtttttgggaatattcgattaattaagaaaccccaaaattgagggtgggggataaggcaaattaaaaacaaattaataatttaatgggatggttgaaaagcattggtcaagcaaatgcaaaatgtgcaggacacaccgtggatataccattcaacagggacacgacgcgagaacaacgcataatgatggtaattagaaaacggtaattaacaggctaatcagtgagttgggctaagaatgcggtgccaattcgagtgaaagtgccattgaatgttcgatgtccgaatatttgccgaagagcgttcggcagagagtgttggaagtggtgagccgagctggatggcgttatccgatgatctccgtggagttttacgagcagaaattgcaatttatggccaattttatcatcgaccgattgactgaactgaggcggatcagaggtaaaaaagctaaaggctggaatactaacggcacacgccaaattcagcagatttttcgcttaaaaatggtcccgcgcgtaccaatccgcatttttccctcggccaattcgccctcaaagtgtccgcgtcggcgtttgacgatgcttttgtccatttgcgcaccatttaccgggacgtgttgaagtacttcgcattttgatgcttttctttttcttccccccccccatagatatcgctattaccatttatttgttgccgatgaattggacgatttgttgttaaaaatttggacaatcgatagaaatctggccgatttccaccgattatcagcgaatacgaaatgggcaattggtgcgcggtcatcgggaaaatcggcgacatcaaagagacgggaaggggggagggataaagcgaatcccacggaatgagtgattggcggaaagccaaaaaaggcggaaaagagcaattgtgaacaataatttgattttcctattaaataattggccattaatgagtttttttggtgttttgctttttttgtccttccgtttgcttccttttccttctcctcctcattcttttcccattttccctccgtttgtcataacattcatttaattttcgatggcaaaagaacagtttttcttcctttaataaataagcgcttttttcatcgcatttcactcgcttactctgctctcattagcgattgttaattgctttttctgcttctgattgggaaaggattaattaattatctgcttaagggggggggggtccaaaagttattttagggaggggagagaaaacagcggtgttttgccaaagagtgttggccgggggggcggggaatgaaaagcgatcggtcggtgttttctccgatttctttccgtccgtccgttgtattcttttcctttttattaaattgttttgttccaataaaaagtttattcattttcatgcggaaactaaaatttgcgggcgatgagtaattttaatgagcgaattgaaattgacgaaatcggatgccatcggcaaagaatgcaaaagtaagcgaagggagggaggaaaagcagaaaaaggaacaaaacagacaaagaaaaagcatttaaaggagcaaagggacaggcaaaaaataattaagtaattaggtaattaattggaaataattattcagcaaaatggaaagtggcgaattgttcaccttcgcttttggcgcctttgccatcgctttgattgccctcgtcattatttattacaaatgcatcgaccgacgtttgtgacaaaacatttgaaaaaaaaataaaataaatttaattatttaagcgccaaaaaaacgattttattaaatgggcacaaaaaagagaaaattgaagaaaaagccgacgaacagaaaaaaggaaaagcgacgagcaaagaaagaaagaaaaagcaaagtgaaattggaaatcaaaagaatcaaatgccatttttgttaaaatattttgaatatgttattaaatactatttaattaatgattctttgaactccatttttaaattttttcagaatgattaaaattcagtttgtacagaaaaggtcgtttatgtggcaatgaattggactgatgggttggcaattggcaatctgtgcaaatctcaaaagcatttggcactttccactctctcccaatttgcggccgctttcaaaacgaattttgtctccaatctgtccaaatttcacagcttttcaaactttaacactttcatataaaagtgacagacgaaagcgaaaaatgaaattcattaaaagtcggaacgatgaaaagcctcacgacttttgtgttctttttgataattgccgcacttccgccgattgtttctccaggtaaaattattataattatttaataattggcaactaatatttacttgtagttaatctgattttgtttagcccaatctccgccttatggccaacttcaaattaagggaagcaaattaaatgagtcgagcgggaaagaatcgtactgagaggtgagcgaaacgtttctcgaaaaattgaaaagctttttaggaatgtcactttttttggagcccatggg

SEQ ID NO: 960 - DNA, 1485 bp, Heterodera glycines
  misc_feature (59)..(60): n is a, c, g, or t
taaatttaaatatttaagcgccaaaaaaacgattttattaatgggcacaaaaaagagannaatgaagaaaaagccgacgaacagaaaaaaggaaaagcgacgagcaaagaaagaaagaaaaagcaaagtgaaattggaaatcaaaagaatcaaatgccatttttgttaatagaaataatattttgaatatgttattaaataatatttaattaatgattctttgaactccattttttaaattttttcagaatgattaaaattcaaaatttgtagtttgtacagaaaaggtcgtttatgtggcaatgaattggactgatgggttggcaattggcaatctgtgcaaatctcaaaagcatttggcactttccactctctcccaatttgcggccgctttcaaaacgaattttgtttccaatctgtccaaatttcacagcttttcaaactttaacactttcatataaagtgacagacgaaagcaaaaaatgaaattcattaaaagtcggaacgatgaaaagcctcacgacttttgtgttctttttgataattgccgcacttccgccgattgtttctccaggtaaaattattataattatttaataattggcaactaatatttacttgtagttaatctgattttgttcagcccaatctccgccttatggccaacttcaaattaagggaagcaaattaatgagttcgagcgggaaagaaatcgtactgagaggtgagcgaaacgtttctcgaaaaattgaaagcctttttaggaatgtcacttttttggagccaatgggacccaaagtattggaacgcggaaacagtgaaacaattaaagtgcaactggggcataaacatcgtatggacaaccaaatgaaaatatttcaaaatatttcaattaattaagctccgcgctccgatgggcgtcgagggaagcgacggatatttgcaaagtgcggcggcgagtgctgcgaacactcaaaaactgatgacaattgtggacgcgtgcataaacttgggcatttatgtgataataggcgagttaaacaccatttaattggacgggggaaagtgttccattaagattggcattatacgagtgggaaagcgtacacggcacaagcggtggactttttcaagaaaatggcacaaaaatatggcaaaaacccgcatgttttgtacgaaatttggaatgaacctgttggggtggactggaacaaagtgctgaagccgtaccaccaaacagtgatttcggtaagacaaaacggaagggaagagcaaatgccaaagcacatttggcaacaatcaaaggcaatccgtgccattgaccccgacaatgtgatccttctcggcacgccaacctattcgatggatttgaacccagtgatcagcagcccaatgggcggcctaaagaacattatgtacgttacgccagtattcatttagacaataacccaataaattagtgacaaaaattatgccgaaaaaatc

SEQ ID NO: 961 - DNA, 4028 bp, Heterodera glycines
tttgttaaaggtattcgtttcacttttacgcggccgatacttctcagagtgggtacccaaatgtgcaaaatatgctcaaaaaggcaatcaaaagcggattgccggtgtttgtcactgagagcggcgccggctcaggcggaagcaatgcgcccgttaatttgccagtaatgaaccaatggtaattagcagtaatgggcaaagagttggcatctttcccattgtacaggtggtcccttttggagcagctcaaaatatcccaaatcatttgggcagtgcgcggagagggaaatttacaaaatccgctgaataaaaacacggcacccgcaaacattggacagaattgggcactaacggaatacggaaaagtggtgaagaatgtgttcacgaagaacgcaaagccgattgggtgttaaggggagagaatgaaaggaaaggaaacgaattacgaaaaagggacgaaaggaaaagccaaaggtacgatggaaattaacagaaatgagctaattacaataacaaatgtcacattaacgcatcaagaaataaaaatagccaattgaaaataacaaacactcaaaattaccaaaaatgggtcattccgaagtttatacccctaattggtcaatgtgtttgggtttttcccatttgaaactgtccgcacattttcttgtcaatttcccaggcaaattataaatccaaaaaacttattaacacgataaattaattgtacaaattaattgcatttgaacgtttgaattcgttgtttctttctctccgctggtgcccttccaaaggtcaacgggggtcactcaaagccaacggaaagtggcggaaggcgacgcaattgtttaggaagtgaatggatgaagcaaaatgtattgtctgtggtttcaaaaacgtttctttatggcgcttggatgagatgtccccccctttatccacatttatccccctcccttttgtccatattttttcccctctttttccccctcccctttcccccccccatttcattgccttccccacgtcatttctttctgtttctttctgtttgcttgcgatggcattctcagccgcccatttcctccttttcctccgtccaattttttagagttgaataaattccgttgtctgacggtagtcgaaagaaaagcgaatttgtcggaagagcacagaaagtcattggcattaaacgccattcacgattcagttaaagtcataaggagggctgggatttatatttacaaaaaatcccaaaataattaaataaattgaattaataatgtttttcgtgtattttctcagcaaaacaaagctgcaggaagaatatttaattacaaattaaatcccagccttagtcataatatttactgtaaagttcgctggcaaatgccaaattatgagtacaaatgattgatggatggatggccttttaatgcgtttactatctgagaaaacgcccccccccctcccctcacaaatttctcttttaatttttcatttaattaaatttatttttgcattccaaatcaaatgatcagaaaaataaataatcatagcaaaaagcaatcattcatctcaaaatgtacaataactgtggtcagcaaaattccaattcagctacagacgaattcattcaaacagcgaaccaacgacagttccaaacgcacttttgcggggcgcaaaatgagggagacagagcgatcggacaacgacccccaatcggcgggggaaatgtgagtgatcggagcggaaaatacaaagggatggaagctgatcagaaaggagcggcgggagttagcaaaaggactgagagaaaagcatggaagtgagagaaaagggataggagtgatcagaaaagggacggaagtaatgaaacaatgaacggaagtgaacataaaaggggtaaaagcgatcagaaagggtgatagtgatcaggaaaggatgggagagatcagaaaaggatagaactgataaaaaggggacgaaagtgatcagaaaaaggggaaagaagtgatcagaaaaaaggacagaagtgatcagaaagtaaataggagtgaatcaaaaagagacgaaagttatcataatggatagatgtgagagaaaagaaaatgaagtgatcagggagtgatcagaaatggacatggaattatcgacgctttaatgcttaagaatgcattggtgccattggacaaccgacagacaaacttttaccagcagacaatgggcggagttggaccaatgaaaagggcgtttagtgaacacgaaaatgttgatgggagaagggaagggacagacgaaaaagtgccgaaaaggagggggggggggagggaatgaaacgaacgaaatttaggagaatcagcagccaatggccaaacgtatgcatttgtcagtcacagaaagtgccgaaacaaaacggcacaacgacgggaaatttggagagcacggggaaaaggaggaagaagaggaggaaaaggaagaggaggaggaggagggagagggagaagagggagaaaacagccgaacgacaaagtgagggaggggcgaaagatagtgccacatgcgcttttgcaggtcgagcagttcggcagaaaacgaagagccgctgggctgctattcgtcctcagcggggcacccgcagcagtcgcacctttcggcccatttgatggccacgccgctccaacggactcagcacacatcggcttcgattgtataccccgaatttggccagctaaacacgccaaatggccaccgtttgcagggaaatcctttggctcactcgactccctatttgggcgccctttcgctcaattccttcccgcaacagccgctggactattggggcaattgcttcggttgttcgctgccattgaactcattgacctcctttagcaggaggtgtcgcgctgcatcagcagatgaactcccatttttcgttgatggcttccaacaaaaacatcgccgcggggggtgcctttatgccgggccacgcccccctgggccaattgacgccgtcgtcgtccgcttattacagtaacccatacggaccacaacagcacaatgtacgaagggatcaatttgagatgttgctgaagatggatgctcattcgaatttttcagcttatggcaccatttggggaaatgacggcaaatggcggcggaggcgttttttcacagcgaaatgtaaaaatattaagcattcacaggatattaacctaaggccggtccaccatttccagcagagtttccatcccattttgcaaaacaattcgtccgccaattcgccgtttcaaagccggcaattccatcgattaaaattgaaaaatgattgagcaatttcagtgacagtggcgtaggaagtgttagggcggagttaaaaggtgggtttttgaacacggagagtacacaatgggaagaatcgcagaagaagggcgaaatgagacgaggagcagcacgtcgggagggtcggacgaaagcggaagcagcggaagtgccgtgggactcaattggctgcgcgttgggggtgagtctcggcatgacacccgcaattaatgccaaaacattcattcggcagagatcagattcccaccttttttccacgcgtttggcaacggccagcaaattgacctcgaagggattaaattcgaagaagtaaaaaagcgatggaatgatttgctaatttctccgttgaggtgccgcctcgtcttgccctgttaaattgcaacaaaaaatacccaatcactttggccgaaatttaccgtcgtttgggatggccggaacatttgaacacttcctatttgagtggcattctcagaaagtggcattccatatacgtgtgtaaaattaaatttcgtttcgcacagagcaaaaaatacaaacgccgggaaggatctaagagacaaattgaacagtttgggctacggcattgacctgaggacgggccgccgcaaacagtcgtccatcacaacattcaccacactttgcgaacgtaaccaattggaaatattcggccattttcaaatttaatttag

SEQ ID NO: 962 - DNA, 946 bp, Heterodera glycines
tgatccctgcccgtattttcattatttccggaacgtctgtgttaattgagactattcattacgttttgtttattcacaaaacctattgacctatggggtgcgctaggtcgaacctaaaaaagtattagaaatattaaatttaattattatttaaaacttatttgctgaataagaattagtcaaatgaatcaaacttgatattgagaaatagctctacttatccactgctataccgtatatgctctaattatagcccatgggggattatttttcaacctcttcagaaaaggggggataattagagactgggggattatgatagagggattatttttcaaaacacctcgtagactgggggataattggagactgcgggattaatagagactgggctataattagagcatatacggtattatgtattttaaaaaaatttagcaaaaatttaaaaaaagttgtaacgaaaaaaagttcgtcatctctcctctcagtctctctctttctctgtgttttcgctcccttgtgcccccatctctctcttctctctgtctctctctctccatctctctctctttctgtctgcccctgtccccctcttcactcttgtaaacttacttcattaccttttcccatttttgttttctctcatccaagtcttttcatcagcctaaaatattttatgtcaacaaacgaactatacaacaacaacatcaacctgcaacacaccattaataaatacgccgcctttcccccacttcttcctcaaatacactctctccactttccgaagacgacaagcggcggcgtcgccttgtcctttggccagttcccacaggggcgaacttcagaaacctaaatttatttcttttagcaaattttatttttgttttcttttgctcaaatattaacaaatttttcttttttgcgagcagtttattttcatttc

SEQ ID NO: 963 - DNA, 3722 bp, Heterodera glycines
aaaacagagtcatgggtcattatttaagaaatacgcattgatattatgctgcagattatgtgttaatgttttgtttctagaattatatgtatatttttgctttaaaatgcgacaaaaataaaacgcagaaattagtaatggtcgatttgacattctttctgctttatctcataatgcaaatgatttattggaacactgagacaggtgcccttttcattagatttttttgattatttattattttttttaagttgagaccaaagcattcttctgttcgacgtaaagggatgtgagaatgaatatgtcgtgtcactttacggtgccatcggggggcctttcctttgttggggtaagctttcactttatttgtccatcatttgcagtttgtgggtgttgtgttgtcaaggatttttgttccattcccttttccgaatgattcggtttcgattggtaaattaaaatggataatccccccgctccccatcggttcggttcgatctaatcgtcgtctcattttttacatacatttgtttactgaccgaaaagggttctctttcctctcattggtcattcccgatcagatcagccggaaaaaacttcatttttcaaacggtttattagctagggtccgtccgggtccgtttttacaaaaaaaaaaaatataaaattatctgcaaaattaactaggtcgttctagagaattagacagttttcattcatcagcaaaatcggcatttaagaaatggcaacgccttttaacaaccgcattttcaaagtgccatccaacagaataaattttctgttttcgagaagctatttctttctttctttttttgctaaatttgctagacagttttcggaacattttgatcgcaaacaaaaaagaattagtattttttaagccttactaatgtaacttcataatattggatagagaaaggcatttagactaaattaaaacaatattcattaaatcaaattaggggatacacaaggcaaagtgccaccaaatgtcttaaaataatttacaatttgctttgtcaaaaagtacataaaaacaatttgtttttcgtgtctttttattgtaaaatataatttccggacattttaactgattggcacattacgtcaaagtgtttcatggtgaaatttttgtactttaaattgttttcaacacaattaataatttaaaaaataaatttaattttcttttctttttcattataaatgaagtcttacattttcacactcagaagacaaatattttttaaatactctgaataaactttttcaatttttttaattgtaaaattgccaagaaaatatttattctgctttgttatttcgtaattttttttaatattttcaaattaattaagctaaatgttgtccatcctttcttttgtgtgttattccatttatgaactcgtctccatcccgttgtatctgcgctctgatcactaaaaaataattttcttcaccgttcttccaatttttgagcatcattggcattttggtaataatttcaatttatgggtcagataatttatttttttataaatttaattgtttttttaaataaatgtaaggaaattgcccattttgtggtcgatgttgtgttctatcggttgcccatttttgctcccacttgcccatggttcggcacgtcgcccttggcactttacaccattggcacatttttggtgtattttttcgaatatccaatttatgtgcttcatattgccatcacccttaatcgctgctcgtgcgtttgggccccaatccggcacaaagaagtaaaacaaacacataaacaatttacaccattacattttctcagttttggtgccgtgcttgtgagccgacaattgcgtttgcttttgctctttctttggcattttctgcccaccgtttggtcactattgcccagttggtccaactcgacaaaacggacccgtccaagggctcaattccgctcattgtcacctaccaactttattttgtatgttcaaatttttgcgaattcatttgaaatttttgtggcacttcgtatcgctctttgattttcttgggattttcagaaattgaacctaacttttttttaatcaaaaacaggaaaatcgcgttttctaatattttattgtaaaaaaataaaaataaatacaaagaaatagaatatgatacaaaaatttatttaatattttttgaagcctattatttaaaaaaagagttcttgaatttttttttgtcctgtctgtgccacattattatttaaaaaatattcactaaattaaatattatcaaaatgcatagcattggaaagtcgaaaaataattttaaatttacattgtcaatataatgcaaattgattaatgaattaagttattatttctattttaatattttaaatttatctttaattattataattttgaagctattattccgattgattccaatttgctgaccgcttcgttcatcatttttgtgttcatctccacttcgttcattaacggcttcactttgttcaaaattgtgcagatgaaacgggcggggaagctgaaaattgcgtctcagcaagtccagttgaaactgttcatcatttcaatttggttgtcaatgacttcgacccttttgatcattttccagctaccgtaaacttatgaattaattggaaaaaaataataatttagattaattaaatgataaagtaatcatttttattatttaaaagaaaaaatattctttccataaatgttttgtatatcttttcatatctttttaaaatatttttgtgcttttattcgcctttttcatatttttatgtaaaaatcccaactaattattgcttaatcttcacaaatttggtgacatgatacactttttctttcaattacaattctttggaattcttagtcagaagattgtcaaatcaatgtgtttctaaaataaggtcgaattagcaaatcattgctaagtggtccgtgttattggaatattttcaatctcacataaattttcattttataaatttgttcattatttttgattataaaaaagcttgaaaaacggtttgtataaatatttatgttttggcctcagcttgcactttggcctgctggacaatgtttttgatgttggccagctcaactactttctgttcatgcagcagcccctggtggaaatcattggcaccgaaagtcacccgtgggtgttgttggccatgtgccgtgcactccgtgccaaaacattgccatggacaacgcaaatctcttcctgatgatttttacacattttttgttaatatattcttatatattttgtcgaaataagaacattaagctgctttttaggagttgctggataaatatcgaaattgtttttcatttgttcgtttattttaggctgaaaattgactacattgaaaatatttgttttttatttgttattttttagaacaaatttcataaaatttccaaaacttttcgagtgttttctgtttttaagaaatttgactcaaaatcgtacgatttgatcttcgggcattggtttatttgatggaactttttgctttatgaaatacgaaaaacaaattaatgaattgtcatttttaaatgggcaggcaattcatttagggatgagtaaaacttaacaactttttttttattcttttcatttaatcattttcgttgaaacaatttccaaaattcatttagttttat

SEQ ID NO: 964 - DNA, 2732 bp, Heterodera glycines
tggcctgctggacaatgtttttgatgttggccagctcaactactttctgttcatgcagcagcccctggtgaaaatcattggcaccgaaagtcacccgtgggtgttgttggccatgtgccgtgcactccgtgccaaaacattgccatggacaacgcaaatctcttcctgatgacttttacaaattttttgttaatatattcttatatattttgtcgaaataagaaccattaagctgccttttaggagttgctggataaatatcgaaattgtttttcatttgttcgtttattttaggctgaaaattgactacattgaaaatgtttgttttttatttgttattttttaaacaaatttcataaaatttccaaaacttttcgagtgttttctaatgttaccgccaggccaaaaattctgttttttaagaaatttgactcaaaaatcgtaagatttgatcttcgggcattggtttatttgattgaacttttgctttatgaaatacgaaaaaaacaaattaatgaattggcatttttaaatgggcaggcaattcatttagggatgagtaaaacttaacaactgagaacccttttttattcttttcatttaatcatttttgttgaaataatttccaaaatcatttagttttatttttttcaaagtcaatgcatattccttgctggtcgttctgtcgccggattcagttcgtaaaaaggctgaaaatgaatatttataacaaaaacaaatacgagtgattcaaaatgagaccaaagttgacaagggggttaagccatgtcaaatcgatgtctaatcttttgtcaaatcgatgtcccatatctttggttttcacatcattttttgagacgccctttttttaaattttttggggaacgtgaggggttcagtggttccgatggatattgccgggcgaaagttttgaatttttatagaatttgtagacacttcctccccctttttatcgacccccccccccccggtgcgaagggtcctctattttgtggctttgcgagcttagggagggggagccgactctcttattttttgaatgtctctaattacccaatgtctttttcgtaaaaaccggcagccatcgaattctcgcagactttggtcagctccttttcatccaattcgttcgtgaatacttcgtcaccaattggggctctgatgagccaacacttttctttgatgattcggtccatcatgcgttcctgcgtgttgttgttcaccaaattcaacgagtctgaagccatttttggcagaatgaaaaagtatttggcagcagaggaagcggacgtgaacagctgaaggtacaaatgtgttaaggtaggctacggttttctcatatctctatttttgaaagaaaaggttctaagaaaaaccaaaaaatttctgtattaaaatcctttttggagggaaaaaaacccctgctcctccaagaccaacctcacccaaacttttcaaaaaaaaaatttgttaaatttttgctaaaaaacttgtcgcccgggggtattcccccgcccaagtcgaaaccaaaggaccatctctggaatgactccctgaaccccttgcacaaaagtttggacagcaaacaaaaggacaaccattttctttctatgaatccaacccacaaaaaggaataatcttagaaacaaggacattaaaatcgttttattgctccacctctttgagcagacgacgcaaatcctggactttgtacacctcataagcaaagtcggtcatgagcactttcggctgaccatttgaaagcggcgtttgaagccactcggcgactctttggctagcggtcatttcgttttcgccaacggaggtgaagccgagacgctcatcttcagtcataatgctgagacttatcttttgaaggttgacaaagtcgccaagtccaaatccggtgagatggcgcaagcacaaaattccgttgtaactgattttgataaatgcgaagattttgtcttttccaatgagtggcaacaatcgttcggaatacagctgccaaacgaccattccggccagtccgacgtccaaaagttccaacgaaactccgccagaaaaaaacgactgccaatccttcaacaaagtgatcaccgtcttgtcaaaacatctgaaatgtgattgatggatgtatatatttaatattggattacccatacacccatctttttcaactgacattaagaaaaactacaacgagaaaaacgaaacgcagctttttcgagtatattcaagaaaattaattttggtttaaaaaaattctatagcctttaacgtttggtaccaacaatacttaagcattgaccgtaaaaatcccctcttttcagatttatgcttttaatggatcatttttctgtccaatgaacgtccgaccccgtttcttaagcaatatgatacacagactttagtttagctatgcaaaaaaattatatgaacactaatatggttaaaaaggaattttcactcaccgcaattcgatgtggttgaaaccaatgaatttgtatcgcggtcagactggacatacgaattgcgttgtcacgccttcatcaattggacccacaatcgccgagtattctgccttttcggtccagcgaatgacaatttttttgcaaacaattttcagacatttgtttacaaatgatcgggagaattggcaattttgacaaaaccctgaaacggacaagcaagccaagataacggataca

SEQ ID NO: 965 - DNA, 6049 bp, Heterodera glycines
ttttgtcctttccgatgagtggcaacaatcgttcggaatacagctgccaaacgaccattccggccagtccgacgtccaaaagttccaacgaaactccgccagaaaaaaacgactgccaatccttcaacaaattgatcaccgtcttgtcaaaacatctgaaatgtgattgatggatgtatatatttaatattggattgattacccatacacccatcctttttcaactgacattaagaaaaactacaacgagaaaaacgaaacgcagctttttcgagtatattcaagaaaattaattttggtttaaaaaaattctatagcctttaacgtttggtaccaacaatacttaagcattgaccgtaaaaatcccctcttttcagatttatgcttttaatggatcatttttctgtccaatgaacgtccgaccccgtttcttaagcaatatgatacacagactttagtttagctatgcaaaaaaattatatgaacactaatatggttaaaaaggaattttcactcaccgcaattcgatgtggttgaaaccaatgaatttgtatcgcggccagactggacatacgaattgcgttgtcacgccttcatcaattgtagccacaatcgccgagtattcttccttttcggtccagcgaatgacaatttttttgcaaacaatttcagtcatttctttacaaatgatcggagtaattgtcaattttgagaaaacactgaaatggacaagcaagcaaagattagggatacacattttgttgaaaagcggactatgatttattaatctcgtgaatgacccaaaaagcccaaaagagaaaaacggcacatttaattcacttaattattgcatttgtcctcaggctatatgtagtaatagtttagcttttcaattttgctttttgaattgttcagtaaagaaaacccactcaaaataaacaaaagttgtttgaaaagctttgtttcttttctcaattacatattgcataaaatgaaatggaaagagcattacataataatttaatttttacaaaaataaaattggtcaattgagggaaacaaaaagaaaaaagtgaatggcgaagagggggggggggggcgaatagctgaagctgacgaactttgtgccggtgctgttatggtgcgttaacaaccacaggacccttttaaccggcaccattaatgagaggagccaatgaggaggagcattaaaatctgtaaaagtgataacacatacagagaaagaaagagatggacaccacgaaagagagagacggagagaaagagagagagagagacagatagacatactgacagagatagaaaaagagcgaacaagagaaaggaaaaagagacagacagacaaagagggagaaagaaaaagagagacatacagaaagacagagatggcgaaaattggtagaagggatgagagacgaacagagaggcaccagtgaaaaaagataccgtagattttttatttttgtagttatttttctcaaaaatttttggagagagagagagagggtggcggtgctgatagccgacgcaatataaaaatttgacccagaaattggcaatttccttataattccttaaaattggctcaaatcgcaaattctggtaatttctttgaataaaacctattaataattcaatttcagcttcaccgagcttccttccacaaaattcttcttgaaaaagagttccgcaaaaaagagatgtgaaaataaaaaagtgaattcttatgtgataccgagtttttattaatttggttgcgtttaagcaaactttatacgaattttctcggaaaacctttgaaaattggcatttctacgaacgccaatagtggcatttttatgaaatgacccagcacgggccaatgtacgtcgtacgggggggggggcacttggttgctctcaatgaatacccgggatacgacccgattggtccggatccaaaaatacactgcaaaaataagcaaggtaaaaagatgaaaagatcaaatatatttttgaaatagctaattgtctattctaaccgtttttggttcaaaatttgttaaataaccttattacttcgattaggaatttttattggatttttaatataattttcagggaatttaataatttttcaatgggacccatctgatgagttatcagaatttcgctagaattttactatagcacaaaacgactcacttatcacttggtggcacagttggcatcgattctctgtgaaattgaatttaaatttcttatttttgtggcatttacccaatgtccgtctcccgaaagctaaagaagacggcattcttatcaaaacagatctgatcattatcttcttcagttttccgtaagttttcacgacgaattcgagagtgcatttcgaaatggcagcagccccaaatgcaattagttagagtgttattcgacggcacattgtgcagctcggaatgtttaaatgaaccatgcatttgggagaatgaactgttgaaggagttgatgggaacgaatttctcaccgaaatgctggaaaagttttaacatggacaaaaaaagtagaatataaaagaaaaatatggacaaaacactaaaacaaagaaaatctttcccaaattctgagaaaatttgctcagatttcttctaatttcataagaatgtctgatcaaaagtaccactgtttcattacgaaggccagaaagatttaaatatttttttcagatttacgtaaatgtttcttagttttttcaattcgttaattttgcagcacgttttcggattaggatccagcaaaatcccacgcgggaccacgtgccgctcttggctcactcgcaggtgccccacatttcttaaatcattcctattcagagctctttttcggctgtttcacacttttctgcctacgagtgcacaattttcattgcgccatttttgtgccaaattccaaaatgccccccttttacttccgtgagttttgtcaacatcggttccatcgacgaaatatgcaaaaatttgcataactcctgccagaaagtgttcttgtcgttaccgtccaaacactaaaatgattacggtacaatcagagaccaataaaacaatctgataactaagaaagtatgaaaggccaaaattatgttcaaaaaccatttaaatattttgaaaaagcttgaagcaattgcgcagcaatgcgcgatcaaatccttcccccctatgaacaaatgtttttcattttattttttattggtagtgtataatatattttttaagtaaattataaaactttttttattgaacttaatttattactacgtcacagttttttaccttcacttcaaaatattttcaatttttaaaattattttaattccaaaaaactaacattttaaatctgtctgttaataattttaaaaaaaattaactaaaataagtaccaaaattgattgaatccaatgagacaaattgattttttaaaaattttttaactaaattatagcaaattataaatttttattatttcgcaaaaatccattaattatttaaagggcttctggtttagtcagctgacgaacaactcagctaatgggacaattcgactgatggacaactccgccgtacaataaattttacaaaataaagcctaagcttaagcctaaagctccggcctagcttagctacgcccttgctagccccgcgcaccgcccagcggcgccagtcggcatcgctggcagtaacgactctttaattcaaaaaaaatcgactcaaaacctcccaaacttggctatttctgaaaatcaaattgaaacttcagattcttttctccggcggtgtgtctgccagcactgccggcccccctcccatacataggatttttcaaaaattgccaataaattttctgaagttaaaagcctttgtgttcaaaaccagatttatcctctaatcgtttaattcaattatttaaatttacaataaatttagttctatttcgatttcttctagtcccttacgaaatacgcattgtatttggtcatttctttggaagggattggatgaattaaaataaattttaaaacattttttgagtttaatttagtctaattgtttttttcacatgaaaaataaatgaaatgaaaaaaatattttttacattttaatatttttgtttgggaaaaataataaaaatttctaattctttaaatcccggttcccgacaagtcccgtccgttttaaattcccattcccgtccttactccaattaaaattacacattttgttaattgatgataattacgacgcacccattgacactgtattggtgcccattcctttcgagcataatccgtacagcacatggccatcgaatgcgacaccaatcgcttttcgcactcgcagcgtcccgccgcgggattggtattgcgcagcaccacgaaacgcttcccgctatacaagcaaattgccttgatgttctcgttgctgatcattggccacaccgtttcggccatgacctcccaacattgtccttcaagcagacaaatgctcaaaatgatgtccaatttgaaaaggtgccgattttggcgcagaaattcgatgacactgccgtcgatgtaactgcgcaaaaagttatgtactttttttaagtttcttcgcattatggttaccgaatagtaagctgcttaaagccgaccacattcttcggcagtggttgcgaaattggcactttggactgtgtgccgtcggcattccgtttgacaatttgcgcaccgacggtgccattctccgaccgtcgaatgtcgaaggagccaattgtccattttcttgttccgaggtgaaattccactatagcatcaaatcgagcggagaccagcgcaattttgagcccaagaacggcgtgcccaacaaagggaaacgcatcgagcaaaaggtcatcgcaaacacggctaaagcaataaaaaaactctgatcaattaagcatttaaacacggatcaaattaattagtaaggtcaaattaatcaagcatttattcattgtttagccccacttacatttttttatgaaaattttgctgtacacgggggtgatcagacatttgtgatagaaatagcaaaaataaaaaatttctgaataatttgaaaatatttattcgagatgtggaattaatttgccaaatcacttccaaatacatggaaaattgaatcctttttatatacaataatttttttatacgcatgattaaaccgtggaattgttgcacaaaatagcgacggaaatcacaattctagataaataaataaaaagtacccataatttatcaaaaaatatattaaaaaagacacctttaataattgcctttaactaaaaaaaatcggctaaaaacctaatttttaagatcaattaaaatcctaaacataaaaaactatcactcgaaaccaaaaaaatattcaaatcaaaacaaaaaaaccactgatcaaacttattgtttattaaattaattttgaaatatttgaaacaaattcattaatgttctaaattagagttttttttacagtttttcattttttgcgtgccccgaacggcttctgacaaaatcggacattttcggtctgatatttcggggccggaaattgcgactaaaatttgggtaaattttggtaccagaaaaagcggatacatattaaaacttaatcatttttgcattctgatttcaggtatttcgcatttctgagaatttttaagaaattttagaaatccctaaaaaatacgaaatttcgcaattttttcgtacatattttcattttttgaatatattttaaggttttgagtatttatagaaacttcttatgaaaaattgaaaaagaatttttttttaccgaaattttgtacactttttgtaatatttcttacatattcgggattttttttaatgtaaatattgtgatttttcttgtaaaatctaaaacaaagaattttttatcaatgagtttgtttaaggctcccagaaaaataaatggcttaggaagtaagcagcccaaattattggagtttgtcaa

SEQ ID NO: 966 - DNA, 3971 bp, Heterodera glycines
ggaaatcatccggaacatcctctgcatccacaatgaacacattcgatcacacggcccttaaatattctaagatattaggaaataattatttgttaaaaaaattttaatttaaaaaagtgataacaactttctggggttttcctgttgagaaagggggaggaaggcgacggcaataacaggaagggggccaagccatcgaattgataacttttaactttttgcagtactttttaaagaaaataaattttggtggggctggtggtaatgaaaggtgtcgccagaaaaggaaaatgccgactaatgttttacccaccgcctcgagtttcgacttgggcacacgacaaatgcaattagttccaaagtttgtgtccctcgtctgaatacaacgcaaacaacacaaattttcaaaacccggcttcttccatttggccaccaattgggcgtcgattagtctcgcatcgatgcaaaattggtataattcgcgagaaattttctcttccttatagaaaaggtcgtaaatgtatcgggaacgctggtgatggatctaaaagaaatgaaaggccatttaatagaagaaaaatcacccggaacaacggccaaacggtctcagtcctccgtttcccctgaattttgtccaatttaacaatggttgatcgacccactcattgccagcccacctcatgcggttcagtctcggcctctcgcattttcgcctcgaactcctccaatgtcggttcaattaagtcccatccctccgggggtttcttccgcaatcttcgcaattttgtagtgagagacattggattactgtgtaaaagtgtgatgaaaaaccgtaaaattaacaaaaataaaatgaaacaaatattaggcgagttaaccaaaaaaatgtcaatttgccaaaagattttaccattaatttatgatagtctttaatatagcaaataaaataaaagtttagttttataactccgaaacccctttggctatggttggttgtcctcccctttctcattgcgcttcttcattttttcctccttcgtcgattgcttcagcaaattgctccaccgtttccaatgtctttgttgtttctgcttcactttcattctgttcaattcgttcccatcctcctcctcccttttccctcccctcgccctcctcattttgccatttctgttggtcatcgctttcgttcgtttgcacatcactcaatatttcattgaagacactttcatgtttacacaatacaaaaagggttttgcttcggaatttgaatgcattgcgctgaaaaggaaatgatgtgtaagttattagttatcataaatgaaaaatgatgggggtcacaacgtttcctcccaaaaagtaaattgcactcaattttattttataaatcggcggcgcgtctaccgacactacctgacccaaaaattccaattgcgaaagcacctccccttttcctgtatgtttgttattccgtctgtccatctcagagcggttcatttccaacatggttaatgggccattccgaaaaggccctttcatgattagcatgaccatttgtcatcatcgatggacggcagacccgtatatttttcattcccccaccctttggatacggactcgatgatggataaaatagaagaaactcaaaaaagacactcacataatcctccacaggacaatgtgaagatcggaaaaagtgaacgcatttctcatggggaaaacaatggaagaagcatcggttgaagaacggaacgaaatatttgagcagaagagaaatggccctcttggcagaaacaatttcagcagaaaccgaaagaaaagaatcgacccatttgaaaacgttttgcaggcaaaaaagaaaaatgccaaaaacttgacgtacctaaaagaagaaacatcagaataaagaagagaaatcattaagtaaatacaagaataatcgaaaatgaatgacgcaaatcattcaaaatgtcgatgagcaaattgccaaacacgcaaatatcatcccaaatgcaaagttcaagcggtgccgaaagaacgctcaaatcaatggacgggtgaccactgtcctcaaagtcttggcgagtattttcaaaaatgtccccatcaataaggtcaagtctttttaactctgttaaactataacaaccaagtcgttaagttttataaatattttcgtaccaattggtcgctgtttcgacccttctcctgcatatttccagaaccatttgagcaaattcgttgacaaccagcggcctgaagtccaaccccatccgcccaaatgaaaaggcgaaactcatgagctgaagaagatacaactccattccgttgcatattttggcaaagtaacgattccctttccctataccttcgtatgcatcacttccatgtccaaataattcttgttctccgatccacgcaaaagactggagagtctctcaatgtttctctgggcccacgaatgaaggaggaaattctgagaactgccagtccatctctcccaacgcgggtcctcactagaagctgccttaactgtgataattcttatccaaacaattcaaatttccatggacgaacgaattttttatgttgcacgtcacagtcgggaaaaacagccaagtaaaggacgattgtgtcgtacatacattccctgtaaacatcaatcgcacgcaaaaagaagtcgggttcggactgaaaaggactgttttcgtaaaagccgaaggttgacgtatttaccatgacacgctgaatatttttgtccatgtaaatgtctctgtactggagaatggactctctgagttggatatttgagatgaaggggatctttctgatgttattgacaatctgagtcaattaggaaagagtaaatattaaaagggcacaaaagaatcaaaaattcaaatgcgaaaccgtcatgtaaacatcacaattcagtttgaagattaatattccaaagaatttcaatttaaacctgaatgctccgagataagtcaatcggacccgcaaatttgctaaacaattcattaaggagattatggcgtgcttcgattaacacatcgacaactttcttaatgcgaaaataaatggttagtgccgtatttttccgcctaaacaacttcttaccgcaagcatagcattcttttgggtgagtttgctttgctttaaagaaattgcaaaatttgttagagaatacgcttgctcataacgacccgtgcgaatgtatttgtccattaactaatgaccaaaatatttgtccaaatgacatcaaataaaaaaacctttggaagacgcaacaccttccaaatgatattgctgaccgactcgacttcatgcagcaatttgtactcctcggtgaacttttctgagtccgaattggccagattaatacacccaattaggtctgggaattccgctttcagctttaccaaaaagctattcatttcagcaaacttaaaaatagaacaaacataagaataaagttaccacggataactgaccatttctttacaatgttcggccgttcgtccgacgtccacataagtgcggtagttgtgaaaggccaaatcactcaattcattctgcaaatgctgaatccgaccaacgacccggtctttctcagaacctaaaaacaagaaaaaaattatttgagtttatttccgaaaattaatactgatttcgccaaaattaagcgatgcaaattctttttcaacggccattttctcttcgatatccatcgcaatttgatgtaaagtcaatcgaataaaatattcaataactaaaaagtagagtagagcgggaattcccggtcatccgaggtcccggtccggattttgaaaagctcaggtcccggtggcaaccgggaaaaacaagcactggtaagaatgggggtctgagtgaaaaattagtgatgaaaattggagttaaagggaaaaaattaaataatcataaatatattctttcaaagaaccaat

SEQ ID NO: 967 - DNA, 2158 bp, Heterodera glycines
ggcgagagacgagaggcgagagtaccaaaaatggcgagagttggcgagaggcgagagacgagaggcgagagttgtcccacccctgctatgtatgtttgtatatagaaatgttcgaattactcaatctgaaggtccttaaagcgaattttatagggcagcggacggtccggcatcggatgcacttcgtcacacatggtccaaaatttttcggaaatcggaattccgaccccaaaaacgtcggaaatcggaattcggaaatcggaaatcggaaatttttcaaaaaacataaaaaataataaaaattttctaaatattttaataggctaaattttaaattcttaaccaagtaaaagatgactcaaaaattttttgatctatttaaaaacatatttgctttaaaaaattattcaatgattttcatcaaaaattttacctttttttgcggcgcgttttttcaaaatttttcgaaacatggcgggggaggtccgacggtgccgataggcgccgccggggaaaatttttataattttaatgcaaattctggcactttttgtccaaaaaatgacaaatttagcgatttgagcaaaaatttctcaagaaaaataagattttagggtccggcggtgccgataggcgtgcgccgccgggaaatttttgaaaatttcagtgcaatttattaacaaaatttgtaaacaattgttaattttttgaaaaaaaattaaaaaaaatttccgaaaatttccgactttttatcaaaaatttcggaaatcggaagtcggaattccgacgtccaaaattttttcggaaatcggaattccgactccaaaaatatcggaaatcggaattccgtgccatccctgcactacaccacataagattatggaaaaatattttaaatgaaataaaatttatttttttttctcaaaaatttctcattcctcaccaattcccttctcttttctcaccagaccctcattcttaccagtgcttatttagtcccgctggaaccggaactagcaaaaccgggaccgggatttctgtttttccaaaaaccgggaccgggacctaaaaaaccgggaattcccgtacaagtcccgtgcaactctaatggaaactgatggaaagatgagagggatgggtaggataatcgaaatagacgagaccaaagtgtacagggctaaaaataatagaggatggatttaaatcatacatggatgtttgaaaacgactagaacccgccgttgataagtatcacattattgccagttgaaccagtaagtggaggacgacgtcgacaacagaacagcgagcggaacgttcatcacagcagcagtggtgtttgcgttctttctcgcctctaattgagccgtttttgccgtcgttgtaacagcggtttccggtgacatctcaccatcttccatcaccgctgacggtgtgtttaaattttctcagcttttggtcctgttcagagtcttttactacatctaatcgacttccttttcacttttttagacttaattcatcaaaagatttcatttgtaccgtttaaaaatccactaagtcagttcctatgacatacatactacttcaaaaaggagtgcatactacaatattaacttatttgtgctattttcgacatgttggataaacaataatttatcatatggcttagccagggagtgtacgcccactaattcgaatttctaaaacacacccttaaaaatcgaatttttgagctcagccccccccccccccgaagcttagagtaaacgcacccaagaaaacacaatttattttcatttaacaaaaaaacaacattttcatcactcaaaaaaacgttgtcatcgcctcaaaatttaattaacgtcgcctttcttcgctttgatcggatctccaatcgatttcgtttcgctcgaagacgcattcggcgcattgtcaagcacaagagacgagtccgatgccacggtggtcggaggcggcgaattcggcgcgtggtccagcacaagtgacgagtccgatgccacggtggtcggaggcggcgaattcggcgcgtggtccagcacaagtgacgagtccgatgccacggtggtcggaggcggcgaattcggcgcgtggtccagaacaagtgacgagtccgatgccagggtgtcggaggcgg

SEQ ID NO: 968 - DNA, 4440 bp, Heterodera glycines
ttttcttaataacttctttacagctcaaattttttttttggtttttcgtaggtgtaatagggcttctgaagggctttagaatgatatcaagactattagatttggttgtcaaagaaaaaagttatagtccaaaaacaagggctggcgccgaaacggcggcgccgaaacgacctagtccccatttcgttctcacattctatattctctcgtctccccttctctatgcgctcacataggtacatattttttgaatttctgacttttgcgtttcctcttcattggctccaccggactaaagcgtttctttcctaattctttctttatcttctcaaatttgaacagcaaaatgcctgtttaaaattttggatttatttatttgaaaatattttgtcagacttgataagttaaatttcaattttaaatggaataatgtaacccgtctttccaggtgttattttttcaaaaaatgggggggggcaaagcaaaaaacgccgatttacaggttgatataattgtaagctaacatataaaattatagaaaatttttcgaatttttaatcaaaaattttgaaaaaaatcccgggtcccggcgggatcccgtcccggtccattttccaagtcccggtcccggccatttcaaaattccggtctctaaaaatcagcatctcctcaaaaaaaatcagcattaaataaataccctgtttacttgttctttatttttcattttaaggtttgtcaacgcgacgaaagcctcgcgattggcccattacaacaagcggtccacgatctcatcgcgcgaaattcagacggctgtccgactgattctacccggcgagttggccaaaaatgccgtgtccgaggggaccaaggcggtgacgaagtacacctcgtcaaaatgagcaggagatgatgaaagcggtggtgatcggacggaaaaacaaaatatcccaaacggccctctttagggccacaatcactcaaatggacgcgaatgacattcttttcctgttttgtatttgcacgcaaataaattgaattacgctttagtagattgggagattttggctaattattaaatgatgtgctaaatggtcatacctaattgtttgcttttggtacaattggtggtaaaattaaagaatatgtgtacctcgccgaattcgacgagtgatatttaattcgacgtttctcggtctgtaatgcacgaatccgaaagaattttttggcggaaaccactttgggccgagttatgggcccgtgactaagcagcgcccgccttggtgagcatgcgaagacggagggtggaggaagcagtctgacgagcgccacaggtggttgactgcgggggcccccgccaatcagtcaaccgcctgtggatcacgcgcggacttcttccctagcccgtagtctcgccccacctattggccgccgtattcgagtgtgcggtgttttggccaaaatacactcaccaatttctattcttttgatccccgagcccataactttttacactatgttcccgagaggaaccgattgttatatattttcttggagattagacgttggacggttcagtccctaagtcattttgccaattcagtcccgggtaaaaattctttcggattcgttagcaacagaccaagaggaatcaaatgatataccattcaacaagaaaatcggagttgtcagtattcttcgctttttcttaaaagagagattcaatttgttattgtggtcaaccaagtcttctataaaatttgagtttagttcttgcctttccttccataagatcctcaaattcgacacatttaatttcgattagccgcttgtactcatggtcgagtaattcgatgtttggagtcttgttaacttctgcctctgccttagcaatatcctcctctgcattatattgcagtttattctaaaaggcaaatttttattcaataaagttgaaaaaccatactctggagaatcccaaattggacaaatttgcttggatatatgcattcctaaaaaataattctgtaattaattcatcaatttactagcttacgtgccagaaccacgagcagttggtagtcctacgttgttgtacattgtaaaagtgtttgtcaaaaaatcttaaaatttgttttaaaattttgcataggcccatattttgaccccctctatcgaatccctgtttattttttcgaagttatgtttttaactcgagatcggctcttctaattttacaagggaaaatcccaaaaaaattttaagttttgcaaagttttggcgttctgattcctaaataaataataaacttatttgcactgggagcccaaaagtcaagcacactgtgcagagaaaagcctagtactatctcgtcgtttctctttttctttgtaatttctctcactttggcgtactatctcttcattttaattatgtaaaaaacaacatttacttttctatgtgtaactttttttctttatgttaaatccgtaccaaattttgcatagcgatagagaaaaaaattctgcatcgattaataaggaaatttaatacaaaaataaggctcactcaaaagttatttggtgaaaaattttgtgaatttctttttctctctttttggcgtactattttcacatctctaacacacaaaaaacatcaaattcgtaaatgctaataattttggttgtaaaggaacaaaatcactttgagcatttagaatcaatagaaaaaagaataaatttagcattttggttagaaagagctgcctaggacttgagttataacatgataaaagtttgaaattccgacaacttttttctgagatgacaaattgttcgggtgatgaccccgagagagacatttaatttattttatttatgtaattccctctctctgtctcccgcactatttctctcatttaattgtgtctgcactccctttgtaaaggtcagacacatcatccctcccccatattgtgacccccgctcatttccaatattcattctgttttcttgttgtattcccacattttcctccgattgtcctccgccccaaatatttatttatttgtttccaataaataattgattatttattggactgtttaagctcggttaggtaagaccgaacaattggcgacgcctctcttcgactcaagccgggttggctgagcatcatcatcaaaagccgagtcggcaatcaacaattttgaaattctaaagccgggttggctatcatcgaatttcttaagccgagtcggccatcatccaatttgaaattctaaagccgggttggctatcatcgaatttcacaaagcctggctggcattcgtcgaaaagcagaaaaccaaaactgcaaaattcttcaaagccgagttggcattcgtcataaattgctgaaagcgaacacaactcaaaatggctgcgaacttcgaccaattagtgagattgatgacgcagcaacagcaacaatttgaggaccaacaaaaattggtgcagcagcagtcgcaacaaattgcgcagttgctagcaaaccaaaatgctgcaaacatcgcagctggtcaacaaaatccgccaaatgcagttgccattccttcgctgccggacatttcgctgttcgaagtgtgtgatgagaagagtcgtgtgagcgaatggctcgaccgattcaaattcgccctcgactgcgccgcgccaacagcaagtgatcaaattaaggtgaaatcgctgatgaacaagctgagcgagatggctttcagcgagtatagccgatctgttctgccagcttcagtcacagatttcgatttttcgacgacagtgcagaaactggagaagcttttcgccaaaccccagtcaatcttcatcgataggtatgaatgccttaaagcggtgaggggagagggcgaggagtttcggcacttcataaatcggcacaaaaagctgatcaacgacttcaagttcgacgatttgaagaaagagcaattttatgcattaatgctcttaacggcacttaaatcgccgagcgacgcagcactgaggcagcgaatattggctaaattggcaacggatggacaaaacgtgtcgtatgatggaattgtggaagacctcatcaacttccaatcaacgattgcggaggctcgagcgatcgaaacgccgatcagctctcgaaatgttaatgctgtccaccaaaagggcaagaaaaacttcctgccgaagaacaaattccccaaaagtggacaaaccacaacggcgaacaaaagttgttggcgatgcggagaatgtgaccatcagccaatcaactgccgattcaaagtgacaaagtgtcacaaatgtggtgccatgggtcacttgggaaagaaatgtgaaagtgttcaggcatggaagaaacaacaaagtgcaaagatgatgagaaacaagaaaatcggacatttgaggatcggaatgacct

SEQ ID NO: 969 - DNA, 4856 bp, Heterodera glycines
tctgttctgccagcttcagtcaccgattttgacttctccctcacagtgcagaaactggagaagcttttcgccaaacccctgtcaatcttcatcgataggtatgaatgccttaaagcggtgaggggagagggcgaggagtttcggcacttcataaatcggcacaaaaagctgatcaacgacttcaagttcgacgatttgaagaaagagcaattttatgcattaatgctcttaacggcacttaaatcgccgagcgacgcagcactgaggcagcgaatattggctaaattggcaacggatggacaaaacgtgacgtatgatggaatagtggaagatttaatcaacttccaatcaacaattgcggaggctcgagcgatcgaaacgccgatcagctctcggaatgtaaatgctgtccatcaaaagggcaagcagagtttcctgccgaagaacaaattccccaaaagtggacaaaccacaacggcgaacaaaagttgttggcgatgcggagaatgtgaccatcagccaatcaactgccgattcaaagtgacaaagtgtcacaaatgtggtgccatgggtcacttgggaaagaaatgtgaaagtgttcaggcatggaagaaacaacaaagtgcaaagatgatgggaaacaagaaaatcggacatttgaggatcggaatgacctcctgttcgatcaatgcactttcgttgatgcagatcaaaattctgctgaaccaacaaaaagtccaattcttcctcgacaccggatcggacatcgacgtgattgatgagtttacttatgccgacattggcaagccaccgatcgaagcgtgcgacgaaattgggaagacctttgatggaaaagaagttccattcattggaaaaggtattggcatattcaaattcggcgagattgaagtgaaacgaccattttacgtggcaaagaaaggctcacttaatctgctgagttgccaaaccatggacaaatttggtttgttggacgaaatgaagctgaagatcagcaacgtggcagtaaacttgtgcaacgccggccgcccaaagggagagaaaattatccccagtggcacaaaacaaatggccggcacagaagccaaaattgaggcattgaaaagggcctttcccgaagtcgttaaagacgggttaggactctgcacaaaggagaaggcacggctgtcgttaaagaagacgccgcaccaatttttcgaaaggcacgtcctgtgccatacaactctttggaagttgtcgaaaaagaattgggccgattggaaaagatggacgtcatcagcaaagtcgatcatttgaactgggcagcgccgattctaattgtgaaaaaggccgacggctcagcacgactttgcatcgactattcgacaggtctaaatgatgctcttctcgactgccagcacccgctcccagttccagaggatatttttgccaccctgaatggaggtaaaattttttcccaaatcgatctgagggacgcgtatttgcaaatcgaattggacgaagaatccaaagatttgtgcggattggccacacataaagggaattaccgaatggaacggttgcccttcggtgtaaagtcggcaccaagcatattccaatcaattatggataaaatgctggccggactaaattttgccaccgcttaccttgacgacatcattgttgtcagcgggacaaccgaacaacacgttcgacatttggaagaagtattttcccgaatccaagcctacggattccgagtaaaattggaaaagtcatccttcttccgagaccaaatcaaatatttgggtcaaataatcgatcggaacggacgccgaccggacccagcaaaaactcatgcaatcgctcaaatgccggctccaaaggacatttcgtcactccgatcattcctcggcatggtaaaccattaccaacagtttgtcaagaacatgcgcttcactcggaagcctttggacgacatgctgaaggatgacgttgaatggaagtggacggaagaacgacaaaaagcattccaaaaattgaaggaagtgcttacatcggaactgctcctcacccattatgatcctaaattggacataattgtggcagccgatgcgtcggaactcggaattggggccgtcatttcccacaaattctcgaacggacaaatgaaagcaattgcacatgcctcaaggtcgctcactccagcagagaaaaactactctcaaattgaaaaagagggcctggcattgatttttgcagtgcaaaagttccacaaaatgatctacggcagacacttcacattacaaactgatcacaaaccgctgatcagtattttcggaagcaaaaaaggcataaggcagtgcagcgcaaatcggctgcttcgctggtcacttactttgctggcctacgacttcgacattgaatatgtcaacaccaaagattttggtcaagccgacgcgctttctcgcctgattgccaaagaatttgagtgtgatgatgaacgagtgatcgccgcgtgtaacatcgacgaagatcttggaatgattttggatatggcaaaacaaattctgccaatcaaatttgaaaatttggtctcagagtccaaaaaggacaaaacaatgcaaattgttatgaaattcgtcagagacggttggcctgatgaacgcaaattggcgccacaatcagaagaaattgagcttttcggcagaagaaaagccgatctgacaattctgaaagactgtctgatgtatggcgaacgaattgtgatccctgaaattttccggaccaaaatcttgacactgctacacaagggccatcctggaattaaaaggatgaaacaactcgcccggcagtatgtcttctggccaaaattggatcaacaaattgaggaattcgtcaagaattgtgcaccgtgtcaattggccgctaaggcaccgacgaaaacggatttgcactcatggccaaaatcaacgcggccatggcaacgaattcatgccgattatgcgggccctttcttcggaaaagaatttctgattgttgtggactcatattcgaagtacccggaggtattcgaaatggccactaaatcagcggccgcaacaatcgaacgactgcgttatctcttcacacgtcacggtataccggaaacattggtaaccgacaacggaacgcagttcgccgctagtgaattcgcaaaattcacagaagcaaatgtaattgcacatctcttttccgctccgtacaacccaatgtccaatggacaagcggaacggttcgtggacacatttaaaagggcttttcgaaaaataaaaggggagggagtgccaaataaggaaatcatcaacactttcctggtcacttaccgcacgacaccgaacgattcgctgccggatgcaaaaacccctgccgaaatgctccttggccgaaaaccgcgcacaacgattgatctcctaatgccgcctcttccacagccaacggagagagacacaaaaatggagcacatttcaatcgccggtttggcgcccgaccacagaaatttgtgtcaaataagccagtttgggctcgacaccgactctcgcagaattggagagctgggacaatttgtgattgctccggagtcatctacacggtcaaattccccgacggttcgacaaatcgctttcatgcgaatcaattgagaaaccgggaaaacaccgaaaatggccatgaaccattggcaattttaaatgaggcattccatctgccgatcaccgcaccgaacgttggaattgtagggcaggaccttgagccaaggcctgacccgatcaacgatgagcaccaggacgagatcgaaccggagcaggcccgtcgaagcccgacaccgcagcaacaacaagtgccgcgccggagtggacgaaaccgccgagcccctgatcggtactcgcccggatgagcccaatcaaaaggggaggtgttcgggtgatgaccccgagagagacatttaatttattttatttatgtaattccctctctctgtctcccgcactatttctctcatttaattgtgtctgcactccctttgtaaaggtcagacacatcatccctcccccatattgtgacccccgctcatttccaatattcattctgttttcttgttgtattcccacatttttcctccgattgtcctccgccccaaatatttatttatttgtttccaataaataattgattatttattggactgtttaagctcggttaggtaagaccgaacattattattattagcttattattcaattttaaattatattattaattaatttaattaattaataatataattattttaatctattaattatttttctgaccataattataatttaaatatattatttaatatttcccaaacaagttacagttttacgagagaaatacagtgccccaaaaaagtcttgactcaaacctgaaaaactatcttatagttcatttaaatacttgaaataatttatgcttgcacaacttttggtgctgatcaaaaaagtctcttacatcaacttgatcagatcactcctttgtagtgaacgggacacccaaaatacactgaaaatcggggaaattttcaaaatccctagggggttgggaaattttttctagagaaaatgggcaagcccactggcaagagcacaaaatttgctaccgaattgttattggaatagtggttctacgatttgtatatagaaagttatacttggttgaaaattgatcaccataaaaatgatcaatttttgatcaacgccataactttttccagaagcatccaaattgagcatacttggtatcatttgatagcaacgaagtgtcctctatttgccttt

SEQ ID NO: 970 - DNA, 1085 bp, Heterodera glycines
  misc_feature (1077)..(1077): n is a, c, g, or t
catatcagacaagacaatgatgaccagaatgattatttaataaaaataaataaatcgagaccggcatgaaccattaattttaagcgatcttttcagttaatttttttcttttctaatatatttctaaaattaaataattaataagttaaaaactccagaagctttgtgaatggtaacaaatttggttgtcagaaacgcccaaaaattatttcaaaatcgcatttttaaatcagcacttgctgttatatgaaatttttatgctcatccgatgcaaaaattacggtaattttggcattttaccatataatttggatttcaaacatttaattacagtacccaacagacgaacacacgccggttacggtcaattatcattattttaccaattagcactgacagctagctatttgatcaatttggccatgtatcaattgctgtatatgctttagctcccgtttggggtaattgtttttcgctgattttccattttaataatctttataacttttgttgctaaaaattattattttagaatttcataattgtatcagtttcaagaatttaatcggtaaaaatcaattcactaatgtcattttatggcaattatttttgggatttttagcaattaaaaattcggtctttttttgttaatgaggtttaaatataactgttattcatcacattcaaggtcgccatttcatggaaagtggctttatttaagcactgaatatcgccgcgtatctgcactttaattgaacacttgttggacaaaaatggtaataatttaattcagaaaaattaaaaattttaaatagacaattaaattcattttttgcatctttactataatttaatgttaattcaactgaatcgcttctgatactcattatcaaaacacggatttgttttgtcctttaatatatacaattttgttttacaaatttgcaagaacaaaatgattggtaattcgccaaattaccataaggagaaccaattaaaaatttaattcgctcaacaataaccagctgaacaaaaatgtaccaaaattcgaaattttaaggttttagtcttcagaantagttatt

SEQ ID NO: 971 - DNA, 1877 bp, Heterodera glycines
gaggatttgagtatttttctggctttttgataaattttgaggatttttgacgctttttgggaaaattcttagaatctgttaaattttatgaataattttgataaatttttctaatgtttgataattatttaatttgggttttaatagaacatcaaaaaaaaaatctcatccaaatttttcaaaaaaatttgctaaatttttcataaaaaccagaaaataaccaatttttccgaaaatctacaaaattaggaattcttttatgaaaatctgctaataatgtggtcccaaggcggcgcctatcggcaccacttggaccctagaaatccttaattttcttaaatcggttcaaatcgcaaaaggtttgttatttttgtagacaaatgttttaacaagtcgcattaaaaattatcggcaccgccggccacccttgttctccaatgatggaccttaaaaatataacatttgattttaagcatgtttagaataaatttattaaaaataaggcttttttgcctgccaaatgatgcttttgaaaattgtaatctgggagccatgtttatgagctctgacttttgaagttgtttaatattaaattgaattctgtgtttgatttcgttttttcattttctattaatttaaagttttatcattttttataatatatttaagcaacttgcttcacactcatttcataacagtgaaaaatatttctatgatttgtttctatttattagtgttaagaatgatataaaaaatttttttttaattcgttaacaattattcaaaaaagaaacaaagaaaaatttaggcgcgccaacgaacaaaaaatgtcgtcaagacactgacatatttagttgtatttctaccgcttttttaaaataaaaaaatattatttgatctacatggttttggtattatatttcattattattggtaaaattcataaattaggatttcatttggaatttctttaatcaatggtaaaaatattataccataaattctggaaaaattcgaattttcagaaaaaattcagaactcagttctgaatgggtgttttggaaaatattcaaaaacaacaattgaaaaagttgcaggtcctcaaaaaacggaaagacaaataattaattaagtcaagaaaatttaatttaattaattatttaaattgtttatttattccatcaaaaatagaatataaattatacctgctttagtatacataatagtttttatgctattttttacaaaatgtttgattaaataaaattttgaatttaattcaaaatgattttaaccattttgttttctgcaaacatttatcaaatttagtgatacatttcttgttggttttacggtgttagactcgtattcttgtgtgcaaagaaatgccgaaattcgtgtgaggcgattaatgcatccgttgttctcgttttttggctttaaagttgaataatttattctgttattaaaaaatcttcatctatttaaaataatttacagtaaaataaaataataaatcaataaatgatcaccattaaaactcataattatttatttgagagaaaacagaaaaatcatctaagaatcataataaaaagaattttattgcataaataacaaataaagcgtatggattattaaaaaaataattaaagagatttatattcaaaaaaggctgaaagaaacgaaacattaaaattaatttttctaataaaaagaaatcaaaaattattttaattattcaaaaataaatatagtgcatatcattttttcaaaattaacataatttcgtaaagaaaaatgttcaaatcacatttttaatcaaaattgagtcaacaaaattgtaacgaaatttaacgatacaacaatttaatttg

SEQ ID NO: 972 - DNA, 11989 bp, Heterodera glycines
aatttgtggttttaggatgtttaaaaatgaaagaaaaataaaaatgggaatatttaatttattaattaaatttcaattgaaataatgtaaagaaaatatgaacatagcaataaatgaaataaataatttaattattttctcaaaaatttctccttctttattaatttccttctcttttcttacccatacccctattcttaacagtgcttaatttagtcccgccgggaccgggacctgaaaaagcgggatttctcgccccattcccggtcccgaccagctctagtctcaagtgtagaaaagtctaatttggcataccttttattgttttttattttcttgaaaggaagaaatacactcaattagattaaaattttatatttttcgtgtttcaccagctaaccgagtttaaatttctatcaacaagcatacctcacaattatcattagggatgatatttataggcactaaaaaccgtcaaaataggtaggccttaggctctaaaaaacccccaaaataggccctaaaaatggaaaataggcactaaaaacctcgtttttaggggtgtaaaatgacaaaatgtattcaaaaaagtaaaaaaattaggccaaatcagtactgagatatataatttttaaagcacaaattattgtcaagaaaataaataaataaatttttgatatgaattttcaaaaagtttttcatttcttataagtgtatttttgaaaaaatttcgggtcgattcttaagggtgtatttttttttttaattttagtcgattcttaggggtgcatttttcgtttttattgcatttttgttaatacttttgggcaaaatgccaaaataggcaaaaataggctctttcaaaattttttaggctttttaggcgctaaaaataaaagcctagaaaataggcactaataactcgaaaagtagcttaacaacagcccaaaaaaacatgttttttgtgcgtttcaggccacggagagctcaggaaaaaaataggcttttgcctaaaaatttcatccctagttgtcactttctttggttttgttcagctccgcccgaccccgcctatgctgacgatgctttggtggccttccaacgcattgtcttctccaagccatatttgttgcttaatgtcgaatacaaaacgacgggcgcctcttcgcccaccgttgacgcggtctctctctattgggatgaagcggcggcgagcagtgccaaaagttgtggggccgaaaaaacgcgggatgtggggcgccaactcgtcgcggatggacacgctttggtcgagaaacgacgggaggcgcgactacagccgctggtgtgtcggtggtgggaaggcatggatattatacagggcgcatttgccaggaatattaaagcacaaatgttggcattattccttggattaagctgaaagactacgctgaggcagagcagcaggcgcgcaaggcccacctgaacatgtggcgctacggcgacttcactggcagcgaactgtgaatgttgacggtgctctgaaagttcggacagactgtgcagtgagcggcggagtgtgggaattgttgcctttgttattattcaacggatgggttaccaagcgaattctttcctttttacgtttattttcacattttcatatttatttagcgtagagaaaaatgttgaattttgttgtttctcaccacttcccatctttggactcacttctaagtttcaatcggtaaacaaaaagcattcatttcaaactatgccaatgttctgtgattgttattgttattctttctaacataattccatttcggggataaattggaagttgaatttgacgaattcatttttatggcctttaaacagccgaagggatatcatctttttaatggagaatattggatttctattaaaagttgaaaatggatgattcggctcgtcagggccaagcccaccgagctggtcttttcaaaacagcgcccaaaaaacactcaattgggcgtcaccgaagcaaacgcgcaatcgctcgacttcaaaagggttcgtttctgttacatattacagttctttattgtgttcaatttaatttgttaaggcaaaattagtgccaattctctgaatgtccagaagcgtcacgccctcagcaaaacggaacgacggcagagattgtctcagattcgagcgaataaaagtgccaaattaacggaaaagcgaaggcttgaaggtgatgccccgtttttggtggtgagttgttttcagtagattttaactttttggttcgatcattgctttgttagacagtcgtttcgctggacaattctcgcccggcacaacaaattgtccaatttttttctaaagctgacgctgaatcgaaggcattcgaaggtggccaaagcgtcgtttgccatttgaagtgcgcatgttccgttggcactttcatgttgttccgttcgttcagtgttcctcgttttcgtgctcgtttctccttcctttgcccttccactttccagtccgtgttagattctgtccgtgcttctgatctgcttctgctcatttggccgcttggcgtcgaatgtttactgtcaacgcaagagcgattgcttgccgcgctacttgcccagggattgccgaccacaattaatgccgttagtggaatgccaaaatcgggaaaacagcgcgagacggcacgtaaacagttggacacagtgatgagaaactggtaaagcgaagcatttgcgaagaaaaaaaaacatttaccaaaaccaatctaaaattatttcttgttttgttagataattaaaattgcttttggggcaggcatacggaacacaaaagcaatgtttacgacttggacactgccggcgatgcactcaaaattctgaggcaaatatcaaccgggaaaaagtcgacgactaatttgcaaggacaacggtcctatgtggtggttgagaatgtgcaatctgatgaagaacacgaggtaccttctaaaatacggcaaaatcaaaatttttttttgtgctaatttttaggcgaattcactaaagtgcactttaaaagtgagcggctttttacggggagcaccattgagcgtcaacaaattggtcagtctaaccaatgagcgtaagaaaaacaaacaatgtcttgttttttgagcgttttattattatttttttaaaattttaacccgttatttacttttcccgtttgctaaggttcatttgcccggttggggcgatttccaattggcacgcattgaccgcactttggagccatgtccaatgaagacgccgaatgacaaggtaaacccacccatattatgttttttgtactgctgcacattgccattttatttttgaaccctccgaccggtgatgtcaaattcgctgtgttagcaaaagcagaccccgccaagcgaactccattggattcggaaattgtgccggatccgatggaagccgaacaaacatggccaaatgaaaacgaaatcgaagaaaacaaatgtaaaaacagaacaatgcttccaactcttagtgaaattaagtcgtcgtgccaaaggtcagcagaaaagtgcccaagggaacctcagaataccaagcgagttggctaattgattctgatggaacggacgaaaatgacgaggacgaaagcgaagaagccgaggtaaaagcagcgaatgaaatgggcgagggagaagggtcattcattcgctgtaaaattaggaggaggagagagaggacgaacaaatgggagaaagtgaagatggcaaagccgacgacgaacagagcattttgagcgcaggggaggaatcggaaatggacgcggggaacgatgacgacgacggcacggacgaagcggcacgcgaacgcttccgtcagcaacgagaaaatttgcaatggccggacgaggtggagacaccgcgggatatctccgcgagggagcgattccaacgctaccgaggcctgaaaagttttaggcaagttacaacaccaacagcaaaaaggaactaattgtaggatttttcaaccatcaggacgagtccttgggaccccaaggaaaatttgccgcatgactatgctcgcatttacaaatttgtcgatttcaaacggacccgaaaattagcttttgccgaggctcaagaagcatttaaaacaaacacaacgggtgaatttgcacatcctggcacatacgttacgctgcacattgcaaatatgccgcgacgaattctcggtgaactttcaattgattcttgttggttttaagccttttctgcagattttatgggtccctcgtcgcctccgctggtcatctacggtttgctcaggcatgagcatcgcatgaccgttctaaacgtcgtcctccaaaagcaccaattcggctcaaacgcggtcatcaaaagcaaagaccgactcattttccaagtcggctgtcgtcgctttgccgcctcacctttattttcacagaacacaaacggccaaaaattcaaggttctcgttttaagaagcgattggcacttgcaaattaacatttccattctttttcagttggaacgctttatgccttcccagggcgctttttgtgccactctttttgcccccgtcacttacccaccgacgaatgtcaccgttttccttgctcacaattcacaacccgcggaactcgtggcgtatggaattttactcaatgtcaaccccgaccgcatagttctgaaacggactgttttgtctgggcacccgtacaaagtgaacaagaggacagctgtggtacggtatatgttctacaacagaggtcggtgatggtcatttatccctttaaatgctttccttttcagaagacatcgaatggttcaaaccagtggagctttacacgcacgaaggcaggcgaggccgaatcaaacaggcaaattggacgacatgccaaccattggtttaatttgtatttgtgtttagccactcggcactcacggactggtgaaatgtgtgtttgaccaaccgctgagtgtccaggactccgtgctgatgaatctgtacaagcgtgtgtttccaaaatgggactacgacgaccgattggaagggacaaatgcgacgaattcggacggaaggaattccaattttgaggaggaggaagaaaaagggggaaaaagagggggaaagacggtgactttcctggagaaaatgataatcgaataagccattcgattgattgccaccatttttaaacatttatttttgttatttgttgaagaaaattgaaattgttgacagttttctcctgtatttcgtttttcgatgtcattccgaaccgtttttatgccttattttgttccgttttcccaattgtcggatggattccgcgcgtcaatcgcgcgcacgtgcagttgtggtagctcatttcggcaccgatgtgttggggccgctccgtgggtttgacaacaacattggcacagtcgaacgtcgtcttcgagagtattgcaaaattcgggtctgctcttttattctaccggtgacttttcttggattatcttttgtcttgtcccctcatcaagagtggcactgcggtgggtgccgtctttccggcggcgcttgccaatggcattcatccgtttgttgatgcatgcaccgcgggtgaatctgccaagaattgtcggcactaaactacgtttgttcagtttttgccaatttgcttaactctgctgaccgcttcatcgtcttggcttattcttcccttttcgactttttccttctctacggcgaatttcccctttccgatcaccatcgtttgtctgatcgcaattgcgtcgaaatgatcagcgactttttgccccatttgcgttctttggacacttttgcgtgccaatgcgaacggctcgcctcgtgcattttgcatcagctcttcgcccttttggcggttcagcagccgatcagttcgccccttccgattggctttgtccgcgatttgcccatggaaagggcgtggcgttgtctgggcgatttgctgtcccttttcctcggtctctcctcccgttgctcttccgttctctctttcaccctccttttcagtgtttgacgaactgatcggccaccatccgttccttcgctcccattgggctcagtttgtccgttcagtgcgtctcgctcagcacaatccctcccaatttgcgctgtacggacagtccggccgattggagcaatttaatggagaaattgctcgattggatgccgaattgatgagcgggaatatttttggggtgtgaatccgaaccccattgaaccccctggaggatagaaacataacccttgggctgctcttctgtactttctgccttccttttactgttccttctgaagggcatctgtcgtcgtctcgcttctctcatcttcggccgtccgtcccccccggcgccgtcttccgccgaccaacgcgcctttgtcgaacgattccgtcgcgtcataatgacctcattggcgcgttgggaacgtttgtcggctgcggaagatgccattcctgacaaacaacatcttctctcactgttggcattggcaaaattgttccattttgtgttggcagaaatcaacagaaatgagaatagcaaacggaagagtgtcgtcgaccggaaaatgatacgagcactgtacgcgacacacaaaagagttggtcaaagacaaagggacaatcctgcgaaagcatgggcagtttggctgtgcgcttttaggtcgtttcgttctatttgatcggtgatattctgttcactcccgctgaacacatcgccaaggcattcgacccaatcgatacggacgcaatcgaccgaaaagcgagggcatcctccgaccaagcacaagcagtgctattagaacatcaaattgagcaaatgagaagagacgcacagacggtgccatggcctcatggtcatgtgaattgatttcatcagaattttagttgaaactttgtgtgactgaatggtgtcacaaaatggaccaattcgaatgtttcccaccgaccaatggcgagccaatggaggaaatcgtcgaccggaaatgcaatttgttgttcgatggagcccaaatttcaggcaatcagccattttaaaaggcgttcagtttacactcaaatttcagatagaattgggcgccttctcaagtgcattttgaacggtcatttggctgctaatcggcctttgtccaaacacaatgccaagcttttgtttgaactcatccaacatgtcaaggtgtcggtcaatgcaaactgttctccgaagtttgatcaccgccaattgtttccactccaattttagcgaatttcctcaactttcgatctccgctggccttcggttttagaatgggctcagtttggctgtgccaaggcttcgtctgcactcatccgacttttggatggccaaatcgcagcactgcccccctcttctggcgaatcctttgataaaaatgcatttgccgtggctgcctttcgcaatgcccaaatggcactggcacaaatggtcaccaaagatggcattgtcttttgcggaattgcgctggagatggccaattacagcgtgtgccattgccaaacattgaacttaattcccattatttacttttggcactctctgtagaaacttctccgtcccgcggatgtccagcgggtggacgaccttttggttcgtctcgatttgctctccgatttcgatgcgctgctccgccgtgtcactgattggtcctttctttattggcatcgtcagtttctctgtgaaactttttgcaattttttggtctccgacccaacggcggtcagcgatttgaccggcataaaagtgtgaattgttggaaaggattcccgacctatcgttttattcagtacttttttgatgcactcaacgacagcacccgtcactttctgcaaaacgccgtcctttccgatcaccgcacactttcggacacttttggcaccgaaatgtttgccatcgtcaaagagatcagtcaattagagtcgtcaattttaattacctttccttttttgttttagaaatttttggatttgttatgcatgcaaattgaaaatgatttgcgcctttcgtaccattcgcagcaaaatgtttctttggattcgatggaacgctcactttttgctgaaacatccgatggcaatattgggaacggtggcggcaccgccccacggcaccaccagcaggaggagggccaactttggcatgggcactcggaaagcgcaacttcgccaatggttgcaagcgtttcggcaaagctgctgcacttgccgcccttccatttgggcaacaaactgatcagtgtcaaaggtgggctcagttggccgtcctttcgctgatcgttcgatttggttttcgtcagcgttcgtccgatgccatttggagtccaccttctacaatttgtctgtgctcgctttgcacgattgcgacagttatcgccgcatggctttgttggccctccatcgttaccatttgcggttggccgactcggggctgcccaatatgagtgttgaccagggtcagtcagtcagtcggtgcttcggttgtgaagtccctcccagggttggaccttctcgcggtgatggccgatgtggacacttttgtggccgattactgttacgatttgaacgaacaagtcggagtttgccgaaaaggccttttttagcgattcggatggcgcttttcctggacatcaattttagtttttcatcgaacgcaacgaacacggaaagacacagctgaacattttgcgggtccatcaggtgatcaattcggtgaaaacccacggactcggcattctccactctttggcatgttttgttttgtccattttcaaattggtcgttcattatcgtaaagatcaattcggcttacaaatttctgcgtgtgcaattccaacgcctttcgcgctgtctttttgacgaacgcatcaaaaagcttttgatgcaagagattctgttttatcgtgacgcaatggacgaattggaccaaatggtgctgggaatgtgcccattttgattgacttttcagggaatgccttttcagtacccaatgggccgagctgagaaattggccaatgctttacttcgttttgactgtgctgcgcttccaaatgctatggccacaagtgatgactgtctgaacaaacttcgggtaattcgttgatcgctaaacacgaccattttccatcgccatttccctgaaaggtgttggtcactcggatgggcaatttgctcggccttttgcgactgattcggacgggggtcgtcgagttctgttcgccgctcattttccatcgctttttgagtgccattgaagccgaacaaaagtccattgagccacagcaaagtccaaaaggcactcgagttgctgaagaagcacgtcttttatacggccgtgccttccaaaatgccatgtccaatttgacggagtcgcgcgactgcgtcgaggcattcaatggaggagagggcacaactcaaaaccattttgaattcagctgctcacttcggtattcgcgcgtgagtttcgctgtaatgggcccaaaaagtacgcccatctccgccactttttcatcgtcgtgcccgcccttacgctgtgccatgttgaacatacgacgagttgcagggcacgccttcagacgagcgcgaggagagaggctacggaaacgaaagacccacgcgcacagcagcagcaacagatggtttttgtggaggacggattcagcatgggcaagtggcgacagagggaagggaagggatggacaaataaatgcgcggggggaaaagacagtccaccaacaaagcaaggcgaactgttgcgcaatacaagcttttcccattagggatggcccttttgcgtaattgctccattttccccttaattggtccctttcctcttaaggcattgcttatgtgctcacacttttcaaccaacgctttttcttcgattctttgaattggagtaactctgtacaaaatcgcttttttcgtgctgagttggcacagtgcgcggcagaactgaaagaggcacaaaaacgaaaagatgagtcattggcacaggttttggcagtgaaagcggtcagttaaacggtttaaaatgagaataacatttgtttgtttaggctcagttggaggaaaggcgagcggaacatcggcttttggagtgcacaataaattcggcacttacacttttccaagcgaacgaacttttgggggaggaggaggaagaagagacatttttagaagacctttgaaaggacacaagaaattcagaattttattttagaaaattactagtaataaattattttactgagtttttcatcccttctttcaattgaatcttcataggataaattgaggaatgtttttttcgtaaaatccaaggtcatcatcgccgaacacgcagaaaatcacagtgtcgagcttaaattgttaatttaacagaaaactaaaactaatgatttactccgtcccctaccttttcattgttttggccttcggtcagccaatctctcacagttttaatcgcaatttcagaggcttccttttttgggaagttgtaaactccggtcgaaatgcatggaaaagcctaaaatacgagtagaaggaaaaccccttgtaagttacgatggatctcaatttgttgtcgcgagccaggcttagcgagttggcgtagcagtcgcgcaactgtcggcactgttcgtccgacacttcagtcccaatttgaggcccgacggtgtgaatgatagctaaacatttggacgatttgtgagcaaatcgtcgttgaattgtcctgcctttgatgtttggcatcaaattatacgcttttgtgatcttcgcttcgccgacttcgcaccctttcagtgttcggcattcctccaacaattgtggacccgccgcccgatggatggccccgtcgacaccgccgcctgcattttgaaagaaaggcctttgtgccattgttttgtttcgtttggacacaaacccccaagcagtgagctgttggccgcgttcacaatgcaatccgtagtcattttggtgatgtctcctttcaaaacggaaaatttgcttcgcaaagaaagtgccatttttcaattctgaactaaaggagaaggaaggcaaaactgcaactaataaatcgaaacaataaagaattgacacaatttgaaatcagaatcactaacattagaagaacatttaaaaaaagtttttttaaaagaaagtaattagcaaatgacaatgaaaaagaatcacttatccttatcatcatacatatgtcaattaaagttcagtaattaaagcttgttgttagagtctatccacactttcatcccttcaaatcaaaagcagaaattggaatgagcggattctctgaaaaacttatgcgcgatcgcctgcagaaactgtccaacacagcccattcagtaattcattcccatttcactgttttctcattgggctgggcgaaaaggaaagtctgagaaatgttaaaaatgattttatggggaagccgtcccttttctcttcggatttgtcaattgtccctcagattcaaacgctctccgcttggcttcttcaccatgcaaaaaaacacgcggattgcattttggactgttggcttaaggttcgttttttatgacttaatttgacaaattcttttattattcgttaaactaatcccttttttcccaggaagtgcgcaataattcggagaacgaacgactgatcagtctgattaatttggcaaacgatgtgatacaaaacagtcgaaagaaagtgccctcctttatggcagccttttttgaagtgttacagccggcatttgtccatgcctccgagtgtttggacgaatcgcaccggaaaatggtggcgcgaatcgttgcggtaatttccaaatggaaaagttttttgaaaatttgaccccgaatggctaaatttagtacttcactacaaaatcctgctttttcgccccagcgctcaaaatttgaaaaaaaccact

SEQ ID NO: 973 - DNA, 4002 bp, Heterodera glycines
ttgatttttgatgcgtttcgagaagaagaagacttacacacacattctcccattgttttgtgtgaagaataaactgataaaaagaagtgatcagttgattatggagacaaaaacaaaacaaccgaaattatgaaagaagatgacaaaaagtgataaagcgaatgatgtttgttatttcggattgagataataataataattgtggtcccttagtgttatggttcacataataaagaactgttgaattcgatttctattaataccagggtcgcgatctgtccttttttaagaaatgttctgaattaggggtagcaaccaagtttttgagcccggttgcactataatgtacaattttgctaattccctcttcaaaattattaaaattgataatggcggcgaaaatattatttattgtaaaataacttattggaataaaaaagttttgagatcctctaaaaccaaatgattatgttcacaagggatgacaaaatagaagaacaaaatcaaataataaatgaaggagtggaggagagagggaggaggggaagaaaacacctcacagagcaaaaagagaaggggaaaaggaaagtaaaaaagtgctctttgtacccaaatagtaattcggatttcaaaaggggagaggagggggaacgatgacctcagtaagaaaataaaacaaatacataatgttaaataagaagggtcaaaagcaataaagatgtataattgagcgcggaatttcgaatcgccaagaccgggactttaaatttgacccggacgggagttcccggactttctaaaagattaatgaacatttgttaaatatgtataataaaaacttcaaaaaacatgacgagtcgttaaaaaagtgcaaaggtttttaaaattcactgatcaccgaccgatttctataattcatagcaaaaagacaataaaattatcaaatatttaattttcttttctaaatatttgaatttgtctgccacgcccaattttcagtcaggtggtcatttgtttataaccaaaatgtttaatcgaccaaaacccaattttaagtatagaaaatattctgaaaaaattcctgctaactataagttaacctttgatgctgacctattaagtcttttacagtaacttggtcagatcacttcttcatggtgctggacactccaaaatacactgaaaatctggtaaattccgaaaaaatccctaggggattgggaaaaatttttcgtaattttgattttggcgacatcggtttaaatggttgtccgcttatattaaaatatctttgatatgcgaatactgtatttttaattattttcttttttgttatattgcatcttttttaacgtcgtagcaccaaaaaagattcttatgtattaaaatcattggatactttccgttatgccgcccaccccaataaaaaaatggatgggaataaaaaccaagaaaatctaattaattgaagtcataaagtgcgatatattttattaatttcatttatacatacaattaaaaataaaattaattaaaaggattcaaatggtttgaccaagtttgacaaacgcaattgttcactcgcatatttattcagcaactgcctgaacttcttctcttcgctcaaatcttacgccatcaccttggctgaaaaacaaactcatcagcgaaaaacccatataaaaaattatctaaataaactcacctgctaaacagaggaaaaaaccatttccatttgacggtgccaaacacttcgtggaagttgcggcgaatgcccaagtcaaaggcacgcttgtcttcgccatatgtgaagaccggcggaccaacgatcatttctgattcaataaagaagaaagggatgatcaaaagatcacataaattcaccaagagatgtacgatttttggatatcaaacaaagatgtcaagttaaaaagaaagtcagagaaaggccaagcaaaaacatcagaacgaagagaaaagtgacgagaatccggcaaacttcatcccaaaatgtgctaaacttagaggaaaatggttttactggtagaaaaattggaaaaaatgaaactaacataaaaagggaaaaatggtggagaaaataaaaacggaaagaagccaagcatagccaacgaactgcacaaagaatttatagttgttgaaacggatgcaggcattaatctgatagaagggaaaaggagtcaatggattgtatccgacggaaatcacaaacgcacccatgggcaatgatggtcgtacttcctgaaaggaacaaccagaaaatgttaaatgctcacagaaagcaacgtccacaggtggaacaatggtggcatctgtcgggcttaatgcaggcgcatcgcatgcaaaagcgaatagcttaacaaaacgacgtgtcaaaatgatgccaattcaattccaaaatgaatgagttccacctccgttttgggccctgcaagcgagctcaattttctgatccattacataacgttcaataattgcgtagaattctttggtgttatatgctctgcttctgatgatgcccttcaattcttcatcaatttgggcgggaatgttgaattgaaaaacaataaagtgatcaaaatgtgcactgtgtgccgcacattgtccggaggtctttcattaggagcgatcattgtttgaaccattgtccaaaggaagagaaaaaacaaaacgtggaaagggaccagcaaggcgagcctaacttcgaacgattcgattattcctgtaagaaacaaaaaaataatttcggctagaataagtgcaaggaatgaacgaacgtaccaaaacataaaactcgcataaacatcccgtcccgcaaagaattttgagttccaatcccgcagcgggatccgcaaatttgactttttgtgcgggattctgcgggattttattgatttttttgaaaaattttatggacaaaatgccaaatatttttgaataaattaaatattaaaatttatcgcaaatttcattcaaaatttgtgaaattttcccggcggcgcctatcggcaccgccggatggccttcaccctattttttcttttaaaaaattaactcaaaattacaaaattggtcaattttagacaaaatctgttaacaaatcgcattaaattttcaaaaatttctccagctgtgcctatcagggctgggacgcgaccgcgatccgcgaatcgcggcgtttttttttgcgcgatccgcgaatcgcggcgtcttttttgcgcgatccgcgaccgcgaaaatttgaatccgcgatgcgtgaccgcgggatttttttatgcgcggcgcgccgcgcatttttggggcagaatttttataaagaaaatttttttgaagcgattttcttttttgaatatccaaagtttaaatgaaaattatttgaaaacttggattatttttctcgaaaattagtttaaaaattccatatttaccccgtcagagctgacaaatccttttcgtttcaaaaattccaatttttccacgtcgaagctgacaaaactttaattttctttaaaaaaaatggctagtaaatcacaaaataggttattctttacaaaatcttttaccaaattgcactaattttcaaaaattttgccggatccaccatgcccccatcagttctcaaaagttttttagaaaaagcgcgccgaaaaaagcggtctgaaaatataacaaatcacaggatttgcgtgtcatttggacactgacgcgcccccccccccaccccttcctccagtcccatcgcaaatcttacacatatgcaccgagatttaattgattttttataaaaaggaaatttttaaaggaagttaaaaaaaagtatgttaaaaaaggagaaaattttgaggttttactccgcccaccgacgtaatttgaatccgcgaccgcggggattttcctgtgcccccccccaccctgggtgcctattggcacaagcagaaccccctcagttttcaattttttgaaaaaaacttcgccgcaaaaaaa

SEQ ID NO: 974 - DNA, 2736 bp, Heterodera glycines
  misc_feature (136)..(136): n is a, c, g, or t
tttgggccctgcaagcgagctccattttctgatccattacataacgttcaataattgggtagaatctttggtggtatatgctctgcttctgatgatggcctcaattcttcatcaatttggcggggaatgtgaatgnaaaaacaataaagtgatcaaaatgtgcactgtgtgccgcacattgtccggaggtctttcattaggagcgatcattgtttgaaccattgtccaaaggaagagaaaaaacaaaacgtggaaagggaccagcaaggcgagcctaacttcgaacgattcgattattcctgtaagaaacaaaaaaataatttcggctagaataagtgcaaggaatgaacgaacgtaccaaaacataaaactcgcataaacatcccgtcccgcaaagaattttgagttccaatcccgcagcgggatccgcaaatttgactttttgtgcgggattctgcgggattttattgatttttttgaaaaattttatggacaaaatgccaaatatttttgaataaattaaatattaaaatttatcgcaaatttcattcaaaatttgtgaaattttcccggcggcgcctatcggcaccgccggatggccttcaccctattttttcttttaaaaaattaactcaaaattacaaaattggtcaattttagacaaaatctgttaacaaatcgcattaaattttcaaaaatttctccagctgtgcctatcagggctgggacgcgaccgcgatccgcgaatcgcggcgtttttttttgcgcgatccgcgaatcgcggcgtcttttttgcgcgatccgcgaccgcgaaaatttgaatccgcgattagtaaatcacaaaataggttattctttacaaaatcttttaccaaattgcactaattttcaaaaattttgccggatccaccatgcccccatcagttctcaaaagttttttagaaaaagcgcgccgaaaaaagcggtctgaaaatataacaaatcacaggatttgcgtgtcatttggacactgacgcgcccccccccccaccccttcctccagtcccatcgcaaatcttacacatatgcaccgagatttaattgattttttataataaggaaatttttaaaaaagtttaaaaaaatgtatgtttaaaaagttgaaaattttgagtttttaaatccgcgaccgcggcaaattgaatccgcgaccgcgggatttttctgtgcgcgccccacccctggtgcctatcggcacagcagaacccctcagttctcagttttttgaaaaaatttcgcgcaaaaaaagcggttttgaaaagcaacaaaataatcaaatttaaggaccattaacaggtttgattttgatctctttttaccgtctgatccattcgaaaaatcttagtcgacccatcagccccttttaatggatcccgccagcccctaaaaattattttttaaaaatttcaggtattttttgatttttggaaattttttgaaatttaatcgaaactttttcgaactttgcaaaatcccacaatcccgcgcgggatcccgcaaattttaaatgcgggattaatcccgcgggatcccgtcccgcaaaaaattttgagttctaatcccgcagcgggatccgcaaatttgaaatttccggtctctaatgtcaacccaccgagtcaattttaacctctcagtcaaaaaaataatctcaaaaaatttaatacgttctttaaaagcatcttttaggaaattttagggggaatctgattcatttaggattcaaagcaaaactcggagatttaaaatttttgaagttttttgtttcaaaaaatgtctcaactacctgtacacatggaaaaaacaaaaccccgagatttcgtagtttttatgcatgttaatattattaaactacaaaaaattgctgtaaacattttcagcactgaaaaataaaatagcatagcgttttttggctaatactatggcatcaattatttttgaactcgactttattaaaatggtcacgcttgaactgctcgagcactttttgcttccgtggctgggcttccattcttcagttaaccgttgtaacaacaccgacgcgcgtcaattgccagcaacgatggtcaaatgcaaagtacagaagagggatgacgaagaggagaaaaggggaacaaagtggaaaagaatgggcgtaattagcaaaggcacgtacagcaaaattgagaaggtgtgcagagtggagaaaccgcaactgatcgccgcgtgcaaggttaaaaaatacaaaatggaaaaacggaggatggaaggcttaaaagtggctttgtcttcccccaaccatttaccccttcaaaatcctaaaaaacggcgctttttgccactccactcccttgctaaacaaaccatgggaaaattaaatatttcgaatggttgcactgtaagttttatattttcaatgttttttggcaactccgattttcttattttttggcaactccgattttcttatttttgatattcattttttattcgttctttcatttactctccaattttcaagatcatttctctgcaagagggcgaaggaatcgacgactttcttgtcgaaattgaaattctcacgcaatgcaaaggccagccgaacatcgtagaactgatctcatactattttcacgagcagaaacttttcgtaagtaaaaaataccattttcttcggaaaacggtcccaggggggggggagggtacgtacgagcaaaaggc

SEQ ID NO: 975 - DNA, 4352 bp, Heterodera glycines
cttatatattttaaaagccaaaaatggaattttcccaaacaactctcgaattagtatcgtttttagcacaaaaaaaattttgaaaatattttactgccctcaaaaacaccaaatttaagcatgaaatagggagtggtggcacaaattagttaatgaaggggccatttgggtacaaaagcgaacacacagaaagaaaaaaaagaaatgctagtgaagaaaacactttgttaaaaaaaacaatcattttaatggttattattaggattataaattatatgattttgcatatttttctgcaccaatttaatgcatcaataataaatgatggaagcagaatttgtaaatattaattaatgtaaaaaagaaaagaaaaatttttctaacccttgttgagcagcagtttttttggttacccgacatttgcggaccgacatttgcggatttttaaagccgacatttgcggacaaacacttttgcggatagaaacattttttttttcagttattaaacaccaaaaattaacaaaattttttatttaatttccctaatatcgattaacaaatcacgaattgtttaacaaataaacaactgtaagtatttcttttggagcgttgcgtacagcagcaaaactgacattccttcgatgtttttctttatgcgacttttgaaccattttcgccttaatcttttttatccaaccataaaggcaaatttcggttaaagatgtttttccggtaacgtcctccagataagcgaaaacagatcaggtttccgatcatttattgtgttgccccatgtgtattcaccgagttgaacggttatggggaagaatttgaaggctctacaataccgacttattaaaaaacagttttgatcgttgggatgattaaattcgaaaggaattaacattgattgagaaaatttttgttgataaaaaataatgaaaaaagctatccgcaaatgtcggtccgcaatataattcagccgaagaaaaaaaagaaattcagccatacagcggagcaaaacaaacaaaaatttcgcttcctaacctttttaaagtaaattagcgcaaaatgtccttaagtttaaaatcaaaatttgtagtgcgaacttatctttttttattttatcgatactatgacgaaaaatcaaaaaattatgggcctcaaaaaattgagatgcttccataaaattatcaaaaattttagttacctagcctaatacgaaaaaatactagaaaaattcaaaaagaaaatttcaaggaaattcaaggaaataaaatcgaccctgctctatccaatggtatataacacatatgcattttccgacttacagttcgggtggttcccttgttagattttcaaaaaagctaaaatacttttttttcttcaaattttttaattttttttgcggcgacgttatgtcccggcgacgttttgtcggcgatgttttgtcctgttccggagcccaccttaaatttttaactaaaaatatcttttttatgacttaaatttgttgaaaaacaggactgtggttacttttaaatagcttaattgaacattaaaaaagtatcacttaattttatagccgattttggcgtatccgccatcatgaagaacaacgagcgacgcgactcgttcatcggcacgccatattggatggcaccggaggtgatcatctgcgagacgttcaaggaccggccgtacgactgcagaggtcatcgtcgtctaatgtccttttttgggccactgttttccctattaaaaagggcacaaaaaactgtgcaaacactccaaattattaattaactttgtttaatagcgacagattttgcgtttgcgcaacgcgtggattgactagtcaatccgtgcacaaatctgaccaattcccacgagtcattggccttaaaccaaaaacatttcttattcttataattagttgccattaattaatgatattattatttggaccggaaacccctcactgattttgacaatatacagcactggttgaagcacacctgcttaattttaaattttttagctgacatttggtccctcggcatcacttgcattgaaatggcacagatggaacctcccaattacaatatgaatccaatgcgcgtggcgttcaaagtgcagaaatcagagcctccaaccctcgaacagccacacaaatggacgaccgaattcagcgactttctgcttaaatgtctcgtcaaaaaagtggacgaacggtggggcgcttcacaattgctaatggtcagtctttggaatgggaaaaggataaacagtttaatattttacctattgtaaacagtcataggaaggaaaatgttgtagcaccatcagatttttccgggtgcactacgttcccccccccccccggccacttatttgactctcgacactcatttctctttcgacttcaccactcatttctctctcgatttcatatgcttgatcagatttcataaacctgatgaaatgtaagcatctttgaattcaaaaccgatttaaaattattttccaaatttaggtgcgttaacattaaacatattttggtggtaatactattgtatatgaaaactgttttcggtcaagtacaaagattaccagttgatcagatttttattgctttaaattttcaaaaattttggttctcaaaaatagaagtgccaattaatatgtagcattgattgacttactttttcatgtcctttggcttgtatgttccctttttgaacagttccaacgccaacttaaaaaatcgataattgcgttgttttctattcattgtatttcttttattgagtctatttacattataataataccagctttttcttatcttgtttaatttttattttgcattttttgtttttacacccccccccccccaataaaaagaaagaaaccgaaaatttcagacatatattaattaacaaagcctgatgcgaggaaataacatgtaaatcagcgactccaacttttttttgttgcttttctcagcatatttgtagtttatctttgccttgttgtttctcacgatcgtctttgccttttttcaaatgcattttcgatctctttttttcgccacttcaaggtgtctaagtgtcaccctatttgcaggacggttccaccacgaatcgctcgagagcacgatctataattttttttttgatattttcaggtcgtagaaaaactggctttacacaccatcccgaaaatgagttatattttaattgaaaattgaccccctttgaattttattaaagccaattccgaatgcttaacctaactttcaaggaccaaaaattaaatttaaaaaagaattttcgattttgggttcgggacaaaattatatcagattcgtggtaagcgaccccgaaaaatccgggaacttttcacgaggtctttaaagcaatttgaatatccaatgaaaaaagaagctaaattctcatcattgactcaaattctaaccttatctgccagtatccatgcatcagctctgtccgaatgatgtccaattgaacgcccacaagacttcttccgttgcccgtcctcccatcgtcataagtaatttgcctttgagttcaggccgggtataccattttgttgtgaagtatgagcaatatccattgttcaaccgacccggcttcttccgaactttgagctaataaataggaaacaaaaattgaaatgatgtcattttttgtggacttgagacattttttgtgaatccaattaattccaaacttaaggaacggggaggggagtgggtccgacggtgcctataggcgccaaatacaatttttcctagtgtcgtcccatttttttaaagcgcaccaaaaaatgtgtaaaaactaaaaatgtcatcgttaaaattccagcctgattttttggggtaagaatttcgttaacaatggttatgaccgtttgtttattttcttccgacctcttaccatttcgaatgtgtcgctacaatcttttgttttccataatatccatccatgagtggcttcgtggacacaggtccttgcgcgggtcgattttcttccccttctcatccgcgcctttcaagactttcgtcaaatttgcgttcttgctgtcgccttttttgctgagcaattattcgtctattcattcattaagttgcttttgataataacctgaaattgcatgagtaaataatgatttttaaaaaatagcagaaggctaaaggttattatttctgacgatggaatgcaggcgccaagtcaggttttagggaataactccttttcgaattaaagttggtttagaggtttttacggttggagaacccgcgtcagatatccatttaggcaccga

SEQ ID NO: 976 - DNA, 2020 bp, Heterodera glycines
ggggggggggacttgttgtgccgacctggccaaccccaacatgttgatggtgcccacgatgttcgtcttcaacgtcttcacggggttgtacatataatgcgggggcgacgccggcgaggccaaatggtaaatttggtcaactgacaaagcattgaaaggaaaatgccaaaatcaaacggtgccttcgctgtagaaagggttgacgatgtcgtggtggaccaactcgaagttcgggtggccaacccatcgctccacgttccctttccttccggtgaagaaattgtccaacgctatcacctgttttggatgttgttgaaatgccaacaaacaattctcaactacagtaacaattgatttggtttttcaccgccaattagtctctgctaattgccctctaattgctcggcagattgtcttttctgctcatttcgtgccacccattcacttcgtgtccgtcggtcatcagccgatccaccaaatgcgagccgacaaagcccgccccgcccgtgatcagaatgcgcttccgttgcgcttcgtttcgctgtcgcacgggcggataattactgacaatttacgcacggttaattaatgaataaaatatattttaattaaattttgaatattattttcaattcctccgttaactcacatttttgtctgcaacactttggcgtcaatgctttgcatttgctcaattttttcctttagtcctttcacttctgtctttagcctttcgatttcactgccaaaaaatttctttccattaattttaaatttaatgaataattattttatattaattttaaagattgactgattaaatttgaaagagactctaaataaacataaagaaaacaaaataattttgtcccgccaccaggctgaaaagcaaaggttccggaaaaagttaataaatattaaattataatattaattaattttatttttaaaaatcggtttatctattttatatttcaatttacaaaaactgcaccttaaagccacggaacggctgccaccattagcagttaattggtcagtgattgaaaaattccgcgaattgagcaaaactaaaaatagcaaaattataggaaaaggagaatgaaaataaacttacaaataaaaattaaaaagacacaagaaaataatgaaaatgaaagaaacaaaaataaattcattcctgccgaaaatttttgtgagaaaataattaaaattcttcgaaataccaaaagtaaataaattctttccttggctaaatgttcatcgaatttctctctcttccaatggatttgaaatgccgtggagaaaagtgaaaattgacaattagtggcggcatttctgcagagacgaggttaaaattgttaacggaatggtattgatttagaaaattaattcattaaggatggttttattaattcggcacaacaaaaaagagaaacaatgccattaattcatggttttcgcctttaaaataatcggctaaatggaaatgacaacaaaaagtgctaaaatgtggtccaaaatcagcggaaattatccaatcggtggcgtcgaattgtgcttttacttcgtcgtttggctttcccattcgcttttggcatttttgctggcgaccaatgcctcgcggagtgtcggccattggctcgaccattggctggagccgagcaggtgccatttgctaatggggaataattggcgagaaatgccatcgcatgctttagctattcgcgcgcactaagaatggacaattcggacattgaactgaaattgttccgtcaatcacttccaaatgtgctgggggcttttgccataaattcgggttaatttggaactaattaattaatttgcaaatgccattcttcggcttatttgacgattttgcttgttgcagtggtctttcgcctcattcttcgccttggaatgtccaaaaatggtcgttcccttttgctcatttcggtttggtttgcgcttaatgcgtacctcgcgaggttcaaatgtttttttaactaattaatttttt

SEQ ID NO: 977 - DNA, 2716 bp, Heterodera glycines
  misc_feature (20)..(20): n is a, c, g, or t
  misc_feature (2543)..(2543): n is a, c, g, or t
atttgttcgtttggttgganattgaatcgagttatgcgctgataaaataaaaaaatataaaaaggcatttaccagtgtaattttgaaatagggcgcaaaaattacgccaattactatttggcgttttgagcaaatttgtctaaactggagcgtacccgcgggtggaatttcgggattcccggtctcgtccccggaatttttttttaccggtctcaagaaatcaacttcaccaaccatattaactcaattaatgcccattttatgtgtatttcttcccctcatgtatattccatcccctcgattttctgggcccacaacacagtcgcacaatcagttgcattgtcagactgatgttctctctggcgcatccagcggaggcagttcaactttgttggttgaatccacggcacactctcagcaacaccaaaaaagcagtgggtccaattccggcaatgagcagcaacatttgcggaagtaagtggattataaaaatgttgctaaagcagcagtcaaagaatctccttcaatccgtaggatgataatttgcccttttagatttacctctgccgtcggtaaactgggcaaagcgcgcgagacgcgtgaagcgatctcaaaagtgctgagttgtgccaacccttttggttggtcctttttatggggttaatttgctaaaagtggaaccaaatttaccaaatttggcattttcattattttcccccctttcctttaaagcgttccgtgccaattgctgagccgatagattatgaacattttgtgggtgagcacagtgcccagctcgaacatgacaaagaccgcgacatgttgctgtttttgcgcgatgatatttctgtaagtttccgtttgaagttctaaaatcgcttagagttctgtcgatttgtacattcatttcaatggcaaatgtattagttaattttttagggcgtcgaaatttggccacgcgaacgaacggcggtcccttcggttcgccactgtgacatcgatgaggccaattggctgttagccatggactccctccggcattactcatcgccgtacacaatgatcaatttaaactattctcgtttttatggcgacttcaaaaggttttacctaattctctcgaagatgcaatgtttacaataaatattttcgatttgatcctccgcttgggctgaactttctgcgttttgaatccgatttaatcgctgatgaggagaaattggttgttctttttgctatttccatccattatctcattttcagctgttgtccggtcagtccgcttccttcgccactcagccggacattctcaaggagggcaatttgattgttgtgccaggcgatggaattgtggacacttttcgagtaaataagtttttttttgaaacgaattttcattggtaaaacagagcgagaagaaacgctattgcctgctgagaaagtcggcggaggagtcacgcgtgttcattgaagtgtacaaacaagcattggcacaaccacagcaccaacagcaaatgccgaccatggaaatggaagtcaaagcggcggccattaaaagcacgaaaaagggaaagcttcttcaggtgcagtcattggactaacttattcgaaataaaaaatgatttttatagttattctcctcaaccgagtccgataaacgagcattgcttctttcggctgaaagtgagacggaattgcaattttggctcttctcaattgaacgagcattggcatggaataacagaggtggaaaaacgcttttcattgtccattttccaaatatttccaatttaagagatgatgcttgctcctgaagaggataatttgtcgttgaattcgtcgggccgtgacaattcctttccgccgtgcctttcctcactaaacgattcggaaagtctggcgagcgaagacagtggaggcagtgagtgttaatggataacgtttgccttgtttttagttcctacctctttttttaggtcgtgaattttccacggctttctggcgaagtcgaaatgcggcagccaaagctttgcaaccgccaattgtggagcggcgcaatattttttcgcttttttgggacatggaagtgtgatttgataaaaaatctttttattttaaatcatttttgtaaaagaaaaatttagcctttgccagaaggggagggagaaaagagtacgttgggtgaacaactgagtgaaacagaacagtgcaacgtggagcgaatatcaccaattccgagcagttcagcgacgacgactagtttggtgttacggccaaattttggtggcaaaagaacgacgtcccatgagccatcctcttttgatgaggaaacaaagggacaacttgcagtcagagaggacagccaatgcttggagccatcgaaatctgaatttgcgggtgaaaagccggccattctgttcacggctcagcttagacaattggacattcgaattcgtatggccggaaaagaacacgccgaacaggtgaattcaaatgccatcatcactttcatgagcggtagtagatccttgtcattttctttntaagatcgagcctttcttcgcccgtttgtttctcttcgattccagccttggtgtccgtgtatcggaggaattccatgtcgctttttcgtcacttcactacgatatgcttcacaaaatggacatgccaaccttgttaaattcccccaactctgctccctcctcttcttttgcac

SEQ ID NO: 978 - DNA, 4284 bp, Heterodera glycines
cagtgagtgatgatggaaaacatttgccctgtttttagttcctacttcattttttaggtcgcgacttttccacggctttctggcgaagtcgaaatgcggcagccaaagctttgcagccgccaattgtggagcggcgcaatattttttcgctcttttgggacatggaggtgtgttttgagaaattattatttcgtaaaagaaaaatttagcctttaccagaaggggagggagaaaagagtacgttgggtgaacaactgagtgaaacagaacagtgtaacgtggagcgaatatcgccaattccgagcagttcagcgacgacgactaatttggtgtcacggccaaatttttgcggcaaaagaacgacgtctcatgaggcatcctcttttgatgaggaaacgaagggacaacatgcagtcagagaggacagccaatgcttggagccatcgaagtccgaatttgcgggtgaaaagccggccattctgttcacggctcagcttagacaattggacattcgaattcgtatggccggaaaagaacacgccgaacaggtgaattcaaatgccatcatcactttcatgagcggtagtagatccttgtcattttcttttgaagatcgagcctttcttcgcccgtttgtttctcttcgattccagccttggtgtccgtgtatcggaggaattccatgtcgcttttccgtcacttcactacgatatgcttcaacaaaatggacatgccaaccttgttaaattcgccaactctgctccctcctcttcctttgcacttaacggtgttttggccactgagaaagtcaatggagtcagcttggaacagattcggaatgccaataaagtgatattaatttgtaattatttttacattttggcattgaaatgttcagcttatttgctcaatacacaaccctcgtgctgatttgtttttggtcgttttggtggagcgaatattgtcggacgtgtcagccgacatttacatgaaggctaataatgcaactgacaataaatattcgtctaaaattcaaaaatcgctgtccgcatcaattccgaaacttggccatcttcgaacgttgttcgcatggaccgcgaggcaatttattataaattttttgattttcttggttctttctctaattttaggcctgtctttccgtctttgtgctcaggcagtgtctttgcttctcaacagttggcgatgagcagcaccaacaattgtggtagcctttgcgatggctctaagaagtcctcgttggccacgtgttcgctgtacaaatgcgacagcggtcgactcactgacggcgatttacagaaattgttgatagaaatgcaaaaggccgacaaattggccaaattggtggtcttcccaagcgcctctttggttctcgaaacagacgtcacttccgtcctctgcgaatttccaagtcgtcccaacttacaataatttttgttgcttattcaattggtttaagtgcgtatttcgccctcttttttgccacttcgtccctggaaatgcattccgacttcgcctgataaaccgtccgctttgccttcgtctgagctccaatcatttcttgaccaatcgctttgttctgaaccacaccgtggccgtgttaaccttctctatgtaacttttgtcattttcagaataattatttatgtggaacaatcattgcttaaggtgtacccactttcgttgaattattcaacccaaaagacattctcccgcgcccgcaacatttcctgcacagtacattatgtgccttcgtctctcgtcagaacgacgcaatttgctcacggaagggtcccttgccatgctaacattttccaccgtacacatccaaacggaccttttgttgactcatttgtttgtggtgtccaataccatgagcaaagtccgcaatttaacgcggaagtaaaaatggatctgccggtggcgttgggagaggacgaccatattctgttcacatttcatcatgtttcaatttcgaatgccatcaccaacaaaaataaacctttcactgaggtgggtgggtatttttggatatcgtcaagagtatttttcgctgtcattattatatgccgtatttatagcacaacattgagactccggtgggttatgcatggcttccgatggtcaaaacggattctcgtggccttcctcacttcgtcatgtctgacaaaagtcaggagtttgaacttccagtaactgccaacttgtcttcaaaatactacgaatttaagccattgtcctcttctggcacgagagaggtgagtcatttaacaaatatttgtttcaatttataaccgacaggtgtcccccaattttgatctcaaatttgttgaatatggtcgtcctctattccgcgttcgacttcgactcgtttcgtcagtgttcaccaccgatgaacgccttcaaaacttttttcaattgtgtcacctgatttatccgaacataacccagtccaaccggaaccctttgacgcaactacccaattcttcatcgaatcgtaacttcaaacattcatccaatatgaatttctatgccaacaacgcctccaaaaatggatgctctgcttctgatatccaagacgacagtttgtccccaccgcattttgctattgaacgtgatttggttgaatcaattgaggtagcttcatactttcttacaattatatattcggatagaaatatctcctagttttcaatttagagtgatgatacaaaaaagtttctttgtttagaaactgtcatcaattgaccttgaccagctgattcctttcttggcggttatcttcgaccgtctttttaatttacttaccttttcaaaggccgaagacgtaatgcttagttctttgaagtgggccctaataatttgaaattttcatggaaataaataaatttcagtgccattatttatttggctgatcaactgtttatgcatcgaaaatcgaagagagaacttttacgaaattatgtcctattgttcttcaagtgccaaggtccgcaacgcaaatgcgatgccgacggtgaagaatcgacccatggcgcaatttgcaaatgcattcctctgatggtatacactgaaaagcgagtgagaaaataataattgtttgtcaattttcagatccacagagcacaaagcagcaaagatgggacgataagcatcacaaaattgcttcgtcagctgtggtttttgttggattgtgcggccaaatcgatggcacattggctcatcattcataatttgttgaaagtgccgaggcggaaccgatttcccaccgatttgtatttttcgctggaagagctctttcacacaatcacggaacgaatcattttcatgcaaagggagtgcccccgtgaaagtcggatggccaataatgcacttggcaactttttaaaggtgcaagcaaaacagagaaaagggaaaattcctttggcaataaattgcttaccgtttcatttcagcactgtttaagtttgatggacagataccaaataatgaaggaactgtatacagtggtcaagaaaatggacacaatcgaaaccagggtaagccaagttggaaaggattaaccaattttaaaaggttttaagtcgtttcgtgtttacaaattcgaactgcttcaaattttggctggtcatgaacattggctcccgctttgcttgccattgttgactgacaaatttggcattatattgcgtggagatagctttcgggtggaaggttttctaaaaatgacgaatgcgttaggctcatttaatgacaaattaaggctcctcttcgacccaaacgcaacagcaaacgacgaagcacaatggggggaccagtttattggccaaactgttctctcaaatcttttcaccatttcacggaataatttcagaatcgaatgaagtggagaaatgtgagaacaaacataactctgtttaaagtaattgtttaatcatttacagtttcatcatattccgagcatttctacttgagcaaaacctattgctccgtgcactttcccatcggacttcttctccaagaattgtcgacttctctgcgcgactcgagagactatcgtcgtaaagtgattcagttgctacgcaatttgcttgccaaacacagccaggacgaacgctatggcgacacggtattacttacaaataaaaaaaattattcactgaaagaagtttgaaattctcttttttaagtcagcccgaaatcgaattgcgattttgaccatgccattgttgaggatcgcaattgaaaacatcaaagaaattg

SEQ ID NO: 979 - DNA, 2748 bp, Heterodera glycines
agaggttaaaacatatggtggaagcattgaacaaagcgaaagccaatcctttcagcaatggctatgtttggacgaatggcaccattaacgcaaataataccggcaaaagtaacaacgagcaacaacaacgctcttcggacaaattcaatcgggccaaacgggagcactcgttacgagttgtactagcaggagagaatggacaaggtccttcccaaaaagaggaattactttgaattattagttaaattatttggattaaatatcataattttaatcattttaataaaatacatcgaataaacgccaaatctgaatggacaacgccaactatttttgattttaatttttacataatttcttatttcttaagaacgaagttcgcgacttgatgctttgcgtcctttacacgctgaacattcttccgaagaaaatattagcagccttttggaatgtccaagaagccattcagccaaccaaaacaatgccaagttgcgacgattcggtcacggaattgcctaagcaaccccaacaaaatgtccttgtcgactttgtccgtattttggaactttcgcttttgctgtttcgctacagagggcgaacgcaccacttaatgttacaagcaaaaaggtaaatatgacataattcgacagaattttcaaactttatttaaagaaacaaagcgacaaacccgaacaaaacgcccgaacttctgctgaagttcgatgggtcgaattcgtacgtaatgagcagcaaattttccacactgactgatataaattttggaggtaagcacttaaatttaatcatttaattctttgccagtagaaagtttcgactcgagaggagtggtggacgaagaaggcaaaggcggcgaggcgacaagttttttgatggactgtaatttggcgcaagaagtcgcgctgattgtgttggagactatccaaacaatagccaaccaaattgccgtatttttttgccattttcaaatttaccctttcattgttcaattcaggcaaagacgcgttacacctccaccagcagtttggatgtcatttttgttcgtcttcttcacttacagctcgaattgctcaacgaatattggcccgaaactgtccgacttcacactctctctgcgctcgctgtgtttgtcaatttggttggtcctcctaatttattttaataaaaaattaaacataccttttttggttccgtacagttttccgcccatttccttaactctggtccattggattgtctgtccactttgatcaaagcgctgcttctccagttgaatagccgtatcgtccgtattcaacatgcaactgccgctttgttacatttaatccttcggtccggatacgatctcgctttaaattcttccgtttgtatgtttttccttattagtatttttaattaaatatgaatttaatgacaaattattcgttttttagccaaattcccctccgacttctcttccatgtccgctcctgatggatcgaagaattcctcgctcactgaacgactcggccgacccggggctcaaatcgcgccggtgttggctcgtcttctgagcgaaaaggccgttttcttgaatagtttccgtttcgagcgaggtctgtccgctttggaatcgcttattggctgtgggtcggcgacaaaaagcggtgccaaaggtgcggcttcttctgcacttgtgctcacctctctctttgacaaggctgtcttggtactactgcttaatgcctaacgcgaacattacaaacaaatgattatgctaattcttacaattaggaattggtgaaacaacttcgtggtgtgctcgaggcaacgcaggcaatttcggacacgattaatgacccggtcagcggtgatcatctttctttttgttttcatttatttcttcagattcaattggccgaccttcatatccaattggcaaatagtttccgtggttcggctgcacttcgggcagaatttttcgacgcattggctgcacaacacattgccggaggttttattatgcgccgacatttcatatttctcactccgtcgtctcctctctcttttagcttggtactcggaagcagctgtgtgtcaagcccattcgctggtgatcatcggaaaggaactgcaaagtcggggactgtttcgacccgattggacactgttgagtgtgctcagtgagagaattactgctactgagggggtcaacgagagcggtctgatgagcagcactcagcaaggcggattcacattggtacaatacctatttggtactgttttggttgaacggacagagaaactcatttcaggaggaatttacccgaaaagttgaagcgttagtccgcgttttattactttccgaacggtatgaagccgttggaccaatatgtcggttggccattcccatctttgagcagaacaatgattttaaagttcaacgtcatggtatttcgaaaaattaaaagttttttctttcaggcattggtgggaatttacgcagaaattcaacaggcgtgttcaagagcggcggagatcaaaatcagcggaaaaaggcacttgggcacctatttcaaagtgacattctacggcaattcgcactttgggttctcattcataatccattccgattcatacactttgaaatctaatatacagcactgaacatctcaccgaatggagatgtcgtgagaccgaactggcgtctatgagggaagcatgcggccggatggtgcaaaccggacgcga

SEQ ID NO: 980 - DNA, 2287 bp, Heterodera glycines
agtgaagcggacgatcccactacagcatacgtcaaagtggcacatgttgaaccatgccgaagaccgaccgaactgaacaacaacaacaacgccataatgccaacaaagggtggcagagagaaggaacaacgagtcgcttcaatgaacaatggcagagcaagcgagcgaccgatggacgaattgaaagaggacaatgaccctatgggttacaacctgcacaccaacatcagcacgttcattcaagaagagcgactggtggaccatgaagtgcccgaaaatgcgcctgaattggcaaggactgcactccgtcgactgactttgactggtctgactcacagcagccgaaaaacatattcctaacctttttaagtgggaaactctttccctgacacgcgccgacgccaaaggattgtgaagactgaagaagctgtgcttaatccgttggaattggcctgtgaatgtctgctcttcaaaactgctcaaattcggcacattctttcggcagcggaaatcccccgagggttccattgtcacatcggcgctactgtggacaaaaatgcactgaaaagactggacttgaagaagttgcaactgtttttgcagggttcagtcagtccatctgtcagtttgttttagtttttaatacttttaaaatttcattttcccatttttaggtcaatgctggattgttggcttatgccgaaacgtttaccgcctcagcccaaagacatcgctatggaaaagacggcatttgtcgattggcaaccgctctgaagtgattttatttcgccatttaaactatacacaaatgcatcattaggactttgatctatgagttgaacgaagcacttgcggtcaatgaggcggcaatgggcagcgaacggacagagtaccagcaaatgttgagacgatcttttgacgggatgctggagagattgccgacattttttgatggcgaaaaagtgcgtttgaatgaacatgacgtaaatgtgccatttcgaaagctgaagttgcacagattttggcaccgggcatttcttttttgttaattaattcttttcattctttcacttactaaacgaatataggtaaattgtttagtttcttcccgacgtgacaagtcaagacggaaaagccgcacttggaggtgccaattctcagctggtgaacggagtgctcgaccgactcagccaaatcggcggaatggcggcagaaatgcacattttcgactcaatcagcggacttagcgaataaataacggcggagaacacagaaaaatgattagagtatttatcctctgttagtttttgaaagtgattttgtactttctgtttcaccttttgcctcacaatcaacttataatttttgtgctttcatcgatctcaacatcattttttgtgatttattatattttttcctcgtccgttcgtcaacagagttagtcaaattgcttacattatttgtaattgtctactgctttttgtataaattttttgaattttttgaaatggaattgtacggaagtgactgataattgggacatttttgtccaaaaatagtcatttcacaatttgttgtctaaatggtttactgcttaagtgatatgttttcttttaatttgctttattcatttttattttaaattgcttttcaaatgtctctttctccatttgtctttttcttcgtccctttctttacgcttgcgttttcgcctgtctttgtcccattgtctgctgttgttgtgccgtcgtttccgcgtgtttcatgccacgggcggcgcgtgccttcgccgctttcaactgaaggaccatcgactgccccgggtaacttccgccggaggcgccgccgctctcagtggcgccgccaccgctgggtggcacttccgccgcggcactccctccgctcggtcctccgcccggcccgtagccgccgcttgtgcctccgcctcccccgcttactcctccgctttcgcttggaacgccaccgccagacgagccgcggttaggacaagggcaactgacaaataatagtggggatgatgcttttgttcgcctcccctctccccgttttactatttgccatctccgccagaagtgccggcttgtccatctccgccgggctgtccgtcgcctccggggggaccgggcggtccaggaggaccaccggggccaggagggccgggaggaggggctccaccgccctggccgggctgtccaggttgaacgggttggcctgatgggccgctatgacacttctggtcgtgttaaacaaaaacacttttcaacaa

SEQ ID NO: 981 - DNA, 5410 bp, Heterodera glycines
  misc_feature (5318)..(5318): n is a, c, g, or t
  misc_feature (5338)..(5338): n is a, c, g, or t
  misc_feature (5358)..(5358): n is a, c, g, or t
  misc_feature (5361)..(5361): n is a, c, g, or t
  misc_feature (5386)..(5386): n is a, c, g, or t
cgacgaagacgacctcctccatatccgacttgacctccacttcctcccgaaactgctccaccgccgcctccggtgcacgtgcccgggttgccgggcggaccgggtggtccggaaccccctgggggtccgggcggtcccgaatctccgggcggacctggtgggcctgcataatttatattttacaattatttaacacaaccatgccatccaattgacctggttgtccaccacctccgccattgccgttctgtcctggttctccgtccgatccgggcggtccagaacctccaggcggacccgctggcccaggcggtccgccagggcaagcaggacatgagccgccggctgggcatggagttcctggtcctccgttctctccaggtcctcctggttgacccggtgacccgggtggtccagcagctccgggctgtccaggcgggccaggtggaccggccgggcatgcggtagcgccccctcccgaagttccagctcgggcgtaccctccaccaccgccgccacctcctccttttttcgctccgccgcctccgcttgcgtatccgctcccgccacctcctcccgagcttcccccgctcgcgtatccgctcccgccgcctccgccgccgccgcttcccccggcagcgtaagagcgtcgttcacggatcatctcggcgaagtcacggccaaatgccgcggcttgtgctttgccaccgaccatttggacttggaccgcctgcatttgggaccaggcgtcgttggcgagcactttgaactcgcccaaatcctcgatgatctcgtcgtacatattgttgatgtcctcaaagagcaaaatattcattttataatgaaatcggctcaaaattcactctgaagagaaggccaatcgttgccagcgaaacgacgaccatcgacgccgtaacggcagacaccaatcggaccatcagctgtttggcttccatcattttgcgactgtgactggagacagtttgttccagttgacgcgcttcagcgcattgctctcccttttatattcttttgatcattagcggaacgacgggcgacgagcgaagaaaagccacgggggggggggggaatttacaacgaatggccaattaatcaatcacacccaatcatttgctgctaattgcaatttaagcatagtatgatagaaaagaaaatgacttattaattaacagcaaaaccgaaaagtaatggaaccgccgctaatgagacattataggacaaaaagggaagagggggaaaatcgaagcaatgcgaattagctggcgaatgattgaaggacaacccatcagatgagcaaagaaagggaaacggagtggaactgataaagggacgaaaagggaagggaacggggacagactgatcaatccgcaaaatgatcagaacaaagggaaagggacaaaacggagggaattcagaagaatttatacaaaaaaaaaatgacagaaaaaggggagggacagcaacagaaagggacaataggacggaatcaatggtttatccttccaaactcttcttcatccttccaaactcttctcttcttcatccttccaaactcttctcttcttcatccttccaaactcttctcttcttcatccttccaaactcttctcttcttcatccttccaaactcttctcttcttcatccttccaaactcttctcttcttcatccttccaaactcttctcttcttcatccttccaaactcttctcttcttcatccttccaaactcttctcttcttcatccttccaaactcttctcttcttcatccttccaaactcttctcttcttcatccttccaaactcctctttttcccctttcattgaccttgcgccgccgacaccaccttttggcgttggtagtgcaaagtgatgtccatcgtcgctttcatccgtccgtccggactcttttcgtagtgaacgcgcgggtccaggcttgaaacttcctaagacaaaagcattttgtagaaagaaacgacctccaataagacaaaggcgagactgaactgtctcgggatcaacaatccatcaacggcatggccatgggcaaccatccgtctccccccccccccccggtctctcccccgcccctaacatttccattcggcatggactgttccaacagcaacacttttgattgttgcttttctttctgctgatctttttgctgttcatcgcctccgaccaaatttccgttttgttttgactcatttggcagctcccatttggctgtgccttcgtcgactttttgtccttcgtcggccatttcgatttcgtcgtcgacaaaatgccgcgtcattaccaagacgtacagaacacagcccgaggcgaaaaacagcagacacgagccaaaaacgacccatttggaagacaatttggaggacattttaatttttgtaaaaagaaaaaaacacttagaaattgagtttaaaataaaggaaaagtaaaaaggaagaaatgagaaaattagagaaataaaatgaaaaaggaaatttggaaggcaaagtgggcgagatgagaagaagcattggtggaattgccaacgcggcaaatgccaataatttgacagccaaaagaatggggcaaagaaaaaagagtgaaaggggagagaaatgaaagtgaatgaagagtgatcgaagatgtcatcaaattacgaataattatttatttattatacataaatcaatttattgtgacaattttttaccgtttattacaatttaggtgattgaataaaatttatttttttctggggatgccgtctttacgaaagcagatcgatcgagtagagaaatttcgcgcattttggcatttctttgtctttggcattggattggcattggtccctctctccgtccttttttcattgacaatcgccccacatttcctctgcttcgtcctcctcgtcttctttgactttttcttttttcgtttcttccgtcgtcggattctcttcatttaaatttccgttcacaaacttttcgatggcatttttgtggaaagtgacatttgtgaattccttaacaatcaaatgaccaccatttgccattttcgcctcttttgcctgcatcagaggcttctctaagccttgttggagctgcaaacagtcgccacccgacgaaagaacgcccaaaataaaccaccgccggcgcccttttccgtcctcaaaattgccgaccaaacccccgccactgtccccctgagaatgggaagcaaaacatttaattcttttttaattaatcccccttcccctgttaattgcccccttcctttaatttatccccttttatctccctttatcccccccccccccgcctttcggctcttgttttgagtccatttgtctcccaccagacacgtgtccctgcttttctcttccaccgtgcacagtttgtcctccgaaaggctcagtccgtcctcctccgacagtttggcccttttccgtgcgcatttttcgtgcctccaaatgttcggcactttcaacatttgcagcttcggataggcctttccgtattggctgggtttctgtttgtccgctgaatatcgttaattgcccttaattgcccaattaaattcccacgtgcgcttccccatcccgtcactcggagtgcctcagtccgattggcacgcatcgattgtctccaataaaagtcgtcttggaaaccgtgcatgaaaggaaggcactgaacaaaggcacagttgggccatgggttggccattgcactctctcacaatgtgattggccaagggggcgggcacggcaccgcccaattcgccgtccaaatccaattcgagaacgatcaaatcgtccgaaatgcacaacaaattttattcgaaattaaattgttttttcatttattaccacttgcgcattttttcttgcaaaatgccgattccatggcactgaatgtttttttgggttttatttatttattcatttttaattttggcactttttgactcggaatttccgctgcgttttcggcgactcacacggcgtttccttttgctccgaaaggcaaatggacccaatgtaaacggaaatctgttctcggatttgctggacgctcaaaaagcccttcggttgcctttcaaaatgccaattttagccaatttaatcggaatgatccgaaaagtgccacccaccggcacaagtcatcggttttagcctcatccgcacttttaaattcttcggaaaaacaaattttgttgacgcttcctccgaacatacaatgcgcggccgttacgacgtgccgtttggaaattaaagtgccggaacaaatgtaagtggctgaaaagcaaggccaaatgatggcatattctggttaaatttaataaatatcgaatacgaaatgtctttttaattcgttaatttatgaaaatttgttttgaaattcatttccatttgcctccctttgtctttcttttgacgaaagattgccgccgtccatggcgaaatgccctcctcaacattctctccccccattattctgaaggaaaactcttcgccgcccgtcggaaagaaacgtttggcattttgcaattgcttttcatccgtttcgactttgaggaaaagcccacaacggagggaatctgcgcaaaagcaaagcgaacgatggaaatgccaaaagaaagagacaaaacaaaactaatgaaaatgccaatgagtatttgcggaaggattttaaatatttggcaaatgctccgactttggcataccgtaaacatttgagtcggtccattccttcggcgcgtgccatccgttgccattggcatggccatttccgacttggaaagggagaacattaaagtaaatttaaagggcaatttaccacttatcaaaagcagaaaaatgtaaaaataaatgcgaaaaacgctgagaaaatcggacgacattcgaaaaaaaggaaaaaaaaagaattattggtaattttgggaaaaactaaataatttaattacttaaaatatttattttgtcaaaagcacttttattaatataattttttaaatatctaatggagaagaagacaaaatgattttgctgtgctttttccaatggaatgattcataaaaatggaaattacccgacaaatcgttgtgttttgttaatttaaatatgaataattaatttatcgatagaaatataaatgcgaacacaaattattttaataatttttaagtatattaaaattgaatttgtttaaggtaaagctttgctaaaaaagagccgactttacaaaattcaaacatttgtcagcaaaagaaagacaaaccaaatcgactctgatggccaagctntgaaagcattgttataatanatttaacttatgttttttanatntaatggtcgtcaaaatctccgtatntttaaaaataattagtcattattt

SEQ ID NO: 982 - DNA, 4099 bp, Heterodera glycines
ctttttttttttttcaaatcattttttttttgcgcggcgctctttttctaaagacttaggagaaaggggcccggcggtgccaataggcgccgccggaaaaatttttgaaaatttggatggttctgttaacagattttgtccaaaaaatgataaattttttcggttttgagccaaatttttttaagaaaaaattggttttttgagggccggcgatgccgataggcagcgccgtggcgaattttgaaatttaaggtctatttctaatagtttttcaccaaaaatttattaatttccgtgaaatttttattttattttttatattttgtaaaaaagattttgaaaaatattaactttttatgatttagtcaaggaaaattaaattttttaatttcaacgaaaggaagattggatttaatttgtcaataaattatgccaatgatgaccaatttttatgggatttttgtttaaaaaaccatattacctaatcacaaaaaaataaattaaaataataacgtcaaccggtttcgaactatgacagaaagtatttaagtgtgatgcacttacccactacacttccccggattagtcgtccccgctctttccccggtttgaccggggctccccccccccccccccccgactgcaatcaaatcgataccagagaaaaaagttttcacattgtttgccacaagtatgaatttatttctattcctatcaaaaattctaaaactcaaaaattccaaaaaaaaaccacaagtactcatttgaaaatttagccattttcagacctaaaagggaataaaatgaggctaaagcatatgctaatcctaaccaataaattttatcatctgctcaaaaaatcttaattaattaagcttcaacattggaacaaatctgcgcaaattttccattgtttttggtgactttcacaatggttcattcacgacgctttcgcccgccgttggtactggattttagcaattatatttttagttttttatttgaaaaattaaaaatttttgaatattaattatttgggataaattttgcgtaaaacaaatctttttccccaatttttgatagaaaagaataagaaagtaaatttaaaaaattatatactggattttatcgtggtgcgacatttgctggcgaatatttgtggattaaactgtctaacaaaggaaggtcctatggtgtcagtgggatttccgaatttgaaacttggtgggtgtgtaaagcacccatggattcttaataaaaaaaaatatccgagaaattatattattccaaaatataaaaagacaaatttgcaattataattttattttttcaggtttttagtacgaatatttgacaagaattctcataactaataccgtatataatttaataaaatagcagaataatattaaactttaaaaaataatttattttattcatttgccaaagttagtattcaaaaaaaaattcattcaaaatggaaatctttatttttgttaagacgttttattaagatacgttaatgtcgacacatggaaaagattttttagtgttaaacacttttctttggagtattgaaattttttgaaaattcattaataaactatcttatttaacaatttaatccgcaaaagtcgatctgcaaatgtagaataataaatgttagtattagggcaaatacggcatgcaaaataaacaaaaccatcacatgccaaaaaaagattaaaactctctataacattaaatcgcaatttaaaaaaaataaattaatataattttaatttattttattcccctacgtttattcatataaataaaccataattcttttggtttagctcaatcgcatctgtcatcggaacagcatcagcttcaaaccgatttcttggaccaccagctccaaaacggcgcatttttggccgattttgccggactttggctactcggtttggacattgtgccaatgattaaggacagcagccagcaacaaaatgtcaagctgtacattcacagcggctgtaattgctccatggtaaggaatttcaatcacttttattaatttggatgtttttacaatgattaatttgtatgacattagttaattagctgtttcgttccattattttttaattggtgcacctttcagttcatcaaatcgcttaatcctcatgggccattcactatggtgattgtggaaaagcaatgcccatcattaccgattgatcaggctttttcggttggccccactgatcgcccatcattaccaattgaccagactttttcgattggccacactgatcgcgtgccaatttccgtctcattcacagcattgactgatgccaacatcaatagcatggcggtggaactgctaattgcctccgatggtggggcacatgaggatttatggaaatagtgattaatttggaatgattttattatttccttagatggaaataatcggcaaataattagatttgacattggcacggacagcgatttgacagttcatttggcatcaggggtaattaaaattgcaaagctaatgctgttaatttgggaatttaattgattttttagatgaaaaatgagtttatcagcaaacacacgcgactggccaagggatcatatgaattgaaagtggaaattgagctccatccgtattattatgtgatcataatgaacggcaccaaaatgggcataaagtattggcccaaacaatggtggaacgaattccaatggctcggtgtcaatcagattaaggtgttgcttatttttaaaatattctatttttatttaactaaattttttgatttgcatttgatgaagaaccactttttttgttttaaatttttttattattttttttcactaatgctaatgcgagaattatttgctgttattaatttgtcaatactttctggtgtatatcagggatggcacggaattccgacttaaaaaagcccggaaatttcggaatttctttttcaggtcggagttccatttgtggaaaaattttgggcctcggaatcccgaaagtttttggggcctcagaatgccataccgaatatgcgtggaaccaaaggcattttccaatccgtgcaaatttcgactgagctttgggcaaaatcactggaacaattctttacattttaaggtacatggcccaatgaagatgacccaggcacccgttgtgaggcaatttgtgaatacaattgaggtaattaaattaatcaattcaaaaatatttgggcattttgaatgaattgtacgggaccgggaattttgacaaaagccgggaccgggacttttcgggttgaaaaagctgggctttatgctgggaaacccgggacttaggtattcagttgtacgtttttttcagtactagtcccggtctggtataactctaattttgaatatcatttggtggggaactactgtatgctcgggccattaaatggataccgcacattccaaaaaattattaatttaatcaaattacgacttttcaacttaaacattattttttacagtcgccagataagcgtccaattattctcgcgtggaataacttttttatttggagcattttcgattttgtcgatttacaattcggcgacaaaaactgttcatacagttgtgtgtacacggaggacataagcttgtaagcagattaaaaataaatgatttttttagaaaatttggaaaaagagaaaatattaaaaaattttgtcttaaaaattaaaaatataaatcaatttttctgcgtcgtctgtcgcatcgaagggcccgttaattccataatttcctaaaaattaactcaaaatcgcagatttgggttttgtagaaatgcttttttaattatttctcaattaaaatacagtgaaaaagaggcctttgttgtggtgtggcacactggcgaccaattgagagatttgcctcaacatcgtcgtgctgagcaggtggaaattaattttttggccataaaaaataatattttgccttcatttagctgtatgttatgatgtcccatgaggtaattaatgtaattataattaaggattttcggataaatggacaatcaatggatcaatggaaaaaa

SEQ ID NO: 983 - DNA, 3331 bp, Heterodera glycines
ccagatcggacgggatggcgtgctttcaacgtggtatggtcgtaagcgatagggctccatttgaaaacaattaaatagtcaattttataatgcattttcttctctttggttaatcttcaaataatctgccaatgctttcacactgttaaagtcgtccaccgcaataaaagtgccgttcggaatgcccacttcttccatcacttttcgactcaacacaattggcaccatcaaatttcgtaatgccttccaaaatttttcagtcacatattccgtgcagacggcattttcgaaagccaaataaaaaaagtgggactctgaaaatggggggagggcaatcgatcaaattttattgtgtgcgtaattaatccttggatacaaggagatagctttaagtttctctagaaaaaaatataattttaaaaattaatgttacaataaaaaattctaaatcgagaatttcagattttaagacaatagctttttataacttaatgaatttaaaatttatgagttaacaaaggaaaccacaaagctatcgaggtactaacaaaggaaggtccccgggtgtccgtggggtttccgaatgaaaatttggtgggtagatacagtacctatggattcataagaaaagtgttttttatttcttctaaataagcatgaatgccgagttatgtgactgacaaagttttgtaaaaacaaataaattaaattatttttttacatggtgacaaaataagtaatgtcccattttaatgtaaaaaaccaattttaatctttttattagagaccgagatttccaattctgccggaccggaccggattggcattttcaaaaacaaccggattcgggatccggtctctcataatccggtcaatccggtaatccggtcaatccctatttttcaaatagccggatccgtaaccggattccgtattggtaaaaatttagatttcaatgttaatttagggaaaaaacccgcaaaatttcatcaattatatgtaaaattcgtgcaccagaaaatgtcgccatggaaaaaacaatgcgccgaaaaaataaaaataaaatttcaagaaaaaatttaaaaaaatttaaagttttttatttttgaaaacctatgtttaatggaaaaataataagaatgtttttttgcggcgcccttatcacaaaaaaaaacttcggtaatggggccggcggtgccgacaggcgccgccgggaaaatttttgaaaatttgatgcaatttgttatctgattttcaccaaaaatgaccattttttgcttttttgggccaattttttaaaaagaaaaaaattttggaggcccgccggcggtgccgataggctccgccgggggaaaaatttgaaaatttgaccatttaaagttaaagacattatggctaaaagatatttttcaaagaaaaatgaacaaaagtgaaggattttgagttgagacagagcaggaccggatccggtcatgaattcgccggaccggaccggattggcattttcaaaaacaaccggattcgggatccggtctctcataatccggtcaatctatgtaatccggtcaatccctatttttacaaaaaattgccggacctgattcctgatccaggaaaatccggtaccggatccggtccggctcggtctctagaaaaaatacccttttttaattttcaaataaaatattatttgctagaaaattgtgtaaaaattcttttcaataaaatttacaaaaattaaactaacaaagatttttcaaattactagcaaaaaatattcgattttttgagcaaaatttccatttttataaaagaaaaaaattgtatgtacgagttgcatttgtacgagttgtcaggatgccaaaccaaaggagagtcgagaaatttttcggttttatttggtcttgattttcgggcaatttttgattaatagcagccaatcgccttttctttggctatgcctttttacgacacattaattaattgcaccaattaattcattaattaactaattttctttcccaaaaaacagagccctctccttggcagtgcgaatttcgaaaaaataccatataatttcttcaacatttctatcacttatcgaagtgatagtgccattcacattccgtacgatgcgttggcaccggtcactgctcaaacgttgccccaatacatttggaccgaagcggaggtggtcaatttccctcaatttaatgtccagcagaaaatgcgtcagcgataccgtattcctagcagaacatacagtaacaaaccggaacattgtttttaagtatttatagaggatcacagacgtattttctgagagaaatcacttttatcttacgctaatatgcatgattgataattttaagtagcagaaaaatagcgggttcagaagaacagagttcgagtctcagtttcaaatgggttcagcaagtaccgggtcgaatcgagaattgaaaaagccaaaatttcacttcaaaataattttttttcatagatttatgcttctttttaccaaaattatttcacaaataaacagtttcaataattcgaatccatatcccccacacttaccagtgagtttttgggtccggacaaaacgcgtcgaatacctggtattggattttccaaatgaaaaagccagctgtccgagtatgggcccggtcgggtacccggacccagtctaggctaatgaaaattaaaaacaaaaagaaacttaaattaataaaattgacagaatttaattatttataattttttgaagttttcttgttataacttttttgaatcataacgaaattctttgaaattttgcagctaaaagatgactctcttagggctttcacaataatgccaagaatctttaatttgggtatagagccaaactgattaatgtcatttatttctcaaaaatcgcagattcaaaagcgtatggcgctgaagaagcgttcggctgtccaatttgtgtccaattgccatgtgccgtcgggacgtgatttgctgacggcccgactccaaaaactgctccaagttgatgtgtatgggaaatgtaacaatagaaaatgtgatgacaaatgcgaccaacgagaacggggcgagtctatttggcattcatttgtcaatgtcaggcgtttttaggcattatttttggtgataaatttcaaaccttttttggtgccaggttcaatcctctgcagcaaatatgttttatagtttttttattgcttttatgcaaattagattgggcgccggacttttcgacagaaatattataaatttcaggaagggacttttcgacagaaaaaagtaataagtttcaaatttaggg

SEQ ID NO: 984 - DNA, 847 bp, Heterodera glycines
tttttgaaaatttgatgcaatttggttatctgattttcaccaaaaatgaccattttttgctttttttgggccaattttttaaaaaagaaaaaaattttggaggcccgccggcggtgccgataggctccgccgggggaaaaatttgaaaatttgaccatttaaagttaaagacattatggctaaaagatatttttcaaagaaaaatgaacaaaagtgaaggattttgagttgagacagagcaggaccggatccggtcatgaattcgccggaccggaccggattggcattttcaaaaacaaccggattcgggatccggtctctcataatccggtcaatctatgtaatccggtcaatccctatttttacaaaaaattgccggacctgattcctgatccaggaaaatccggtaccggatccggtccggctcggtctctactttttatactcatattaaagccaattcaattctctagaaggagaactgaatgaaaaacaaatgttcattctacctgattgtaatggcactatcaaaaattgtgacccatttttgacgccaaaagttaactgtgcttagaaaataaaaaaattctaacaaccgaacaaagtgaagcaaaacaatgaatttacgtggccaatatggcattacatagttcattaaaattagcttgaaaagtggtaattacttttgctaagctcagaaaaaactctaaaacgataatctatcagaaatcgtgggtttcaatgaaaaacattcgctctgagtcaaaatgaaaatggattcatttaaacaaatagcaaaaattaactgatcttattactttattagataagttaagccaattttatt

SEQ ID NO: 985 - DNA, 2638 bp, Heterodera glycines
  misc_feature (2586)..(2586): n is a, c, g, or t
  misc_feature (2612)..(2612): n is a, c, g, or t
ttaaaaaaaataaatttagtttttttgttggttatttgcattttgccaaatttataaaacgcgcaaacccattttggcggatttataaaacgggactggcggatttataaaacgcgcctttccattttggcggatttataaaaacgcgactggcggttttataaaacgcgaattgttaggtggcggatttataaaacgcgactggcggatttataaaacgcgcctttccattttggcggatttataaaacgcgactggcggttttataaaacgcgaattgttaggtggcggatttataaaacgcgactggcggatttataaaacgcgactaggtggcggtttttataaaacgcgcaagcaccatccataggtactgtatctacccaccaaattttcattcggaaaccccacggacacccggggaccttcctttgttagtacttatatattcttctggagaaacttaaagctatcgaagcataaccaagaatgttaaatttagttgactttaaaaaatctgtgagtttattttttaattttaaaagacagaatttttgctgttttaagagaccataattttaatgtttgaatttatttatttttttccagaatgtcctttatccaaggattaatttattataacattatttaaaattgtatatttttctagagaaacttaaagctatcaaatcattaccacgaatgttaaatttagttgactttaaaaaacttatgagtttatttttaatttttaaaatgccaccttcacagatcactgaattttgctgttttaagagacctaattttttccttattagataatgctcgaatttatttatttttttccagaatgtccttgtatccaaggattaattacgcacacaatttgatcgattgccctccccccattttcagagtcccactttttttatttggctttcgaaaatgccgtctgcacagaatatgtgactgaaaaattttggaaggcgttacgaaatttgatggtgccaattgtgttgagtcgaaaagtgatggaagaagtgggcattccgaatggcacttttattgcggtggacgactttaacagtgtgaaagcattggcggattatttgaaggaattgcaaagggacacggacaaatacatgaggtaattaggtggaaaattagggaaatgattgccaataagggttaattagagagaaatgattataaatgagtgtaattaattaggatgaggaaagtcgtgtaaatttgtgacattcttagctatttcaaatggacgaaaacgtaccaaaagcttcggagtgggaatggcattcagccgccgttgtgccaattgtgcgaaattgcgcacaaacaacgacacaaggacacattcaaaacatacgccgtacaattggacaaattttggcctaaaacacaatgcgaaccaaattttgtgcaaaaaagattcaaggatctctgacaaataggcgaaagagacgaagaagaagaagaagaagcggataaacagatgaaattggataacaattaattaaccaaaatttaaatatttttttctttgataattacaatttttcttaatgctttttgttatcatataatttttgagctttttaaatgcaacattgctgtttaatcccgtcattaattatttatatattaaaatccagtaaaacagataaattttatatttgaaagttttttacgcaaatcgcaaaaacttggattttaaatcccaatctcctgggttttcatccccgatccaagtcttacgaatcccaatttccagttttgtcatcccgctttccctgctaatcacaaattctatttctgacttatattgttcgtgataaaatttgatactaataatttattagtaataaaaatgggctgccgagtgagtctctttcagtcagcaggctatacaaagcttggtttagcactcggagtcgaagctcgaactttttcgcatatttttttaaataaatttaaattatgcctttcaaaaaagtaacgaaaatattttaaattattattataaaattctataaaataaatgaaattttttaagcaaatgaattaattgtaagtttaggaaaattgataaatatagggtgtgcaaccagcagcagaagaggagccgtgatagaataagcacgcggtgtgaaattgtttagaagattagcaaaaattacctttttctcaaaataatttaattacttatttattttttctcacattttgagacaacaaataaatgttaacaaatgaagaaaaatagatttttatacagtaaaaaaatttataaaaacatcagaaaattcaacaaaaaaattaattatttttctttacaataaaaatttaaaaaaacttacaacatcttcgattcccaggacgaaaggcccaacgttgcttaacttgacagatcggacgggatggcatgctttcaacgtgatatgtcgtaagcgaaagtgctccatttgaaagcaattaaatagtcaattttataatgcattttcttctctttggttaacctaatgattaatctaaacatggatagttaaagaatttaaattcacttanataaggtaaaaataaaaagaaaattncgatagttttttttcaaattgaaaaa

SEQ ID NO: 986 - DNA, 1127 bp, Heterodera glycines
tttctttttttttattttttattaatttttcaactgcaaatcggctaaattgaaaatgagttatataaattttgcgattcatcacaatctctttaaaaagcacatataaagtcttttcctaggcacaatttaattttttttttaattcgaaaaaacctcgaaaatcaaaatttcttaagaaaaattggttttggtagtggtgattgaaatgtgggaaaattttcaaaatcagaaattattttaaaaacaaaattacagcgaaaataatatgcttatgactagagaccgcaaaaaaaaggcatcaaaaatcgcgaaaaaggcactataataggcaccaaaaaattgaaaaaggcatgtaaagcagggctacccttgaaaatttcccaaaataagtatttcgctggtcaaaaataagttttaagggtcaaaaataagtacattttttcaaatatgcttccaaactttaaatcacatttttattcaacaaaatcaagcattaacaacatatttctcgccgccaactatttttctgagcaattccggcttagacatgagaaatttatacattttcgaaaatgaatttaataattttgtttaaaacataagcaatttgtaaataattatagttcattcgggatcaaaaaatcagatttttaacaattttttgcggtgtgctttttccaaaaaattttgaggaatgggcgatgggatggggtccggcagtgccggtaggcgccgccggaaaaaattttgtaatttagcgcgactggtaacaaattttcaccaaaaaggccaatttttgcatggaaaattttaggtcaatttttgaaatctcagcggaaatttgcggcactgcggcgccgataggcgccgacgggaaaaattttttttgggctttttcatgaattttgttaaaaaaatatattcaaaaatccccctttttgctcctttttatgccttgaaattcacgctcataatcagcgtgaaatttatatttgcggtttggtggagccattaacgtaaataattaataatttaactctaaaaaatgtgatcataaaactttctttcgaaatttagaatatttagcgaatcttgttacgattttgtatttaacattcgcttca

SEQ ID NO: 987 - DNA, 780 bp, Heterodera glycines
ttgttacgccgctatgtccaaagtgaataaaccaaaagtttattcaaacaaaataaaaaggggacaaggcgaacaataaattaaatattgattggaaaatggggtcacagaggaaagaggagaaaatgacaaagtgaacagaagaagtgaatgaaggagggaagaggaggggtatttatgcaaaaatatatggggggtcaaacagtgtatgtgtggagggggaaaaagataaaacataatgccagacatatttaaatggtgtctaccgaacacctccccttttaaaagagtcatccttccatctgatcggcatgcacaggtcctcagatcacttcggtgagtagcgatcgggcggacgacggttccgttgagggtactgtcgtcgaggacgaattggcgaaaatggctgttgttcgacaggtggtggatcatttgctggctcagcattgtccacaatatttagttgaagcacggccacgtttgggcgctggtttggttgttgtgccacgtttggcaaaccaaattcttcattaaacacgtccagtggatcagtgtccatttgatcggtttccctcttgatcagctggttggcgtggaaacgggatgttgatccgttcacgaactccacgtcgtacatcactcctttgcaagtcgtgacatgtccagctctccattgttgggacagccggtgacgagcataaaccttttctccgactgagaaaaatctcggttttgctccgaagcgtcggttgaatggcttttccatggcttcgtcccgga

SEQ ID NO: 988 - DNA, 2977 bp, Heterodera glycines
taatgctgttttgagtgacgaattgcttgaattcgtcgtacgaaaattgggtgccgttgtcggtgaccaatgtctccggcaagccataagttgtgcaaaggccacgcaacttttcaattgttgccgctgttcctgacgagcgcatctcgacaacttctggccacttcgagaaggagtccacaatgatgaggaacatctttccgaagaatggtccggcatagtccatgtgaattcgtttccatgggctgtccgtttttggccaagagtgaagttcggtcttcactggtgcttttgcttcggcagcgcacggttggcaagactttaccatgttttcgatgtgcttgtccattccaggccaataaacgtattggcgcgcgaggcttttcatccgctttattccggggtgccctttgtcaagagttgcaacacctcattttgcagcgaggcagggaccacaactcgatcggaaaataacaaacaaccattttcgattgtcaatgcctcgcgcctgcggtggaacggcagaagttcgtccgaaattgcctttttgttgggccattgagttttgacgaactttttgaccttctgaattgtctgatcctgatcagcggctctgatcagatcctcattgacaatcgggagccctttttcgatggcgttcagcacaaaacttccagcagtgctaatacttgccacaattcgttcatcgtccggaagtggcgtttttgcgatcagtcggtacaaaacatcggcatgtccaaattctgacgtgcttttgtattcgatgttgaagtcgtagcctaaaagtatgatggcccagcgctgcaatcgatttgtggtgcaagcttttatcccctttttgttgccaaaaatggccaacaaaggtttgtgatccgtttgcagtgtaaaatggcgtccaaacagatatttgtggaacttttttactgcatagatcagagctaaaccctccttttcaatttgggaatagttcttttcagcgggcgtaagcgagcatgatgcgtgcgcgatggccttcaaattgccttccggaaaacaatgacagatgacggctccaatgccgtgctcagaagcatcggcagaaacgacgattttgcgggccgtgtcgtaatgcgtcagcagtttgtctgactgcaggatttcgatgaccttatcgaaggcctgctggcattcattcgaccaattccatgccacgtcctgcttcaacaactcatccattggttgtcgaatgaatctcatgtttcggacgaattgctgctagtgattgatcattccaaggaacgaacgcaattccgaaacatttgttggcactggcatttcagcaatggcttggattttcgctgggtccggccttcttccgtctttgtcgacaataaagcccaaatacttgatttggctttggaagaaggagcacttttctggcttgatccgaaatccgaagttttccattcgttggaaaacatttgccaaatgctgttggtgttcatcggcggatctgctcaccacgatgacatcgtccaaatatgcgattgcgcaattacagccagccaacatcgaatccataatggattgaaaaattccaggggcggacttaaccccaaaaggaagtcgttggtactcaaagttaccacgatgcgttgcgatggtgcacaattctattgaattgtcgtccaattcaatctgcaaatacgcatctttgagatcgatttgtgagaacacttgtcctccgttcagtgtcgcgaatatgtcctcgggcactggtaaggggtgctgatgcaacagaagtgcactgttcaacccagttgaaaagtcggcccaaacgcgcgtggaaccgttggcctttttgaccacaacaatgggtgcggcccaacgagtgtgttccaccggacgaatgactccgagttccgttagccggtccaattcggcctcaaccaccaatttggtgttgtatggcacaggacgaggtcggcaatatgagaaaatttttctttaaaaatttccaaagtcgaatcctgttccgaaaattggacattgttgagcttcaaaacatctgtcagattcgtccgaaatgagtccatgagacccaaagcatccagcatatcgatccccaaaaggtttaatgatccttcgtcggatacataaaatgttccttttgtcatacgccctccgatcgaaaaagttgctgttcccttgccaaacaaacggcattgggatccgtcgtgatagaatgcctgctcactgcaggagctcagccgagtgccaactaatcgatgcgattccttgttcagcacggtgatttcggcacccgggtccatcacgaattcgattgcgttcccatcgacgttgacgggcgcttcgatcaggcgtttgggttgattaactaagttaatcttcaaccctccaagcctaacataattgacttgtttccgttggttggcattctttgccaaatatttcttgacccaggcctggtgcttctcgcacatcttctccaaatgtcctgatttgatgcaatttttgcagacaacactgctgtgcggatacgatttgggagaatgggtcttaccgcaacgccaacatgatcgatcagtcgaatttttctgttgatcatggcatttttccggcggtttgctgcgttcatgccactttctgactgcgaagacattcttcgtgccggttggctgttcgatgacttttgcctaggcgatggtggaaagataaacctgcaaatcttccacaatgttgtcatatttgacattgtccccgtctgcagtaagcttggccaaaatgcgctggcgcaaggcagaatcgttgtgggacttcagtgctgtcagcagcatgaggcagtggaattgttccttgttcaaaatgtcgaatttgaactcttggagcaatttccgatgtctgttcacaaaatgtcgaaagtcttcagcattccctctttcggctttcaaacact

SEQ ID NO: 989 - DNA, 8370 bp, Heterodera glycines
  misc_feature (8348)..(8348): n is a, c, g, or t
tacagcattcctaaagaagcttgcctccaccagatcagaacaaaaagaagaacgaattaatcgaaaaacgctacagctggccaaattttggcaatcgttgaaaatttgtgcaaaatatattgagttttagtttttaaactaacgaacaaacaaaaaagaaggttggcacaatacgccgatttttatagagaaattgccaaatctcgttcagagaaaacggcaagaaaaaggatacaacagaggagtggtatagccctgggagctgtcttgatacctgtcctgagtgttttagcccaacatttattagaaaaaataacatcatgaaatttgcaaagaaaatgttaatgattcccgaggcggaatatttggctctacggagtgcgatgaatagtggtgattatctccaaaatgaaaaatcgagtttagacgcaaaaatttctcagaatttacaagaccccggcataagcgaggacctcaaggcgaagagacacgattggctctataaagaaaggcgtacggtaaaggggatacttgaaaatagaccacagaaggtagtgattgagaatcatgtacccggtccgaatgttgcaccatatctaggcctcaacactcaatccaaacgggcgccggacttttcgacagcggacctttcgacagaaggacttttcgacagcggacttttcgacagtaaaggacttttcgacagaaaaaatttttgtttaaggggaggacttttcgacagtggacttttcgacagtaaatggtagttttaaaaaagacaatgctatttcatttagtaagcaaaataattatttttgtttcgaaattatttccgtttttatggaaaagttaaattgggtccggcattcgataggccacagctcttaaatattggtagggatggcgctgttcacgtgtgttgtaaagcgcgagcaaattttcgtcttgttcaacataaatttcttttcttttcatgcctttaccacgaattccattcacaggcgtgtcatcccagtctcgaacaacatttgcccaatgcaaatcttcagattcgattcccctaacaatttcactaactttcgggtgaccacttctaaatcgaaaaagtaaaattcgaaaaaaataaaatagaaaaaaaattttttacttaaatttgctgttccaaactctatgccatgactccaaggagttattggtacggcataaattcgcattcaaattcaaacacatattccataatgaaattggaaaagtggcattacggttttggtaatttttttggacaatccagtttcgcataaacaaatcgacatgttgataatggcccacagccggatcatcatttacaggatcggattgccaaatttgacggcatccaagccaattttttgcaaaatatttggccagttctcaaatgggatttaatttttttaaaattcaattgttattattagggattagatttttaggcatactaaatagacacttaaaaaggcataaaaagtccgaaataggcaaaaataggcattataaaattgatcgtagaagtttcaaaccaagataaaaaatcgtttttgtgcctatttcagcatattacgagcgcaaaaattttaggaagctgcataaaatctaatccctagttattattactctgaacttcctcattttccatatcaaattgtgacatgatcaaacagaaatggagataagcagaaccgcttggaacgaatgcgagcgaaattaaacatttgacattggtttttgtttgatgcggttcttggttttgggccaaaaaaagtgaatttaaatgtggcaattttcgaaggcgccggaaaacagattgggacatatgaaacaaacaacctttttgccgagagagtggaaaaacctataattttgatttcaaccaatacttgcctccctttttcacctgattcacggcctgaattgaactattttcaaaatccgaaataaaagtctgtggattccaagctgggacagcgtttcgaacaacttgaaaaagtctttgatagacaaccatttcttttgatggtagcaaagcataaacagcgggaatggcaacatgatcaacgattgggttaattgtgtaaacttgttgaaaacttgccggacaagtctaagattccagggatatgaccaaatgcaaattttccaacatatttattttggtttcgagggggggggcaactcaaaaagtcgatttttaggggaatatttttcgttttttaaaaagccgatttctatgggatttcttttaaaattgataatattatttaacaaattttacaaaatatttattttaattttttaaaattttggtttcggggggggggggcctcggccccctggctacgcccatgatcagtacctatttgcattcttaccttaaaggtaccatcaatggctacatttgctccaaagcgtgccaaaattcctctgccaaaattcgaacaaaaaaccaacaattttctgctatttactaaaccatcaaaagcaaccgaagcaagcactctttcaggcaaaacaatttccgctgcatttggcacatccataagatcgtcaccagccaaggcacgcgcttgagattggtaacgtcggtactcacgggacaaagaagcacggcttgttccttcattcattttattttatttaccccgtttaaattttgtcataaccacatttcaccttgtccggctcggacatctgcaggcatttgtgctcgtgcctgagtcacagcatcccttgcgggaattggattatcggcctctgcgttttcctttagaattttttgggcatctctgacagattcgtgcttagctggatgattgtgatctcttccaacaattcgccccaatttgtaagcacgcccctgatcatcgtggtgccaagctgaactgacatgcactctcccagggcaatacggggggcgattgatacagcgccaaaattcgatccctaatttggggtttggacaaaaaattccaagttttgcaccttcttgaagtccgctgtccgcttcaaaggcatattcaaaaccgccgcttctgattaactctcggccacgcttgctttctgcttgaaaaaattggacaagaccagctggttcctctgcttcttcaaaggcttcatttgcaaagagttcggccccaatttcaccttcttcgggaccactagaaccagaagacatttttcacagcaattcaaaaatattttcagtaatagttatgaatggcatggtcactcttttttgggccggtcgagaaacggaggtcaaacaaataaattatttattattgataagaaaaccattcatgagaactccaaaaatgcagtgcaataaactaaaatgccttcttaaaccccgctaaattaagatattttataaaccagtaatttataaaaatatattttttaattaaaaattcttatttcacaaataataaaataaaaaaacaagattaattattagaaattatttgtttttaatgaaaaatttgatttgttagtgtactgtcgaaaagtccttcactgtcgaaaagtcctttactgtcgaaaagtccgctgtcgaaaagtccttctgtcgaaaggtccgctgtcgaaaagtcctagcgccatgagggggtggatggaatttaaattttgtggacccgtgacccctgtgaccacttggattttatgatggattggccgttcatccttggtcggcggtgatggtcctcggatccgttcacgagtcgaacttacctcatccgaaggaattgtaacaacgaattcggtggggatgtttgtcggagaagttggtctcgtgttgggagggcatgaagaatagatagtgtccggagttcgggggttcaattcaatgtcggcaatttcaggggggagggatgactcaagggtgggtacaacggacaatagtgaattctgggtaatgtcgatttgggatggatcggtttcagtcggcatattggcgtcagataaattgggagggttaaaaggactaagcttcaagtgtttatggatattttggatcgaaattggggacaattttggcgtcttccgtgcttccatcaaaaattatttagcggagcgggggattagttcgcagaaccaactcttgaatggcatgtcggacttctccgagttcgatggattcgggggtggaaatggaatttggggaattggcaatatttccaaaaagacgattgcgcaaaataaaaaagattttaatcaaaataagaaggaggattcctgccaaacaggaaaaaatagccaacacaagcgaaatgggaaattggggtttattttcaggttcagaggctagggaatcaaggccaagatacagggcggatgaagcaaggattgggagggtatttttagcaattccttttggggataatttaattttcggatgcgcttgaatggggggaagcaacacaaaaattacaaaaaggaacacgaccgtcggaataattgagggggatatggacgatgggagcggatgagtagtcggaagttcagttggttggagcggtggcggtgagatttgccgatttacatgtgccgaatttgagcggaggccaaaacggacaaggaatgagttgtaaaatcggacgcagacaaatgaaattaccgctgcaaaaatcaaaaaaatagggattaggatggcgaaaagtgggattggattggattgggattgctgtggggctgggttgtgatggaacgcaaactcaagcgagagaatatttcccattagtgagaaacagtgaagaagaatgtgaattgttgttaatcggagtccattttataaggaatcggagtgccgagattcaatgaatttttaatttacaatacgggatgggaagggaaaacgtgtgaaaaggcgaaaacccattcgctggcccgccggatgttagcggcagaaaggaaaaaagggggggggcaaaagttaataaacatggaaaagtgtaagttttaatatgtgatcgtaaggagcgggctgtgggaaaattcattgaacgcgatcagcgcgctcccgagcacggaaatgtgattatgttgttatgtggggtactgtcggtggctgaagggcccaagtccattttttaccgacaaacgcctttggaacggaagtgtgagggatgatggttttagaattcactttataatttggggggtatggtgcccatttaattttttggattgggggcttttgtggttcacatgttcgattacaaaattcattttccgtttcaagtgggtataaatgggcgactgaacgggtggtaatgtgacccgttattgtttttatttttgccgtattgggcaagtttgtttctgttttgaatatgtccaatataattgcgaggtgccataatgagcggggagtattttcattatgtaccagaacgagttctccaatttttggtacacaatttgaatggcatcccaattttttgtggcgctcccttagcgaaagaagataatctcttgtccattttgatttaaaggcttctgataatttggtaattgtatgccataagtcttttagagatgaattagtactgtcaaaattttctatatggtattttttggtattctcaacaatggaagaaaatagaggctcattaaagcccaatggccgtataaaatcaatgggacgaaggggtctggggtcaccaggattagcggaatcgaatgttattgggcgagtatttacagtagtttcaacttcacaaagcaatgtagtgatttggtcattatcaaaaacacgtggacggggaccaattaaaactcttcggatatggaatttaacgagggctacaaaacgttcataatggccacccttccagggggctgcgggtgtacgaaatttccaaattgttgctgagagggatttagaaaaatgataaaatttaataaaggaaggggcattatcacagtatacagtagttgggataccgtattttgctgaaatgcgtcggaaagcaagggaaaaagaaagggtcgattggtacggcaccaaatccagggaaatattacgggttgaaagacaaacccaaagaaccacccacattttataagagtgagttttgtttgatgaagtaaaaattggctttacatataggggaccaaaaaagtctaatccgacagcaaaaaatggagggtttaagagcacacgatcagttggcaattgtggaaatggtggtgggttaaacggctgtgttttaaatcggcgacatattagacaaaatttgtaaataatacgttcgacgattttcctacctttcggtatccaaaatttgaaacgaataattgataaagtatgaagagggctcgagtgttggtagtttaagtgtgtttcaaaaataattaagtgtgttaaatgagatttagtaggcagcagaaatgggtttgccgtgaattgcgtcaaatcactcttatctatacggcctttagttcgaaggatgttttggtcatcgacgaaaagtccaagcgtttctctgtcattttcagagggtgggtaacatctctgctcttgttttaggagaaaaataaatgctgtacgtaattcggatacagtaatttggagggattccgctttgcatggagtttttgttattttcgatttaagatgtaaaataaaacgaagaaaataagcaacacttcgaagtaacttgggcaaacgtgaaaatcggttaatatcaattaaagcatttggggtttcctgttgcgttgtaaaagtaaaaattggaagaggcgacgggcattttgttgtatcaattgaggtggtatttgagttaaaagcctttatttctttgttagaaggccaaaacattgggaccttggatagccactcggggcctgaccaccaatgggttaatttgattagtttgttaagtgaatttacgcctcttgagccaatgtcggcagggttttggtaaccgggtaagtgtcggacaattaaattgggtaaagaccgaattactttaagccggttatttacaaatatttcgcgcgttgactgttcattatttaaccaagaaagtacaatggcagaatcgcaccacaaatttaaggatggatttagtgaaatatttgttaaaagcgaattagtaaatttaagcattttggagcccatttctgcagcaatgagttccattttgggaatagtcaaatttgttcctttatgtttgggtttaacttttgttttggagaaaattaaaaaacaatcagaaaactcggaattgggattggaaacacgtaggaaaacagcggcacacatggcgagatttgaagcatcggaaaaacaatgtaattcatatgatcgattttgaagggggagagtgaggggatttcgggggatttcaattttttcagcgggtacccaatttttaaaaagatgattccattcattttgtgaatttagtgtaattggttggtcccattcgacagattccacgcaaagagtttgcataaaaatttttaggggaagaattacgggggaaatgagtccaagggggtcaaaattagaagcaataaaagacaaaattgaccttttagtacataaattttcagggggtggtgatacggttaacaacaaattgtcatttagggtgttccatgatacaccaagaaatttatgtatcgtaccattgagcatacggtcattagggagatcagaaattgcttcggacgaattgctggcaaattcccttattggtaatgacacagtttcaaaaagggaaataacattcgaaatcttatttttaccaatcaatgggtcatcacaacataacaaaaggttatcaacgtaaatatttgacaatatttcttgggataaatgggacggattagtggttagatgatagcgaattgtggctgctaataaaaaaggggagcaagtcaaaccaaaggacactctcgtaaagcgataaatttgcaaattggagtttgaaattgacaagtcaggattttttaaccataaaaagcgggtacaatcgcggtgagaggggtgtacacttacttgaagaaaagctttctcaatgtcacaaattatggcaattttgggggtacgaaaacgaagaaggaggccaattaaatcagacaaaataatgggaccggggtgtagacaatcattcagtgaaagttctttccctaattttgcggatccgtcataaacaattcgaattttacccttttcctggctaatgactgggtgctgggcgacataatgaagtggaggggagaattcggaggagttgtccacaaactcaataattcccaatttcttttgttcttgaattatttcattatatttgtgtaacagnagatttgtcctttgaaagctgt

SEQ ID NO: 990 - DNA, 3245 bp, Heterodera glycines
  misc_feature (110)..(110): n is a, c, g, or t
  misc_feature (132)..(132): n is a, c, g, or t
agaaaaaatttaaaataatgtttgctgatttattggactcgtccgccgacgaagagcccactgaaaaaatcctcgatctttcgaacgagaatgatttggacaatactcgnatcagtcagtaattgatcactntcggtgccacgagaggctattatcagactcgcagaattgatctcgccaaaaatttctcaaatatatgaaaatcgaataactgatattaaccctatacaacaacttcaattagcattgttgttctatgcaacaggtgaatctacttttttgctattagcttaaaaggccgattatttggaggtgatcaccaaaaaacattggcggcagcttgtggtgtccatcaaacgaccatttctcgagccgttagtttagtaacggatgctcttcttgaatttgcgcatcattatgtatgctttccatcggccgaacgaatacaatcagtcaagaccggtttttatttggtgattaaagatcattagtagttcaagaaaaatggcaatttctagaaagccggaatgcctcaagtgattgcttgtgttgacggtacatttttaccaattcaacgtccgacaaaccaattagattatgcctatgtatgtcggaaaggctttactgctctaaatgcaatgggcgtctgtgaccatcaaaagaaatttattgcatttttttgtaactaccctgggtcctgccatgatagttacgttttacggtatttttaagattctgacaaatataaaactttattctttgattagttgctctaaattttattcgagaatggaggaaggcactcttgacggaattgtgctgggcgattcggcatacccgcaaaagaggtggctctttactccattaagaaacccacgcacagaaaaagaagaaaattataatgctgcgcacgctcaaacccgggtggccattgaacaatgttttggcatttttaaaaatcggtggagatgcatgatgtataaatgcagattatcaccgggtattttgttagttaaatggcactgctaaaataacttttaagaaaagttgacaaaaattgctactgtttgtagcatgttgcataacatcgcaattgattgtaatgcaccattaccaagagatttgttggttgctgctgacattgaaggagaacaacaaggaaatcccgatgaaaatgttgctcaaagtgcagaagcaatccgaaatgattatattaatcggaatttttaattataatataattggcagattttttaataaaaaatctatattaaattgatatacatattaataaaattaattattttaaaaatttaattattttatttaaattttttcaaatcaatggaactcttaaccacggtttcgttaaccatggtttacttaaccacggttaaagacgagcataccggttgaggtcggtcgttaaccacggttaacggaaccgtggttaacgcgttaaccgtggtttactaaaccgcgagacgagcataaggccccaggtctatatatgtatgtgtgctagcatcgtcgaggagaccgattcccttaacaaaattggaagggatttccgggttaaaaattgtaacttcgacacattttaaaaggatggggatttgatggcattcttgcaaatttgaaaatgtagtatttgtttgtgatgtcaaaaaggagttttttgtgaggtcagactcagaagtgttaattggaactgagcttgtcaactgactggaagggttaggagttaaattttgattttggttattttggtgcggaaatggttgtaagttagcttgggatgttgaataaaaggcatcattgggagaatatgttatgtctgaattaccaggaaatgtattggggtttggggaaaaggtatgagtacaataagtagaagattgcttagttttggatttgttgggacaaagcactcgtggatgttggcccttgcatgcggagcagtcggttggtgtagtacattgatttgcaaaatggccggatttgagacatttgaaacaacgctttagagtttttaagcgctcaatccgagctgtaacttccaaaaagttaggacagtaagttgaaaaatgggatggatcatcacaaaataagcagggtaattttggtattattttgtgagtggattgagaatagggttttcccttttgagaatgaaatgttagggttgaagcgggggacgaaatttcatggttaaagggtttattagtcccgtggttaaatgtgaagtttggctttgatggagtttgttttagcagtggcaattttggttgtactgaatcgatttgctctcttctccgtaagatgttgcggagacggtccttcagttgatcagtggaccagttggcttcttcgtctttggccttgaaaatttcttccagaacgaagcgagggagacgttgctcgatttccatttgaaaagaagtagtatcataggattggtttagttgattcatttggacacaaatgcattcaatttgatcaaggagggagcgcaaatcggaacaaaacaaatcacctccacgaatacggggcaaattcttaagggaattatgcaatgagcgagctacatcttcgggattatcgtagctttttgtaagtaaagcaagcgcatcattgtatgagttatccgaaattggaagagggctaatgagggtaaggggagtcccggttaaacactgtttcaagtacgtgaatttgatggaatcggagagtggtaaatcatggacacaagatttaaaggaattccaaaaggactgatattcgacacaatttccgttaaatttgggaagttcggtttttggcagatggataacagaggaattgggagaattagtatttgttgggttagtattttgggaaatagaagtctccaatttgcggcgctgacttcggagggtacgttcgtattttttgagggtatttaacccggggaaatggtgttgtagcaacgaattcgtcgtaggcggtgttgtccgatagccgttcgtttccggtcatgcttgttcgcagagccatccatttgtcactcgcatcagacaattgagtaatgtaatcgtttacctcatttgtctcctcatccaggtcttggatgatggattggacttgtcggtaatgattggaatcggattgaccctgggggcgggcggggatcggaaaatctttctggttatcggcaatttcagaagcgtcaggaaacaccaggccaattgttgttcgataatggg

SEQ ID NO: 991 - DNA, 3509 bp, Heterodera glycines
attctctttcttcgtcaaataaaaattaactgattaatctcattttttgatttgaccattccggcccaaataaatcgtcattttaatgtttctcttttgccaatccttctgctgcccttccttccattgtatgcacattcacacaattggaaggccaaaaatagcaatcacagaaaaggaatcactgagagagagagccgagcggaggagcacagagagcgaagagggagggacacacacaaacagagagaaaaagacagaaaaggacgggcgaaagggcctcaaaaggccgtctctcgtgacttggttcccaaaaaatgttaaatttacaccttttgaattgctttaagcaaccaagaacatgaacacttttcgttgaaactaaacgaagaaagggataaagagcctgttgagtccaatggcatggctaccatagtttttcagacaacaacgaaaggctcctccacctctttaaggggaattgaaattaacgaaatgttaattcaaataagtatcagaattatccattcaatattcagaatcagaaaatttgccaaaaaggtggcataccattggcaattttaccaccgacgtctcccttttgcgtgttttgccagcctttgtgtccttccgatttcatttttattgttgtacttatttctgttattaatccccgctctctttcctccttgcgtctgtgtgcaattctcaatttgccttttggcgtctctttaagaatgaaaaatgggcgcactatttagtagagtttattcatccattcgacttttatttatccaatcgatgaacgtgtcaactttttcttactttgtcaatccatgtcattcattattgctcttttcttacatttataatttcttgagacttacatttaaactttcgaattgttctcaattgcctttacattaaattgtcctctctttttgaatgaaaaatggtttggtgattccttcacaaaatcatttttggcttcaaattaaaagatcagaaagcactcaaataaacaaaaagcaattcattagttgtcaaaagagggagcaaatgattgtgctcttcaatctattaaattctgctgctgtttatttgtgtattttttacattttttgtgcaagagcagtgagtgagagaatgtttgatgctgatgagaaggagggggagcggctaatgttcgtcttgatggactggcccactctctctctgttcctctccttcccctcttttcttgggttcttctactctctcattcccttctccgctctctctctctccgtcctttcctctctcttcctctcctttttctctcttctcattgactttcttccccgagcagattgctcctccttttcttccttatcttttccaaggtcagacaccctttctttgtgtctttgtcagtgttttccctccactctcttctctctctccccccaccctctctcttctcctttccattcggtcttcgcttttttctatttctgctccccatctcataatttcattcttttttcctctattggtcggggttgtgctgctggtgatggtggtggtgtattggctgatgattatgtttgctgctgggggtgggggtggtcgacggaggggcgctgatgagtgtcagtgtgcagcacgacttattccgttgaattgtcatcattttttttcgcttaaaatcactaatttccgccccgatttatctcttatttttctttttatccttttatattccactcaatccatttagaattaattgccattcatctgtcccattttttgctgctctttaaacgtaatcatcgccatggagaaccaacagcagcagaacacgccgttgtgtcgtgccaattgtggcttgtaagccctttttttaatttgcatcaaaatgcttaaataaatattccgtggaagaaaggtctgaggtgtttgctatttaactaccgaaaccttttcatccgttgtccttttttaaacgtgaaatttttgccgtatgatttttttacaaagagaatatccccttctgtaaaattcagttatggttcgcccgccacggaggatatgtgctccaagtgcttcaaagacatgatcaagcggaaacaggaaacgggcaacaccgcgccttcgacgacagctgcggctaccaccgcagcgaataaaacgacggaaacaatgccggtcgatgcggtcgtcgccgcattggcggcgagcggtggcggaacgactgagcagcagcggagcacgtcctcaccaggtttaagcgaaacataactgaaaatagtcctttgagctggtgcaatttctatacgagagaaagaggaggtcgaaattataaaaatcaatcaaattgaacgggaaattgaaaattgcttacaatagctatagcaaaaagaagaaagttgaagagagcgaaaaaataataataattatttaaaccgatagttttctgattgttacttttcttacagttaaaataatcgtcaattatttgaattttaacgtgccatacaaaatatgttttcagaaaatgcaatcacgggattgtctgcttcgtctggcaccactgcctccacttctcatccgggaatgctttcctgctcagccgccacaacaacaacggacgcaactaacaacacccatgcggcgccaagtcctgcgccgggacaacagcaggaagatacccagcagaagaagaagccaaaccgatgcggggtgtgcagcaaacgggtgggacttaccggtgagcgaaggggaagggttgggcgaaggagggaagaatgggtgggggatggaaatccaataggaggtacacaaacctaaggtggtaccaaagactaaagcctgtgatttttaggtttcgaatgtcgctgcgggggtctcttttgtggggagcatcgttacgattctgcgcacaattgcactttcgactacaaaacggccggacgcgaagaactgcgtgccaaacatcctcaggtgtgactaaaattaaaaggaaattggggttggtcagtagagggtaattaatgatttatgaacaaaaatttgacggtggaataattaatttgttaaggtgatcactgacaagatcgaacgtatttaaactgtcgcaggacggcgtatggacgacgactgacaccaattgatgactgacagatgatctggaaatgataatccgacaccaccatcacacaccattcacataaatgtccgtacacatacactacacacttgtcttgtgagagcactgagtacactctatcataaagataaaccgtgatcaattcgcatgacatcagctgtatttttctttgaaatcgaaatttcgggaatgcaatttttcttttattcgttacttaaggcctcaaaatttgttcaatttgaatataaagatgggtccggaatactcgttttcttgttcgcttttggacctggcgaaatttcgattttcaggatgcgatgtttttcgttatgagccggacaacactttcgtcccccccccc

SEQ ID NO: 992 - DNA, 1057 bp, Heterodera glycines
ccccccccccccctatccctcacattccatcaaaatacaattgtgacatgaacatttcccccaaattcggcttgctttcccaacaaattttgttgttgctaaaaatttaaaaatatatgtgtatataaaaggttaaagtcaattcattttgttgacaaatttttatctgtgtctggcattttgagctaatattaaaattgaaaatattgctcaacgagtcgacgctgttttcaaaaagaaaccactaaaagatcaaacaagcgaaaaacaacaaaatcaaattcccaacgatcaatgagctgtccaccctcatgaaaaagacggccctccgtctggcgagccaaaactgcccatgcctgccatctgttgggccttggcagcaaaagcagttgaaacaatgctgaagctgaactttggggggatacgcgttattaccatggtttaaaagctgaaacaatgacacgaacaatcgcaagcccgaatttgaacaaaattcgaaatgacctgggcccacattgtcaaattgttcacctgtcaagccatctgtccacgcatcgttgcaaacactaaaatttattggacagatgatatttccaggtgttgtaatactgtcgaattcggacctgtttttcacctccgctcaaagtgttgcccggacttgtgatacaccgttgggaacatttttcagagaaggaggccaacaaagacagcaccgattgggtgtcggattgacgacgaacatcctcgagaagctgaaataacgaaatcagagagggggaggggaggtgaaaatatgaaatgactcttcctgttttgctaaacatattttttttattcaacattaggtccaaaaatctaagtaaattgaataacagtctctctgtaaaaatattaaaccttgttttgctgctcaggactctgaaaataataaaataacaaataaataaacattttggtggaaaataaaccatttttttcaattcatcgatgtccattttaggaagaaaaattaagctaaaataaatctgtaaaagataaaatattaaaataaataatt

SEQ ID NO: 993 - DNA, 1090 bp, Heterodera glycines
ttatcccgttttttgaattcccgcttgttttaaattccccccccggcatcttaaaaaagcatcattttgcttttcacctggttcttaatattttagaatttcagaaatgctgtgtaaaactttagcttgaaaatctccaaattattgacattctaatcttttgatatagtaaatttgtttagttgtctaatccaatattataatttataatcgaaactagcgtcgaactaaacgagaccaattctcatcattttttctgcatctttccttccctcactaatttttcgtgaaagtaatcaaagccaaaaaatattttgaattacatttgtacatgttaaaaatttaaaaacaaaacttaatatcacataaaaaataaaagaactgattttgatagtttgatttgtaatttaagatccttccatttttagctgtcttttgtttgtcacatacaaattccgtccaaaaatgcctgagttacttttcaagaccatcacgcagcaatcgttcacaattgaagttgaggaaactgcaacggtgagatgtttagacatccttttcttgtgcctaaatacctaacgatccattccttttcagatcggcgaagtcaaacgaaagatccaacaggtcaaaggcgcagaatacccagcggagaaccaaaagctgatcttcaacgggagagtgctcgaggatgccatgttggtctctgagctgaactttgcggcgccgaaattcattgtcatcatggtcatgcgagtgcgtttttgcccttcgtccgagtcaaattcggtacctaaattgcgtttgggtccacatttttggtcaaaatttttatcaatattttttttgaattaaaaactcctgaaaacaagtagtatgatataaactctccctttcagatattaaaatcattatttttggtaattttcaaacttaatgagatgcgctttctcccgacgccttcggtacagtcagtataattttttgagtttttaatatcgtaatacttagggattcttttttgacgcacaagaaatcgagaaatacgcacctaaaaagggagaaaaaaatcgcaaaaaaggcatcaaatagg

SEQ ID NO: 994 - DNA, 3448 bp, Heterodera glycines
acgaggtttctgtacactaaaatcaactttacagtcatcagtgtttcaataaaacttgcttatcccatttatagcctaaaaatcaaaaattgacaattttaaagtttcgacttttggttcgaatttggtttcggaatctcgaattggtcgaaatggatgtcgtattcgtgatcagagccccgaaaatcccataatacttgttttcaggagtttttaaaacaaaaaaaaaaattgtccaaaaaaatgggggccaccaacaaaatatatatttactttcccccatcaaagtccattcttttcagaaacccgcgcaagcatcgtcaactgttcggccagcaacatcctccgcatcgccacaaaagaacacatcgacagcggacggacaggcgccgaaggcggagaagtcggcggagaacaaagcgacgggggcgacttccaacacatcggtggcccagccgggagcagcaacgggaggtcgttctgctgattcaataataaatcccttgcaagtccaaaaatttcagtgccggcagagcatgcgcaaaccgtggccaacatcgaagccatgggttaccctcgccaggaagtcgttcgtgcgctgcaagccgcgttcttcgacgccgaccgtgccgtggagtatttgtgcaatggcatccctgagggactttctctacaagagtcaaattgtgagttagagtagttcagcagtattattccccgttttctttaattttagctgatgctgacaatgatgcggtcaatgaagaaggggaacttatggaatcattggagaacccgcaaggactctcttttttggctcaatcgccgcagttccaacagctccgagacatcgtaaggggatgaggatttattttatggattcaattttgattttcttttcaggtacgtactgatccatcgatgctgccgcaaatcatccaacaaattgccgccgccaatccgcagttgatggaggcaatcagaaacaaccaaggcgcgtttttgcaaatgctcaacgagggacaaccattgggcggtgggaccgacgctggagccggtggagaagcggcggccggcgttcagcaggaagcggcgcaaagaagggtcagcattccagtgaatgcccaggacagattggcaatcacccgggtttgtcagcgaatgcaacaaaataaataaataaaaattcccattggctttttcagctcgtttcaatgggatttccggaagcgttggtggttgaaggtggttttgtccgttattttttgttttatttacaactttcttttttagcttatttcgcctgcgacaaaaacgaggtgtcgcttcaattaaaactattaatttttgtaaattaaaatgcttttttaaggatttggctgtcaattacatcttggcgaggatggatgagtctcagaatgaacgggcgggtgccgggcagcagggcggacaataaatagggtaacggaggtgcagtaatgatcgcaaattcctcatatcgtttccctaaattatgatcattttttgctcctaaagtgcatgttctgttctattctcgccctttggctgttcgttgtgttttattatgaccatattaaattgtttgcggactgaaatgaccacatttacatgaaatggctcaaagatattcagaataaacgcatagatttacatatatatgaatttattatttctagaatcagcttagaaattacccattcgttcgtcgggacggaaaacgcattttttgggttttgtgctaactttatgccttttcatgcataaaaatcccatttctattctaaagtgataaccctcccccagcagcagtactgatgttcaagacttaaaatttcacaacatagagaattggttagcagagccaaaaaacccgactttacgagatacgtccgatattcttttcaagaaatcttaattgcacacctaaaatcaaataaagactaaagcgtttacaaccaatattgatgggacttaatcatggatatcgaacgtaaaaatcatcgtcggttttactggtcccataaaaaaagaggtaaaaaagagattttgaggtgctcttagaggttttcgggggcgctgaacacaaatatgacatccattttcgacctatttcgaaacccggacccgaattcgaacaatttttttttatgcatttttcactcggaatttgcgtcaaccttctttattgtatgtaaaattaccaattttataatatgaaaaaataatttctcaaaagattttataagctttagttgattcttattttaaggagttgctaattagtttctccggtttttttatttagacatatgcttaatttttacaaaaaatcacttttaaatgatcactttcggcctcagaaaagcataaatcaaatcaattcattttgcttttcactttttggttgaggattaggttgcttttcccaaagtgccgttgtgcgagcaaagaaaatgccgtccgttcccattcactggcagaggagggcattaagccactcaaattaacccaaggaaaatcaaatggacagattaatggcaattagagaagagaaacaaaatgggaacagcagagatgggcagggaaaccatggcatataaaagcacaaatgaaagatgccaaaaccattcatcaccaaaatccaaattagcactaaattctattttgctcccctatttattttatttatttaataaaatttactagattttaacgatttatttagcattttacatatttattttgtattatttttttgaaatcccttactctggtgcccaaatttcatgtcaccattggagcttcgtcactaaaatagtgaaaattcattattttggcgtgcgttttgtcactatttttttcactatttcgacattttttggaaattttctcaacaaaaatgcaataaaaccaaaaaatacacccctaagaatctacttaaaaaattacagaaaaattagcctcctaaaaatcgtcccaaaaatttaaaaaaatacactcctaagaaattaaaaattttcccagaaattcattttcatggcatttttggccttaaaaatcccagtctactcatttgcaactgcaattagtaaataataaatttttggctcaatttttgttcgattcttaaaagtgtatttttcgcttttattgcatttgtgttgcaaaattttccaaaaaatgtcgaaatagtaaaaaaatattgacaaaacgccaaaatagtaaattttcactattttaagtagagtgccacgggaccgggattttcggtgtcaaggcagttcgtacaatttcaaatgggaaaggccataatttttttgttcgtcatttaatttcttcaaaatttgtttcaacgaaagctcaacgtgtttagaagctatcattaagcagaagctaagcgattaatcatctcaccaaaaagttcatt

SEQ ID NO: 995 - DNA, 3992 bp, Heterodera glycines
gtggtcagtgcgttctccagaactgacagaaaatatatttttacaattctgccaaaaaaaaagggagggagttttttccatcggcagtattactctgttttcttttcccccattattcttgtttcgttatctttccatcctttatttttttgagagtaaacctaagtaataaatagtcaaacttaatcttgctcgtcctcgttgctcaatgcatacaacggcagcaccgccacctcatcagccttctgttgtcatgtcggcaattgatgacaacaattcggcgagtgtccttttctttcccatctttctcttttacttccagccaataaatgtatcaaagaatcccttttttaggtgcgctttccgatcattcaagtggaagtgaaaattcgagtgcctgaccatcttgtcggtcgactgatcggcaaaagtggcatctgtgtgaagaaaataatggaggacacccagtcgcacatttccatcaggcaagcgtcgtcgagaggtttacgggagcattttggatagggggccaaatgaaaaaaaggggaaatgtgtcgggaggtaagggtttgaatgggattcagtacctgaacaacaaaaaagaaggtacatacacttgtgtgcattcacaacccaactatgtccgggcaccggttgggttggtcctattggcaaaaatgagtccgattggccggcttcgattgacatccgaaaactgtttgaccgagaaaaaacatttaagcgaatcacgaagtcaacaggaggtgaatcagtaccaaactccggagctgctcgaccgaatcatcaccattcggggcactgcttttggctctgtgatggcggccgagaagcaggtgcagcagaagttgcgccacattcaggaacaggacatgaacatcagcgggggaggcggtggagtaagcgcagcaagcggacgggtgagaaaaggacggggaaggggggggaattgaaaaatgcaaaacgaaattggattaaaagtcccattaaaaaacgcaacaaatatttcctccccttccgcctttcttcagcagttctgccccacgcctgtgcctgctccgcccggtggcattttgcagtctatggacggcggtggaggcgctgccattggttcgtacattgctccgtcggcggtcactgtgacgggtgcgccaatgctttcccgtggtccgccggacaatgccttccatcaccatcctcccacagccgccgccatgtacagtgcgcaatgcatcccaatgggtaggtatgaagcaacatttacacaatggagagggactgtttcatttaataacccattgagcagcaaaaatccactgattaggagaccatgacctacctttaaaaccccccccccccgattcggctgctaatctttaacatttaattcggtgcgtcgtttaacttccatttttctccccaggtgtcgctccgcaggctttctttgtgcataaccatctcgctacgggtcaattcgctcacaatattgcagtgccaaatttgcctaaccttggtgagtcaattttcgggggcattggccacgcaaaaatatttattttttaagtccatgtcaaaagtcgggtatatgttcccaaccaaatcgtcggaattctcatcggaacgaaggtaaagaaaaaaagcaaaaattatttgtttaaaccaagcatttaagggtcagacaatcaaaagcataagtgccgagtcagggtaagaaatggaataattataagtccaaggagaaatattgacgaaattttatgaacaacaaaatttcctttcttttcccctgggggtgcatcggcgtattactcgcatatgaatgaataaatgggttattgttttcctattataatttcatcttcttccacagggctgtgattagcatcaaagctgagatgacaaaaaaagggggacgagaagaaaagggagacggcgggacagtggcagggaaagaggacaccggcacagtttctgttgcggacgaagccgacggagggacaacgaccaccgccgctggcgcaaacgatggcagaacaaccgcaaccatcgaggacaacaatgccaatgcgaccactgtcgacaacaatagcagcgaaactgttgccgaaaacaatggaggcagcgccgctagcgttaccaataacagtggcagcacaatcgcaaccgtcaccaccgaccacagtggcagcacggccggcaccgataacagtggcagcaacgcgaccacctgcgaacaaagcactgcgacgccagtgcagcaacagcgcacgtatgactcgaacaactcgcttagaccggtgttcatccagggctacgacttccaagtgtccaaggtgtggtgattgatgtgtctgctctttgtttgtttccattgttttgttttgtcccctcccattaggcgcagtattgggtgttccagaaggtggctgacagtcagaacaaaagcgtggacgaaattgagttggcgtgtgaagcgattgtgccttcgcgagtgatcggacgaatcatcggaaaggggggacacaacgttggtgcattcatttgggggatcagtttttggtttcattattcagcttttaggtcaagaagcttcaacagagcagcggggcccgtatcaaagtgaaaactaacaattttgttttgttttaaaaatgtttgaaaggtgccggacgacatcagaggcaacaccaagagcagtggcgactgggctaccgttagcatctatgggaatttctacgcggtgcaggcggtccagcagcactttggcgcgcttatcagcgaagtggaatggcgtgacagtcgcgagtgagtgcattgaacccttttaactccgcttttgtctggcactcaattgtctgtgttttcagacaggacgagagacgctcgcgtcattggaacggcggaaacagtcgctgatgagccgaaaaacaatttgtgtcaggaaattaaatatgtaacgatttgtgtggagaataactttgcggattgtttgtttgtttttatggccgtcagattaacaattgattatgtttattattcattgtctgttgtgcattttcgggtaatccttcgggattggtgtcccgacggaaaagagataaaattttcttcaaattttttctagggaaaaaaaaactctgatcacgaatccgagaacgcacgttctgaatggtgtagattcgtagagttttagaatgagttatcaaatgtatggaaaactttgttttcactgcggcttttggctcctgacagggagggaggatttataaaacggtcgaatcctgacaaatttaatatcattgtcctaaacatgcggatgaaatcgattcaatgcagtttgagagatcttcgaaccggtttaggattctaaaatgggtaatccttcggaattggtgtcccgacgggaaaaagagagaagaaatttcctttacacggctagtcaattttgggctccaagtacaaataagtttattatttatttagtaatcagaacgccaaaactttgcaaaactttaaattttcttgggattttcccttgtaaaaatggaagagccgatctcgagttaaaaacttaagtttcacaaaataaacttggaatcgttaaagggggtcaaaatatgggcctatgcaaaatttgaaaaaatctgaccctaggaaaaattttttgacccaggacaaagttttttctttttctctcatttgggcgtactatttcctataaataacacatgaatcatttatttgccaataaacaatttttttaaacttttgactaacttagaaatattcttcagaattttcccttcaaaatgagcataaaatgattttatttgttctagtactgaccaagttataagctaaaaaatttcaataaaatcagcagtaaaaaatagtgtaactctttgtatttgaattttttttcttttggcgttctgtaattaattatattttatttgtttgctttaaaaattgaa

SEQ ID NO: 996 - DNA, 1428 bp, Heterodera glycines
tttgaattttagtctttttgttcgaattcgggtccggggttctaaattggtcgaaattgatgtcatattcgtgatatgcgaccctcaaaaccccataagacatgttttcatgactttttagaaggaaaaaatttttgttccaaaaaggggggggggcaccagcttcactattacccaaagctctttaagagcgtccgaatgataccatttgtcagggttcgactgtttttaaaaatgccccgttaaaaagagcgtgtaagtaggcagttgtctgatttacgctagaggcaaatgcccaagtcgtaaagtcatgcaaggaaagcaaacctttatgccaaaaaaccagatttttaaatttatataaattagtgtgggaacaattcggagaagaaatgaatgagatttgtgttggccaaattgacaattgatggcaatacatcaggttctggtcgctttttatgcattaaatgaaattttcgtttcaaaaatatcgttttttcaaaagtttggttttcgactttcttgaaaatgatgtcaaaagtatgaatcgaaatttgtttctaaaaagggaatcgaccaaagtattaccaaattgattattcattggaatcggactctcttctttccgtcctcttttctttcgtcgccgtcgtcggcggctgtcgcccctcgggcgccgatcgtttttattgcaattgacgtgcaaatggttgcgctccgttgcgaacgattgttgcccatggacagtggggacgcgggcagttgttggcattgcttttttggcgaaaattcggcggggccgagaacgattggattgggcaaggagaagagactctcgacggaagggatcaaactgaacggaaggagcagaaaataaacggaattggcaaagagccaacgggacaaacagaaacagtgaccgaccgaattgtgtccgacgacgagcgacggatggtcactgtgtgccaactctcctgcatgtacacgtagccggcgattgctgggagaaaaaatgccaaaaatataattaaaaatggaaagggcggcggaaaccgacccaaaaagagaatagcggcaaaggcgagcacgcaagcaacaagccgaatccacatgtcataaatgccgtcctcctcctgcgatgccgtcgactgttcgcccccgtcgtcggtgccgcaaaaagtgcgcgtcacattttcgcactgattgctgtccaaacagcccaacgagccgaaatgggtgtccgccttgcccaacgctttgagccaagcgccgatccactcctgctcacagatgcactcccaattgttgcctgggggcaaaagaagcggcaaattcaaagaccaatgaaaggaacagagcaatgccaaaacagaaagaaatttatgcgcaaaaattggatgaactttgagaggagagcaaatgaaaatt

SEQ ID NO: 997 - DNA, 939 bp, Heterodera glycines
cgaagtgtgaatcatgtccgtatgagtcatcttgggcttttagccaaaaagggagcacaccgaaaacatttgttttctcatagaatagggaggccatttgtccctctcccttggctacgagccgaaatggcacaacttttagcataatcagcaaaagctaaggcaacagcaaccgcttcaatcttagaagaacgcattggaacagcgagaagaatggactcggccgggttggcacgaaaggaacggacaattccatagacattcactttatccacggaagagttattcttaaaccttcgattattgtgattactaaactgaaataagcgaattcgaaattgccaaaaaggatgatggagtcagtctgaacgagtgtttggccacttcaacgcccatttcgaccagagcattaacgatgtaatcgcgaagttcactgggaataggaaaagcctctcttcgaatccaaatggcatttccaaaccatcacctctttttgtcaccaacattcctgcgcaaatccctcagaaaatggtccaatttcgaagtatccttccaattttcctcaacaagtccagccagcagcgcgttttcttgaattttcgctttctccgtaccaaaatgagaaataacaaaaacggcgtatgcgaatgccaaaaaatggagaaacaaagagacggggccgactcgatcgatcagcagccgaatcagtttgggaggcttggccttggaggtcccaataaattgactgcgaatcatcgcactcaatcaaatgtgtgaaaaatagttgaaacgttattagagtaaatttgatttaaaacaaaagacaaatgcaaagaaaaatgttaaaatacaaagttttattattttaatcattataaacaatattttgtatttaaaacagtacaatatgaaaatgagggctttcaaaatggaaaaaaa

SEQ ID NO: 998 - DNA, 5140 bp, Heterodera glycines
  misc_feature (4103)..(4103): n is a, c, g, or t
atgaagagaagagcatgattaatgttgggacaacgacaataattaccaatgatggtccattcctaaaaatgttcgtttctcttttcttatccccaagcaacccacttctgatgcatcgttggcatacgctgcagtggtgcgcacgttcgggtctcaggcaagaacattttgtacatttgtagagaaccgtcccataattttgctggtcgcgttccaactgcgcaatatattcatccgtaagggtacctttagggaccgctcctaaaacagggcacaaaacaagacaaaatagccgaaattaagcacttaccagggtcggtgaacatcgtctttaagtgtgaggcgcaggaaaggaaaaaaagcaattcgaagagcacaaaattgacgctttggtgaattggattgtcggcgaaagaaccgaacatcatgacagtcaacacgcagaactgacctggggagagggaaaccaaagtcacacggaaaagacatcacttgccatagagaagaagaaaccaagtgaaagcagcgcaagtgatccctaaatgtgtccataaagaaactggacataataaacataattattgttgcaaaaaatcgccgccggagaaaaatttggccgtcgtattaaatttgatctcgagacaccccccccccattgtgggtcaatgacaactcgtaaaagaaaaagcgtacaataaaaatttttacaataaagcctaaagcaagcctaagcctagcctgaatcttagaccttgcggtatactggagaatatgggcttcacccaaacattatttttctaggtaatactgtcgatggtacccccccccccttttttgaaagttttttttttgttttcaaaagacatgaaagcatgtttcctaggggtttaggggccgctgatcacgaatccggcatctatttcgaccaatttcgaaccccggacctgaattcgaacaaaagttcgaaaattcaatttttcgaatttcagatttttgatacaaaatggtttaaataattttttattcaaataataatttactgttttattacgcgtatttacaaaccccaactcaacacaaaaactcgaaaattaagatggcgcactacgttccatacgatttaaagaaaatcgtgtaaggattactcaccacagacatcgaagacacaccaattccgcccaaaacaattctgtttgccatgaattctacgaccaccagccatcgcaatcattggtttagtcaaaaataaaataatttacaaataagaaaataaaataaaaaacgagcgatagcatttgcagttaaaaataaataacacaatttttcccataaattatcggggaaagctaattgtaagacaatggacacaggtaagagaatgaatttgtgtgattctggtgattaaatgatacacttcacatcaatttgcccacgatgagtccaaccataagagcgagaacggcaaacaaaatagcctaaaatggatgcaaatttcataaccaaaaatgttgtgcagacctaggcccaaaacctttttgtgcatttagcattaaaaaagcttcgggcgaaatttccaatttttgttgaagaaaagttttttaaccaggttttactcacaaaaattaacaattttttgctagtttttaggtacttttcggttttgtgcctacacctcaaaattttaaaaaatgtcaacaaagggcgcactgaaggcattttttacaattactattctcatagcataaattaacggagcggtaaaggtcctcccctcccaattcccaaaatagggcgatttcgttaggcgacaccccgccccggtcactgatttatggtaatattttgaaattaatggaatttacatgaagcaattgcacattgtcctgctgaagaacgcctcccgcagcagcattgtgagtcaatttttcgagcttatcctgaaacagaaaatgacgaatggttcagaaaaaggcattcggattacgatgagtgcgtaattctccttttcgaggttttttttctcgtcctgatacatcatccgaagttcaacttccctttgcaaagcaagttgaatatcgccagaatttgcttcctcaaatgggaaaaattaactcaaagacaaagtgcaaagtattacggtcgattttggagtttgcgttggctgttcgtttttcggttcgcccgttttgttgaaattgaaaaacggaccagtcgcattggtttcgtcccgattgttttcatcgccaaatccaaaaggtcgctggaacaccactcggagctttgaatccatgactaatgttgggtcaacagttttccagaattggtccacaggaagctgctcgtcatcaggcgcaaatgcagtctaaaaaaaaattttttttttttgtttgtgcagaggtggcgaaagtacctgaatcataaatttgtgccggctccgctcactctcgagagtctcaggcgattcaaccggctgcagcataacgttgatttgggttttatcattcgccttaatttctgtccatttaattgccacaaaactttgggtatgcttattcaccttgataacaccagagttaggacggacacaataaaacttaggtgcagtcgttttcaccttgaaataaacgtcctttcgcgagggatttgacagtgtgagattggcattcacatactcagtaaacggtccttagacggcaatagcgtagagaataggtaattaagcaaagcagtgtaaaccaacccttgaagctgagttcgttattcggatcaagaacaagaacctgttgcggttttgtcattttcgtattcagctattttgaagatattaaagatctttaaatactgaaactaaaaaatatcaaaatgtaggctattattacaaatgcgacaatctgagtaaactgccgagacaattttattccttttttcaacaaaaatttgactatatttagggctcggaacgggcaacatttttgaatttttctaaaaaaatacctatagtaaactgaattctcagccaaatttatgaagatatattttttagtggtacacacgacttatttttgactctatgttctatgtagaaacaggcgcaggataggatcatgcgcgcaattttgtgggatccaaagccgccgcaatctgcaggattctgcggggttaatccctcgggattccgtctcgaaacaaaaaaagttttttcaattatcagaacgccaaaattaaaagaaatattatttaaccttgtaaaagtgcaagagtcgatctcgaattatttcataaaataaaaagagttcgatcaaggttcaagggagtcaaattatgggcctttgtaaaatttcaagaaaatcggccgatgggaggtaaggtctggagtccccatgacttttattcaactaaagaaagaacagtaaaaaaaaaaatcatttttatacgtcgcaaacaaacaggaaaattcattcaagaaaattgcttagtttaataggaatttttttgtataaaagaaggaaatttagtcgatggcaatcattcacttactttattattctattgcgctattcttcttctgcaacacattaaacaacgacgcatgccggaggaactggtggcgctcagtcccggaacgcgtgtctccggccgctggaccatcatcaagaagcttggggcgggtgcgtttggagccgtctacttgtgtcaagaccgagatggaaggacaatggcagcactgaaaaccgaaccgatcgacgctcagcgaccactgctgtatatggaggtagaagagcaatggcgagtcaacaaagcattcgttttttcatttttccaggcccacgtgttgctcagcctgaacgaacttcgatcaaacagtggacgccatttttgccgttgtctggaccttggacgcgatgaacaaccggatgccgattctggacagacgatggagttcaactacgttgtgtgagtgacaacgcgaaatcgagaattaataacattcccttattttcaagcatgtcgttggttggccgtccaatggacaaactccttcacgaatccggtgaccgcttcagccccggaactgcgatcggcacttcaattcaacttctcanagcgcttaaggcgttgcacagcgttggatacctccatcgtgacattaaccagcaaactcggccatcggcacgcctgagacgaacgaacagcgccttctctacctcctcgactttggaatggcgcgcaaatatgtcagagaggacgtgagctgctcttctttttaattaaaaacatggcaaaaacagtttctgttttcagggcacacaccggcgccaaagggacaccgcccgcttcagagggacgccaatctacgcaccaatctctgcgcacatcaaacgcgactacagccgccgggatgacattgagtcgtggttctacatgctgattaaattctacaaaggcgctgtcccttggaatagccttcgcgacaaaaatgaggtgtttgcgtgtgtggcaaagatttaattatctccgccatcattttcagattggcctgtacaaatgtcgccggatggaggaccagccacccgaggtgcgacgccaggccatcgacgaactgactgctggatgtcctcccgaatttaccgagatcctatcctacattgtgagttttcgtttcaaacaccactttcctgttgaacaatttgaatttttgaggacggactgcagccggaaagccgaccagactacgagatgatcgagaggttgctgcgcggatatctcaccaggaaaaacatccaggagcatccgtacgactgggaggagggacgcaaaaaaacacaaagcgcgcaatgagaggaggaagaagaaccactcgcaagaggaagtgagcagcgccgttctgaccaattgttaatcgtatatattgtgatcagtgcctatgatgatacactattatattactcaacttgtaattttcccgtatctgcccaccattgtaagtaacttgtcaatcattgtctaataaactaactaaggcatgaagacatgggcaatggtagttttgtggtttcttcccaaaaataaaattaaaaattttggaagtgccttttctaggctaaaaaaatacgctaatcacgaatctgagctcggattt

SEQ ID NO: 999 - DNA, 9488 bp, Heterodera glycines
cagcgtattttcttagactagaaaagggacttccgaaatttttaaatttaattttcgaagaaaccacaaaactttaccattgccaagacatgttttctgggtagctgatcgcgaacaaatctggcgcccatgtcgatcaattttgaaccccggacatccggtttcgaacaacgcattttgttttcaatccctgatagtattcatgccatccataggctaattcattaccaaaattatctttcagtttaatcttttaacgccatagccatattgagaaataaaattcaaaaggtcgtttttgttgattgggttctgtatagtgttccacacggattcagcggttgaacaagcattcggatgacttttgtccgttctttcgcgcataaattcccatcttttggtctcccgctcaaatcattattaatgaaatcaaaataaaaaacatttaccgagaatttgcattcaataattttgttgttgtatggtaaaagctgtcttgtcgctttgattgtagcgaaaggtttatccgcgtggagaacatgcaaatttccgacgaattcgggcaattccccggggcgtattacctgaaaaacaaaacaaatagaaacaaaagaaaaagtccaccttttttatgtcaagtcggaagtcaatcgatgataattctggcggtttccatttcaataatttgtcacatctcccagacacataaccctggaatttgttgttcaaggattagttatttgctaattacgaactccgttcactggctgaaaaactaatccgtcaacttcgtgacaactcaaaaagcccggttcgaggagtctccgcgtggactcaatgttccaaaagcctttcctccgcactccgattggctcttcctcccgttttaaaagtccagctttgaaggcctccgttcgtggtcgaatcagctcattttcgatcatctcaaaccgcacattgaaaggcttttgacgtaaatcttctcccttataacaattaattatttttccaatttttgtgagtcgatcttccacttgaaatcggacgaggtcgtaaattaggagacgaggtatctgttggccttcattctggtcgataaccatttcagcatcaacaagcgtgtcgtggacaaaatcatcgtcttctagcggtttttgtcttgggtgtcgaataaaggccatgctccgtatcaagaaggggttgttgtccctgtcaaatgcgtacacttggtatttcccgtcaatcaacaccaaatatctaaatagttcgttcgaaatgctcttctcctcgcaaattcgccacctgacaccgtcggctttccacgagaccatataaggctcttgggccagaaactcaatgttattgttcccctgcggtccttccaatgaaaccggctgacttcccggaaaaactttggagccgtaaccacaaaaaagccttgtctaaaaagcgattgctgttaattaggcaattaccttgttaatcactttgtcctgcacttgtcgtcgcttattcggttcttccacgtaacttacattcacaacttttccgtccataaactttggcgcgccttttcccgacagttttgttacttaatgattggcagattttcccaattgagtcttttccaaactgttttttgccatttgtgtgccgttgttcgaggaagacgaaggcccattcgaagcaatgccaacgtcagaattgttggaagtcgcctccatgacaaatgctccgttgttggtgaattcgtcgtcactgatcggtccgttctcccacaaaggccttccggggaactaaaaggaaatcacagtgttttgccgatctattgtatattcaaactgtcatctcgtcttcgtcctcatcgccgtatctcttgcgaaggtcgtccaagtagtactgcttgtaaatgccattcggacgacactccgcaaattctctgactgccatttcgatactcatgtcgcacttttcgtacagataggccgagatgagaaagccggtccgattgaaaccttcaggaaaaagggacattgagaagtggcgaaaggaacggccgcttggtgttaccatgagtgcaatgcaccacaatcacatcgtccgggttattctgtattcagaaatgactttatattcggattaccgtaccgtgataaaacggtcaatcgcttcaatgaatgccgtcatttgctcaggcgtcggcgtttgtttgtgccccaccattttcatttttagaaatttgcttccattgtttaaaaccttaagtgaaatttcccaaataccgtcggctaatggtccctattattattactgaatcggacactcttccctcacctcttcctcgttgtaaaaattgtcggaatttgtcaaatcaacccaaagtccaatcttcgctccttttgtcgctcccagcaaaggggaacgaaaaacggacgatggatggaaaaaatatttgggagattcgattaaatggtcgtaagaactgtcaagcggagtcttcattggtaagaacctttgtgcaaccaccttagaatttgaattaaattgcaaaaactcagaaaaacacttttcccatgggcggacagtaaagccaccggggcggaagtcttgtcctttggttggcctttaaattttgtccattttcgagtgaaggattgtcattctgctcaaatgctaaaagtgccattaattgttatgcgtaacccccaagggcgtcgacaaaacttacaaagcaatttccgtttcggcatttcaatacgaaatgaacagaaccaatgagtactactaaatcataaaatattagtaataatcaagattccgataacgaaatccaattgtccgtttttaacagaaattaattgaaaaactgccaagaaagtggccgcatttattaagaaatgaacaaaaatgggggggggggggtgttgaaacaagaataggttagttgttcgttatttggctttaacgttcattcttcttttgtagacatcaccgcccaaagacaattgcaggttcgagtcgtcctcctcagaatcggagtcaccgccggccattgtccgttttcgtgggaggttaaacgcattttgttggtcctgggaagccataagcttaaaaagggattttatgaaggggaggtttgagtttcaggaccactagaggatccgttgtagtgtttagcaattggtaaaactctttcttaacatctgacgcgcgatagccgtcgaaattggcagtcggatccaacgattctttggggtttgccttcggggcttaataaacaaacaatcagctataaatggcagatgcaaaagcaatacgttctcggttaaagctagcaaggcttttcagcagttcttccacgtcaacaaacggaccggaaaaactcctcggcggaggcaaaagttgaagcaattgggagacaataggcggtggaggaaaaacacctttactaagagaaataaaggagagaaagaaagccggacaaacccccgggcaccgggtgataggaagccgggggaagcttcggtttgaatggaagcatttgcgaagtgtcgggccgagcgtaccccccgagctcaatgttcaatgcagctgcagatgtgaggaactgctgggaacgtccaatttgaagcacgtttggctgaacagaggccgaagaaactgggaaagccccattttgaaaagggacagaagccgacggtctggcaaatttctgctgaatttcaaacgaataaaattgaacggataggacaaaatgtactggtgaataacccatcaacttcagctgatcagtggtacacggagccaaatttagaaatttatagcgatcgatcagccaaagggcttgtcggtcctccccctcgagacaagcagttttccttcgctggtccaccttcaaaacacttgtcaagtcgccaacctgtcagagattaaatgcattttttacagcttccacccattctctcacctgcgattcaaattccaaatatttgtcccaaatttctctaaaatgaaaagtgaaagaataaataaatcacgattacaaagatttttccgggggcagtgcattctccgaatttagcaagcgttcgaacacaacgcgagtgttgttgtcctctgattttgaaatggatgatgagctgtaaaaagggcaaacaatcaactgaccatttaaatgcgacaaaaactccacgtaagccaaagcatagtccgggtcactgccgtggctttttaatcccaaatcaaaaattctctttgccacatctggcctctaaattccggactgaaatggattgtagaatttaatcgctgttactttgctgcagtaatactcgagaagcgcggccgcgacgaaaacgtgaaaattgctccttctgtcttcgcgcgcccttttgaataccaaacgggcgaatttgacgccctcagttctccgcacaaatttcattgattggatatatgcctgaggcaacaaatgtgtaaaaagagcaatgtgttgaatgtaccaattgaaaaacgcaccaatgtcggatcgacactttcgcatgccaacaaacggtcgtagattttctttgcgttttcgtaccttcggttttcctcttcaaagtcagcataagcaaagtgaagcatttgattctccttcattagtccggttattgctctttcgtatagttctgatattttttaatcaattaaatggataattttgcattctactcactgataacgtcggaaagcattgcggtggacagcttaacgtcccctttgtcggctaatttgttcgctgcttgttgctggaaaaaagcagcttcgtaccaaaagtcgggcatataaccaatgcacagcagagactgctcataggcataaattactgaacccaaaatgaattgcttttcaaatgctctttggtgtcgctttatttacctctcttggccaattggccgtactcttccgtccccattgggttgctcttctcccattggatgtacttccgccacaattcggcctgtttcatttccgcactcagcccgcgaggcggcactgaaactgcttggcgattaattccacgggtcacttgctcgtactgcttggtcattttacgtgccgacttaacaaagagtgaaagagaaccattggagcaatagaaaaaggcaacactcacttggtaatctttgtttgcttctgctatcattttttcagcaagtgtcgaattgattccctttaaagaatcgaaaattcgggatttatcggaaaaactgaggggaggggaaaatagcataaaaaatgtttccgtatttgttttctgttaatgaacaaaacaaaccctctcaaaagcacagtaatcgttccataattgctcgatgtttgccattggagttgacagtccacgccggtagattttccggatcgccgtgattttttgattctcagcgtattgacctaccgcatttcttaaaaaacaaattttttcttggcatgggtgtcatcggacttacacagatttcaaaaacgtaacataatccacatacagcgaataactatttttaaaatttcactttgaacaagaaaatgctcaaccaacctctgaaaatctaaaccaactttttcaagagcaaaatcgtaagtttgggctaattgttcacgaaatgaagccaaatgtccttttgtttccctgacaaacaaataacactgtcaaaaaaacgtttgtttgtgattacttcacataaaacacatagctcttccacaagtcaatgtttaaaactcgaacgagacaacgctcaaagatcttaacaattaaaataaattgaaaaagtaacaaagcctcaccgcttcaacattgtcgaaattttttgctctcaacttaaaggaagacggggttaaaacatccgtcaaaacctttagtcacttcatgctcaatgtaagccttccaatatcgaccggcgttgttgaattgggtcaccaaccgctcatagaaacttcgcacctggtcgataggcctcgccttaacaaaatttattttgcttaacaaaattcacccactaaacaacgaacatgcaaaaattcattttgtttttatttgttatttttcttcggcttttttcacctgggactcacgcatcagcaaattccacgcgtcaacatcgaacgggttgagctctatgcgtctttccgggcttagaacggaatggtgagccataactttgtatgaattatatgaatttgtgctattaaaaacaaaatatgtatttcaatactgaaagaaaagtaaagttccataacaaattatatgtgttaataacaaaagtataacaaaaaaacaacaaatgaagtgcattaaagaaaaagcatcagtttttcccaaaaaatcttagatgacaggggattctcgtcgaaacattctcttccacatgctttacaagaacaaatctggagtttaaacaatttgtcgatagatcggatcggtcctcgagccaaaaaggttcaattcgggaatcactgctcttagcgatttcatgctcattggattctgcagattcatcaacaaatagacgtattttgctcttaaaatggattggtttagacacatgttcttcattctttcttacctcttctatgctcaaaagtctcaaccgcgctttgtttgttgttgcaacgacagtccccctcatattcacatgcaaataagcgacccattcatttgaaaccaaacccaactcggcattgccaatagtaaacaaaatcgaatttgaatttaaatcatagattatgacgtgcttattcaagtcagccataataatgacgattttgcacttgtcgtaaaagacacagtcatacggatgcgctttctgtggcaattccaatgaaattaatccgtcctctcccatttgaccattttcatgcgttaatttggtcaggtcgaaacaaaaagttcccgcgactgttaaagccacaagtcgagtgtcagctgaatcgacgcatattttggtgacatgaccaccattcacttgaaaagggattgggtgtaaccagctcaaaaacaaacattcacaaccttttgatgcaaaagtacgaagccttttgttttgtaaatccaaacgaaccaaattaaattctccgcgtgcaaaatacaaaaatttgttcgtgcaatgaattgctaaattttaaattcgctgttgcgttttcattttgccgcttcgacctgacactgtcctcccccccgtgtgtcctgttcgtttgctgccattttcttcatcgcccttatcattgctccaaattagtttgatcaatttgcttgattgtgcgtcctctatatgttcgggggcacatgtcgcaaggaaagtagtaatttggtcacagtgaagtcggaaaacacggatagcacctgcaacagcaccagcaaaggcaaggaatttcccatcggaagagacacaaaactgaaactcaagaggagcaatgacccaaggcaaatttcattcgaaagcttacttgtttgataaaccctaatttgccactggtaattcgaagaaatagtttcaaacgctttctaaaattgaatgaaaattaggacaaaagttaagctttaaccattaaaagtgcatttaagttcattcgctaattttcgttttataattgtcttggttttattaatcgaacctttggtccataagagatcctccgattgttttataccataagtcaagatgagacaaatggtggctcacaatcacatagcaattggactttgagacgaagaaagcgcattctgactgaagataaagcaggggaacagataaccgaatcatttaaagtgcttacttttatctgggggttcgcatgagtgaatttatcagaaatgaaaagctcagagtcggaccctccagaaacaagcaatcgtttgtccaacacacaaatagccctcacgtcgttggcatggaaaaggcgctggccactttgttgccactcgaaacggacctaacaaaagtcaatttaaataaaaacgtcataaatcgactgtacattgtcatgcgatattctttttacgatttgtatccgataatctgcccccgcagcaaaaacctctttaccgttcgtggcaatggtgagaactgccgcttggtgcgtttttagtgtctaaaaacaaatcagtgtcgaaaaatacaccaaaaatcgactttcaaaagtgttccattcaatgcgtcgtaaatactcaattggccacgcgaatcgcccgtgaaaagaaaagtttccctgagagaaagaaacgcatttaaaaattgtcgttttgaaagcgcaactcacacaaaaataagtgaccacacaacgttcgcactctctttcgtccgaggaatgtcgatttctttgtgcttcttccattccgattcatataaaaataaggaaagtccattgaccttcccaactgccatcatttgcggtgttagggtcttattgttagaacatccaatggcggtaatgtgctcatcggtggacaatttaatggtttggacagttgaaaaagtggggactttgttggtgcactttccctcctcgtcgaagtcgcggttgtttacaacgagcaattcaccagaagtgttcccagcaacaaactgatggttttctccggcacgagtcatcacaagaatatcagaaacgcacagttgaacacgcttaacagatccgaaaaaatcgacccaacttttaaaaaacccactcacaccaaatttgctggtgaatggtgacagtgcggtcagacggcctcccaaccctccaaacaccgcccaattgtccacccaaacaagcgtttcaaatcggtcattgaccggaatgcttttttccaggaaaatcaatggcaaattgtctgcattgtaaaattcaacaagggacaattgagccgggaactgctggctgaattttcagttgagaaggaaaaactttaaactgacgaacctgacagtcgattcattttgacggattacacacaaacggccaattgagctattgaaggagagtgccttcactgtgagagatggccgcgtgtggacagtgcaatattctccaacaaatttctccgcttggaaatggcacacttcagcagattcatttccaattttaggctttttctgctctttttcacagatgctgttcggcgtgtgaactccacttcttttcttcctcatttataaaaaataataaataaatacaataaaaaagaaattaaaataatttacggggaaaagtaaaccgtttttacgcatttctctatgcaacataaactagaaaaagcaaaaagtaaacacaattttattataaatacggcacatgtgaaattagatgatgaattaagtgaatgagaaatgataattaataatgtgaaacataagaatttggcgagatttgttaaaaatgcgttgtgaaagaaatttttaaaatgaaagcgaaatgtgagaaagtaaaggaagcaattagtgctttagtttgtacagtgagaaaattcg

SEQ ID NO: 1000 - DNA, 9580 bp, Heterodera glycines
atactagaattttccaaaagaatcattgaatagtttttttaaaatttcaaaaaagttttgaaaatttaaatagcaatttttgatgatttctacatattttttcaaaaatttattccaaaaatttttaaactgcgtccgccctccggagttaattcgtatttgaaagaataataaagaattgttgccttgattgctttgcttattttcccacgattgtggccaaaaaatgacgtgtcaaaaaggcgaatcccctcctcgagcgctacctgaattttatacagggctgccagatctgaggctttagcctcattttgtggttttttgataggtcaatgaggctaaattttcaaaatgaggctttttgtggttttttgagaaattttgaggctttttgttaaatatttcataaaaactagaaaataaccaattcttttccgaaaattcacaaaattacgaatttttttaatgaaaatatgctaaaaatatggtcaaaatttttaatttttcccccggcggcgcctatcggcaccgtcggaccgtaaaaatccttaatttacaagcaaaaatttgctcaaaatcgcaaaatttggtcatttttcggacaaaatctgttaacaaatcgtattgaaaattacaaaatttttcccggcggcgcctatcggcaccgccggcccccttgcgccccaaaagtttttttgggaaaagcgccgcaaaaaaatcaaattcgtttttcatgctcataatcccaaaaaatgcttatttctaacaaaagaatgctcaaatcgatcatgacaatcaaaaatataacatttgaacattttaaacgtgtttagaatacattttgtaaaaatgaggcttttttgccgcttttaaaattttcatctggcagccctgattttatatatgttttatttttaaactcaaattttaaatcaatttaccaaaatctattaccaaaatccactgctccgcctccaattcgctccaaagtggcgagcactggagaccaattttgggtataaaagtgccattccaaaatctccatcgtccacctggcacatcgacaaaagtggaaatttctatacaaataaaaataaattaggaaattaaatttgctattcttttctggcaattaaacagaacaaacaattccagaaccatcagaatgactgtaagtttcattgaaacctgtagcagatgcgggacgggattgcgtcccgaacaaaaaacaatttacagacatttaaaattattttaccttcatatttaatgtcaatgatgtcaacggttttgcgataaattgtaaaaaaataaacctaaaaaatttaaatttaaatctattatagatcgtcataacgttcccgcgatcgcatctgcgggctttatggactttttgagttattgttttaaagagttcctatcgtccgagtgcaatttcaaaaatacgggcatgggcaccagggacgggcgaagctcggttgctgcccgtcaaatccagatgtgtcaaaaaagagggcaccaaaattgtggaattaactcgataaaaatcattaaaataaattcatttgattatttaaaatttaaaaatcaaccaaaattaaaaaaaatgaaattagaaactaaaataaattaaaagaaaaaacagagattctaggataacagagaattccaactacctttatttttatgaaacaatcatttccaatttctataatttattaataccggatttgatgaacaagtatgcgtatcatcattactctgcaaaatggggtcaaagtcagtgtatgtttataatttcatattagaataaaagcggttaccggtaatttcactaaatattacctgtaattttggcgatcttaacaatttttctaataatttagcaaatttttttggaaatttgagtgaggaaggatttgaaattggtaccaagtatgaatgttcgaacaaaccctattgtgataaatgcggtcactctctccccttgtgccaagacggcagtgaaggagattaagagagtgattctcctcctaagataggagagagaagagagcaatggagaggatgcctgcgtagctagttggttagagcacagcacggaaagctggggtcgtgggttcgagtcccaccgtgggttgatcttttgctcttccgcatcaaagaaccaaagaacatcacttggcgctcctggcatggaatcacattcggtgtggagtttgtgtcaagccgacagctccccctccccactctgagagaagttatccaaagactggagctttctcatcaaagagaccggggaccggtcttctcaaaggccggggatgtgataaatgcggtcactctctccccttgtgccaagacggcagtgaaggagattaagagagtgattctcctcctaagataggagagagaagagagcaatggagaggatgcctgcgtagctcagttggttagagcacagcacggaaagctggggtcgtgggttcgagtcccaccgtgggttgatcttttgctcttccgcatcaaagaaccaaagaacatcactctatcttattggtagcattcgaaagcactaagtctaacgaagctaaaatttataaatcgcaatgtttaggcaattaacaaaaaatatttgctgatagggtttgttcgaatatgaacaaagttattgtataaaaacccgagattgtcaactgactggaatcataaaatactctcgcagcgaaaaactcgcggccagaggccgagttggcggcggcgaagccgagccctaccagcggaactgggtcgttttggcgcccacgttttggcgccagcgcgagttttttgattataactttttttgttgtaggccaaattaaacaatcttggtatcattcgaaagcccttcacgtgctctattagccttacaaaaagcaaaaagattttttagcctgtaaaaaatgtacctgtaaaaaatgtattaagaaaaaacttccaaaattttggttttttttttgtaatttcatgttataacttttttggtaattgtctaatcacgaaacaatagcttagaaacagcttctaaacacgttaatctttcgaatgataacaagaatgttaaatttggttaacaataaaaaaaagttatagtccgaaaacttgggctggctccaaaacgtcggcgccaaaacgacccgaccacctccagcagcaataatcgaaaaaaattccttcatatcccactaattagacgataatatttaattataaactgacgcgtcgtccgaacatttttgcagcctctttgtcctgtgccttggtcaatttgaacaaaattttaaggcggaatgcctcgcccgaaactcgttgtttggtggcgctaattaccttgacaagacacagcaatggcatttgaagattggttctgtcattattcagtttgtcaacagcaagtgaagaaatttcctaaaaacggtaattcatattgtagtttgtcctcaatggggcgaacctaacaaaggaccaatgataataaacagagaacggatttttaggtgctaaaaatcgaaaaaggggtgtattttaaaaaattaaagtgattttagggggtgcattttgtgtttttttattgcatttttcacaataattttttgttgaaaagaagaaattgtgaaaatagttgaagtcgttctaaatcgaaaagtgatcgaagaaaatgtgtttttgcgcttatctcactcagcatatgctatccgcacaaaaaaataggtgaaaacctaaaatccgttccctgataattaataaattaggtattttaaagcaatattttttttatactattaatgagaaaaattacaaaaagctattttcttcataattttttttcaactttaaattagggttgcaactcctatcccgccccgaccccgacatttttggccatttttcggggttaacctcgacgctacccatgaaaatcaatcatccttggcataatttattgaggtaatgaacccaattttcctttttttgactaaatcatgaaaatttaatatatttcaaaatatttttgacaaaatataataaaaaaaatttctttctcggaaattcataaaatttttgcgaatatttattagaaatagagcttaagtctccggattcctttctcgtaaaaatctttagaaaaagagcggcgccgcaaaaaaaaatgatttgaaaaactaaaaaagataaggtgatcagaaatttttgtgcatttttttgaataaacccacaatttttatttgggggccagtcgccttaggaaaaatttgaaattttgactatttttacagattttctctgaaaattggccattttaaaatgccttatgcgtttttaattaattctatacaaaaatatttatgataaaagaaataaaaaacacataaaatactgaataataaaaaagtttaatctaaaataatataaaattttttgactatatggtataaggcaaaaattgaaaaaccccgaccccgaacgatttggcaaccccgaacccagaattttccaaccccgacgtcagggttgcaaccctaatttaaatttaacaaaaaaaactaattttatttcacattgtctaacagtattacttatatattaatgcgtgaattttttgcttacatggtttatcgatacattcaatttgtgtatttatgcttaattaatgaaattattttgttaaaataaaatacctaattcttttttagttttcccccaatgatacctttttaggttcgacctagaactagtttcatagtccaaaactgcatgcaatttttcatgcctttatttgcctttttcatactttctgggactttgaatgatttagcacaaaaaaaacaaatcacgtgcaataaaatcgaaaaaaaatcaccaacctaaaatcgacttttaaaattattaaaaaccaattcaataaagctattcttttcttctatttttaaaaaatttcattttaaaaataataataaaggtggctggacatttcgacaatgaccgtttcgccaatgaccgtttcgacaataccttttcgacaatgaccatttacgactatatcatatcgccaaaatttaaaatatcaaattaaatataataaaatgaatataaaaaataataaattaatttaaaaaaatattgatgaaatttaaagagaaaaatttaattaggtagttatattttttaaatttaatgaatgcattatctatcgcctattgtgtatgattattaatagttaggagttggatttttaggtttttacctatttctagattttttcaatttttaacacctattttcgcacctattttggccttttttggggtttttagcacctattttgcacttttttagcacctattttagtacctatttagggatttttagcacctaaaaatccgagccctattaatagtgaagaaagaagacaaaatgagacggacctataatataaatccaaaatgaaaccatttatttaacttaatgtagtgtcctctttttacccaggcggcaatcctgaagaatggttgtccctaattttcattttttttttaatttggtgctcaaaaccagtttttaggcgtttttgagggtgctgataacggatcttaactcgggtttgcccaattccgaactccagacccgaattcgaacaaaaaaaaattgtttttttaatcaagaatagttttttcagggtaaaagcttctaattcattatcaactatttaggtgtaaaacaatgtttcaatttttaacaaaaaaaaaataagcaatttgcgccgaaaattgacaaactaaagccattctcataatgctattttgaaaaaaacgaaaaaaaaacttttttatattgatcccaaatccgcaccgtccatataattttgcagaaatttgaattttatttaaaaaaatatatttaattttattgtcgaaacggcattgtcgaaaaggtattgtcgaaacggtcattggcgaaatgtccgggagccataataaacaggtgctcttaagaactcttttcggatacttgcggcccaattaaaattaaaatataaaccttaatttatcccatccagttaaatcgagtcaatataaaattcgcctaaattggatgggaaaaaggccgaaaaagtcgaggttgggacaagaaaaatctagattttatttcaaaaaaattggaaaaactttccgtctttttcaaattttattacttttttcgaattaatatttgcaaaagttatcataaaaaagaaaatcactaaaaagcctgaaatttagggggctgtaaaatgataaatttattcaaaaaattaagccataccagtaaaaaatttttaaaatcaaaaattcttgtcaagaaaataaataaattatggagatgaattttgagacaaatttttcatttagtagcggtacattttcaaaaatcttatggtcgattcttaggggttgtatttttctgaaattttttgagtcgcttcttaggtgtatatttttcgttttatttcattttggttaataaattttgagcattttttattttttagatttttaggcactacaaaataaaaaacttagaaaatatgcaccaatagctcgaaaagtagcttaacaaccactagaaaaaaaaacttgtttttcttgcatttcaggttacaggtagctcaggaaaaaaaacaaagcaaaaacctaaaaaccgtatcccttactctttacatgcacttttttgtcgtgctgacgcgtttcttaaaatccgccatccatgcgcgcttctcaaatcagccaatgggttcgtgaaacaaaaaatgtgtaacccataaaaattaataactttgtttaaatttaaccaaatatatttcttggtagcattcattagctctatgtgttctctattataatattcaaacttataatttttcaaatagtataaaaaaagatcggatataaaaataattttggctcaattgcattttaaagattttaaaattttaaatgtttataaattataattataaatgcatgaccattgcaaaaaatatagcatgttcaatgctttataaatttttttatacttaagcaaaaaaatttttaaaattatattctgaaagaaaacaattaaagctattgaaaataccacgaattattaatttggttaaatttgagccaagctatgaatttatatacatatattacccatttttattttcaaacccattggcggatttaataaacgcaccagcaccctttttgctggtcttttctgccaaaaaacaactgttcagtcagccgtattgtttaccgtaatttttgcacagtcaacgcaacatggaacaatacggttggccacaatttgctggtgaagaagaaaaaattcgtcaagcagttcaatttccaaataagaaacatgtggtggaaagcgtttggcccacgattcctcttcctccttctgccgttccatctcaatcgaagcactcttcattaatagcaatgatatttttaggatctaaaaactgccaaacaaataacatttgggactaaaaaatggactgaaaatgagaacaattggtccaatatgatcgagcaaaatggggagctagagagggcaaggtccgtagttcagctggtagaacaacaatggtaaggaaagccaaagccactgacaccggttaaaagtagagaccggacaagaaggtcggtcggtcggtttcgttataaaaaccgaaaaaaaccgaaaactcaaaaaattttcggtcggtcggtttcggttaaaaaaccgaaaaataccgaaaaaaaccgaaaaaaaaccgaccggtccgatctctagttaaaagccagcccgccccatagtttttccagcaaaagcttccccagctcggaatggggccaactgcgtctcaggcaagtttggaattcgtaacttttttaaaagttgcccaatcgaacaaacttggtatcattcgaaagctcttaacaagctctatcggctctccaaaaatcacaaagattttccggcatataaaaaagttataaagaaatatatgcaaaaattctgacttttttgcggttttcgggttgcagcttttaataatttgttcaatcgattagaataaatagcttatcaataatttctaaacataaagagctttcgattgatgttaaacttttaaaatttgatcaattgagaacaaaggttataacttcttaaagttgcctgagatgcacttggccagacgcatttgcccctaccgtctacagctcatttatatattcataaataaattttttttatgaaaatattgcaaaaaaattgatttttactatgtatttttcaatttttttatatttttcatacggaacgggtcagttccgtcccgccagttttccgtaaataggccctaaaaagtttcagatttaggggtgtttttgggccaaattttttagcttcggagtcgcgttttagaaaaatattatttttttttcattttaaggcacacagtatttttgcctacaaagaacagacaccgtcatatgctttacaacagcgacgctattcacttctgaagaggatggcatccttttacaaaattggaacttccgtgagtaagcagctcccgccaaatgaatttttgtgtcttttgaacaactttatgtgaaaatttatttaaacaattcaggcgcttccttattatttgatttgctttttctttaaatttacacaaaacaaataattagggatgccaatcatatggatggataccatatttttttcctggactgttgagggcctgaagcgcacgaaaaacatgtttttagcttggtttgaagcttgtaggatggatttctatatccatatttttccatatttcgcaatttatgtcaatattttagcattttgatccatattttatgtccatattttggcatttttcaaaaaaacctcaattagaacagcccccagcagctaaattagcctttttgagcccaaaacccgaaaaatttttcaaaaaataattttttcgccaaaatttctcgagaatattgaataaatttaaattttcttaaaaattaataaatttatgtcaaaaataagcaaaaaagcgaaaatttcgcttttgttgcacaaaacaaacaatcacaattggttgattgctttttaccagaggctgaattttgtaaaattaaaaaaaaatgtaacttaagcaaggcttcttggttttctaatagttttgcctgtttttctgaggataacattttatgagtagggctcgtaattataaatcaaatttcgccatttgggtttttagtccatattttggccattttttggaaattttcatatgaaaaatgcgaaaaaagcaaaaatacacccctaaagatagactttttgaaattttaaaaattacacccccaaaaatacgaaaattttgtggttgtcgatcattttggcattcgcatttttcgggcttttagggcatatttgagggatttttaatgcatagcttatgcgcatatttggcattttttagtgcatacaacttataaccctaataattatt

SEQ ID NO: 1001 - DNA, 1477 bp, Heterodera glycines
atttgattgatttatttttattcatttttattacggtattcattttgtttttttatttgaccaactttatttgttgttttctttttggcaccatataagagcactcatgtgcctttggtttgctcgataaattaaattaaattaaatgtcgcggcgcaaaattcgtaacacgttataagtcaagtagagaaattcagtaaaaatcccaattccaccccagtcataaatcatacataaaaatacagagcctagtgagtggagcatatccactttgttgcaaacttaattcatcgaaaaatggtttaaatggaatgacaaatatcggagttagggtcttattgttagcccggtttataaattgaaaatctgagccaataaataatgggtaaatttatttttaataaataaaattttaattgtgaaaaatgaatataagaattttaaagtcatgactcatgacaacatgaaaaaaatttttttgaagttcatttgagaaattgtacaagaataattggggataaagtgaagactcacacaatgtttgcattatttcgtttgcgtaaagaaaaaaaaatccgtaaggaaagagaggaaaatattgtttgttctatagctagcattcccggccccttggggaagaaaagaaattctcggcggcgagtggggtaacgccagggtaggcagaccagggtcggggagcccaaaattgtcgggaaggggactgcaaacaattttttggattgctaatttgtaatcactaaaaaacgttttaatgcatctctcatttttaagaacaaaaaacggttagctaagaagttattctaaagaaataaaattcgaacgcatattttttttctggaaaaaaagggaaaaaattaatacaattttgaattttttttttttaaacaatttagacaatttttatggaataaggtaattttgcttttgttttcaaatatatttgtggattagtggttagtgcttcaacgctaacagtattctttgttatgggttcgatgccttttgacgttttcaatttaattattttttatgattaatagacaaaaacacccataaaaaattgaccattggcataatttgttaacaaagtgaactcaacttttcaaaaagattcagatggcaccgccggatgaaaatttcgttgaaattaaaaaaatcaattttccttgagtaaatcatgaaaatttaaaatattttttacaataccgattgaaaaacaaaaatttatcggaaacatcttaattatttgatgaatatctgttagaaaagagagcttaaatttgaaaattcacccggcggcgcttatcggcaccgccgccccctcctccacaaaaaaacctttttttcttaaaaaattagccgaaaatccctaaatttttagtcatttttagacaaaaccttgcaatttatgcaaaaaggaattgaatcgagggggaacatcgactcaaggaatgtg

SEQ ID NO: 1002 - DNA, 8101 bp, Heterodera glycines
taaataataaagaaaacaaaattaggagagatcaagaaaaccaaaggaatggaagtgcagttgaaaagcttctgtttaaattttattttattcacatggcaaaaacaaaaatgctaatatttgttttttaatcgcttttggcatttttattaaaaatcgacattttttaaattttggatggaaaaacggtagttgactttaatttggactaatgaattcaatggtaagcatcattttgttgatataatcgtcagtttagaaacttcattaaaacttttataaaatgaaaatatctttgttagaatttatagaatttttggtgttttaatatatacaaaatttactgacggattgtcatggagccaaagactgtgcccaattgtccctgtgccaaattgccgctttgccaaattgtccctgtgctaaattgtccctgctgtgcccaattgtccctgtgccaaattgctgctttgctaaattgtccctgctgtgcccaattgtccctgtgcccaattgtcccccggtcgatcccttttcaggtgttggacaacaaaatcggagagggcgaagaagtgccaaatttgaatgtgattagagaagatgacccggtgaacgaattccttggctttttgcactacgaccaaaaattgggccatcacattgccaaagcgtacaacgaaacagtgttttgtgccgccaaaaatcaaattcccaaaagggtggtcgaccaaattttacaactgaccttctcattggccattcggataacgctttgtgtgatgtgagttttgaaattgaaataatcaaaaagaacaattcctattgtatccttattaaattttgggcttttggcacaaattttgttggcactttttccattgcaaataatccttaattaattgaatatcttatcaataatatttggcaatttaaatatatttttttcacattacaaataccatccttagttatgagaattatttctcgcgtttctatgaagtcggtgggtggcaattggaacaacttttgtccgtttttcaaattttatcggcacaaagaggcggcaccaacgaaaatgggtaaaatatttttcttccgtttttaattttgtgatttgctattaattacttttttaaagaatttaatttaatttacagaatatttccttttcaaatcattcgcattgacgcgcaaaccaaaaaacatttttgggatgaaattaaagctaacagcgcgatagaaccacaatttattggtgggtgaacaaagcgattaaataaaatttaattacaattaaattacaaaggattatgaagctgctttcaataatttaatttttatacataaaaagatttttaatagttttaattagtttattaatgttgtatagcaaaatacaactatattaatatcattggaattgtaagctgtctattggtgatttggcaattattaagaaaaagttctagcattaatatgttcagcaatgaggaaaatcatacgtatctggatcattacttacgatttcgacgtacacagggtcaaaaaagtgggaaatagtttcgaacacgaagtcacctttgcagcggctaccgtcatctgcaccaattgtattaataatggagaatggaaaaactcactagagggaaaacaatgtgctatatgtggccccaaccgtacaattacattctcaccatttgattacaaagagacaacagtagatcaaaaaattgtcacccagcaaactctacgggaatttgtccaatggctactatttgaacaaaataaaaaatacccaactgtagcctttgcacactttgggggtcgctacgacatgacaatgatcatcaaggaagttattgcacaaggtacaatttttaatattcatagattatatattttttaaggtgttcacgatccacaaattatcaaacaaggaaatcgtctttatgaactcaaaattaaggataatgagcatgccccactaacaattttccatgacagctacaatttgatgcctatcaaattatcgggtctcatcaaatcatttggactcaaaattcaagtgattaattttcataaaaattatcaattttttttttgttttaggataaacaacactttccacacatgtttaacaaatcatctaattatgaaaatgttcttactaatttaccgccgcgcgaagaatactgtcccaatcaaaagaaaaaaactgatctgcaaaagttcaacgaatggtacaacaccaattatgaccaacactttgatttaaaagaaaaattgcccgaatactgctgcaacgacgtcaaaattctcacccacgccctcgtcgagttgcgccgggaattcaaacaattaacacaaagagaaggaaatcatggaggaattgacattctttggcaagccatgaccatagccagcgcctgcgtcaaaaactttgcccttaatcatttgagatccaactctctagctatcgtcccggagaaaggctacaccccacaacaaaaccaaagtgcactggccaacaaatttcttgactggtactctcacataaacaacgttcatgtacaaacggccagttcccgctacggagaatatatgttcaagcgcgaagggcaggtttatcaagtggacggctacattaaaggcacaaatgggcagcgggacaaaataattgaagtgaatggttgtttatggcatgggtgtgaggagtgttttgatgatatggatgaagagacgaggatgccaaacgggaagacactgggggagcttaggataagggaacagaggaaacatgaaatacttaggcggtacgtcgacttggaggtggtatgggagcacgagatcaataaacaaatgaagaaagacaaagagatgagggagtatttcgaaaactggaaggattgttcacctatcaaaataagagaggcatttcacggaggacggacaggaccaatgaaactaatccacacagcaaaaccggggcagaaaatcagctacaaggacttcaccagcctctacccgtttaccaacttctctacaaaatatcccctagggcatccaaaaattatttctttcacgaccaatgagcaaacggtcaattggcgttctccaactgacaacccctacaaaggattacttaaagttcttctccaaccaccagacaacaacgtcaaaatcactgtaatgccaataaagtttgatgagcgcctgctattccctctctgtgaaaaatgcgccaaagttattagcaacaaatacccaaaaggtctcaaagacgacaactactcctgcccccacttcaacaccaacgaccgcgccttcgtatcaacttgtactcatcttgaattaaatgcatcattggaggctggctataccgtcagaaaactttttcatgtcctacaatacgaccaatggagtgacaatgtcttcaagtcctacgtgagcgaaatgatggccttgaagatacacgctactggctatccatcatggtgtaataatgaagaggagaagagaaaatacattgatgagtgctggagaaaatttggaattaaaatagaggataacaaaatgaaggctgaccccggaaaacgatacattgccaagctttgcctcaactcactctggggccgcttctccatgcgaaatctcctctcaaaagcaataattgacaacgacgaatgcctgatccgccaatactctgacgataaaaagattgaactaattgatgtcgagctaatggacgaagacaacgacgtgtatatgctcacctataaacctaaggaagaatttgtcgacgaaaacaagtactcaaatgtcgtcatttccctcttcactacttcaatggcgcgactatacctctacgaagctctgaaaaaggtcgctgacgctcctggctgtgaaattctttactacgataccgacagtgttatttatgttcatcccgaggacaacgacccacttcccactggaaaaggacaccttggagagcttacggacgaaaaacctgaccacgatattttggaattcatcagtgctggctgcaaaaactacgggctgaagcttcgccgaaaggacaacggagaaattgaatatgatttgaaaattcgtgggtttactctagacgaacagacggtacaaaagatacattatgatagtgtgaaagatcaaattttacgctatggtaccgaagatcccgctgatcctatcattgttacttatccccattttatccgtcccaatcttatcaaaggcaaagtgtacactcattccttcacaaaacagtaccagcctattttcaccaaaggtattattaataattcattccaagttctagaatttggtcatcgcaaatgaattgtataattttctctcagctattttctttttagaatcaaatctccggatttttattgtctctatttatacctcactcgcattagggacgggatgatccctggttgatcctctccaacactccaggccatccatctgagatgaaggtggatgagctgctcattattgcaatgagcagcctggtgcgtgagtgtttggattggggaccgaaggctaaacccgatttccttggtgcgtttgagcttatatttaattgaatttaaatcccggagaattttgattttatttatttcatttgcatttattcaatttttaactgtacaatttgtctttgtaattaaaatttttaataaaaatattctttgagctcaaccaaatgagtatttaaggactgactgatttgaattagtaatcccaagattaaaaatgtcttcagtgtcctctaagaaagcccttcaatcagtagtcgctaaggatcccgaaatacatagtagtgaaaaaaccgcgcatgagaaggaagcggaaaaaactgtccgaaaatcaaaatatgagtataatttgcttgatcatcaacgcttcttctggaaattggcccgcccaaaatttgctgtaatgaatttcctatgcccaacgtgtcgtcgaattaattacaaacataaggaccagttcaagttgatgggagaagatgagttccactttacccaagtgatgtgccagggatgtgtcaagtacaatatgatgcaaactgatatttacattaaacacactaaaaacccacactaaattgtatttaagacaataatttattattatataagtatcccaaataaagatgattgatgaaaccatttttcgttcagaggacttaaaattaaaaataccttttggcatggtaattagtggtccatcaagcagtggaaaaacaacatttttgttaaggtttttgaatcaaataaatgaattagtagccccacacccaaagtcaattgtttattgttatggacaatttaatattagcatcccactgctacaaaaaatgggtgtacatgtgcacagagggccacccacagatgaaatactaagttctcaaaagaagccgctcatattaattcttgatgaccttttaacaataatagatgataaacatttgaccgaattattcactaaaaaagctcatcatttgaatatgggagtgatttttataactcaaaatttgtttgaaaaaaaggtgaaagtagcgcgaataaactcacaatatatagttttaatgtctgctccgaatgcagcgctacaaattcgtaatttgggtatacaattatttcctaaaaatcttgcatttttcctaagtgcctataaagacgctacttctacaccgtatgggtatttatttttggatttacaccctgcctcaaacccattattgagaattcgcacaaaaatatttaaagaagatgaagagaaaactctttatattaacaaccaaaatgcataatataccgcaaaatgttattaaaaatttggagtttttgaagaaattatcaaaaacaaaatctcaaaggaaacgtgaaataatatttaaagaagcaactaatgatcaaattgcattattaattgaaatttgttataacatattaaagggatattttttgcttaccaaaaaacaaaaacatagacttataccttatgttaattttataagaaaattaggaagagttagaacagaaaagggtgcaaagaaaattattcaacaaagtggaggagggtttattagctttgctccattacttttacctataattatcgctgcattaaaatatggaaaataaatttattcttgttccttccgacatgtacaaaaatttattaaaaccagacgccggggaaattaatgttgataatgctaaaaataaattgtcttcacttttgaagcagcgaaaattggactccgggacaaaaaatttactttacaaccaggaattgcgtcgtttcttaaaactaaggaaggaaatagaagacaaaccggtaaaggttgagctcaccgacggctcattaatggtttttaatccaagacatcgcgaaaaagacagaaaaattcctacacagattgtgaaggaagatgatgaagaagaattggatgaaacgggatctattccaacgtttgaagacccttatgcgacagctgaagagagtgatgcggagcctactacaacaacaacaccaaaatcaagaccacttttcagacctttacgtattgggacaagtaaatttcgtcaaaagcaaaagtctttcatagataggaaacaacaaaaaattatgtcgattataaataatgaccctgaaaaatttggggttggctctagaggacatatactgagagctgatggtacggcatatttaaaaagtaatattaaacaagcattagagcgaatacttagacggtcacccgagaatgctccatcacccataggtacaaaaactttagagcaacgactgagaaacgacccgaggactagtggaatattaaaacaaaaatttaatgaacaatcgggatcgggccttaaaaataaacaacaaaaatttataattaaaaaatggagaagttactaaacaaattgtataatgacccaaattcacctgcgtgttatgcagggcaggaaagactttacgaagaggcacaaaaatatgactcttcgattacaaggaaagacgttgaacactttctcgagggagacagaacatatactttacataaacctaggcgtgttcgatttaagaagtcaagaactgtgcccgctggattcatgactgatgttcaggtcgacttggcagattttcaaaaattatcaagagaaaataatggattcaattatatattgttgggtattgatgtgttgagtaagagggtatttgctacaccggtaaagtcgaagaatttcaaacatatgagagaagcgtttgacaaattgatcagtcaaatgccaatggttcctcatagaatattttcagatagaggaacagaatttgaaaatagagaaatacataaatatttccaagagaagaacatacaaaagcacaaggctcatactagtacggtgaaggctgcgctagccgaacgttgcataagaacgcttaaacaacgactatatcgttattttagtcaatcacatacaattaaatgggttgacgttttgccaaaaattgtaaatgctttgaataactcaaaatcacgaatcaccggtatgaaaccagttgatattaacccggataatgctcaaaaaatttggaaaaaggtctatggaaatgaattttcacgaaaaacttatagaagaccaagatttaaagagggggatcatgttagacttgcaaagtataaatccagttttgaaaaatcataccttcccaattattcggatgaaattttccaagtttatgatattaaaaaagcaaatccttatcggtttgggataaaagacgataaagaagagccgtttgacacccgattttatgctgaagacttggccaagaccagaaaggacgcggagacaacatacagaattgagagggtgctgaagactaggacaagaagtggacataaagaacatttggtgaaattttacgggtacaaagaaccggagtggattaaagacaatgatattgagagatgaatgtatttaagtgtattgttattatgttttagaaaaataaaaatgtcaaatttattttacgttcttttacctagtga

SEQ ID NO: 1003 - DNA, 634 bp, Heterodera glycines
aggactcgaaggggcaaaaggcgctggcgggggaagaaccttaggaagtgaaaacgcgaacctaacaatagtggaaccaatttcactgtactttttacacagctgtagtcagacattgtaaattttggcatcatttacgatttaagcattcgccggttcgttaattaatttgtcgtgttgtgattttctgtacttttcccttaaaattttttatcctaatttagcgactcatcacctcccttcctacatcaacaataatttcattgtttttttcatttcgttttattgaataaaataaatctctaccctttccatctttttcttgagttgctttttctctttcacttttacaacatatgttccacttgcttcatagatttttatttcttgatgactgctcatttggccacgcccgattatcgcattgaccatccgagtgtttatcctccttccgaggacacttttttgttgcttgatgccctcgaagctgaacaattggtacatacattaattgcgaagtcgacaatgaaattcttcggcaattgtgaagatcattggtcccgaaattttttaattttatttttttatcttaaaatgttttaacacttttctagggttgctatgaggagctgag

SEQ ID NO: 1004 - DNA, 3196 bp, Heterodera glycines
acgaaaattttaaatcctatcgaatgaatttggaagggaacggcttggcattgaggggaccgtggtgatggagcgacagtgtcggaatgaacatttgttcgtgctccgtttcacccatgcaaacgcggaaattgctgtcccaaccaccgccggtccatcgtctgccccgacagcgaaattacccgtcgccacaacagcagctgaaacaccgcctcctgcaggcagtggcaacaccccaaagacaccgtccaaaatcaccatccacctgagacctgtcggcagcgcaccgcaacttgaggcccagtacagaaaactggtcacaaactctggccagtcaatcgcccacatcactgtaccaaattaatttaactgcttatattgtccccaattgagacatttatttttgcttttatttgagtgttccctttagcgtgtgcttaggaaatggctcggccttggtcccaccgattcgctcttcttgttcgtcaacgaaacgttcgccccttttcccgagcataccattggcaatctgtacgaatgttttggatcacatgacagtcggaaattgtacctccaatactgtttgacaccagcatggggatgaaataaatatatgtaaagctcccttcaataaaacactttattttcatgctaaaaataatatcttatacggtccattaaaaatcgttggaaaaatgtacacactaagaggaagcgcttacttttacctacaaaaagttgtttaaaatactatgtatattattaaagagcaattagttgaacatccccacaatcagccgtccatgggaggcaccgattcattatcgcgctcctcaaaaggtgtttccgagtgggaagactcggacaagtcggaccttaagagacgagtacaacatctttggccctaatttgaagtgtacctgtcggatgacgacgaggaaccctctctgtggtccgcagcagtgctcaaatgcattccttgcgcgtggttctgacgccctccgactccctcagtcgaaacacactcttcctgctgttggttgttgttgttattgtccactgcctcctcggtctgtacattcgctgcaattcgttcaacaattgaatccaaagcattttgagacgaggccaaaatggacgacgaactcggcacaccaatggacggaggcgaaatgttgtcttcaatggtctttgtgacgatacgtcgcagtcgggcgagccgttcctcctctgagacactgtccgtttccattgccggacattcaaaatgtacacagtggaacacttcgttggccgaattggatgtgcctgaagcgatcgcaaattttgctttttgagattaaatcgggttcttctatcaccaactatgcggatgaaaacgaccggttgtcgtataaaatggacagtttgccaactcctgcaaatgttttcattaattaagtgtatttttcatttgttatcaattagtaaagtgtgttcgttgtacctgcgctcattcacgtccgccactttcatccatttgcattggtccgtggacacttcgatgaaaaatgaataacaccgatcgatcatcgcaatcccaaagcaaaagcctggacacaaaatgaaccttttttgtgttttaatggatgggaattaagtgcctcatcgtttccacaagagacggctggggaagttggacgaccaaagcgccgctgcccaattggtggcaagtgtacctgaaacatatttcaccaaaatccacatttatatcccaaaattaaaattcatgtggcctaaataaggaattcaaaaaaggtttttctttttgattccaatactgaccaggtgtaaatttgaagttcgtttggagggacggtaccacgcgaataatcactggtcgaattatgacgtccatgggcacaaaaaatccgtagtaacagaggacaaacctaataaattcacatgaactagtatataaaataattattaaatatttaccttttcacggtcgatggttttctcaactggcacttccacttgggacacaacttgtgcagaagccattttcaaaatataaaaaacagtaaaacacaataaaatatcaagagaattaattctataaaaatctttatttaaattaaaacttaaatagagttagtccaaaaaaaattccgcgggaatttgtatggtactgtgcggcatattacaaagatacaaagcgataccgattcagttttttttaattgaaaatttttaaatgtttattacgccaaatagcgtattttgcatttttaaatgaggaagaaagtaattaggtagcagctacttatctacgtctacctaatcttcggattcctccaaacctaaaaatcggaatatgagctcaaaatctcattttctaatgaaaattttctcattccagaaaattaacggtaatactgccgatggtagccccccttttttgaagaaatttttttttgttttcaaaagtcatgaaaacatggttccaatggttttcagggtcgctgatcacgaatccggcatccatttcgactaatttcgaaccccagacccgaattcgaaccaaaatgtcgaaaaatcagattttcgaatttcacatttttggtttaaaaaaagttttaatattttattgaaccaaggatgactttcacttcgtttccgtgtatttacacagcgtccgggaaatgagctcctgtaccagaaaagatttgcatgtgtggctcagtggtttttgtaagatagtaaagggacaaagggtggtggctcaagtccgttgtgcaacatgaatattttcatttatttttgtcaaaatattaaaaaatcacgatatttgggaattatttttgaaggtttttgccaaccaaattggataatcttggtatctttcgaaagctcttgataatgagaagctttttctaagcaaatgctaagcgatttggtgtaccagagaaaagttatgaggctctaaaattttgtttttcttataacttttgaaatagagcattaacaaaaataaattcagcattaatagatgcagaatttttttctctaacgatatgcaaaatttcctatggatctaacatatacaaaataagctaaacatagcgaagtaaatgttgtttttcctaataataaaaatattatatagtacgacaaaagaagacgaaaaatttagagaaaaaaagataatgtt

SEQ ID NO: 1005 - DNA, 5788 bp, Heterodera glycines
  misc_feature (5764)..(5764): n is a, c, g, or t
gggtgcaatttgttaacagattttcaacaaaaaaggttggttttttgcgattattaagctcaattggtaggattttcatttaaaaaatgataaaatatgtatcaatttaaaaaaaaggctatgaggaatcatattttctttataggaaacccacgagtatacaaaacaaaaaattgaaaataatctaatttctgtagagggattgaaccaggggaaagaagaagggaaagtcgaggagactaaccattaggccatttgcacacttgggcagtgttacttttaaagaataggtatattaattattattttttatttttccctttgactccaattttcttcactaatttttcactcagaccccattcttaccagtgcttgtttttcccggttcccggttgccctaccgggaccgggacctgaacttttcaaaacccgggacctcggatgaccgggaattcccggcccggtcccgtggcactctaatacaaagcgataccgattcagtttttttaattgaaaaattttaaatgtttattacgccaaatagcgtattttgcatttttaaatgaggaagaaagtaattaggtagcagctacttatctacgtctacctaatcttcggattcctccaaacctaaaaatcggaatatgagctcaaaatctcattttctaatgaaaattttctcattccagaaaattaacggtaatactgccgatggtagccccccttttttgaagaaatttttttttgttttcaaaagtcatgaaaacatggttccaatggttttcagggccgctgatcacgaatccggcatccatttcgactaatttcgaaccccagacccgaattcgaaccaaaatgtcgaaaaatcagattttcgaatttcacatttttggtttaaaaaaagttttaatattttattgaaccaaggatgactttcacttcgtttccgtgtatttacacagcgtccgggaaatgagctcctgtaccagaaaagatttgcatgtgtggctcagtggtttttgtaagatagtaaagggacaaagggtggtggttcgagtccgttgtgcaacatgaatattttcatttatttttgtcaaaatattaaaaaatcacgatatttgggaattatttttgaaggtttttgccaaccaaattggataatcttggtatctttcgaaagctcttgataatgagaagctttttctaagcaaatgctaagcgatttggtgtaccagagaaaagttatgaggctctaaaattttgtttttcttataacttttgaaatagagcattaacaaaaataaattcagcattaatagatgcagaatttttttctctaacgatatgcaaaatttcctatggatctaacatatagaaaagaagctaaacatagcgaagtaaatgttgtttttcctaataataaaaatattagatagtacgccaaaaggagacaaaaaattagagaaaaaaagataatgttttctctggcactctctatttattggtacacatctcgttttttcggacggtgtgtttagactaagtttgaaccaaaaataaaattcaaagatttgaattttcgactttttgttcgagttcgggtccggggttccgaattggtcgaaatggatgccggattcgtgatcagcaccctgacaaccattggaaccatgttttcatgacttttgaaaacaaaaaaaaattggcgctatatgttatcatggttttttatcacaaaaaaattttgcaaaacaaaagggtcccaccccttttgtttcaaaaaggcccactttccatatagcgccaaaaaatttcttcaaaaaaggggggctaccatcggcagtattaccaaattaactttaagagtattaaatggctggacccgactctcgttttattctcgaattcttcaaccgtgaggctaaagagattggagtaacgcaggaattgcttaacaattcacaggtttttgactttatgatcgtttgaattttatttttttttattcagcagtccgatcagttgatccaggcctactactttctgtgtgatttgatttttgaaaatgtcggcaccaccaaagagaacgagtgtgaagtggccactgatctgacgagggctcgtcccaagatgatcatccgaacgcaacagcataggtacgttggtttttgttattttgatcttacaattagtattttcgtatagttttatatacattgcatccacaatttgttcagcaatttggtgttcaacaagttgttcgatggttctaacgaatttctctactccgatctattgcaaccggacccccgcagaacgaagatgcacattgctcaactgattcgcttgtacaccacaaagtgtgacattgccaaagagctttccgcggtggacaatcacattgtgagtgtataatttggcggagtttactagttttagtttatcaattgggctaatttattcggaatttacaaatttaaggatgaacaaatgaaagcgcatgactttgagaagaactgtgaacgttccacacatgctgtatgagatgatgtgtaattatacgcggaagagtttttcccttttagcaactgaaagatcgcgaagaagcgcttaaccgcatggagacgcgaaatgacgaaatgggcagcaaagtgcgacgactcaaggacaaattgaacgatcgacaagcgctagcggaggatgagaaaagaaatgtcgaacgcattgacaaaattttgttgggggcacagtgcgaaaatgcaagtgaaaaatgaaatgctgaaaaaggggcggaaaattgtcaaaaactttggatttattaacatgttattagtgatttttcgcttatttttaataaaaattataggacgaatgcaagaaattgtttgcccaggaagaggaaaaccgcaagcgattggacaacaacattgtgaactcaccggaacgcatcatcgaagagctgtccaacatggaggtcgaagtggaggacatccgtcgcaaaaatgatcaagcagtgtcagttgtccattcgttcggtttttgtaattggtcatttattttgttaggcaaaacgaccgaaagttggagagggaatacggcgaacaacgcgtgaccagccaatgcgtggagagtctgatcaacggcatgcaacaattggagatgatgcaggaacaaatggtggagatgcgggcgaaggaagaagagcgacgaaaggtcgtcccatttggtgatttaataccaatttaatttatattattaagcaaatggacgacttggaaatgacccgcaaaaatttggtggccgaaattgaagtgttggagagacagtcgacgaccgacttggaatcgttggggggcgaagtcaaccacagggctaagtcgctggcgatgctcaaccagcagaaggcacagctcgaaaggtgccgctgccaatcagtgggatttggagagagttttcctgaaattgcatcaatttttattcccatttaaacctccctattttattgggaaagtaatttaacactgaccatgagagaatcggttcatgaattctaaatttaaaagttaaataggtaactaattaattattcagtgatgaaaaggagttggccaagcaactgaaggagaagaaggacgacattcgccagcatcagcaggagatcaagcgaaaagaccgttctttcatcattctcaccgacacttacgacgattccgtggccaaacttttcaaaaatttgagccttgtggagcaaaaggtgtgggaaagggcgtccttttgtcttataaatccggcaaatatgaaaacatatggcggaaaatgtgattttttcgtggtcatttttcaggttcaagtgagtcgctcgaaccttctcagcctgttcaacgagagcgaaatttttggtccgttcaatcagtgaaatgataattattatgatggtggtgaacccccattggtctcgtgtataatttctgatcatgaaatatctcttcggttttgtatttttttatcgtttatccgctgacactcacatttattctgccaatggtaaaagattcttgctaattgttttggtccttataataattggctctattgcactttaaccgtcccatcagctgattttctctgttttcttggccataactttttaaaaaactgaacacaaaagtcaatttgggagcctaaaatgcaagagcccaacagtttatgttaattgggacatttggaaatcctgtctaatttaagagtgtgttttgcccatggcaagtgataattaattaattacataattaattgcctgttttccatatatttttttttgtctttccgttggccaacagcaggtgaaacacccgtcgcattcttctaatttccgttgtcccccggggcgttctcccccccccttttcccgccctttcagacgattttcccatggccaaaagattcgttcgtcagtgttaattaattttccattaattacgccattatcctttttttttctccggcaaaatgttcagtaacattttgcagattttcttcaattatttcaaacaattaatcatttttggactaaatcatcgaatattaatagaaattcagatttgattttcacatcactttttttcggagcgctttttcaaaaaacttttgggaaagaaggggtccggcggtgccgataggcgccgccgggggaaattttagaaatttgggtgcaatttgttaacagattttcaacaaaaaaaggttggtttttgcgattattaagctcaattggtaggattttcatttaaaaaatgataaaatatgtatcaatttaaaaaaaaactatgaggaatcataggagactagccattagaccatttgcacacttgggcggtgttacttttaaagaatatattaattattattttttatttttccctttgactccaattttcttcactaatttttcactcagaccccattcttaccagtgtttgtttttcccggttgccctatcgggaccgggacctgaacttttcaaaatccgggaccgggaacccggacctcggtacccgtatgcataaagatcggatcctcggatcacgacccttattacaagggaaaataggatccgaggatcggatccgtagatgaggctcacgatccgtatgcataaagatcacgatccgcgatccatggatcatttttggtgatccgcggctcaggatccctatctacctccggagtaggattggtgcgcggatcgagtgagaaaatttaaaaaaataaattttttaaagatgaaaaattaataaatcagaaagatttatcattttttggcatgaatagaaaagaaaaaataaaataaattacgaagagccaccaaaaaagttttcggcaatattattgcgcaaattaaaactgtcaagcgatcgaaatgtaggaagtgaattaatttggaggagagagggctgattgtcaacaaaagtttcattaagaaaatctggcaaattgcgatcgattgcaatgttgtgcagcacagctgctgccgtgatcaatgttggcacattctgcaatttaattcgtacttcggaatgtaaaatatggaatcgccgcttccatctcccaaatgcattctcgacaataacccttgtttttgcatgtgcataattatattgttgttgagcagcttcccatacgtttgactggcggagaacaaggcatcgtggctgcaaccagccattggcaagaatgtttgaaatcggccattgtgatcgancacacctaatcacattgctaatga

SEQ ID NO: 1006 - DNA, 2541 bp, Heterodera glycines
  misc_feature (2521)..(2521): n is a, c, g, or t
aactcaaaataatttaaaaaatactactaacaaattacgtttattaatcatattcaaatataattagttaaaagattaaattaaaaagcaatataaaatattttgtttgcttaataaaatttattttgctttgcttgattgctgtggctttgtgtgtatacggtttagggccgaaacacaaataataattaatttaaataaattaacccaaagagacaccgtactgatgaggcccggtctctttcggttaaatttgcacgtttcgcgaagtgcccatttttgcactgtcgcgaagtgcccaatttttgcatttttcgcgaagtgcccaatttttgcactgtcgcgaagtgccctttttgcacttgtcgcgaaatgacgtagcacccgcggatcgagtgagaaaatttaaaaaaataaattttttaaagatgaaaaattaataaatcagaaagatttatcattttttggcatgaatagaaaagaaaaaataaaataaattacgaagagccaccaaaaaagttttcggcaatattattgcgcaaattaaaactgtcaagcgatcgaaatgtaggaagtgaattaatttggaggagagagggctgattgtcaacaaaagtttcattaagaaaatctggcaaattgcgatcgattgcaatgttgtgcagcacagctgctgccgtgatcaatgttggcacattctgcaatttaattcgtacttcggaatgtaaaatatggaatcgccgcttccatctcccaaatgcattctcgacaataacccttgtttttgcatgtgcataattatattgttgttgagcagcttcccatacgtttgactggcggagaacaaaggcatcgtggctgcaaccaggccattggcaagaaatgtttgaaaatcggccattgtgatcgacaacacctaatcacattgctaatgaattattcggtccattttatatgtattgtaccttggacgttaatcgaggggtatccttttcgattaaaatagtccttttcgtgagcggatgctggaggaataattcgcacgtgtgtacaatcaatggcgccaattacaccaggaaaattagcaacattataaaagcttggtataattatttctctggcctgcaaagggtactaattttttgaccaaaattcattcataattccggtacttgttcataaggagcaaaataaatgaattttccagccaaatttcgtaatgctgtagtaactcttagcactgatcgggacactgtagattgatcaaatcccagcaaatcaccacagatcatttgaaaagaatttgatgccaaataagcaagagttgcaacaacttgcaactctaccggaattgctccccctctcgaacggccgttagactcaacttcttcacgcaccaaattagtaatgtacttaatttacttttctaaatgaatttataaaaatggtacttttatcccttccctgtcaaatcgaaatctcttatagagatcttgatcagacatttgggcgagaatttctgccctctttcggtaaatttttaccgctgtttgtgtctcaattggggcacacattgctgcagacaaaaaagtttattaaaataaactgaaaaaaatacaaagtgctaaaacgcaccaattaataaatgaatgtagcattatttaattttctttctcatttgaatgctttccacgaaaaaattcgcgaccctcagtaaaaaatgtcttagcatcgtcaagaacatcctcaaattttttaaaaatttcttgtttttttgtcatttctttcaattgcatctcgagaacactccgctgcagttccattacatcagcagctgtaacagttgaagcagttccggcacgagatcgtaatggcacgcgagaggtgcttgattcaaattttggagttttcaccgcctctccgcgtggcacagtgccaagaacggcataggactttccttcttcaacaacaacttgctgtgaggaaaattcggcactttcctcttgttctttgccttcaaagaaaatggtgtcgccgatgatgagaccggtctgtacgccgccgggcactcctttaacaaacatctacttacacattagctcgaacacatatctaccctcaaatgccggtgaatcagcaaacaattgggaaacattgcgcgaaacttcagtcatttcgaatttcttgccaccgcctgtggcacgctgatgcctaaagaaaatgctgaaacccagcacaggcgcacatatgattaactttttttcggtttgtcgttcgtccttggccctttgttttagatttttgaattttgtttggatttctgcaatcgttaagccgccctggggcacttcctgaggaaactcacgattcatagaatcagtgacaaatttccacgcctctttttgctttcgtttgcttttgcagttcgagttggagggttcaaatcatcttgacgcgattgaacaagttcgatcaagcgagccaccatggcttcattgaatcgcgccgccattaataattntaattttttggggaaattga

SEQ ID NO: 1007 - DNA, 1278 bp, Heterodera glycines
  misc_feature (83)..(83): n is a, c, g, or t
aatgtagcatatttaagtttctttctcatttgaatgcttccacgaaaaaaattcgcgaccctcagtaaaaaatgtcttacatncgtcaagaacatcctcaaattttttaaaaatttcttgtttttttgtcatttctttcaatgcatctcgagaacactccgctgcagttccattacatcagcagctgtaacagttgaagcagttccggcacgagatcggaatggcacgcgagaggtgcttgattcaaattttggagttttcaccgcctctccgcgtggcacagtgccaagaacggcataggactttccttcttcaacaacaacttgctgtgaggaaaattcggcactttcctcttgttctcaagttcgatcaagcgagccaccatggcttcattgaatcgcgccgccattaataattttaattttttggggaaattgatttgggaaaaataagaaagaatggcaaaagaaattgttttgatgtaaattcaccgccatcaaaaacatagtttgggtaaacaatctttcagttattgatcatctaggttaatccataaattatgcaacaacaaaaatacaaaaaacccaaatatttaatattcatggtaaataaagtgatccacggatcaggtcgatttagaggaaaggaaaatagcgttggatttgatgagaactactgaggaaaagaaaaggaatacaatccacggatcgagatccatggatcacccaatccgatctttatgcatacggattttgatccacggatttttcgatcctcgaatcagtgattcgtggatcacgatccggggatccgatcctgatctttatgcatacgggtacggatgaccgggaattcccggcccggtcccggtcccgtggcactctagtaaaaatagaagagccgatctcgagttagaaaagaaactcaaaaaacaaaagagaattcaatagagtgggtcgaaatatgggcctatgcaaaatttcaagaaaattggtcaataggaaaattttttttcaaggacaaagttttttttttctctcattttgacgtactatttccatgtctctaacatataaaataacacataataatttatttgtcaataaacaatttttttaacttttgactaacttagaaatattcttcagaattttcccttcaaaatgagcataaaatggttttatttggtctagtagtgacccagttataagctaaaaaaaattcataaaatcagtggtaaaacattgtgtctaacttttactatttgtatttgttctt

SEQ ID NO: 1008 - DNA, 6545 bp, Heterodera glycines
ggacaaattcatggatggaggtaggcaaaaatagaaactattcaattattataaataattaactatggatgcatgaaaaatgataaaaatcacaaaatttgatcattttttagtgaaaatctgtcaacaaattgtaatcaaattttcaaattttttcgcggcgccgcctgccccctcttcacaaaaagttttttttgaaaaagcgcgcctcaaaaaagcgttttattgatttttaaatttggaataaaatttaaaaaaatgatttttgctttatgattttaattattaaaaagttgtagaaaaaatttcgcattttcgcatattttagcttttcgcatttcgctttttttcatttcgcattttttagtttcgcaaatttcgctttttatttttcaatttggcccatccctgctaaaaagtaataccgtttttgcacccaaacttcccccctcccattcactattgatataaaataatgattttgaggtctgctcgcaaacaatccaagcctggaactgttggatgaaataagcaaggaaaatgcattggcaaaacaacacaatgtatgcagcagttgaccagttttatttagttttttttcaatttttacattttcaggaaccccagtatgagctggagtgttttgtttcgcttggcactggcaaggcaccgactgaaccggttggcacaacatcgttggagattgggactgaacttattggagcaattaagaatctggcggggattttgatggatcaggtacacacacacacacacactatatatatgtgtgtgtaaagcaaatcattttaaaactaatttcaagctggggttgtatatttccccttcctcacaattgtttctgaaataattgctttttttggaattagactcaaaattttcaatcgaaaaaatttgagtgcgtttcaggcctcccacagtccaggaaaaaaatatggatttccatataattggaatccctaattatgacccctcgaaaatggtagaactttgggcgccatggtgccgataggcgatgccagaaaattttgattttcattgaatttagttaagaaaatgttgcacgcactttgaagtcataaaacgaaattttttgcgatttttcaagaaaaaatttgtttgttttttgaaatttttaaagtttttggtagcagttttgcataaaaatggccagattagatcattttaacaatcattctcatacatatgttttccttttttcacatagaattctcttcttatttcggttttgattttagcttacaaattttctacaaaaaattttcatggatttggacgcattttttcgtttcttcgctggggtttgcaatttattttaatgtttgtcttaaactttttttttgtccagccgcgcagcagccagcaccaatgagtatttacgaacgctttaacaaggaagtttgcgaaaaaaacccttgagcgtaaatctaaaaatgtacatttagttcttaaaaaattggttgcgatcaaatactgtggagtcaattaacgcaagaagcgttgaccacggaggaaagacgcctttgatttgcgccatacagcgtgaatgtttgttgttttttctatttaaaaataatttttatttgcacttttaatagcacctcttgcgtgcacgatgatgattttggcgaacggagcgggcccgaacgcgactgacagcgctgccatgttgccattggcacatgtgttggaggttcgttagcgggcaaaaaacaaattgcttgaggggctaataattaatttgtgtccgttttttgcatttttactgtgaattctttgaatttttgttggggtccggatttagttaggggtgcagaatgactaattgagtgaatcgtattcagcaattactaaaaccccttaatgcgtttccatgatttttttgactttttgaaaatcgtggtagagttttcccaattaaaatatcaccaaataagtattatttggtaaaatttagaaagttttaccaaaaattatattttcacacattaaggatgaaacaggcaaattccaaattgccaagttgttgctttgcttccatgcacgttgaatgtgccggccggaaagagagacaaaatgtattttaattcttatttttgattgttaacattgaatactttagcaatgaaaaggcattggcgaagctcgtggccaaactgaacaaacaaaaggtctcagaaatttttgtttcatattttccacttggaaaattctttttttttttttgctttaatttatttaaacattttttgtttagaagaaaaagacgggcacaaaatcggaagagtcgaccgttaaaaagccagagtgtgtggatgttgaggaagcaattaggaatgagtgcagcaaatggcactgaaaacgagaagaaatgaacaaaggaaaaccccgagacgcaagggcacgggcgtccgagcactttcactggacggtggcggaattcgaggcattgtattagtgcaggttttgattcgggactttttaattaaaaattaaattttcgattaacaatttgcgacttaaataattttttcctgcaaatgaaaaattggggtttactttcttgacaaacagttaaaaaacacttccataaaaaccatattttttaaagaagcatccaaaataaacaccaatatcattcgataaacctaggtcttccattctcctgcaaaattccaaaaaattcgttctgcttcaaaaaagtcattgcccgaaaacctcaaaaaaaattttttatctaagcattttgtttataaattttccgaaacagagaatattctttaaaattttgcatcctaataaagttatcgaatgatataaagaatgtttaatttgagtgtttctttaaaaagttgtgatttacttcatttgcaaaattatttattggctggtcttttttatggtcatgtcaatgcaatagagcggcttaccaccatatttttcgctatgcttatcccttatcaaatttgcagatgttaattgaaatggagtcgctgatgtacggcgagggtttgcaagcgggtggccatgaaaaaaacttcgtacaaaagaacttcaattgggttatcgggacgagcaccggagcggtgagagcaaaaattaaaattatcagttttaacttgctaagtatcatatttgtgcaattttgggtctgatttcaaaaaaatgcaaacattggagggggggggggggtggcggtgaagagaaattttcgaaaatttgttaatgcattttccaattaaaaaaattatttgaactgatcaattaaagatgttggacattgcgaatttcagatcgttgcgttggcacttgtctcgggcacctcactgatcgacgcactgtgagtttttgggagatccattttaaaattggatagtcgcagaagagccatttatagttttttgaactttttgaaaaattaattttttttttgtttttgagtgatggtcatcagtgaaatttttaaaatattgatgactcagaacatttgttattggtctctgccaaactgaatattttttcagagggctgaaaattgggtaagcccgtccgtttgttagcctttaaattgggaaaaaattttgctattagaaaattttcaatttttttggttttgctttaatgaattttcaaaaaaaaattgcagattgtttactaccgcaacatacgttggccaaaaaccttcccgacttgtcaaattcgaaacttcacttcggacctcaacgaatacaacccatacaaaaccaacatttggctagcggcgcgctattcaagtgcggcgccaacgtactttgaaagtcgggacaaattcatggatggaggtaggcaaaaatagaaactattcaattattataaataattaactatggatgcatgaaaaatgataaaaatcacaaaatttgatcattttttagtgaaaatctgtcaacaaattttaatcaaattttcaaattttttcccggcgccgcctgccccctcttcccaaaaagttttttttgaaaaagcgcgcctcaaaaaagcgttttattgatttttaaatttggaataaaatttaaaaaaatgatttttgctttatgattttaattattaaaaagttgtagaaaaaatttcgcattttcgcatattttagcttttcgcatttcgctttttttcatttcgcattttttagtttcgcaaatttcgctttttatttttcaatttggcccatccctgctaaaaagtaataccgtttttgcacccaaacttcccccctcccattcactattgatataaaataatgattttgaggtctgctcgcaaacaatccaagcctggaactgttggatgaaataagcaaggaaaatgcattggcaaaacaacacaatgtatgcagcagttgaccagttttatttagttttttttcaatttttacattttcaggaaccccagtatgagctggagtgttttgtttcgcttggcactggcaaggcaccgactgaaccggttggcacaacatcgttggagattgggattattggagcaattaagaatctggcggggattttgatggatcaggtacacacacacacacacactatatatatatgtgtgtgtaaagcaaatcattttaaaagtaatttcaagctgggtttgtatatttccccttcctcacaattgtttctgaaataattgtttttttttggaattagactcaaaattttcaatcgaaaaaatttgagtgcgtttcaggcctcccacagtccaggaaaaaaatatggatttccatataattggaatccctaattatggcccctcgaaaatggtagaactttgggcgccatggtgccgataggcgatgccagaaaattttgattttcattgaatttagttaagaaaatgttgcacgcactttgaagtcataaaacgaaaatttttgcgatttttcaagaaaaatttgtttgttttttgacatttttaaagtttttggttgcagttttgcataaaaatggccagattagatcattttaacaatcattctcatacatatgttttccttttttcacataaaattctcttcttatttcggttttgattttagcttacaaattttctacaaaaatttttcatggatttggacgcatttcttcgtttcttcgctggggtttgcaatttattttaatgtttgtcttaaacttttttttttgtccagccgcagcagcagccggcaccaatgagtatttacgaacgctttaacaaggaagtttgcgaaaaaaacccttgagcgtaaaactaaaaatgtacatttagttcttaaaaattggttgcgatcaaatactgtggagtcaattaacgcaagaagcgttgaccacggaggaaatacgcctttgatttgcgccatacagcggaatgtttgttgttttttctatttaaaaataatttttatttgcacttataatagcacctcttgcgtgcacgatgatgattttggcgaacggagcggacccgaacgcgactgacagcgctgccatgtcgccattggcacatgtgttggaggttcgttagcgggcaaaaaacaaattgcctgaggggctaataattaatttgtgtccgttttttgcatttttactgtgaattctttgaatttttgttggggtccggatttagttaggggtgcagaatgactaattgagtgaatcgtattcagcaattactaaaaccccttaatgcgtttccatgatttttttgactttttgaaaatcgtggtagagttttcccaattaaaatatcaccaaataagtattatttgataaatagaaagttttaccaaaaattatattttcacacattaaggatgaaacaggcaaattccaaattgccaagttgttgctttgcttccatgcaaagttgaatgtgccaggcggaaagagggacaaaatgtattttaattcttatttttgattgttaacattgaatactttagcaatgaaaaggcattggcgaagctcgtggccaaactgaacaaacaaaaggtctcagagatttttgtttcatattttccacttggaaaattctttttttttttgctttcatttatttaaacattttttgtttagaagaaaaagacgggcacaaaatcggaagagtcgaccgttaaaaagccagatgtgtggatgttgaggaagcaatttggaaggagtggcagcaaatggcactgaaaacgagaagaaatgaacaaaggaaaaccccgagacgcaagggcacgggcgtccgagcactttcactggacggtggcggaattcgaggcattgtattagtgcaggttttgattctggactttttaattaaaaattaaattattcgattaacaatttgcgacttacataattttttcctgcaaatgaaaaattgaggtttactttcttgacagacagataaatgaacacttccataaacaccatattttttacagaagcatctagaataaacaccaatatcattcgatagaactaggtcttccattctcc

SEQ ID NO: 1009 - DNA, 5680 bp, Heterodera glycines
tttgaaagtggggacaaattcatggatggaggtagtcaaatatagaaactattcaattattataaataattaactatggatgcatgaaaaatgataaaaatcacaaaatttgatcattttttagtgaaaatctgtcaacaaattttaatcaaattttcaaattttttcccggcgccgcctgccccctcttcccaaaaagtttttttgaaaaagcgcgcctcaaaaaagcgttttattgatttttaaatttcgaataaaattttaaaaaatgatttttgctttatgattttaattattaaaaagttgtagaaaaaatttcgcattttcgcatattttagcttttcgcatttcgctttttttcatttcgcatttttcagtttcgcaaattttgtttttatttttcaatttggcccttccctgctaaaaagtaataccgtttttgcacccaaacttcccccctcccattcactattgatagtgaatataaaataatgattttgaggtctgctcgcaaacaatccaagcctggaactgttggatgaaataagcaaggaaaatgcattggcaaaacaacacaatgtatgcagcagttgaccagttttatttagtttttttcaatttttacattttcaggaaccccagtatgagctggagtgttttctttcgcttggcactggcaaggcaccgactgaaccggttggcacaacatcgttggagattgggactgaacttattggagcaattaagaatctggcggggattttgatggatcaggtacacacacacacacacacactatatatatgtgtgtgtaaagcaaatcattttaaaactaatttcaagctggggttgtatatttccccttcctcacaattgtttctgaaataattgctttttttggaattagactcaaaattttcaatcgaaaaaatttgagtgcgtttcaggcctcccacagtccaggaaaaaaatatggatttccatataattggaatccctaattatgacccctcgaaaatggtagaactttgggcgccatggtgccgataggcgatgccagaaaattttgattttcattgaatttagttaagaaaatgttgcacgcactttgaagtcataaaacgaaattttttgcgatttttcaagaaaaaatttgtttgtttttttaaatttttaaagtttttggtagcagttttgcataaaaatggccagattagatcattttaacaatcattctcatacatatgttttccttttttcacatagaattctcttcttatttcggttttgattttagcttacaaattttctacaaaaaattttcatggatttggacgcatttcttcgtttcttcgctggggtttgcaatttattttaatgtttgtcttaaactttttttttgtccagccgcgcagcagccagcaccaatgagtatttacgaacgctttaacaaggaagtttgcgaaaaaaacccttgagcgtaaatctaaaaatgtacatttagttcttaaaaaattggttgcgatcaaatactgtggagtcaattaacgcaagaagcgttgaccacggaggaaagacgtctttgatttgcgccatacagcgtgaatgtttgttgttttttctatttaaaaataatttttatttgcacttttaatagcacctcttgcgtgcacgatgatgattttggcaaacggagcgggcccgaacgcgactgacagcgctgccatgtcgccattggcacatgtgttggaggttcgttagcgggcaaaaaacaaattgcctgaggggctaataattaatttgtgtccgttttttgcatttttacagtgaattctttgaatttttgttggggtccggatttagttaggggtgcagaatgactaattgagtgaatcgtattcagcaattactaaaaccccttaatgcgtttccatgatttttttgactttttgaaaatcgtggtagagttttcccaattaaaatatcaccaaataagtattatttggtaaaattgagaaagttttaccaaaaattatattttcacacattaaggatgaaacaggcaaattccaaattgccaagttgttgctttgcttccatgcacgttgaatgtgccggccggaaagagagacaaaatgtattttaattcttatttttgattgttaacattgaatactttagcaatgaaaaggcattggcgaagctcgtggccaaactgaacaaacaaaaggtctcagagatttttgtttcatattttccacttggaaaattcttttcgatgccagaaaattttgattttcattgaatttagttaagaaaatgttgcacgcactttgaagtcataaaacgaaattttttgcgatttttcaagaaaaaatttgtttgttttttgaaatttttaaattttttggtagcagttttgcataaaaatggccagattagatcattttaacaatcattctcatacatatgttttccttttttcacataaaattctcttcttatttcggttttgattttagcttacaaattttctacaaaaaattttcatggatttggacgcatttcttcgtttcttcgctggggtttgcaatttattttaatgtttgtcttaaacttttttttgtccagccgcagcagcagccggcaccaatgagtatttacgaacgctttaacaaggaagtttgcgaaaaaaacccttgagcgtaaaactaaaaatgtacatttagttgaatgtttgttgtttttctatttaaaaataatttttatttgcacttttaatagcacctcttgcgtgcacgatgatgattttggcgaacggagcggacccgaacgcgactgacagcgctgccatgtcgccattggcacatgtgttggaggttcgttagcgggcaaaaaacaaattgcctgaggggctaataattaatttgtgtccgttttttgcatttttactatgaattctttgaatttttgttggggtccggatttagttaggggtgcagaatgactaattgagtgaatcgtattcagcaattactaaaaccccttaatgcgtttccatgatttttttgactttttgaaaatcgtggtagagttttcccaattaaaatatcaccaaataagtattatttggtaaaattgagaaagttttaccaaaaattatattttcacacattaaggatgaaacaggcaaattccaaattgccaagttgttgctttgcttccatgcaaagttgaatgtgccggccggaaagagagacaaaatgtattttaattcttatttttgattgttaacattgaatactttagcaatgaaaaggcattggcgaagctcgtggccaaactgaacaaacaaaaggtctcagagatttttgtttcatattttccacttggaaaattcttttttttttttgctttaatttatttaaacattttttgtttagaagaaaaagacgggcacaaaatcggaagagtcgaccgttaaaaagccagagtgtgtggatgttgaggaagcaatttggaaggagtggcagcaaatggcactgaaaacgagaagaaatgagcaaaggaaaaccccgagacgcacgggcatgggcgtccgagcactttcactggacggtggcggaattcgaggcattgtattagtgcaggttttgattcgggactttttaattaaaaattaaatttttcgattaacaatttgcgacttaaataattttttcctgcaaatgaaaaattggggtttactttcttgacaaacagttaaaaaaacacttccataaaaaccatattttttaaagaagcatccaaaataaacaccaatatcattcgataaacctaggtcttccattctcctgcaaaattccaaaaaattcgttctgcttcaaaaaagtcattgcccgaaaacctcaaaaaaaaaattttatctaagcattttgtttataaattttccgaaacagagaatattctttaaaattttgcatcctaatagagttatcgaatgatataaagaatgtttaatttgagtgtttctttaaaaagttgtgatttacttcatttgcaaaattatttattggccgtgtcttttttatggtcatgtcaatgcaatagagcggcttaccaccatatttttcgctatgcttatcccttatcaaatttgcagatgttaattgaaatggagtcgctgatgtacggcgagggtttgcaagcgggtggccatgaaaaaaacttcgtacaaaagaacttcaattggattatcgggacgagcaccggagcggtgagagcaaaattaaaattatcagttttaacttgctaagtatcatatttgtgcaattttgggtctgatttcaaaaaaatgcaaacattggagggggggggggggggtggcggtgaagagaaattttcgaaaatttgttaatgcattttccaattaaaaaaattatttgaactgatcaattaaagatgttggacattgcgaatttcagatcgttgcgttggcacttgtctcgggcacctcactgatcgacgcactccgactttacttgcgcctgaaggattcggtgtttggcgcccgggcgcagctgatcggttacaacgcgcaaaatttggaaacattcctccaagcgcagtttggcgaacacaaaaaaaaatggccgaattatcgcgtggaaacattaagtgagtttttgggagatccattttaaaattggatagtcgcagaagagccatttatagttttttgaactttttgaaaaattaattttttttttgtttttgagtgatggtcatcagtgaaatttttaaaatattgatgactcagaacatttgttattggtctctgccaaactgaatattttttcagagggctgaaaattgggtaagcccgtccgtttgttagcctttaaattgggaaaaaattttgctattagaaaattttcaatttttttggttttgctttaatgaattttcaaaaaaaaattgcagattgtttactaccgcaacatacgttggccaaaaacctccccgacttgtcaaatttcgaaacttcacttcggacctcaacgaatacaacccatacaaaaccaacatttggctagcggcgcgctattcaagtgcggcgccaacgtactttgaaagtcgggacaaattcatggatggaggtaggcaaaaatagaaactattcaattattataaataattaactatggatgcatgaaaaatgataaaaatcacaaaatttgatcattttttagtgaaaatctgtcaacaaattttaatcaaattttcaaattttttcccggcgccgcctgccccctcttcccaaaaagttttttttgaaaaagcgcgcctcaaaaaagcgttttattgatttttaaatttggaataaaattttaaaaaatgatttttgctttatgattttaattattaaaaagttgtagaaaaaattttttcgcatattttagcttttcgcatttcgcttttttttcatttcgcatttttcagtttcgcaaatttcgctttttatttttcaatttggcccatccctgctaaaaagtaataccgttttgcacccaaacttcccccctcccattcactattgatagtgaatataaaataatattttgaggtctgctcgcaaacaagccaagcctggaactgttggatgaaataagcaaggaaa

SEQ ID NO: 1010 - DNA, 2471 bp, Heterodera glycines
tttaatttatttttgtcaaaatattaaaaaatgacgacttttgggaatatttttggaggtttttaccaaccaaattggtccatcttggtatcattcgaaagcccttgatgaggagaagctttttctaagcaaaagttaagcaatttgacatcccagaaacgagttgtgagattttcaaattttcatagttgtctcatgaaaaaatgggatgtataacctaaaaaaatatttgataggttcgatgcagaatttttttctctatcgatatgcaaaatttggtaaagatttaacatccagaaaaaaagttaaacatcacgaagtgaatgttgttttcgctaataatgaaaatattagatagtacgccaaaaggagacaaaaaattagagaaaaaaagataatgtttttctctggcattctctatttattggtacacatctcgttttttgggatggtgtgagtaattaaaaaaaatcaacaaattattcgaatgcaatttttttttttgcatatccactcgtacgaaaactgctcgcaattttgaaaaaggtgatagagggagggcgggggaaggctgaattacttgacaaatggcgaaacaaattcagcaaacggatgccaatgatcggaagcgcaaaggtacgcccattgagtccgattttgtcaactccgctgaccctctcgacgagaacaaaaacgcatccgccgtcgaacattcgcctgtccaaagccaagtcgagcctttgcctccttcagtatcgctctcgaattcgtttatgatcgacaaaagtgatcatttcattttatttccttttgatggtgttttactttctcagttctttcatcgcagtcgctcaatttggaggagaaacatccgctaatggtcgaccagcaacagaattctcaacttcttctgacgcgtcggtttgaacctgtcactttcgagggcacaatggatgaacttcgcttggaatttgagcaggtcattttaacaaaccaacaacagtcatttggttcaaattttaaaccactgccaattttgctggaatggctaaatattgttagagttgctttcgttttaaatcaaaaatcaattctctgaaatgacattttgaccagttccctttgctctggcaggtgttgcggcactattaccatgggaatgcgttgcaattggcctctctaatggccaattacgtgcgctacgaatacgaattgcgttggcaacagtccatgttcggcatcccgccgcatctgatgaagtccgcctaccttctattgtcgcgccattttcacatgaagaatctgcgcctcactgatgtcaacgatggtttggccgcgatggacgtaaacgtcggaggcacttccaacaattggttggggcattaattgtatgtgccattcccacgacaaatgaaatgcctacccaatttttaaattttctcatgggtatgaagaagttcacaatgttctttattctgtcgtttaaaacttatttcaattttaatggaatctaacaaattgaggtaatccttcggatttattatgctggcccatgaaaaaatgcagtttttccggtgccaaatttttgtgaattttcattcggcgcgtcataagcggattgtttggtggcaaatgcaaacaaattttgtgttattcgaatgcgctaggcgggctcgacatttccaaatgtatcaacaaagggtctatctccactctctggcaaggtatggccagccaaagcagagtggggcataaacaagaattttttaatctttggtatttcctctattttgtgcctgctctacatttatgtcttgtgccaatatgcctattgcaacagaaatttattcagctttcccgacaaattgttgagataattattctagacgatttttttatatctcaatgcttaactatcgcctttttgtttggcaactggtagaaattggcagtgaaaaaaagtttgtttgtaactatttacaataaaaatttatgtagcatttctaaaaaggatgtaaaaataagttcttgcgtaatatttttatattgtgtgttgaagaatttgagtctgcttctgatgcaagtggaaaatttttcagcttttctcgaaaagttttttcccagaaaaaggatgggacaaataaaaaactaaacatctctcatgaccaatttaaatttccttacattttgggtttactttattatgctggcccatgaaaaaatgcagtttttccggtgccaaatttttgtgaattttcattcagcgcgtcataagcggattgtttggtgccaaattgcaacaaattttgtgttattcaaatgcgctaggcggactcgacatttcaaatgtatcaacaaaggatctatctccactctctggcgagggatggaaggccaaagaagagtggggcataaacaagaattttttatctttggaatttcctctattttgtgcctgctctacatttatg

SEQ ID NO: 1011 - DNA, 8644 bp, Heterodera glycines
ttttcatcgagtacttgatttttttgaaaattttttcggtaatttcgatgttctgattggtgtagaatgcataggtaaatattttagaatgaatcagtaaatgtataggaaagacaaaattttagaaaacaaaaaattccaaaaaatcaagtatatgatgaaatcagtgattttgcaaaatccgaactcggattcgtgatcagcgccttttttaccctagcaaaagtgattttgtaagaaaattttatttattttttctgtcgggacaccaattccgaaggattacccaaattgaaatgggtacagcccacgaatgttgaaaattcgaaaccagtgtctacaatataatatttattcagcaataagcgatcaaatggcttcaatgttgaaaaagacagttgggtaatcgaagaagttcggccgtctcgccaatgccaacaccgtgcacattgattcattagcataaagacgagtcattttattattatacaactgaaaaaataaacaaagcttgacgagaaaaggcggtatccgcggagtgtcacctgaacgaagaaactgagttcgactttggccatgtttttacaaatgttcacgaatttaacacgaagttcttccactggaaaaaaaattatgagccgattaccataacaaatgaattaaccggtcgcccgatgcattaatttcattcgaaaacgttcgtcgatgggtcggcgaagtttgggcaaaggtacgatttcaactgtgatcagtcccaactgacccgtcttcgacacgtactctctcaacgccgattccatcgaaacgttaattctgaactcctcgaaattaaacattaattcaaaataatgaaccacaatactatcatccaatagtcatacaaataaacgtcaaaaagatcacccaaaattggtgttgcaatcatcgagaggatttggggtgtaaagacgcagaatttcattggcgggaaaaggagacgacgaggaagaggcggtccaaattccggacgattcatcctccacagtttgacacgaaagaggcgacggcattgccacatttgacgacgcaccttaacaattagcagtgataaccattagaaatggatattggggacgggagggggttagttggtgggtcacatttcactataatttaatggccaattcgaataaatggtcttttaccgcctaattcagcttctctgctcgttaattgtccgatgaatcggtcatcaacgcttttgttgaacagacccacgtccacgtcgacgatgagacttttggacaattgcgtgcccttccccgcatcagaagttgggtcgaaggaagtgtctttgccggatgaagatgatggagattcagaggaagaatcagtgtaaaagtcagctgaaaacaacaataaacaaagaaaacaacaacaatagtcattgtcagtttgcatttttaataaagaaatttgtcccttcacaatttctctgtagttttataaggaaaacccatgaaaagcagcagaaaaacaacacattaccacaatatgtccaatctcaaaatttcgaaatgattgctttttagacaccagtcccatttattacttactactcaccatttgcgatgtcattttccatcacatgacgaggaagaagacatagttttttgggagcacagattgcattgtgttgaataggtggcgaagctttttttgctggaacaaatcaattaaaatattagtcacatttaaattctgaaagcctcgtggagggcacaacgagtcgctgataaaggacaagaaacggtgcattagaacatggttttcccaatcgcacctttattcgccacctgtcccgacccttccgcccttttcgtcgtcgtcggttcgtttacgtcggcattcgaatggcgaatgagtgccttcgcttgcgcccgcattccctccgcaatgctccgttgcaatgcgacaacatcgaaatgtttgctccatttttgcgccttctcgcgttgcaacgcttcgtactgctcacgatcaggccaaatctgaaaaacggaagaacaaccgttagtccagagaagaacggtggaatttgttgctgctgttactttgtcgatcaatttgtccatgtttgggtcggctcggagattgcgtttggaaatgattttctttcgacaagtcggacattccctctaagattcattccattgataaattaaataatggtggtcatttgtcttacatttcccttgtaaatgcattttttgatgcattcggaacagaaacggtgaagacattccttaaagttttaacgtaaaagcaaacaaaagcagaaaaaatggtacaaatagtgttcaacttttgggtttcgacagaatgttacccattcgtaccgtgaccatagtgtttttcagcaaatccaagcaaattggacatgaaaattccgtgttgagcgtatcaatcaaatcggaccgcttcagcaactgatcatcctccccctttttcagagtatgcggcaatcgattctaaagaaaaagtttagaaaagtatagtgaaaataaaaccaagtcgtattcagtgagttctttctgataaatgccagccaaagggtcagccgatggattaagagacatcggaaatgacaaaaagaagtcaaaaggatgaaaaagacaaactgaggacaatcttaaataaatttattggaagttttaaactgaaatttgaaaatctgcgaattcaaagaatttaattcaaattttttacaaaaaacatttcgccatgctaatcttttttaaattttatattttactcttcttcatttttttggattttaatacgcttttctcttaattaagatggtcgaacttgatggcgcgcctatgatttccgctgaagagattttggacacaaaaatatctttccaagactgtgttcggaaaattaaaaaaacccatgaagtgagtaacaaaattcgataaacaaatctgtccgtttgaattaaggaaattaatagagccttcgacatggagaaatttgacataattcaaagaacgatgcgaatgtattttgagtcggaagattcctcggatgtgtttgaaggctttctgaacgttgtcaaatatgtgaagtcacttaccactgagcaattggacatttcgctcgtcaaactcgctctgctcgcattttacgaatttcagaaactcggaatcgcgcaaggccaacaaatcccttttgaccttcacattgataagactcttctcgtgagatccgctttctgtcatgtcactaaaattggcttttcccttagttggatgcgctcgtcccgtgtttccgacttaaaaccaaatacatcgaagcgatcagttccgtattccatctgaaggacagggaaatggttgaagttgcgattgctcaaattaaaacccttttggagaacgaagtgccaaaggctgtcttttggatggaccatttgaatctgcgcgaccatttcccatttaacacagtgagttttgattcggaataattgatagacttttgatataatttaatgaccctatttagatcgtttgtaaacttattttggaaaaccaaactgctttgatttatcctttcgtcggtgaaagtcaatttcgacgtaataaactcattcattatttggacaatttgttgggccttgttttgcgcaacagacgagcggaggatgaatatgagcgggaaattatgaaaaaccaaaaacaattggagaaggttgggtaaggggccagagtacaaattggggcagtcaaaaatggcgattcttttcgtaaattttcagaaatgtcgctttctcacttttaattgttattgttacccttatactgttccgcttaatgctacgagaaacttaatccctatttaaatttagctcaccagaaagtttgtcaagaatttcgaattaacggaaagtgaagtgcctaatttgatgaagcttggtacgcaaaatgctttgttatacaatcactatcgttggtgccacaaagaaattacatggagtcaatttgaggagatagcgcgcgtaatacttttttaatttgtgctttttgccaattgttttttcttcccccccccccttcgttttctttccattctctcctttctgctgatttctttcctcgtcctacctttgcgttttcgccctttcttcccacttttctgtctctgtttcagcatgctctgcagttctcttccgatgttcgtgaccattacttccgccgtctgttcgagtccaaattgccagaacgagcgtgtcattttgcggaattgcttgaactcagtgagcacgattacatccccgaattgaggcattattgtcagcaaaacgcggatgaagtgcaacgaatccgcaaccaaatcagaaagtgattttatccgattttctttccattttcgcacatttagagacattgccattcgcctgcagaaccaacagattgaagagcagtgcgtctgcgagttgacccccggccaccaaattgtcctcgtcgacacgtggccgaagttagagcaactgattgaccatcttcggcacgacaacgaggaactctttggcatcgatgccgaatggcgtcctcactatctttgcgcagcagaaaagtgattttaccatttatttcttttttggtattataaatgtgcttttgttgtctaaaatttcctcagaatttcactgattcaaatcgcaacaacaaaggccgtttttctggtcgatgtcctcgtgttggaagagagtcggacgatgactgaaagtcaatggttaaatttcttcgacgcacttttatgcactgacgtaacgaggaaaattggtgggatttgtttttgtgccatcgtttatcgcttgtttaaaggggagtaaattcctttcttttcggcatttcctttcaatggcaaatccctttaggctacgactttcgcaatgatatgcgtgtcttgcgcagcactttccctttcatcgcaaagcttttcccgacggtgagaaaggtcgtctgtatgtatcggctgctctccaaagtcgaccaataccccgaggcgtcccgaatcgttttcgaccgcacagacgtggccaagccgacgctgtccctttctggagtgtccgagtacttcttgaacattaaattagaaaaaactgaacgcgaaggcaattggagtcagcggccgctccgtctcgagcgtaagtgcattttgatggccattctttggcatttattttcagagaaaaaatacgcggcgcaagacgcgcactgtctgaatcggatcttcagaattgtggcatcgaaattgaaaagattgaaggacaatgaacttgccaaggagttgaaacggcactcactgatcgatttcaacgaagaaaaggcaaagccaacgatggcaattccgctgctcagcggacaattggtgcgagtgaaggaaggcgaggaggacttcattttgaacgtgcaagtgagtggaggggaaggccagcagatgccgaagccaacaatgccattttgagaaagccgccgtggaaattgagcgatcagccaacggagtgttggacggcttcagaaccattggagatgtccgcttcatcgtcgactcgatgcttttcgggttgggcaaacgtttacgcaagtgcggcttcgacacgcgaatgattggcgaccgtgaacaaattgtcgagttttgcaagcagtcgaaggacgaaaaatttgtggtgttaagcgccggcaaaggacataaacaggtcaattgaggcatttggagaatggtgtcatggagatttattggttatgttttgcaaagccatggcgacacttggcacactttcagctcgccctccaaatgccagacaatgaagtggtcaatgtgccaattgcgaccgacggcaccaccccaccttccctgttggtcaggaacttgttggacgaactccgcatcattctccgtccttccgacatgtggtcacgctgtgtggagtgcaacaagcggtccttcgtccgtataccaaaacgaattgtgcagaccttgtgctttatgaccgcagttcggcactcggccgaatggatgggtgtcgatgaacaggtcgacaaattccaatgatttgtgatggattcattttaacccaacaaaacgcacaggatttgaatgaatctgtcgcccgtttgaaagctgaaagtgttccgtttgacttggaccaggacaacgactacgaagcgcagcagttcgtttttgtttgtttgtcttttcaaattaattggcattcaaaggcccacccttttcaaccgcaggcgaatgttggatgcggaagagtacattttgatcgttgaccagaagcgcgaagtctgtctgtgtcgtaatttctccattgacatgctgtacgtttttattttctttcacttcctatgcacagtctcccccccccccacccctcaatctctctcccccctcaccgtcctctgtcggtccgtctgcactttctgtcctctgctttcttcctctctccgtcctctgtctgtctcttcctctctctttctcttcctctccgttctctgtctgtctcttcttctcctctctctttctcttcctctctccgttctctgtctgtctcttcctctcctctctctttctcttcctctctccgtcctctgtctgtctctcttctccactgctttctcctctctctaaaccccttcccttaatttaccgtccaattcatttccatccattcaaattcattctccattcagcaatcgtctgctgttggctgaccattgttggtcccccgttcaaatgcgtgttgggcttaagtacaaaaaggacacttttgacgttgctggcatccaatttttcgtgtgttccgactgtggcaggctccaactgaacagtgcgagcagcgaatgaccgcgggcaaagcaattcacttccgccgaaagtgttgttgttttttgttaacaatttgtgtcattgtttttgcatatttaatttattcttttcttttggctgatctgtcgcttctctccgctcatttccttttctgtttttatttgtttacgcttcaggaacgatttattacttctttaaataataagtgcatagtgagtgttgtcaaacacctcctaaaaacccaaaattgttcctcagcagtgcctacaaaactcatatttttataaatggctcaataaaaaactcattttttggggaaaatattttaataagcaaaaatagggttgcaaccccgaccgtcggggttggaaaagtcggggttcggggttgtcggggtcagcaaggttggggtcggggttgaccaaatggttcggggtcggggtttttcgatttttgccttatgctatatagtcaaaaaactttattattttttcttaaaaatcttttattattcataataataattttatcaaatttttcctccggcgccgggcccccaaaacttattttttcttaaaaaaatttgcctcaaagtcgaaaaatttggttatttttggtgaaaataaaaaattgcattttaattctttaattttcaaaaatttttcgcagcggcacttactgacaccgccggacccttgttcccgaaaatttttttgttttcaacatctttttttcgcaacgcactttttctaaagacttttaggagaaaggggtccggcggtgccgataggcgtcgccgggaaatttttttttcaaaatttggatagatatgtaacagaatttgtccaaaaattataattcgattttgagcaatatttttaggttttttggggtgctggcgatgcccataggcagcgccgggcgaattttaaaatttaagctttattttctaaaagattttcatcaaaaaatttatgaatttccgtgaaatttttatttatttttttattttgtcaaaaattgtcaaaatttcatatttttcctccggcgcctggcccccaaataaaatagaggagattttattcaaaaaaatgcccaaaaatttctgatcacctttctttttcttttttttgtttttcgaatcatctttttttcgcggcgctctttttctagacttttaggagaattctattaatcacataaaaataaattaaaaaggaaacagtcaaccgggttcgaaatcataacaaaggtagtgttagtgttaaagtactaaccactacatcacaatacaaaaaacaacaaaatcattttactttatttaataaaaatttggcaaaatggtttaaaaaaatacaaaatttatatattttttgccttttctcacacgaaaatgccattcttaggggtgtatatttaaccccgaccccgagtcggggttaagggtcggggatcggggtcgtcggggttcgggtcggggttaaccccgaaaaatggccaaaaatgtcggggcggggtcggggttgcaaccctaagcaaaaagaaaaaaaatcgaataaatgatattttgatcactgattttattccgattgttcgcattttctgcgtccgtcccttctaattatcgtccgttccttcgatcttcttcagcgcatctttggtcttgtaatattcgaccaatcggtattttgcaaaactctgaattttggtgttatttctttcttttaataatattaccgtgtaatcgaattcttcaattgat

SEQ ID NO: 1012 - DNA, 992 bp, Heterodera glycines
cggtttttttcaggaaattcccctttttgccgtttcacatttctttgggaatttgggcctggtcaagggcgcaagcccatcaatgaagaattcgattacacggtggtatggttaaaagaaagaaataacaccaaaattcagagtttgcaaaaatcccgattggtcgaatattacaagaccaaagatgcgctgaagaagatcgaaggaacggacgataattagaagggacggacgcagaaaatgcgaacaatcggaataaaatcagtgatcaaaatatcatttattcgattttttttctttttgcttagggttgcaaccccgaccccgccccgacatttttggccatttttcggggttaaccccaacgaccccgatccttaaccccgactcggggtcggggttaaatatacacccctaagaatggcattttcgtgtgagaaaagtcaaaaaatatataaattttgtattttttaaaccattttgccaaatttttattaaataaagtaaaataccgacgtttacgtccatcgcggccaaaccatcgttaacatcagtgaggcgcagattcttcatgtgaaaatggcgcgacaatagaaggtaggcggacttcatcagatgcggcgggatgccgaacatggactgttgccaacgcaattcgtattcgtagcgcacgtaattggccattagagaggccaattgcaacgcattcccatggtaatagtgccgcaacacctgccagagcaaagggaactggtcaaaatgtcatttcagagaattgatttttgatttaaaacgaaagcaactctaacaatatttagccattccagcaaaattggcagtggtttaaaatttgaaccaaatgactgttgttggtttgttaaaatgacctgctcaaattccaagcgaagttcatccattgtgccctcgaaagtgacaggttcaaaccgacgcgacagaagaagttgagaattctgttgctggtcgaccattag

SEQ ID NO: 1013 - DNA, 3320 bp, Heterodera glycines
  misc_feature (3309)..(3309): n is a, c, g, or t
ggcacagaaacggtcccgacggcgcagcaaataccgtgcgtttgtggttaagccgccgcccgcctcgcgctgttcgtccgcgcaggcgcacggcgtcgccaacgggtacagccgctgggcaaccgcggcccaactgcagccgctgcccatccaaccgctgctggtgttcgtcaacccgaaaagtggcggcaacaaaggagccaaggcgttgaacacgctgtgctggttgttgaacccgcggcaggtgattgattgcttggcccaccttttttgcccttggctggctgtcaattttgaatatatttggtacaacgatcaattttagttggtcctcattagccagtgattggtaatgaattgcctaaatgatcaggcttgaccagactagacaaagggccatttgccaagcttttatgtatttaaaatgctaagatcattgatttttgatgaccgatttgattgcagtaattttgatcaattattgacaaatcatttagtcagattaggctttggctcttaccattgtgggtctggtttctgctaatattatataaattcttgatgcccttcaggtgttcgacgtcaatgtgatgcgcggtccaaagtacgggttggacatgttccgcaaggtaaagccggccatttatgcttcaactcagactgatctgttcattaaataatagattatcaaccatctttgttgtttttttaattgacaaataccggataagtactctaaaaattccatatattttgatcaattatatattgatcattctggttcatccaatcaatgatcatcatatttgtgatcagatccactcttccatgcgcattttggtgtgcggcggggacggcaccgtcggctgggtgctgtccacgctcgaccagctcggctggcccgcctacccgcccattgcgctgcttccgctcggcaccggcaacgatttgtcgcgcgccatgggctggggcggcacattcagcagcgacgagcctttggcggaagtgctggctgcaattcagacggagaccagcatcacccatttggacaggtggggacgaacatgatgacccatcggagacaaacggctttatgtgggggagggagaaaagaaaggcatggcacggcataaaatttcgcaaaaatttgaaaattttgaaattgataaaaaaagtgccgccggtttcctcttgccgctctgttggtgccgtgcctaaaattgttgttcattttccccttcatcagatggcgcattgatgtgtgcccattggcggctgcaacgaccgcagcgggagcaaacaatggcacaacggaacagcagcagcagacgaccacggcattcggcaccaccggaaacaaaagtgacgacaattgcagcaatggaagcgacgtcaaaacggagcagcaccaacagaaacaacaaacaaatggaggggcaacgacgacaatcgcaacaggtggcacggggggagagagagggacggcacgaaaattgagccaaaaatatggaaatcatttttaaaattttaattttttaatattccgaattaaaatcatacattccatttaaaaagaaattaggcgcaaatggtgcatttaatgaattcaattaaaacaccgcaaaaatgataatttcaaacttccatttttaataataaaccccaaaatttaagaaattttaaagtctgaataagtagaaatattcggtaggcgcttctctcaccgccaatttgcctttgctgtcaccgccaacagtcgacggcggaggcgttcttcaagcagttcaacccgcccaaactgttgctgccgcctccgccactaccgccgcttcttcggccgatgaggcggcggctgtcggggcgaacggcgaagcggcggacgccgtgcaaaaccaactgccgctgtcggtgatgaacaattacttctccatcggcgcggacgcacatgtcgcactccaattccaccagtcacggagtgccaacccgcagatgctcaactcgcgcttcaaaaatcgcatcgcttacggaggccttggcaccatcgacctgttcaagcgcacatggaaggtggttgacggcattcatcgggcgatagggggagtggggaggaataggcacggcccaagaagggtgtcatgacaacactcgcacaaaaagggaactcgtacaatggcttaggctaggcctaagcttcagactagacataggcttagacttgtttggcttaggctttattttgtaaatttttattgtacgaattacctttagtacgagttgccattaatccccaagaggggttggcacaactccaaatttaagggtttaggctaaatcagttgggcatgaatgggggagtactgggttggcacagtcggagaacagtgacatccaaatttggtgggtaggagcgtttggcacgttcactgaaccgattgggagagattggcacggctcagaacaaatggcactacagaacccaaccaaatacataattgtttatcccttaggacctttccgagtacattaatgttgagtgtgacggggtggacatcaccgccaaaattcgcgagttcaaattccactgcattctgttccacaacatctctttctacgccggcggcaccgtcccgtggggtgccggcgacggagtgcaagtgaggcgattaatgtgttaattagtagtttttggcaaaagcattcaaacaattagttggcaaataatgccattggcattttggcaaaataaatttggcattctgctcaccaattttactgctccgatttgaggagaactgtggcgaagtgttctcccgtccgtcgccatgtgatggcaaaattgaggtgctcggcttcaccaccgccactttggccgccctccaaatgggcggcaaaggcgagcgcatcgcgcagtgctcaaaggtgcgcattgagacgagcaagccgatcccgatgcaagtggacggggtaagcaaaagggacacaatgggggggggacagggataaatgacaaagagcggaagaatggataaaatgaggagaaacgacaaaatggggacaaatggttaaagtggggacaaacggaaaaagggcgacaaaaggacaaagagaggacaaatggaaaagggcggcaaattgggggcgggagtaattaggaatcgaaagttgcaatttggaggtgaatcagccccttctcctttcaattcaggagccgtgtctgctcggcccatcgcttattcatctttcattccacaacaaaggtaaagccataaagcagttaattatctttattatctatctccccatcactgntttactctaga

SEQ ID NO: 1014 - DNA, 2591 bp, Heterodera glycines
  misc_feature (79)..(79): n is a, c, g, or t
gacgggacatcatgccacttccagggtaatgtggtgaatgtggacgaaaagtttggcatcatttaaaatgccaagctgntcttaggcaagcgtaagccccgagggcccttgttcgccgccgcgttcgcttcgtcatgtgccgccgtcggcggcaagggcgcagccgcctcaccgccaagcagcacaatgttgctggacgtgccagtggttgttgttggccggcacgactacgacacgtacagagactcggtggaacggctgaaagacaccggtaagcaaagcaattaattaaattaattttataatccttaattaccctcattaccgaaaatatcctcacttaggctttgagcttggcctgttaaatgtggaggcggagacggaacttgtccaactgcggccgcacattcagcaaatgatgtgtgaacaccaaattttgccgtacgacccgggcccggactggcgctttctcgactgtgagtttaattctgaaaactcagcgggggtccggcacccgagtcccaaggggtggcattgatcagcggcattttggctagcgatatggcctgctttttttaaattttgcctcacaaattccgtcaatgccttttctcagatgtgtccaacgcggaggagggcactttccgcgtgtcgcgtcaccaggagcagagtcggacggtggccgacgtgtgcacattggaggcggaggagggcaccagcagcagagcgggcattttcattttggacgacgctttcccttcaatgagtgcccgggcggcggccatcggaggacacgaattggtgttcacaccggccaaaatgaggtgacatccaacaccactttcgtccctgatttgaaaaatagagaaaaggacaaatcattttccctgactcaaacggtccccggttttccgattgatcgggctcagattttgatcgatgttcgagccaaagcattttccttggcattctcccgatctctgattatatatggtcccgaatcgactttgatctggaaattaccttaatcgttttctgagatttcctcgtccctcgttttttaggatttttatcactatcaaattaatttgcacaaaaataatgtcttgcttcatttctggcatagtgttgtgccaacagtggctgatcgcagaacaatgattcggcgccgaatcagtgaaacgctgcgcattgtgttggccaacgacgcgccggaaacgcacctttgagcggagagaagcaaaaagggagagagagtggggcacaactgatcagagagcaaaaaatgatcagtcgaagtgatcagaatgatgaccgaccaattggtgttcaactttggcacgccaaaatttgccataatttgttttcttcatttttttgtaattttccaaggttcacttccatcttcccggtgtgtacataaaacaataaatatttcacatttttgttaatcattttgaagaaataaaacatgaaatgataatttgtaaattacaaatttgaatttgaattttattttttttaccaaaatattattagatgatttgtatttaatcattgagaaatgaaaattatttctgaaggatttgacgctttatcgtcaattgtttaatcattttctttgaattccacaaattaaaatacgaaaaataattaaatttaattccgattaatttgctccttttccttttcctcatcctcaattaattgtcattcgtttccatttcaagttttggcattccgtcctctgttattttggcgcacattcgtgcggtttgtcgtaacattccgtgcacttcggttccgacaaattgtcgccgcaagtgcttttgcaggccgacttcacgcagctttggcactcgcgcacgcacttaagcccctttttgtcgcacgcggatgaacactcgcggaaaagcgcctttggaattttaataatttattaattaaagaaaatttaaattaaaaaaggaaatccctttaaatcgaattttaaattcaacaattcattaccgaagattggtggagaaactgtgcgaaaatgagagaggccaacagaaaggccaaaatgacaaatttggccattttaatttttattttgaaaaaatattttgctaaaaatgttagtgaaactgtgaaaataaaaaataataggccaattcaatcgctgtaaataaaatggcaaattatgggcggaggacaaaaacaggcgaaaaagagggattatttttaattggcccaaaaatggcgcaacaaaaacacaaaaacagtgaatgaatggacttttgaaaacaactaacaatttgctattaaatgataaaaattgaaaaacgaaaatgaattttttttttttttgccgattttaatcgaattaccaaactcatttttggggccaaatttgcaaaattttttgaaaatgtccaaattatgatggaaaattttgtgggattcgttctctgactatttgtattccttcaaagtgttctttcgtttttgtttatttgtttttctattgtttccttcaattttgccctttcttctcccatttttcatttgcattttcattttttactttttcacttatgtcccaaata

SEQ ID NO: 1015 - DNA, 4320 bp, Heterodera glycines
  misc_feature (28)..(28): n is a, c, g, or t
tcacttatgtcccaaataaacaaacaantcgccaaaattcatttaaggttatattacatacagaaatattaaaatttattttattataccaatgattacaaaaaaatgaacgcgaaatgcaaaaaataaaaatatttggaaataatgtgaaacgatggcaaaaaaggaaggggggaggtgaacaaaaacaatgccttgggagaaagacgggcacggcacaatcaatgggacataaaatgagagtggcataaactgagtaatggacgatcagccaataatctctcccactcatctccattctcttccgatcactgatcatttgttttggttttgtctttttgtaccactaagagatccaccgtaatccatcatcccatacagtagtcagtcgtccccagtcgcctcgttgttgtcaacacttaggcaccgtaaccgctgggtgccgtttttggcgcagcgccgcccgcatacggaggcgagccggcggcagcggactccgcaggttttgcctgttccgccggtgccgaggcggacggttggggctgcgccgaggcttctggagcgggagcagcaccgcttggtccaccggcgttcgcgggtgccggctgctcggctggtgcagcagcatttgccccggccggtgcgggttgtgcggcagcgggcgcggactcagcgccgccataacctgctgcggcagagggtgcggactgagctggtgcggattcggcaggtgccggcgcagcagcggcagctggtgcaggtgcggcttcggcaggtttttgctgctcggctcctccgtaaacagaagctggagcttgggcaggctgagattgagcgggtgcagcggctggcgcttgttcagctacagcaggtgcaggagcagcttcagcgggttttggttgttcaacggcagctggtgcaggtgcagcttcggcaggtttctgctgctcaccagcattggctccgccgtatccgccggctgcgggttgtgctgcagctacaggagcctgttcggccgctgccggtgcgggtgcagcttgggcaggctgagattgagcgggtgaagcggctggcgcttgttcagctacagcaggtgcaggagcagcttcagcgggctttggttgttcaacggcagctggtgcaggtgcagcttcggcaggtttttgctgctcagctcctccgtaaccagcagctggttgtgcggcttgagcaggttgcgctgctggtgctggagctgcctccgctggttttggttgttccgctgcagctggtgcgggtgctgcttcagcaggctgggcttgagattgcgctgcgggtgctggctgttcgccttgagcggggttggcttcactcggcggggcagcagcagaaccctgaaaagtaaaaaatagaaaaattttaaagaattttaatagcctacctccgaagttggtgcactgactgacgggattccagcagatggctgagcatttccgtaaacggcggcacctccggaaggcgcagctgcagctgatgctgaccctgcttcagtcgggctggcattcgaagcgggcggcgcgttttctgccggtttaggcgcctaaagtgaaaaagtatttttgtttttttaatatattcacctcaggcggtgaggctgcgggataagaaacagcttctgatggtttcggttgctctacgggcttttgctcggcagtttccggttttggtccctaacgattaaaggaaataactttcaaaaagtcatgcaaaatattcacttccgatggtgcagctgcacctggtgctgattcagcaggctgggattgtgcgggcgcaggcgcttgttcagccacagcaggtgcgggcgctgactccgctggtttcggctgttccgcggctgctgcgccgtaaccagagcttgcagcaggcgatggggctgcctgttgagcaggtgcagactcagcgggatgttctgcgggttgcgctgcgggtgttggagctgcttccgctggctttggttgctcagctgcagctggtgcaggcgcggattcagcaggttgaggtggagcgggcgctgcggctggcgcttgttcagccgcagcaggtgcaggggcagcctcagcgggttttggctgttcggcagcattcccatatccagcaggcgctgcttgggctggtgcgggttgtgctggagcaggctgagctggtgcgggcacagctgctggctgttcaaccggtgcaggtgcagcttccgcaggtttttgttgttcaccagcgttggctccgccgtatccgccagctgctggttgtgctgcaactgcgggcgcctgttcggccgctgccggtgcgggtgcagcagccggctgttcagctggtgcgggtgctgattgagcaggttgagacgcaggtgctggtgcagccgcttgcgcctgttcagccgctgacggtgcaggggcagattccgcaggttttttctgttcaccagcgttggctgcggcgtatccgccggctgcgggttgtgctgcagatgcaggtgcctgttcggctgttgccggtgcgggtgcagcttgggcaggctgagattgcgcgggtgcagctgctggcgcttgttcagctgctgctggggccgatgctgccgcttctgctggctttgagggctgtgcgcccgcgttcgctcctccgctgtacggtaccgctgctgcttcgccctgttgcggctgtgttgcagtgggggcagcgttcgggctcggctgagcgcctgcctgtgcttgctccggcgggcttaccgggctcggctgctgcacggttggcgcgttttgctcagctggtgccggtgccgcctgatgcgcacccgagggcaccaccggctcgtctccatatgcgttctgctggttggcgcgcttgacgactaaaaatggaaagtttaaagaaaattgctgagaaaaaactgttacaccaacttgatctgttctgcacctcgacagcgagcagtacaacgagcagaacgatggtcgcaaaagctttgttcatttttggaatactttttgaatataaaaaagaaaatctaaatgtgatcagaaatgtcatttgtcggcttattggggatataaattaaaaaacattgtggcaccacaaaaagccgaaataggaatggcataaatcattttttggtttttgggaaagggaaaagcgctaaaaatttgcacaaaaggaggcgatgcgacgcaatgccgcgggcatttgggcaaatgaatggctgctgatcacttgagcgggggcgagtgactgatcagatagaggcgggacttgctcaatgccccgggggaaagagacaaaatttaaattggaaaaacgatcggtagaagaaggcccgaacaaatgtgcttttaaaataagaaatgttgctttttaattgcaattttgatcagaaaagcgattccgtccaaaaagcttcatccgggcgcaataaactgggttaagtattggtttctccgtcgtcccaattcgggcggattatcctcccctccaccgggggatcgtccctatcccaaacatgattgaaatgactggttgttctcctgcagctgtacagtgtttttggagggctttgggtggaatcgtcccaacaagtcatccatcccatcggcagcttttccaatttatccatccgatcacctctcactctctgtgcccccatattcggcggtggcgtccaaccggtcaaccttcgtcgcccccgccgatcacgtctttccatttccagtagcagcggcagacaattgcaaagtgatcgatggattttggtgggatgggatggactggattaagctgctaatgatgatgattatttgggacgaatttgccgcttcttcccatttgtcccatgactgccggggcggggcgaccgacggacggacaccgaaatccgccgccacacaccattcatcggcaggccaaggtgttggctaaattgatggctcacctgctgccgccgccgctgcagcactaagaccaaaatgcgggccaaatcggctgctgatcggtcggtcggccaatcgacggcggtcccagtggccagaccaacccctgccgactgacgacgacgacaggacggacagaggcggggggggggaggagggaaggaggcagagcggacttggattgtgagcattggcggggaccgcggcggtatttattccctcccgccccattcatcaaacccaaagccattaattcattcatttatgcatcattcattgaacccctcggggtttcccttgggtcggctgatgtccccagagggaacaatggaagcggcggcggagggggggggggagaaga

SEQ ID NO: 1016 - DNA, 1001 bp, Heterodera glycines
ggggggggggaggaggagatgaatttgaagaggaagatcagcacggaatgggacgggtcgaaggtggcggggggggggggaagagaaaaaaaaaggtcgatggtgcgggtgcagcgccaccgccgccccttttgtgggggaatggacgggcggacgggcacgggtaatgaatggaataatgcacgaatgaaccagtggatgtgaatggtacgatttgtgggaaagtccgctgaaaggacgccatttatatgggcaggggacggggggaggacgacctcgacgaggagggcgagtgggagcagtagttgttcatgtggggatcaccgggatcagctgctgctgctgctgctgctgctgctgctgagggaggggtgaggcgacgacaacgacctaaatctgatcagccgatcagctgcaggagcagcagcatgcccgagggacggacgggggcatagaacgccgccccacccgccggtccgtccgtcggtccgtcagccgatcagttccctcctccctctctccctccgcgttcgcccactccgttcattgggcgctgtgcgtgatctgatcggatggtgattaagcgatgattatttacgatggcagctgcgaattggcgcatttagcaaaggggacaaacggatctgcgaattcctatcattattagcaaaaaaagtaaaagcgaatgccaaaaatgaggatggaacagaggagacgacgcaccccgcccaagtgatcagccagccgttcctatcgcgctgtccgatcagtgtcgcggcggtgatcagcagtcatcccgagcaccagcagtccgccgatcactcacagggacattcccagagggaggggagagttcttgcttttaccggatcagcatttagctttttgtgatttatttttattgaacccattaaaagggggcagagaaaatcctggaccggtggtggaacagctgagggagacacattttgatcatatgattagatggatcaccaaggtct

SEQ ID NO: 1017 - DNA, 4838 bp, Heterodera glycines
ggaatttgggggatgcttatgcttatgcaatattatttttgtttgtccaatgggtggtggacgacggaccgacgatgggatgggctgacaaaagattggggaagtgaaaatgaggagaaaatgaatcggtcggaagcggacgaacaaaaaaggaagaaaaggagaagaagaatgggcaagggagaagaagaagaagcgcacttttggggaggagaaaaacagcaaaaagtgtccaaaaagagaagggaattaattattattaacaaatgggcaaatacatcacagcaaaacgacaataattaacaaaaagtgctaatttatggctttgttgatcggtggatccctcgtttgatcgaacgaccgatcggttggactctttttttgtttttgattctctcctctattcaatagcatatgcaattggcaagaaaattaaataaattttttatgtaaaattcaatttaatttcaatttttaatttatttcaaaattactctcataatcattcccccacaatatccattacaatacaattagtgttttggtcatttatcccaatttctcgcctttctcccgctcccctaatttgatcagtcaattccaatcggatcaaaagtcacttttggaggtcgttttagttcttttgcggcgatcgccagcaaaaaatgtttgttaattgcagtaatttgtgcgcttttttttgtgctgtgaccacagtgtttttcacactaattaatgagcacaaatggaagaagggtgaatcggtcggcggggcttttggtgacggatcgtaatcgaaattggtcaagcatgaccagcaacaacactcaccgatcattgctgatcagtgtttgatcactttttgcatcaccctatcattgctgatcactagcaatacaaattgataacacctacacggcactgattgttagcattccctcattgaggttcagcgaacggatcgaaaacggcttagcatgatcagctaaccgatcgccgctaatcagctgatcatcgatcagcaatcattcagtttttttgaaccaatcaaaatcagtttgtattctgcgtgtccgccaattcacgtgttggattttgttttcattgagctcagttcgctcggttcgtgatgtaccggtgcgtggcgtacttttgcactgaccgatcattttggcggatcaaatgatcggaaaaccaaaaataataatttgggggatgtgacagagcaatacgacatacatttgtgacttttttcgggataatctcgctaaatccatcggaaaaatgccccagattaacggagaacgggaaaaaatgaatgagtaatatatgaacaaacaacaaaaagcttttttcttggattattttattacaatttaacaaaaatgaatattattttgataaaataaattatgtttctaaagttaattaatttatttattcaaaccaaatttattatttaaattccatttatttgtaaaatttaaaattcacttttttgggcttttattaaatatctttttattaaaaaataattatttatttattccacttaaatgtgatttataaaaaaaaatttcttctaatattctgatgttttaatttttttaaagctatttcacagtgatttcaattcaattaaaataatattttatttgctttttaaaaaatgcaaaattcaaaattatacaacaaaaaatcgagagagatgtaattaaagcactaatttgagtttgtatttgttgaggcacagctgaatgagtttcggcgcggctgtgccgtgccgtggccattcgtcggcaggggcaaattcgccggcgcttggcgctgtccttcctccaccagccgatgccaacagcactcgtcctccatttcgtcgactaattaattagaaaaattatcaattagtaacataattattcaatgtaagaattggctgcactaccgtatcccataatacattctccaacgtttactgtaattcgcagaaagaatgagaaattaaactgaataatgaaaaacggaaaggtaaataactaacaatgtttttgctgtctattgccgttgctaattctaccgtatccgtcagtccctgtgatctcttcaccgttttccttaccgtaatcctcgtcgtccgtcagcggcggtgtgtccacaggcgcctcgttcagaatggccatcatcatctgctgccgatgtagttgttcctgcttctgactgaacagcttggcaagcccgggcgtccgaaaaacgggcgattggttcagccgatggtattgggaagccatgtggggccacgaggacagaaaaaggtcggacgaacgggaggccactgctgcggatgagtgccgggaggaccagcgatgtgttggcgaggagtccaaagccaatgcgacgatgatcacacctatggacaatagccaaatgaagaattaattttggcagccattttcaggactgaaatggccggggtcgaaacagtcagagagaaattgacccgagtacaaaggcaactcgtacaataaaattttttaaataaagcctaagcctaggcccaagcaagtctaagcttagtctaatgcttaggaccaaacctatgctaaagcttaggcctagcctaagccattgtacgagttgtcatgacaccaaaaaaaaacgaaaaagtgagaaagttcacggccaaaaaaaacaatgaaatgatagccaaagagatgatcaaaacgaaatttgaagaatgaaagttaaaacaaagaacggaagaaatgcttaaccccaagactctcgatttatgatgatttccagtggaattaaatgattttggttttatgtgctcacagcaaattgcggtgatcagaatggcaatggacagcagcgagacgatcagcacaatggccaagttcagcgtcagagcgttgcccgtgccgttgttgtgcagcgccggcgggaagcgtccgatagggaacagtgacatcaatgccggtgccatctccgccgacgcgtcttcgaagcgattgggctcgggtgccgcgtcctcatcagtgccggcaccggccaagagaaggcgacgcacttccgcatctgttaaaatgggaagaattggagaggaaagagatttaaaaacaattaaaatttaattggataattaaaatgaaaattgatcaaaaataatcagattgggaagaaaccaatggaaagaaatgatcagataagaaaattaaaacaaaattaaatgatcaaaatgatataattacaatagtgaaaaaagagtgtcctcaagttttattggccagaagataattaaatggttggttaattgcttttaatgatgataatcagcattaattaccctcatttgtcccgatttcgtctccgtttgatgaatgaccgccttgctgattggtactctgagatgacgaactattgttaagctagcgggaaattaagtgccaaattcctaaggtaacaagtcaaaggcacggaagagcatttgccgcgccctaccgtaccctgccgtatactgtacttacagtgtgccgttgtgtgaccagcaaaatgatcagaagagcggtaagcacagtgccgagcagcagcagaacacagcgacggaagcgaaagcgcatccaccaaaagtcgcattcagtggggagccaaaaggaagcgcaataaatgcaaatataaaaaataaaaagcaaaattaaatggcgaatcaatcggaaaggggccaactcagtacggcaaaatttgagtcaatggagcttagaaaaaggtaaagcagcattcttaaaactggctgagacagagttggccagacggagttaccacgtcgtggtaatgtaaatgccaaaaaagtgtggcattatagaaaaaaaatgcctgatgagaagaacttacgacgagtggggctcgtttggtcctggacatgttttgaaatgatttattaatataggtatttagggctgcaacttgaaattttctaaataattctaaaagagtaaacttaaactgtagacggaaaaactaattttatagtaaaaatttgattttttcataagaattttcataaaatggcggaaaatttttacacaaaattcaaattttaattttagacgaattcaattttgaaaaaaatacacaggtcgaattcaatcactaaaagttgcagcccttttctattgctaattgatttaaaactaaaaaacttaaaagttaaaatattttttaattaaataaaattattttgttctttgctttcacaaattttgccccacaaataaataaggcaccgtaaaagtttttgtggccaaacattttgttggccaagaatttttgcccaatcggcggcaccgggcgaacctcgcgttttttcgctgtttcgtgtgaatggcacattaatgggggggggggggcaaaaataataattcattatatgccatggaaatgatagggaaaaggaacagcagcagacaacaaagaacaaagagagagaagagcatctgtcacatacagcttattagcaaagactgggctgtcagcaaaatttgattagcaaaaaatggaaatgagcgaattaattataattaattaatgagtaaatggtgggtgtgactcactgacgcatcatggccattgcaatgtgcaaataattatgtaattaattaattaattatgcattttcgcaattgttgctaatgtgaaagtccgctgcttaaaattgcttttctctttctgctgattggtgcatacattttaaaatgttgtccgattatgaattaccatattcattttcagcattattactttaagaaaaactttgaaagtgtaaaaaagaaaataagaaa

SEQ ID NO: 1018 - DNA, 2647 bp, Heterodera glycines
tataagcgcatgcattttcccccattttggttgttcgctctttttcattcatttcattttatgtttttcatctctctcttcttttgcatttattttatttgtgttttccaaacaataaatatttgtcgccaaactatcggacataacattggcgctttcagcaggatttttttatttcattctaaattattgccagttccgaccgaattctatttaaatataattgctcataattgtccaagcctcctagcccgtaacacatctgtcgggggcgtcaagacgataagtagtccgctgaacgtacccttacaaagaagactgctaggaccacacaagtcaaagcgaccgctgtgtgcatccttagcaggaaagcctctttggtgaaagcacaagttgataagtaaaccgctgtgctcagcatcatcgagcaaattcccatcataaaggctgaggaagcccattcaaatcattcatcctcattccatcatcggatcggactgccaatcaaaacatttcaaaccaaaagttgtggctgaaagtgcattttcatttggcatttattcattcatcattcggtcacttcttttcactctcatttcaattccatcatcataaaaatgagcgacaaattggaaaacctccttcaaaaactgcttacggcgcaagccgatcagcaaacccaatttactcaagctttaaattccttggtcaacaacaatcccgacaaagaacaggcttcattgttctcgacaattaattcccaaatttcagaattcgtgtatgaaccagagaacgaccagacatttcagacatggttcgaacgattcggcgagtacatcacaaccgatggcaagctcctcacggacgcgatgaaggttcgggtggtagtcggtaaattggggagtcaggagtacagcaaatatgtggagcgcatactcccacaaaaaaccggggatttaaattttaatgacaccattaaaaagcttgaagacatcttttgtggcacaaaaagcctcttcgtgcggcgctacgactgtttcagaatggcaaaggcaccgagtcaagcagttttggattttgcctcgcatgtcagtgccgaatgcgagaagtcaaagatgcaattgaccaaagaagagatgaaggcgttcattttcgtcagcggcctggacgagggagaccgtgacctccgcgaacgatgtttgcgcatgatggaagaggcacgacaacgcaacgcgaccatcacattcgcaagtttgattgaggaatgccgatcaattctttcattacgcagcacagcagctgccttttcccaatcatcatctttaggcgctcaaacaaattcaatttcagtcaggccacagcaaattacagagcgttcgagcagaccagcatcgaagggacagaaccgaacattcaatcatcgttccccttccgttcaatcacacaggtccgatcaacagcgaaaaccgccaccgccattcccgtgcaaatggtgcaaacagatgcattggaacaacgagtgcagaaatcggaacaaatgcacaaaatgcggaaaattcggacacaattcgtcgacatgccgatcgcgcaattattcaaatgatcggaaattcaaccgcggttcgatgacggtaatgtctgtgcatgattcgagcgagccatggatcgacattcattgtaagatcaatgcgtatccggtcaaactcatggccgactcgggatccaaaatggcagtcattcagacttgcctctgggaggaaattgggaaacccccacttaatcattgcacagctaatggcacatcatattcaggcgatgaatttgaaatttcagggtggttcaattgtcaggtcacttatggtgacatcacgctcaccttaaaatgttttgtcacgcccaaaggtgtgatgaatttatttggtttgccgtggattcgtgcgttcgaaacggcactccaacggccaattgcgaccactttgccaatgcccttgccaacagcagcatcacatcaaagcatggcgattccatcatcaacagaattggccgacctactcaaacaaaatttcccagatgtttttagttcagagttgggacattgcaccaaaatgagggctcatttgtatttgaagccaggcgcacagccagtattctgcaggcctaggccagtaccgcatggagcacgagatgctgtcgacgcggagttggaccgtttgttaaaaatcggtgcaatcaaaccggtggatttcagtaaatgggccgcacccattgtggcggtcaaaaagaaaagcggagacattcgggtctgtattgatttctcaacaggtttgaacgacaggctcgagctcaaccgccatccgctgcctcggcccgatgacattttcaatttaatccgtggcgccactgtcttcagtctgatcgacttcaaggacgcctacctacagatcgaattggactacgagtcgaagcagttagtatgtttaaacacacatcgtggtctgtttcaatttcaaagacttccatttggcattaaatctgctccatcaatttttcagaaattgacagatcagctcatcgcaggcctgcccgatgttcatgaataatggacgacttcattgtagcatctgcgtctgttcataaggactctaga

SEQ ID NO: 1019 - DNA, 13045 bp, Heterodera glycines
attaatttttgcagtgcaaaaattccatcgcatgatttatggccgacagttcacattgctcactgatcataagccattaatttcaatttttggttcaaaaggtggaattcccatttacacgggttccagacttcagcgttgggcactcattctcctgaactacgacttcaaaatcaaatacatttcgactaaagagtttggtaaagttgacatgttgtcgcgactaattgccaaacagcgagaagacgacggagatgaccatgttattgccaacatcaatcagtttcccatttcagaagaggaggagcaactcgatttgtgtgccaacgcagtcgattacattttccaggcaaacattgaacagttaccggtcacagcattggaagtggccgaagcaacgaaacaagacgaagtcctgagcgaagtctcacagttttgccgcaacgaatggccaaggaaagttcaatccccattgattgaaccatattttacgcatcgttcgaaaatctccgaaattcagggatgtttgcatttcggggacagagtcatcattccggcaaaactccgtcagcgcattctcacggcacttcatttttcccacccgggaatcgtccgaatgaaagcgctggcacggcaattcgtctattggccacggattaatttggacattgaacgttggtcaagaaattgtgccgattgttcccttgcagcgaaaatgccagcaaaagtcccacttcaaccatggccgacatcgcatgaagtcttcgaacgacttcacatggactttgcaggaccgtgtgccgatggaaacaaatatttgatcatcatcgacgcgtacagccgttggccggaagtgatcaaaatgcattcaacgacagcacgatttgtcattgatcagtttgtttggttattctcacggtatggatatccaaaacaaatcgtaactgataatggtccaccattaaagtcatcaaaaatttttgatttttgcagaaaacatggcatcgaacaggtttttgcaccgccatatcatcccatgttaaatggacgagcggaacgttttgtcgacaccttcaagcgacaaatggcaaaatgttcaaggacggattcaaattgggtgcaaaactccttattggcataccggagcacaccaagcgacattctcagcggaaaaacaccggctgaacttttcttagggcgtaaaataagaacaattttttccctattaaagccaaaacaggagtcgcaacatcaacaaccgaggaccgatcacaaaacgcagcaaatggaggcacaattcaacaagaagcacaacacacatgagaggatcttcaaagtcggagacaaagtgttgttcatcaattaccgagacaacaagaaattttggttgtttggtaaaatcgtaagagggtcaggggtcatgtggcggattgaggcgccatgtctgagtgccatagtaaccaggcactcgaatcaaatacgacttttcaatcccatcccatacaaggaaaccgatcagattcagcactctccgcagcgtggtcaagcacagaaccctcccgaacaaattcaagtggagcgcgagatcaccccgccgagagcaccgaaaaaggtccgattcgccgatgaacagcctcatcatcatgaacagccagctgaagaagagcaaattcaagagacaccgaatctgaggcgttcgacccgcgtcagaaaagccccggaccgtttagatctttaaaagggggaggtgttgggtatgactaaagtccatttcattcccttccttcttttattgcatttctctatcctttattattgattgtgtctgaccatttcattcgcatataagcgcatgcattttcccccattttggttgttcgctctcattcattcatttcattttatgtttttcatctctctcttctttcgcatttattttatttgtgttttccaaacaataaatatttgtcgccaaactatcggacataacaaaatgaaaatggggaaatggagggggaaataactttggcatatacaagttggcctgaagccaatttaatttcattaacatcattggttccgacaaatttaataaaagatcactgggaagtacacacaaatgaatttggaaaaagatacattacggcatggctttttgggataagttttgaattatttttgagcgatgagcctgacagggttgtcctaggaattcaggcacaattttcaataaatgacgaatggcactcaaaaactgagggggaaagtgaaacatattgggaacaattgggtgagattgacggacgaatcctcgaaattcagagaattcccgacataaccattacttattccgaaaacccattaataattgattatgaatttgatcaaaatgatgatcagaataattcaccgacaattaatgttatttccgaaggggatttattcatgagcatattggacataaatacagaaacagagaaacaaaaagaaaaatgtgcggagatttcaaaaaataaaacagaattaaataaaaaggccgaaaacccaaaaaaaattgatcaaaattttgctgaacatacatcaaatttagtcatggattcaccaaaagcgcctgaagtggtgccgttcgaggatgaacagttaagtgcggaggaaaaacaaattttgaatgatattgaagtgctgaaaacgaaactggaagagacaaacaagcgaaaaagtgaactgaaaaagcaaaatgaggaaaaagagaagataaaacaagtggacgaggtcatattagaagatgatgaagaggaggaggaagaggaccaaacgcccaaaatgagtaaaaagccgcggttggacccggttgtggcaaaatgtgttgtggaaaaagtcataaatgaaaagtgggaaggaaacgatttggtggtaatggatccaagaggaaagggatcaatggaagagcaaaatgatgaagaaagccggaggaaggaagatttggtgcgaattggccgaagaaatgatcacaatgaggcctggcgagagtttctgaccacaacgacttccttggacagagaaaaggaagagcgattaaaagcaatgggcaaaattggtttgggggaaaatggccgaagaatggcagagaaaagtatgagagcagcagagaaaacaatttttgaaagtccgtgcttacagccggaggggatgagaaggaatgtgattaatgaattggagagccaagaggagcgagagcgaaggaagcgtttcgccacccggactcctccgagtggccaagcatttgcaaattcggtttgggcggaaaaagattggaaaagggatgatgagggggaaaaggatgaaaaagaagagcctgtcttcaccaaaataataaaaattcaacggaagttaaaagaagcaaatgaagaattaaaaatgctgcaaaagagataatgaatgtgtttgtaaaaatgtgtgaaaaataacttaatgaatgtgaacagatcgccaaaagtgtgttcaaatattatcttctcacatgccccgtccattgaagaattggtccccaattctgatcagtttccccgggctcctctgatgcgacgtccccggcgcatggcggcgatggcagtgcttttcattgctgatctgttgaaattctgaaatggaaaaaaggaaaggagggatggatttgcctttggactcaaaatcaaatgtgccgttgtcagtcatgggaatgccattctgatcaaaacaaattaaaagctgttccagccatggggttcccattctggttaaataacaaatcaaattttaatgaaggcaaaatgtagttttgcagcacagtacaaattaaaagaaaggggaattgatctcaatcgaagatggcatgttttgggatgatcgtcggttggcattaatgttcacacatatttttcacacacatacaaatttaatgagaataaaagaaatacataaatgaggtaaattaagcaattatttagatcaaaattaagtcactcgatgtgaataaaataaataatatcaaatgaataaaatggggtctgggaggtcatgtcagaagttgccaaattgcacatttttccctcactcgtacttccttctcttgtattgggccagttgttcgtttccggtccttttcatcggctgctctcgttcgaaataaaaatttggccttcctgtcgggaaattttttattcctcccgaattcggatttgcatttgtcagccgtccgaatttttggaactgtggacgcttcctgaagcctttcccatttcgtcccgacttttcggcacttccatttcaaacgacaccttttttgtcggcactttaaactcaaatacttctgtcaggtgcttcaacatggcagttacgccaataaattttaagcgccctttttcgtcgacgcatcgcttttcttcctgtcttccccacatagtcacttccaagattgagcgaaaccttttcattaagcataagtctctctccggaacgcagtttgtcagcatttccaaaaattcattatgcttaacagccttaatgcgatggaacggtggtgggacgacccaaatttttaggccaaattgtccgatgtgtgatagaattttttaattgcttctttacaccattccattggcgtttccatgtccaaatcggctgttccaacacaaataatgacttcattcacttcttcaccaaatgccacttttgccaatacgtcgcttaatcccatgcagttatcagcctggattaattcggcatcgcatctttttccgagttcctccgccaatttgtctccagcaagaacaaatggggatcggataattcggtgtaagccatgaattttgattgagcggatgttttcgaaagcgcgggcaatttcaggcccaaatttttccaatggccccggagggatttcgaaaataattggcttgaattttgagtttttcaactcaggaaacgctctgttgcagttgttcagccatttttctagcgtcccctcaattcctccgactttgtttttcggatcggccacaaatttgatgagtgccactgggtctctgtctctttttgccgcccattcccgtagttgcccgtggagcacatccgaagcgaagtgaagacagatcagttcgctgagtttggaaattggcagacggcgcagcgggtcattgtttggcaattctgtgaaaattttgcccaacataatgcggcaacagttcgaatgctcgtctccctggcactccgaaagccaattcactgtgtccatttgcacgagacctgttgaaaatgaaaagaatttctgtgaaatgatcaaatttatttttatttgatcactccgtttttcagacaaccaattctcaaacactttctttttctgttgtcgtggcaaaaagactttatcgggaaattcttttggaactcgtgttaagttttctaatgggattttcattggttcagcttctgctttatcgattggtacaacccaagcggaagttggagaaagttgggttattttgtacggaccgtaatatttccattctagttttttgtgttctccttgtgcttttggtctaaagaaaaccattactttttcgtccaacgaatatttgttaggattgacattcggttttgcgttaaagtgcactttttgtgcttctcgtgccttcaccatattttgtcgtgcttctttcaaaatatcttcaaaattttcacgaaaatgttggaggtaatcgtcatgatcaatcagatatgccggatttggtctttttggggcggtaagatttgtcggaaaattgaccgttcttccgaaaaagagagtaaatggtgggaaaccagtggattcattaggagtaatgttgtaagaaaaaacaacaaatcccattcgtgtgtcccattcccatggtgatgctacacattttctcgtcatttcaacaattgaaccattcaaacgctcacacattccattacaagccggatcataccccgatgttgtggaccgcgcaatcagcaatttttccgaaatttctttgagagtttcattaacaaattcttttcccaaatcagaatgaatacgttagggtgcaccaaattttaaaatccatttttcgacaaattcttttgcaactgtttcagcagttttattcggtactgggacaacttcagcaaatctcgtaaagtgatcaatcattactaagcaatatttattgccattgcgagttggaccaagcttcaaaatatccatgcaaaccaattcggaaggtcttgttgtgacaatagggtttaagcccgggtgattctttttcggaattcggttatgcccacagactctacaacttcttgcccatcggtggcaatccgaatacatatttggccagaaaaaatataatgcttttatgcgcttgaacatttttttttccactctggtggctggcacacgacccagcgtgatgttcgaagagaattgcttctcgaaattttaaagggacaaaaatttcggtttcaaatttttcattcaaatgataaaggaccccatcttccaccgtatatttttcaagaacacttagcagtttttgtcgaagtttcggatctgctgggaggcatctttgatccaaaaacttaaaaatgaaattcaattctgacttttcaacttcggctgtccattgatcttttgaaacattttcaggaaaattaatttttttctgcgtgatcactgtcaaaattttcaccgattcttcttccttttttaaaaactgcaaatcattgggaaatgccctcgaaagagcatcggcgacgtaattcgtttttcctggactataaatcacttccaactgaaacggtgcacctaattccataatccatcgatcgactctcgcgtttccaaccgaattttttgtccgaaacatcgctggaagtgctttgtgatcggttacaacaacggttggcaaccaagcgatgtaatgcttaaattttgttgtcgcaaatttaattccaaggcattctaggacagttgggccgtatcttctctccgcatcgctgcaacgtcgggacgcataacaaactggacgcatctgaccagaaatgtctttttggcaaaggactgctccaagcccatttgcactagcatccgtataaacatggaagcgaaaattcgcatctttttgtgccatttcaaaatttggatattttaaaacaacatcatcaacaataatttctttaaagtcagaaaagcattttccgcagaatcattccactccaactttttgccatcttcagactttttcatcaaccgatttaagggaccagcaattttcgcaaaatctttgatgaattttcggtgccaatttaacattccaacaaatctttgcagctcttttacagtcttcggtctaggaaagtccaaaattggttggaatttttcgagatccttcttaaggccttcttttgttaggatatgtcccaaaaatggtatcgaattttgtgcaaatttgcattttttcgctttaacctgtaatccaaactgcgacaatctttcaaagactttttctaaatcgtgcatgtgttctttaaacgatgaactcgccaccaaaatatcgtccaaatacacaaacacacttttgttcaccaaaccttcaagcactttgttcataaccctttgaaaagttgcgggtgcgttgcacagaccaaaaggcatcaccacaaattcaaacaggccactcgggacagcaaatgctgttttagggacgtcttcgggatggactttgatttgccaatacccacttactaggtcaagacttgagaaaattttctttctccaagatacattagcatttcttcgatgtttgggattgggtagctgtctttacgagttattgcatttaacttccgataatcaacacacattcgcaaactcccatcctttttattcattaatacgaccggtgctgcccatggactgtttgaaggtcttatgacacctttaccgagatattcctccaacatttccgaaattttggtcctaattccaatggtatgggacgtggtgaacattttataggagctgcgtcgcccgtatcaattttatgctcaaccaaatttgtttgtgttagctcggactcatccaaaatcaagattttttcaaattttttccaaatttcctccattgaattttcttcagctttttccagctggcccaaattcatttttagtaccgacaacaactcagaaaaccggtcttcgtttccgttttttcttaagcagaaaaccgtatgttttggctgacaaattccatcaaattcatttgggaggatttcagtaccaggctcaaaaattgtctctaccatttctgcttttgcgattttttcaccaatttccaaagtcagcatttttggtgatttattgtgtaccaaaattttgacgaaacctttttcctccgcttcgacaatgcatggctcgacgaatgttccaccacttttgaccggcgtgttttccttctccgtctcttcgatcactcccaattttttcagtgccgcctcttcgtcttttccactcatttttaaaaccggctcattctgttgctgttcttcgtcgtagtccagcaaggactcggtgtccatttgatccataattagaaattttttggtttctaaacaatggaaattgttaatgaaagttcgaacaatttgtgatgaaaatggcggaatataatgtggttcaaagactttgacttcacgcatttctccctttccattgctcgttttctttgatggaaaattgaggatttcttttgtcaaagaatttccaaaataaaaacccaaattgtgcaaagccgtagtgcccaaaattaggtcataagaaaaggaatcacgggttattagacacggtatttggcattcaactgttttcatttgaatgggaacattaaccacaccaattacgtcgatttttgtgtcggtaaatgacgaaacagcaaaaggcaatttgcttttcccggtgtttgggctaaatccccaatctagcaaatttattcccttttctttcaccaacatatgcaaaaaaattgggtttacaatggcagtttcagcccctgagtcggaaagtgcgtctgccgaatttccaacgacagataagttcaaaaccaaacactccgaaatttgaggaaaggcgggattttctgccggaaattggtttgcgtgcaatgtcagttcattgaaaaattttacgtgttccgccataccgagctgtcgaacattaactgaactactttctttttctgtttcgccttttttaagaaaaattgtgtttgcacttcttgggtttgctctttccgattcttgttcggggggattagcgttcaaaggcattgcattgccaccggtgaagcgaattggctgattatttctccaattttggctttggttttgagtttggttttgatttgggaaatttcttcgattcccccaaaaatttccgtaattttgttgcctgttctggaattgagtgttcgagtcggtccggttccaatttctattgtgaaacggttgattttgctgcgtccgtcctgatttcgactcgatttttgcccggactcgttctgggtctgccaaatgtatgcgattggccaacattaacaattcgtcgaatgtttgtcccggcctgctttggcactccaaaaatctcgccaaatcgccatcatttatgttcatcacaaaaaatttcttggcaatttcgtccaattgggtttcattgagccctgtgtatgagcattttaccagacgataaattttctcaccaaaactcattaaatcttcatttggtgtgcgttttccgaattgggtcagctcggtaaaagctgatgcttcgcggcaatctgtttccctcaaagtcgaagcgatctcggcttttaaaattttgaatgggggattgggaccaaattttgaaagggcgatgttcagtgctttcagtgcttttcccctcaaccttgttttcaaaacatttacttgcttttcgggttcccaatcagccgtcagcgtctcaaccgtcaggaaaaaatcatgaattttgtcgcgaccctcagtcccttcaattgttggaatctctctcaaaatacttgcgtattgtgtggccaatgtcatccggtacatttgaagggccaaattttcactcattctagggaaccccacaaaattttcaccaaaatttctttcccccattctcatttggtcaatttcgggatgttgttcgtgatttcggtaaaaatcatttctccgttctctttcttcggctaaccggtcaacccttcgatgttcattgcctctttggtcatacatttcacgcctcaaaaaatttccatccgctaattcgtttctctgctcaatttgacgcggcctctgtccattccggtctccttctctttgcacttcgcggcctcgcaacaaagaaaattcacccaaatttgccctcctatccattaattcttgtccgcgttgattttccaggcgttcaactctccgtgcttcgtcagcccggtttctcaaaacactaccatacgaaatgtgcggactcgaaagattttgcatgtttagccggccataattttcattaatcgatgtcgaatgtgctgcaggtctaccaaaaatttctccctcgttggcatctgctcggcccaatctcactctttccgggatccacaaagccatttctcggccaaaattttcaaactctcattcctattcactaaaactggataagtgcggttttgattttcagccatttcattcacattttgctgggcgtttgcatttacagcctgagggcggtctctttccaatctccgaatttcctgacttatagcctcatcaaattcattctcaatttctgcccaatttcgccgattttgccggtctctcaaatcgtaccgtctctcatccggcacttgtcctccatcattctctcttgcatttaaaccttgacgccttcccgacatcctcggatcaaatgtgcttcttgtcgcttcggtacacagttggcgtttcccgaatgactggtgcagtccgagtgtcgcgccaggagcgccaagtcagctttctcgggggttcgcagcagggattttgggggaaagtcagagtcaaatacggcgagaaaaacgatcggtgaattcgaagaaatgtcaataaagttaaaaccttcactcagccaccgaatcacaaatttgatgataaatatttattttaaagagagaggaaatttcaatataattataaaatcggagagaaaaaactaataacgtgaagtgaaagataatgaatgtgtgtgtaaaaatgtgtgaaaaataacttaatgaatgtgaacagatcgccaaaagtgtgttcaaatattatcttctcacaattcaagtaatttaaattgttttaaaaatgaacaattttggtgatttttatacaaatttttataaaagtggaaatagaaatatttaaattgcttaagcttaaaaaattctactaactaaaggaaaattgtaattcagaaaaaataactttgtataaaaaacaaaaaatagtcaaaaaatctcacgcggcaaaaactgaagatagacgtgattagcaatattcactttaaaattaattaataggtttgaaatgtaaattaaattaatttttaacagtttcttcatcttcaattaataattctgcaatccacaattgcggacccactaaaagccggcaatttgagcaaaatgaaattatgttcagcccggccaaaaactattctgtacaatcaatttcaaattttattatttaaatttgaaattaaagaaagaattttttgaataataaaatgaagtcaaaaagaaaagttggtcggacaaagatgaaacatttcagtaatctgatcacattgacttaaaagtccttcacttagtttaataaattaacaattcgtttttctcaccccaaaaggtcggataattatcctaacatatttaatttactttttttttgattatttcttattctcaattttttttatacataattaacaataagccagtccgactcggtctttgcgatgtgattcattttccattccaccgatggcccactaattccatcccacttttccatcccaacacattcgtgtttatgaaaataataaaatgcatagaataatataataaataaatgtttaaaaatattcagaaatagttcactggaatgccaaaaatggaataataatcttcgacttgtacggatcaacaacttgatgaatgtatcggaaacctggtatgtatatgccaatagtgtcactgatcaaaaatgcgttgatcaagtattcatggttaatgagtttattagtgacaaatggtgaacaataaataaaacgaagtctacaatagatttaatgaactgctttgcatgaaatgcgtgcggattggcaattgacgcaaaagaaggccggcaatgtcgccacatgtgcacggtcccatgttgtgccgatcatttcgagttctcatgctgcacgacagagcaggtcgtccccccccccgcgaaattttttttaaatttttcaaaaattataagtaaaatttttttgaaaattttttcttataaatttttgggcaaaatctgttaacagattgcattaaaaattacaaaaattttccagacggcacctatcggcgctgccggactcccatgtgttgttccccaaatgtttttggaaaaagatcgccaaaagcggttaaaaggtcgtcgccatatggctcaaaatcccaaaaaatggcctttatagaaaaaaatgagtttcaaagcaaatcccgtgtgatcccgaaaaatatttgggattgatcgggattcggtcgggatcccgggtatctgtcccggttgcttttcaaaaatctacgggatagatcggtatcgggattcgatcgggatcccagttattatctgtccggatcgcttttcaaaaatcttcgggattatcaggaccgggattcgttcgggataccaccgaccccagctgtctggtccctaggggggggggg

SEQ ID NO: 1020 - DNA, 1257 bp, Heterodera glycines
cgtcggcaacgatgcgggcgggggaggaaggacgacggagtattggccacgcattttacgcttttggccacccccgaaggcagagaagcagggcaaaagcaatcaatttgcgtgccaatgaaaggcacggagaaaaatgtacagaaaagaaagggcgataagcctaaagaggggaatagagacaatgcaaactgaactgtgttaaagaaaaagaggatcgcgaaacattgtgaagaaagagtaaaaaaatagcattgcttacagacaattagaatgggacgagaaattaggtgggctggccgacagacagttagagcttatgagagagtgttgcaatgcgagagggtgggggagagtgcttgagtgagtccgtcagagccgaaagagtgcttaaaaaggggtgagattatctgctgctgctgaatgccaatgcgggggcgtaccccccgcccagcaaggctaagagaaagcgcattccatgcgccaatttggggcgcaatggacacgcggcagcggcggcagcgggtggcacaacaaagagaacaaggaaaaaggggagggggcggagaagaagcaatttcctccactcggcgggcgaaagcggtgcaaaaagcgacttgggatgggcagcccaacgccgccggaaggggtaaagcgggggacaacgaccgacggacgaaaccattgattggcttttcggcggtaccgggggcgactgtgacagacaatgaatgaatggtggcactaatgaatggggcggagagatggactgctggcccgaggcattagcggtctaatgggccgaaggattggctgccgaatggccaaagtgattaattagtggcaccgctacttcacttgttaggcataaggtcaatgatcacaatgatcagagagagtccaacaggtgaaaaacatttgatggcagcagcacagccccaagccaagtgatgccctgagggaacgctttaatgaggcgggcgggggacgccgcaggcaaaaagaaacccgtgacgacaccagaacaaagaccggcatcatcaaagcgggcagcagatagaccggagaaggagcagacaaagtgcattcccagccctttggcatttatatttggggtgcattccttcgtctcccccccccaatccctcgggccaaatttcgttagcctcaggggaaaagacaatttatcaaaacagataaaagaaagaggaagggggggggggggggattttgaggtttgctgaaaagcaaagaaag

SEQ ID NO: 1021 - DNA, 6693 bp, Heterodera glycines
  misc_feature (839)..(839): n is a, c, g, or t
  misc_feature (856)..(857): n is a, c, g, or t
  misc_feature (874)..(874): n is a, c, g, or t
ttcccttttttattttcaaatgaatataattttatttttaaatttgctttctcattgaattgccattttgtgcagtgtttcgcccccggcggcggcgctttgtgcccaaatgttttggttggttggcattcaaatggcggcacaacaacaaaaggccaacagtgcgttcaagaagaagctgaaggacaatttgcgcaaaaagatggacgagaaaatcaaaagggacttcgagaagggatggttttacaatgtaaagctgagctcggaagtgacggagcgggaaaagctgcgcaattggtgggctaatggggcaacaattattgaagtgattaaccggggaacttaatatgtgttaattattgaggactgataattatgaccagggttgccaactcaaaattttcaaaatcaacatttaaaaaccaacatttggggtcaaaaagtacctttttggaaatttttccaaatgaaaaacaataaaaaatgttttttttttgcggcgtaatttttcaaaaaaaaaaaacaacttatttttgggaacaggggaccggcgatgttgataggctaacactgtttatgatcataattaattgatggagaattgtaattatgctaaacctattaaaaaaatattattattgttttttcattttaggataattgatccaaatatctgacaatgaaaatggaatcgatcgtcgcactttttaatttttgctcctaaaattgtacttttaattttgttaataaacaaaagaattacaagcatttcatcttcaatatgtagacaatttttttgtggaattttacatgacaaaaagaaagcttttatatgtganaatttgcccacattggnnagacaattgataagaanattggcaaaatgttttttgggttttgttttgtcactttgaattcgttgaaaatgggcgacacattgcttaattgggaaagacatatacatttggaaataaaaggggcaaataaaagcgaaaaagcgaaaaaagggggaaatggtcagcagatgccattcccgcccgaatgctgatttttacaattccgatctcgagaaagcaaagactgggcaatgatgagatttttaggcaataaaggcataaattagccaattgtgaaaagaaatatttacttttcttatttctgtgccaatttttgcgtttccgtgcctaaaaatctcatccggacattgcatcgtttgtcggccttttgtccgttcgctgctaatccctacaaatggtcgaatttgaatgaaagcacatctctcagtgggaactcttccaacgcttcttgtctccatctcgtccactgttgctcagttctgccccgcttcttcggtccccgctccatcagaaacatttgtacataagtccctccggggacacgtcgaaatgagaggcgttcattggtttggccattgtccaacacgaaattgtcaagggcgaggccatcgaaagcatcgaaattgggttttaagccagggttgccagcggataagctcaacttcaagcacacagagaagctgataagtccaaggaaataatgcgaaatccaaaaaatattcaaaatttgcctccgatccattggaccaatttccaattgtgtgcttttggttggcatccaagaaggaaaagcaaccctgtttaaaaagagagatttgttcgaacacaaccaaaaagttgaccgatgccgtggcattaaaaaacaactgaaaatgagaaaatttgaagtctccgaaaaaggctaccgttttgagttcgtccaccacagcgggaagaagttgacgaactttgatcactttgggctgcccatcggagcgtgccgtgtgcagccatttggacaagggatggagaggcgaagaccaaatgcgatcggacttgacataagcgaaccaatcggcgatataaatgatcagtcggatagtggtcgaccattggcacttaaatttccatttttgatttaaaaatgggcatttacgtcgtttgagaaaaatttcgggtaaaaatcggaattttgccgtttttgcattgttttaattggcaattaattgactttaccgttgggctggtggacggaaacatttcctgccaactttcataacaagcaaattgaattttgttgatctcgcaatcgctgccgcactttgtcggttttatcaaaggcaaaatttggctgacaaaaaacgcgtggaggggatgagaattggccgtgtcgtttaattcgtaagtctcaaatttgcgtacaccgcacaaactcaatgtgacgtcggcggattgtaaaaggcggcgattgttgcggagaaaggcaatgacattgctctcgaattccctgtgatttgaaattgcccattgctgatacgataatccaggatttaaccaatatttaaataattaaaataaaattaaattaatcacataataattgtatttaaattttcccattagggttgccgtctgaatcccgatgttcttcccgtcccgaatccctcggccggcaattttctcgaccgagcccggaaaccctgaccctcattagtcgacaaaaaattctgagttcgctaagaacagggcaattcgtgtcccaattttccggcttcaacttactctatgcaaatcgttctaaagccgcggataaagtgcggcattgtcactgtcggcaatttcgttgccgacgagagggccagaggaggacgaagcggaatattggtgttcaacgccgacggtacggcgagggaactgtcagaggatgaggaaaatgagtgggccggggggatcttctgccacccccccccccccgcccaaccgcgggacccgaacaaaggagggaagaagcgccgaggaggacggcgctgatcgaaaattccggaggggacattcccggataaaggccattgccgtggtgaacgatccattttttaaatttgtcgacattttcacccctcttatttctctctttatttaaacttttcatttcctttcacttttgctcatttacataatgttttccttcaacttcaccatttgccttttctttccaatttttttgcccattcacatctgcctccgattttgattcctttgttcacactttctccgatcgccatttccattgggccgtttttgcattcatctcattttttccctttgtttggcatttttctccccgccgatttttgtacccttcggcgtcgctcttttgcatcttaatctttgcccccccccaggggaaattgtttttggtacttaagtattcgattatcgtctatttggcacacacacattcacctcttgctcttcacttttttcactcctcaccatctttttctttttgctgaatcattcccaatttttgaccccctcaataatccttatcgcccttcccttcctccaattttcaccatataatccatcaacatctcgcatataatcatccaccaatttttgaccattttatcatcatcatcaccaataaacattttgtcggaaaagtgttgaaagggtcagagggcaaaaaaggggggaaaattcgctcgggaacgaagtgaccaaggggagccaaagccccgagaatcgaagcgggggacaatcccccgcagagcagcagcaaacaaggacgggagccagttcccggcggttgacgcagttcgcggccggaagtccaactcttctcccgaacctcaaccgggagcgccggcagctcttcaaaaagtcggtggtgccgttacagcaacaaccgcaaaccccatcttgtttgtcctccccaccccctccccagttcactcccttgggcacggacccaacggcagcagtagcagtttcaggaaattgagtgaattgggcccgagggacgggagagaaactcccgcgcacagaccccctagccgtcagcgccggccgagtttctttgccacaaacaatttggtgccgttagcagggggaccagcaacaacaccccggtcgcaaaggaccagcacaaccaccagcaacagcacttcggtcgccgaggaccaacacaacgcatttgaacaaaaatggagcgacacgacgacgaccaattcaacgaaaacgcgaatcagggggatcctcccccctctgatcagcaggacgagaggcgagcgatcggagctcagccagctaagcccaagacaatcttggaagcgcacggacttgggacaagccaaccgggtgttacacccgccgtgacgaagaatttgcgtagcggactaatcgcagtgcgatcggcacgggaccaaatcgaaagagcagcgggcactcttgccgcgcgaatcgtcgacgcgcgggagctgatggacgacgattacacaaggggcgaagcgctcgaacacgctgctcggatgatggcaatggagcgggggttcggagaagtcaagcgaatttttgaagggcattttgagaagggcatagccgaagcgggtgcggcacctgatgaacggcaggacttcttctatgattccattgccgcccctttgccagctgcaacgaaataccttcgactgcgggagcacccaactcccgccgaactccttcaaattgcggccgagcacctcggggatctgcgagcgatgcggcaaacattcgaggacgaagaaagggagagcatctctcgatcgagcagatctgtcgaaaccgagaacaatcaggcggaggaagaactcccacgtgccatgccacgacggagcatgcaagagtgggagacatcgttcagagaagcttatgttcgacagcatgacgaactgttcggccagcagcaaccattggtcaaccaagcggaacgggtggccacacccgtaatgtcaaacatggccgcgcttatccaacgacgctcaaatgctccctcggtggccagtgttcgtgtgaacaatccggtcagggagtggatggcaaggaaccaaggggtcgggaacggacccccggcacaggcccaacaaccaacacaagcgcaacgcccgctacaggccgtacagcaacgcctcgaacaacttacgctcaacgatccaagagccaatttccctcgggcagcacctcatttccatgtccgacgggaggaacctcccactcgggaccgtacccgagctcagggggtatttccttcacggcctcatcgcccagacgaatcagctggcatgttaacaacttttgaagcagtgcgcctacaaccgccgacattttcggggaggccggaggattggaccactttttgggcctacttccaacgggccgtggacgacaagcaaattcccggcttcgagaagcagcttcatctgctgcggtgcttaaaagaaggatcgccggcacggagagcggtggaagtgtacccaccgtcggatggcaattatccggttgtggtgcagctgctgaaggaacgatttggggacacgaacgacttgcaaagagcgatccgagctcagcttctacacttgcagccagcaaaggacaacgtgtcgagcttgacggcagtgatcgacgaattcgagagaggagtgtgccagctcgaacaactgggagcgaacgtggacgacgagtcgttcggcccgttgttggaggccaaactcccggtccacatcctcacagaattgaggatccgggagagtacgatgggagcaaactggacagtgcgagagtttcggaaagcggtgggagtgcaagtcaagtgcatgagggccgccgaatccgcgttggcagcaatgaaaggacccgaacgccgacatgagcagcgatcggagcccgagcgaggcggacggaacgcccgaacaggacaaggattccagcgggcatttatgatcagagatcagcccccggagaaacgaacgtcgaacgaagcaaccaccaggaccgaagtcgcgatgccacccattcgaccaacgaatccgaatcgtgtgccgctcgggagttactcccgaccgatgggagcgcattcccaagcacaggatggacagggaggacaaccccgacaagggtgctcgttgtgtggacaaacgggacaccaaccaagccggtgtggcaaatatgggtcagcacaagccaaaaggaggagactgatcgagcaacgccgttgtctcaaatgcctgggatccgatcacaccgcgcagcagtgtacacgaaaaacagcctgccggacgtgcgaacaaatggatcaccactggctgatatgctggaagggggagagaaggaacgaaccccctagccactcgagaacggaagatgcacaacaaaatcggacgatgatcattcgggaaattgaagcgaagcacttgcgcactccccctcccaccgagtccagcaaggacgggatgggggctaaaggggaggacccacctttgctcgacggagagcagagagcattcaccaccgtgggccagcaactcccggcctatttaatggtgtgcccggtggtggtggcatcggaggatggcatgacagaatgcaataccaatcttcttctcgacccagccagccatggcgattatggggatgcggctctgatcaagcagctgggcaccgagaaagtcgggagtgaccagctggcaatccaagtgttcggtggaaagaaagtgaagctacaatcgggaagatacaaagtgaagctcaaacggctggacggagaatgggaaagtattgagctttctgaggtgccaacgatttgcactccaatcaggac

SEQ ID NO: 1022 - DNA, 4953 bp, Heterodera glycines
tcggcactgtgatttgcggggagcagattcagaccacgacgggagttactcccgattcgtcggtattcgcgatcccccccatgtggggaggacgagcgggatcaaatgccatcggtcaaagcaatcgaccagttttggtcggttgaagcgatcggaattcgcgacgacccaacacaagacgccgacacggaggcgatcatccaattcgaacgatcagtgcggcaacacgacgacggacggtacagcattcggctcccatggcgggaggaacatcccgagctgccctccaattatgcggtggcttatcgacgactgatcgggctactccagcggcttcagaggacgcccggagtcctcgagcagtaccaaggagtgatcgaggagcaattgcgggctggcgtgattgaggaggcgacagtggggacgggaagtaccgagtatttcatccctcatcaggccgtgatcacccccaagaagctgagggtggtgtacgacgccagcgctcatgccaaaggagttccctccctcaacgactgccctttgagaggccccgtgtggctgccagacttggccggaatgctcatccgttttcgggcatgccaagtacccgtactcgccgatgtggagaaagcttttctgatggtcggcattgaagaagctgaccgagaagtgtgcaaatttctgtgggcgcgcgacccacttggaccactgacaacggccaatttggtgccataccggtttcggcgattggcgttcggcctgacacccagcccgttctgtttggctgcggtggtacgtcaccacttgcgcaaatacaactccgaatttgccgagcaactcatccgggatacatacgtcgacaatgtgttaattccggccgacaccattgaggaagcgacggcaaaggcccgagaagccaaacgaatgttcacggacgcaaaaatgaatcttcgggagtttctgacgaatgacagagggctcaatgacagcttttcggaagccgacgcgctgggcaaaacgacagcgaaagttctgggactggagtgggactcagtggacgattcaatccaaatttccttcccgggagttactcccgagggagagtgccgccaaacaaggaggacagtcctcaagaccattgcgcgactgttcgacccgctcggactgctcgcaccggccaccctccccgccaagcagtacttccaaaggctgtgggacactacccataattgggacacgcctctcgaaccggacgatgcgcgagattggaacagagttttggcaagttgggaagggggactcattaccattccccgagccgtccgggctggaggtgtccaacccggacagctgcatgtgttcaccgacgcttcggagacagcatacgcagccgtggcctatctccgatctgagggagccgacgggagatttcactcccgactcctcatggcaaaatcgaggctgaagccgaagaaagcggcagcgacgtataccatcccgagaatggagctgatgggactggtcctgggcacgcgactggcagcattcgtcaaagcgcaactgcaccgcccaatttcggaggagcacacttggagtgattcgatgattgcgctgcagtgggtgaaaaatcgagcaccccaaccacaattcgtggccaatcggttggccgagattcgccgggccacagctacgaccttccatcatgtgccgaccggcttcaacccggccgattcggccactcgggggctttcccccgcgcagcttcaaaattacgatctgtggtggaagggaccgaagtggctaacatcgccatgggcaacttggccaaaggagctggactttcaggtggactcagccgaggacgaggcgatactcccggacgaagcaactacgacggcactcgtaaccaggcgggagcacagtcccgagcaaccgaaggaatggtcggaggagctgctgaacagatgcagcagatgggtgaaagcactgcgcgtgatggcctgggcacgacgatttgccaacaacgcacgaagaaaagccgaggatatgcacggaacaatggggggatctgacccctctcggcgaaaagcggcaattcggggacaaatcgtggctctcccaacccacgacgaagagacggacgcaaaatgggcaattgtccgggcaacacaacggaattgccaaccccgggacggcatgcgaaccgagctggacgaaaacggggtgcaacggctcatcagtcgaatcggctggtgcgaagaagcggaactcagtcggccggtgatactcccgaaaagatcaagagcaggagcgctcattatcgacgacatacatgtgcgactccatcacatgggaacggacggcactctgtcggaattcttgaggagctggtggtgtcccagtgcacgacaacaagttcggcaagtacttggtcaatgcaaacgatgccgacggctcagggggatgccctaccccctcccgacaatgccacaactgccaatggatcgagtgagacgacgattgccgtttgaatcagtcgggctcgactacctcgggccgacagtcactctcgacgataagggacaacgaaggaagacatgggtgctgctaatcacctgtttgacgacgagggccatttatgtcgacgcgactcgagacttatcggccaacagcttcatctcagcactgaggagattcatcgcccggcggggagcaccgagtcgaattctcagtgacaacgcgccaaccttcactgtggttggcaaaacgctcgccgagttcggcatgccgggagacaatccgatcgattttgcggactcccgaggcattaagtggcgattcacgccccagcacacgccgtgggccggaggaattttcgagcgggccgtgcaactcgtcaaacgtgccttgcagaagacattgggaagcactgtactcgactacgacggtttggtcacgctcttggccgaaatcgaggccaccgtcaattctcggccaattacatacgtcaatggcaattcgggagagcctctcccgctccgtcctatcgacctcatccaagaaaatggccgattatgggtggacccgccgcacccatctgcacaacgaggagacgaaccgcgcgatccgacgcacaaacaattggccaaacattggcgagactcgcaacaacgacttgaacatttctggcgacgatggcaccgggaatacctcatgaccttgcgagagagggccggctggcatcatcctcaacgacgagtgaatgcacccggggcaccggaagtcggggacgtcgtgcttgtggaagacaaattccaccctcgcaacttatgggccatggggcgaatcgaggagctcagaggttcagacggtcacacccgcagcgtgctgatcagaatggcaaatggaaggatttgggggagacccgtaagcaaaatttgccccctggagagaagtccagaaatgggggaagcacaggaccaaccagacgaagcagtacaggaagaggaactcggcgcggtggctgggacagaagccgaaggtcagcccggggaggacaacaatgctccccgtggcttgagtggcagtgagggagaaaaaactgtggaggctgaagaagtcgcgcaagacgaagcagaggaagggcccattccaccgagtttcgttcaaaacgaagtcgggagcacctctcccgtgtcgcagacaaatgaccggtctctattggaaaccatgaaccgagagacggaagcggagaaagctgactcaccggagggagcgaacagcatgcgaggaattgaaccaagaaggtcgcttagagtccgacgaattcgagaagtatggtcaccggaccgatacgccccgaaaaggagggggattggaggccccctagtcagcttggccatgctgatcatgttggtttacccgactgtgacattcgggtgtcaaccgactatccgatccgaaattgttgggaaacagtcgctggagttgccaacaacgatgttgccgtgccacatgcggtgtactgaacgcggagtaaaagtactgagcaagcagcgactcgaaaaaatggaaatttgttgcccggatggatgctgggcaattgtgcccacttcgacggagatcagttacgagctaccatccagcgagagcagaatgcgatctgatcagttgctccttctgttgggagcagctggccaacccgacatgcaacccgcggtgggcatcctctttcttcggttttggagccgcaattttgctcggcatcattgcttgcctctgctcaatttttgggcgatttttgtcaggagccaagttgctctcgaaagccgtggcatggggagttcgttaccccatcgggctgatcaattgggcaaccggacgcaattacgacggcggtcaagcggtgcccatcggctgggtcatgccgcggcaacatgtgcaactcaatccggagtgagacggtcattcccgaattggccgagctgaacaaccgcccgggacactcgttttgcatgcgtagcaccagtttctggcagaacgcctgcggacttccaacagcctcttgcctcttctacagatgggcggcggtaccgacaacgacggtttgaggagtttacttgcctcgaatgggacatgcagatcacggcgtgggtggagctggagacgaacagtggacaagtcgacacacatctgctgactctacacccgggagtctcggaacagtggggaaatatgacaattgcggtcgtccccacttccctcccgcccaattatcgtgtgctcttaattaaaagatgtccatagttttgacttaaatgaattatggttttcagacttttaaggacaaattttttctataaacagttcacagatgttgcggtgaatattaaaataattcacccacttcattacgacatggaattaattactgaatatctgttttttataaaa

SEQ ID NO: 1023 - DNA, 1313 bp, Heterodera glycines
aataatataaattttattttactcataataatatttttttgaaatggtcgaacccacgatttaactttaaatggtgtcgacggttttatttatttatttatttttataaactttattaaggaaatttagtttttaaataaatattcatcatgattatttattatctctcctcacttgttgaaatagtatttggttggaagttttagttggcaaaatgaagaaataattactaaattaaattttatttttatttaaatgttcataaattaaagttaaatttaatatttagattttaatatttttcattaatcttttgctttacaaaacctatcaaattcaaatgattgattcataaaatttagagacttaaataatgagtaattctatttcacatttagtcaaatatgtttttatattaaatactccatttatattaatttttgctattcaataattgaaattgaccagattatgttttttaattgtaatatttttaaaggaatttaattcagttaatttttttaattttttctcatggtgagttcgtggggttttttttggcgaagcagatgactcatatatacaatattttcttttttactaaatgcttttattaaattattagggccgataaaccatcgatataattgattttttcaatcaataaattatttacagttttaaggttaattactatgtttttgttactgttttaatatgatgacttaaataaaaatattatttccatttaattttcgcatatttttctcttttgtttctcagattcatctgtcatttagggcttttcgataagatcactatctagccaagtttgttttttttcgacaaaatgtcaatcttttacaaccaaattgatcagatcattgcttcaaagcgacggtacaccctaaaatacacagaaaattggggaaattttaggaaaaaatcctatgcggttgtttaaatgtttctagaagaaattaacaacccacaggaaaactcaatatatcaaaaaaatttaaaaaagggggctgctactacaattattgcaattcctagagcacaaaattctctactgaattacattttgaatattgtggataaaacatgtacaaaaaaagttatagttggttgaatttgatgattataaatttactgaaataaatttatttttcattgtcataaatattttatatataaaattaatgtatggttataaaaatgtaagcatttccgtttatttattgagtattaatatttaatttaacaaataaaatgttttaattgaataaaaaattttttttttgaaatac

SEQ ID NO: 1024 - DNA, 5991 bp, Heterodera glycines
  misc_feature (5976)..(5976): n is a, c, g, or t
  misc_feature (5985)..(5985): n is a, c, g, or t
caaataaaactattttatgctcattttgaagggaaaattctgaagaatgcttctaagttagtcattaaaaaaatgtttattggcaaataattgattcatgtgtaattttatatgtatgttagagacatggaaatagcacgccaaaatgagagaaaaagaaaaaactttgtcctggtaaaaaaattttcctattgtcgtgcccattatctcactctagcgattccaagtttattttgtgaaagttaagtttttaacacgagatcgattcttcctttttaacacgagatcgattcttccattttacaagggaaaagcccaaaaaaatttaagttttgcaaagttttggcgttatgattactaaataaactgttgtgttcttccacttagaacacacaaagaaaaagaaataaataaataattttattgattcggtcggagggcaaattggaaatataaataaatgaatgatgaaagggaagaacaaaaagtgggaggaggtgtccacttttatggacgagggtgggggcggatggacatagaaataacaaataaagtcaataagtcagatcgccataaattcaaattattcactatccaacatctccctcctcaattcttgaacggcgtcagcctggcgagaagcggatcggcggtttggtgttgcgactagagcgtctcaatgccatgggtggtgaattggcagtagttgggtggatttcgtcgggctgcttccgcttttggcatttcggtgtcgtgttttggcgtgccggtgttggatggttttgatgtgccggtgaatgatgatttgggtcatttgccacctgggcgggaccaacaaatcctaaactttcttcgaagacatatcgacggcgcatttggttggcatgtcgatgaatgtttcgtccgagtcttggcacatttacccgataagttggcgaattgttgagtcgttcgatgactgtaccttggagccaatgtgtcttaccatgctggtaattcaaaacaagcactgggtcagtcggaagaaactcatttgacttaactccatgcttttcattaaaattttgtgccattttcgtgcggtatttttcctgtttctgatgaaaaattgtcttgtcaattgtctcattgacttttcctgtcggatgtgtaagagacaattgagtgcggagttttctaccaaagaataattggtccggtgaatgtccattaattgcagaattcggtgttgttctataggacaggagcattttctcagcccaatttttgtcctttttcgaacacttctgcattgcccttttaaaagtgtcgacaaagcgttcgacttggccatttgactgtggatgaaatagcggcgtgaacatatgtcgaatcccaaattctttacaaaattcggaaaattctgacgatcgaaattgtcgtccgttgtccgagacaatttcttctgggattccaagccgattgatgattaatctgagaacactgatcgttgctttcgctgtcatggtgttcatctgataaacttcgggccattttgaaaaagaatccactaaaagtagataaacatgaccgtcttggcatgggccggcaaaatcaatatgcacacgttcgaatggccgtttggtggcattccaaggagaaagtggtgcttttggagcagctttttgggcgatttggcattcttcgcagctttttaccaatttctcaatggctgagtccattccgggccagtaaacgtgttggcgagcgagagccttcatgcgcacaattcctgggtgtgccatgtgaagtgctttcaacgtcctatctcgcaaaattgttggaatgatcacccggttttgataaagcaggcaattctcaatttgcaaaatttcgttccgttttggaaagaacggtgcgaggtcggggtcattacacttttgtgaccatccttccttggagaatttggccactttttggagaatttcatctttttcagtcatttctgctatttcggtggcagtgacgggaagatgattaattcgtgcctgcaaaattgtgccgatgaaacattctgtttcggtgcaaattttcgctatcaaaatatcttcttcaggtcgcggataattcgcgataagtcgtgaaagcatgtcgacttgaccaaacgcagtggtattgatgtagcgaatgtcaaattcgtaatttgacaagataagcgcccatctttggagtcgacaggcggcgtaaattgggattcctttcttggacccaaatatggaaatcagcggtttatggtcggtcagaagtgtgaattttcttccaaaaatcattctgtgaaatttttggacggcgaaaataagagccaaagcttctttttcgacttggctgtagttccgctgtgcttctgaaagaacacttgacgcgtgctcaatgaccttctccgttttgtctgggaaaatgtgacttatggtcgctccaattccatcttttgaagcatcagctgcgacgattattggaagcgaggggtcgaagtgggttaaaagcagatcagacaacatgatctcttttgctttttcaaaagctttctgctggtcttcaccccaattccaaagttcgtctttccgaagaagttggtccaatggcgccctaagttcgcgcatctttttgatgaaccgactgtagtaagtaagggctccgagaaatgagcgaagagtcgatttgtcatgtggcactggcaattttcggattgcatctgagcggcctggatcaggtctaattccattagccgacacaatgtgcccaagaaaaagcaattctttctgcaagaatttgcatttttcaagttgaatgcacaatccgtatgctttgaatcgtgtgaacaattgatggatggctgaaaggtgctcttcgagggttttggacgcgattagtccatcatccaaataagcaaatgctccggggattccagcacatatttgatccatcaaatgttgaaaaattgccggtgctgatttgacgccaaatggaagacgttggcactgaaaaaggccacgatgcgtgttcaaaacgcagagctgtttggattcgtcatccaattccatttgtaggtatgcgtcttttaagtccaaatttgtgaaaaatgcagcgccgcttatggctgcataaatgtcatcaggccgagggagtgggtggcggttgagttcaagtgcattgtttaagccagttgagaaatcaatgcacactctgattttgccatttttctttttgacggccaaaatgggtgctgcccaatggctaaattctatcggattaatggcaccgatctgtaagaggcggtccagctccgtgttgactgcttccagtgagccatgaggaacgggtcgggctttacagaaaaccggtcgagcgtcggatttaagaatcaagtgtgccttaatcttggtgcactgtcctagctctttaccaaaaacatccggaaaattttctttaagagccgtcgtgagtgacttaacatcggcgatttcttggaaaggtgcggcagatgatgcgcggattccaaccgatgtgtgcgtctccggaaacatgatttctttgggaatcagttccgttgcctcaatccatggcaaaccaaacaaatcgtaattgagctcttcagtcacataagctgttagctttttggctggttgtcccttaatgctgacaagacatataaatttgccaattgtgttaaatgtgacgtcgttgcagttacgagtctcaatgtcggttggcaacaatttaggttgtcctaatttggtccatgtttcaatggtaaggactgtcgcctgagctcctgtgtcgacattcatttcgatttttgtgccgttaatttcgaccaaaattttccaccaccgtccttgagtcgtgccaatttgtaggcatgttgctttgacttggaccgtgtgaaatgaacggcgttggttctttgtcgtgaatgctccctttcggcaaacattagcaatgtggccttgtttttggcaggtgtggcatgtcgcttctcggaagcgacaatctgatctccagtgatcagtaccaccacatgagccgcacggctgggtcggttgtccacgaattgcttttcctcctgtggccggtttttgctgtgccgggtggttttgttgcacggcatttgctgatttggccttggtttttgattctctccactgttgagggcgagttcggatggcatttgtcgaagctggcgtggaaaggagtgacaaagcgctatctttaacaatttggattgcttttaactcctcttccaactttttgagtgtgactgtggtgccacttttctcggcttcttccatcattttaagacatttctgcctcaaatcgtgatgttcatccctcagtgaaatcaccaaaatcatgcatttgagctgttccttggtaaggctcaaattggcatgctcacacgctgcgttgatttgagcaaccaaagaactgatgtcttggtttggatgctgtctgattcgaaagcattcatatcggcggacgaaaagagagcgcgtttcagcgaacaactcttttaatctgttgattgattcagcccacgaagctttgtcgggcaactccgggctgattgtgtccctgtacttcgtgtactcttcgtctccgagctttcccaacaatagtcggactttggcttgctcggttaagtctttgccatcctcttcaatcaatatgccgaagcgtttgtgccactgttcaaatgtttgaccattctcggggtcataaacaaactttgaaattctactgtcgattgagctggccaaattcgcttggcttatgcttgaagcggcatttccttggagcaaagcggtcaaaagttgttgaatttgttcggcgttcattgtccgtcaattgaaattgttgaaaaagtccacaaaatccacacctggtggatgcttacaccgtcttggtgctaagctgacgaatttgttgaaaaaccgcttcttgcggaacctcacccttcttaggtctattggtttttttgttgagttaaactgcttcttagcagacctcacaccacctgggtgctattggtttttgttgaatttgcagctgtccttgtcctcagtgatgaagaatggctgctgactgcgccaatttgttgtgttcttccacttagaacacacaaagaaaaagaaataaataaataattttattgattcggtcggagggcaaattgggaaataaaatataaatgaatgatgaaaggaaagaacaaaaagtgggaggaggtgtccacttttatggacgagggagggggcggatggacatagaaataacaaataaagtcaataagtcagatcgccataaattcaaattattcactatccaacaattattaaagcaaaaactgtttctctcatcaaactcacccaatgcaatccttaaaaagccaaaagttgacatagttcaaattgtgccgacttttatactcccactgaatcgccgccgtctccccaatttggcatcgtttcaacagccaatcactacaaatgaattgttcataatcggcttctttctccagtatcagcatttctttagtccgttcgttcaccaattcaaatggctcaaattccattaaatcaaaaagttcaattcgaattttgtagcaggcagaagtggtggcacggagaaatgcctaaacaatgggaaacgaaaagcaaatgccaattaatccaaatattttaattgaaatcataaaaatgattagtcccgttgaccgctttgaaactgtcgatccattcgtaaatgttttctgatccgtaatttatatatatcaatcgcttgggttggccatcttttgtcggagtgtgcaaccatttggacaacgcttggccagcagttggaattgcatttggatcatcattcccatcgaggaacagatcaccagattgtattgaagtcagctgattgaaatcagtgagaattgtcggcgaagtgtgngcgacgcanaattgt

SEQ ID NO: 1025 - DNA, 1359 bp, Heterodera glycines
tttcccaaatttccccaattttcgtcctccattccctaaaattggtcgtcccgcattataaatttatttatttatcatccatcaattttgttttttttgtttcgtccactaattcaaattcattcatttattcgtctcgccatttaaactccgttctcgcctcgtcccgtgccttttgctgttgtgctgtgctaatcgctcaccttcggcctccccacccattctcttctcattcatttctccccattttttttttgcccctcgggcgacgaaatttttttttttttatcgaatcgaacacacacagcccaacaaaacaaacaaaacgaacgaaccaaccaacgacgggaggacggagaacgacgacgacggacgatggccccgcgggggctgtcattttttgggggcgcatggggggggggccaccgacggaacggacggacagtctttggtccgtccgtccattttttggaactttttttttcgcccatcgcctcgacactacgccaagcaaaaaaaaaaaaatacaaattcgtaaagtgtgaagatgtgagtgaatagggaaaagggaaagaaagaatatgtacatagaattaattttttttaaagaattagtaattttgtttacttttggcagtttttttttcaaaaaaaaaatttttaatttaattttttaaagacattttttttgtgatttttaatgtttggaaaaaacaaacaaacaaatcgcttcttctgctgtttgtttgtttggcctgtgttctttcttcttctgacgtgtcaattttcaaacaacaaaacttttttttttgtgtgtaaaatgaattttggtactttttttttcatgggacaccgtttttagtggtctcgttttttttaaattttaaaatcagagagagggtatgtgccttggtcttactattgaggctcgagagaacgagacaagcttaaaccgaccaagattttaacccaagaaggggtattatgactcaaaacttcttgcttatttagccctggaaattttgggccgggaaacagggtttgcagcatgtcgagaaaaatgtatgccgagtcgggattagggactcggggacggccatagttcgggccgggacttgggacgagaaaaaagagatgtgtctggtttcgacgagtcaggtttcggcattcgggtcggcaaccctggatcggaaatggagtcgtcaaaccgccggcaaccccaacttttgattatctcgagaccaagctttatctcgaaacaaccctttgcccaccgatgctcgagactcgagactgcctccccaataactgggcttaaaaactccatttcgagactctcgggcaaccgggggggggggg

SEQ ID NO: 1026 - DNA, 631 bp, Heterodera glycines
ccccccccccccccagtctccaatttcattcactttttttttgttttatgtctcctaacccctcaccccttcggcattccccccctctacccaacctgcaaatttttttttttttgcctcccgccgggcgttgcaataaaccagcggctgtcggccggccggcagctgctgagaccgacctgcgccgaccccggcggggcgaacacggacagagggggggggggataattattgctctcgagagtggggcagtctcgaggaaaccgaacaacaaaaaagagagaaagtgaagtgtgtaagctgtgtcatgtgagagggggcggtaggcggcggtccccacccccaaacagttcaccagacattttgggcgacgaccaacgacgaacccatggacacaattgggggggggggggggtctggaattttgttgatgtgaatcatcatcattattattatgtattgtggagaagagaataatgggcgtggtgccgccgccgtcccgcccccggggcgatggatgtgcatattttgtggggtttgttgacgacggacaaaaaaaaatgggtaaatgccccgggggtaacgacacagcacaacagagacggagggcgggggggcagagacggtaaat

SEQ ID NO: 1027 - DNA, 2991 bp, Heterodera glycines
tgttgttggggatgtattatcgatattgactgttgttgttgcggtggttgtggtattgatgcagatgccaaattttgttgtgttggtagttgcgatgacgaggttgacggttgatgtgatgttgcttgcgcagttacagcagcaacgacagatttaaaaagcgaatctgcagaagtttctgtggggctgaatgcgtgttttgttgtcaagagttgggcgtccgtttgtcgcaatgtctcagccgtttgtagaccaaattgttcattttgcgcgaatgccattgtctttttgcgttttgcaataggcgccaagggaaaaatgtcatcataaaataaaaaacaagttacaaaaagggttaagacatatatgtccttacaatgttgacacagcaatttgtggtctcatcaaaaccatgtatttttagagctccatttgtatttcgaagcatactataattaattattttttcattaaaacaaggatttatatatttataacccaatgttaagaaagaaattttaataatttataactttaaaaattacatttttcgtgccagagtgatgtctatgtgtccttcaattctggtgcgcttgtttatttcttcgaggagtaaaagaagtgactcgccagccttaatgttatgtcaattttttcaaaataagattaataaaattacatgctcgagtacatccgtttccaataaatactcggattccccttggaacccaattttccaaaaatggcactgtttttcgcatctaatacagctacggatgtcgtacagccgaagtgacgttatttcgtagaattcctttccttcgtcatgaaagtccctctggcattgctccatgtggcgatgcgagcaaagctgaaaaataagcggtttatttcgaagttcaggcgagcaaacgcccaccttccggcgagcaaacgcccgccttctggttagcaaacgcccgccttccggcgagcaaacggccgccttccggcgagcaaaacgcccgccttccggcgagcaaaacgcctgccttcccaagagcaaaacgcccgccttccggcgagcaaaacgcccgccttccggcgagcaaacgcccgccttccggcgagctaacgcccgccttccggcgagaaatgcgcccgcctttcggcgagcaaaacgcccgccttccggcgagcaaacgcccgccttccggcgagctaacgcccgccttccggcgagcaaagcgcccgcctttcggcgagcaaaacgcccgccttccggcgaggaaaacgcccgccttctggcgagcaatgcgcccgccttccggcgagctaacgcccgccttctggcgagcaaaacgcccgccttccggcgagcaaaacgcctgccttccggtgagctaacgcccgccttccggcgagaaatgcgcccgcctttcggcgagcaaaacgcccgccttccggcgagcaaaacgcccgccttccggcgagcaatgcgcccgcctttcggcgagaaatgcgcccgccttccggcgagcaatgcgcccgcctttcggcgagcaaaacgcccgccttccggcgagcaatgcgcccgcctttcggcgagcaaaacgcccgccttccggcgaggaaaacgcccgccttctggcgagcaatgcgcccgccttccggcgagcaaaacgcccgccttccggcgagcaatgcgcccgcctttcggcgagaaatgcgcccgccttctggcgagcaatgcgcccgccttccggcgagcaaaacgcccgccttccggcgagcaatgcgcccgcctttcggcgagcaaaacgcccgccttccggcgagcaatgcgcccgcctttcggcgagcaaaacgcccgccttcccgcgagcaaaacgcccgccttccggtgagcaaaaagagaaaaaccccattaagccacctcttgcgattgctgacgtcgtgtgcgtgctcctccaatcaaagtcagagacaggtgaagcgtcgactcgttctggatgttgtagtccgcgagggttcgaccattctccagttgctttcctgaaccgtaattcttttaagaaaagtttaacaaacggaagaattaccagagaagatgagacgctgttggtccggtgggatgccttccttgtcctggatcttcgccttcacattctcgatggtgtccaaggaatgggcaaaaatagtcagcgtcattcccccaagagtcttgacgaagatttggatgaaagtagttttctttgcagttattcggtggcaaagccgcatgatgattgaataaaataatacataaagaataattatttcaatcatttgtaaatactgaatgaaaaaattaaataattttgaaaaaggactcacatgacagaaaatattcctaatttttattatgggattcgggatttaaattttatttgaatataagtaaaaaaattaaaagaattaaatattaaatttggtaaaatctttaatcgcataaaacgaatgaataatttttttcaaattcaacgccatccaaagttgcggaaataacggcgatgggcggaaaagaatcaatgaaaaattgctgttacttagggggggggcgactggtggaggcagttgcgacgccaactaaaagacccagttgcggcgataacgatggacggaaagaatcgatgagaaattgttgttatttggggggggggctggtcagagtcagtgcgcaagacgaatggatgggaggcttgtgaaaaaacagagaagaagaggaatccctgatggaaaagagaaagcgcaacgaaatttggaaaaggaaagggcgaaaatttggaaaaggaaaggggggggggggaaggaatttgcgagttatcacatccgttcaatctctttctcacaccatttatccccgcttttccccatctttattccgttccataagtccaactatttaatcgggagcattctctcgataaggagtcaggtgagcgggcaggtaaatcgcgagcgagagccgag

SEQ ID NO: 1028 - DNA, 1764 bp, Heterodera glycines
aaaaaacacacctaaataaagcatctcgatgggcacgaacgacaattttaaaagaatatacattcgttaaaagaaaaattttcttttattaaattttgttcattaaaagcaaggacgggatttttttttgaatatttttctaaaaatatttttcataaatatgtttttaatttatttttaggtcaaatacaattttttattaaaatctgttaacaaataaaatttgtgcaactttgattataaaatttaaaaaaatggtaatcttctattttagcttgggaataataggcaaagcaatgaaacgaccttttttgttgtcttcaaagcacttttttaaaatatttaaatataactttattttaaaatcgggtagttctatttcaacattaagcaatattcataaaatgcataaactaaccaataaatacaactgtaaaattagtcataaaataaattaaatctagccgtgttaaattcaagtaaaaattattacttcaaaaaatttaaaaatgaattaatttaggcaccgtttgaaaacactggttgaccgcaagcttataatttattacttcaagaactttaaaattatgtaattaattaaacgtaaaaaatatttatatcacaaaaagtgataatgtgctaaattttacaactgtcataaaaatgcaatatttgtaaaaattaaaaacagaaaaggtggattatctaatgagattttggtaattaaattggaaattaataatttattaaaaagtcactttaacaaagtgaatttaaaatatgatttacaaaaacagttaaattaatacaatgttagatcttaattaatgaatataaagagatcgaagatgctaattgttatttaaaaagaattcaaacccttgaaaaattacattgaatctcaataataaaaattagaaattttttttttgtaattcattgaaagataaataatgtataggaaaaggttttaattttattttttaaagaaatgaaatttgaaactttttataaatctatacaaatatggttgtcaaaattttatactaacaagtacgattttaaatattgaaggtgatcaaaattattcgctaccaatatgtttctctacaaactacactaatagtaacaacagaagcgagtcaagaaactcaatatgtataatttgctaaacaaccggtatttttaattgaaacaacaaaacaagctaattatccttaaaaactattactaaaatttagttattttaaaataattgcaaaactaaaaccggctttaaatagataaaaaaatttttagttaaaacacgaaataacgcatatattttaatttacttaatgttcagtgataaaataacatataaaattatttttaaatataatatcaatatctatattaataaataagtaaattaaaaaattgacattctaagttttcttaattaataatagcaaaaatataaatctatacaaatatggttgtcaaaattttatactgacaagtttcgaaaattctattacgcttgtaaataaattgagcaaaatctgttgatgagaaaataaacgaaaaagattaagagttaaaaatattcataaagaattttaatcttgactcaaacctgaaaaactatcttatagttcatctaaaaacttgaaataattcatgcttgcacaacttttcgtctgatcaaaaaagtctcttactccaacttgatcagatcactccttcctagtgaccgggacacccaaaatacactgaaaatcg

SEQ ID NO: 1029 - DNA, 6497 bp, Heterodera glycines
aatgaataaataaattaaaaaactttttcaaaagtaggtcacctgtcaactaaaaattgattgatggggtttttttatttttcttcccttatttctcaatctgcacgtgactttttgttcaaattatttcgcaatatctcccctaaattaggtcaactgtcaataaaatgtgattgattagtttcttatttaaatgtctccattatttttagttttctgttccaactatttcgcaatatggcccgtaattttgcaaacctgtcaaaaaaaaatgattgatgactttcgaaataaggaatatccaaacgatttttgcacggtttttgaataaaatgagacagctgtctaccgaaatgattgatgaccccctaaattaaggcaaccccagacagtcacgtgactagacccctcccctctcgcccaatccgtacacccggcccaaatcgaaaatcattcaactaaatagttggatttcattaaatctcttcgcgctctaattttaattcactccgctctatttttaattgaattaattaaatcttctattaaattcccgtctttttcttttcaaatctctcttcactctttaattttactgcatcaatttcgcggttttttgttttaaaatgtcttttaaacgcgtgaactccttccaacccgccgtgccaatggccaaaaaatgggatttccgatcaatcgggtaagtgatttttaataaattaaataaaaaaataatttcttaaacaattataaatacaattataagataataccccttaagaattatttcaaaaaaaaattttttttgttcagaaataattttgctgaagaaatggaaaattataaattgatggattaccaatcgacaacttgcgaaaaatttggatttacgaaaaatattacggaatttcgtgtcaacccggacgccccgatgaagcgatcaaggatgcgatcgacaacatgataaaggtggctttaaagactacggaagaaaaaatgaagcgaaaagtgcggatgtttggagttgcaattacgggtgccgggcttgctttcccggtgtgggtgccgtatcgggcgtacccccagaataatgcggatgttatcatggaggagattaatgagctggggcagagcggggacggggatgaaaataagaaaatgcttttattatctgaaccgattactatgaaaattacatgcgttacaatgcccagtggagaggggccgaggaatgtccacaaatttgactttggattcaaggaacaccagcggatagggtaagtgttttaataaaataaaattaaaatagaaaaaaaatcaataaataaatttaaaataattatttctaaaaattttaatgaagcaaaaaaaactttttttttaaaaaaaaaaatgaaaaaataataatttaatgaaacaaaaaaaacagaataaaattaaaaataaagaaagtaaaaaataaatttaaaataattattttaaaaaattttaatgaaacaaaaaaaaaataaacttaaaatatttatttttaaataatttaattaggtaaaaaaaaaaaagtaaattttaggattgtgaatactgataaattttgccttttttacgcactggcgtcgtcgatgaattatttaattatggataaatattcgtttattcgttttatgaagaacttagcaagacaaaaggaagcggctgttgaacttttacggaattgtagaattgatggaaacgaaattagttatggtgtggagcaattgccgaatgttcagaaatattgggtgggtttaaaaacggtgaaaaacatagaaatgaccaatttttcaggatgagatttaccccggaaagtaccgggttgttgcgtttgagaagtcagctgatccgcggaaatcgatctgtgttttgtggaaggcccctatgggacgagagaaggtcgtaccgatatttttggagaatggtcactgggatggtctgaagaattacgtctgtttttttaatcgtgggagaaaattttgtattgattgtgagtgcttttttgacaaggatgtcaaacatactttcgagtgccgggcaaggtgttattattgcaatagagtgaggggaatgccatgtgaaaaggagagtggagtgaagattgaatgcccgaagtgtcatcgttacttttacaattgggagtgttataattatcatcagggacatcagacttgcaaattatggaggcgttgcgtgatctgtgacaagacttatcgatttaacccgaagaagggacatgaatgcggagagacttattgccagctttgtagtgtgagccacgaccccaagcggggttgctatattataccgatcgaggagaaggaggaaaaagatgtctacagaattgtagtttgggtaagttctacaaataaaatcaacaaaaataagtctttaactccaggattcggagacttcgcaggattctatttacaagggggaccagaaggagcatgttattaattatatttcggtgagagttacgtgtacggaatgctgtgatgacaaaaacaggacgaattgcaaaatttgtggggaggagaggatcaaggattggagcgaggcagagggacatgagccgaccaaggattttgtggagtggattttaactgcttttacgaattacgatacgtacatatttgcacataacgccggacgttttgacggtaatttcaaaatttaatttttaaatcctaaatttttaggtcattttgtttttaattacctctgccgtaccgggaagaacccgttaccgctcatcaatggattgaaaatttatgaatttaaagtgcaaaactcgaagaaacattcaaagctgatttggagagactcatgtttattgatgccggtgaagcttgagtcgctgaaggcgacatttaatttggactgtgaggacaagccctttttcccttgttattacaacaagaaagaaaattatggaatacgattggaacatctgccaccgatggaggactattcgccgggatctatgaacaaggataaatttataaaattcgaaaaatggtaggaaaatagaaaaatttttgaataaaattctttttttttcaggtacaatgagaacaaggagacgcccttttatttggatgaagaattgagaaattattgcagaaacgacacggagattttattgttgtcgattattgagtttcgaaggatattgattaacgacattactaagggatttgacccactaccgaggagttgtacgaatgcgggggttgcgatgaatatttttaaggcaatgtttttattgacggagcagttatcgattgtgccggagaagggatatgagcggtgtgatcgcgccagtgtgatggcaataaagtatttggagtggcggagccagcgggatcgaattgagatacggcacgcggggaacggacgagaagttaaaattgggaattacaaattggatggatttattgcgaataacggagctagggacaaatgcatcgaggttatgggatgttacatacatggatgtttgaattgttatgacccggcggcggaactgattggaggaaggacggcccaggaattgaacgatgagactcaggagagattagtggagctacggaagactttggatgtcgaagaagtttgggtatgtttatttgacatttacatttttattgtgaatttttaggggtgtcaaattgagaaggaattgaaaaaggatgaggaaatgaggggcttcttcgacgacagaggaaatgagaaggggccgattgatccgaggatggcatatgcgggagggaggaccggaccgatgaaattgtttgcgaaatcggatgagaagaaaaagattagtgtttacgatattgtgagtctgtatccgtcagtgaattacggtacagcttacccgattggtttgccggagattattataccgaagagcgatgagattaatgtaaattggacgagaccggaggatttgaagtttaatggattgtataaagtgagggtccacccgccgcgagggttgcggattccggttctgcagttgaagtgtgatgagagattattattcccgttgtgttggagatgtgcgtcaacatttaagaaggaaactacgagatgtgattacaattgcccccatgatgaggcacagcggagatacgtggcgacatatactagcgttgaattggtaagaacttatgtgggaaaattttaggaaaattttgacatttttcaggcaaaggcgttggaatgcggttatactgtggacagattttatagagcgtggcactacgaagaggaggcggatgatttattcaagggatacgtgcgattatttttgaagctgaaggaggaggcgagcagttttccgaaaggggttgagacggatgagcaaaagaatatttggagagaagagtataaggaaaaatatggaatcgacattgaattggctaaagttaagaagaatccaggattgcggtacataagcaagttgatgctaaatagcttatgggtaagatttagggttttccgaaagagttttaacttaaaattttagggaaagttttcgatgagaaattgtttgaacaagaatgcggtgattgatagggcgtcggagttttataaaatagcgtgtgaccataaaattgaattatgtgatattgttgaatattcggaagaggcgattagattgatatacagggacaaggaggactttgtgatggagcacaagtcgagcaacatagtcattagcttatggtgagttcaaaaaattataaatttgtatataacctaatttttaggacgacgagtatggcgaggttaaaattattggaatttatgagggaggctgaaagcaacggaggggaaattttgtatacggacactgacagtatttttgttttgcacgatcgggatgtggagccgatcacgacggggaaatatttgggagagatgagcgaggaatacggcggctatgagattgaagaatattgctgtggaggggcgaagcagtacgcactgaagatgagaagcaagcagacgggggagactgaatacgttatgaaaattagaggaattacgttcgacgtggacaacaggaaaacattgcactacgatacattcagggagatggttttgaattatgggaaaggggaggtggacccggcattcttcgtctataagaatgattttgggtgagttttgtaaaaattatttgcttcattaataaatcaatttttaggccgacaagggattcgaaagtggtgacgagggagaagcataaaatgtacaggccggtctgtcagaagggtatcatcgatgaggagcttaatgtgatgccatttggattttgttaattttgtattttattgttgtttttttttgttaaataaagttgaataaaaattaatgtgatattaggactagcgggggtggaacggtctaaagtgaaggcccactcctgttagccgtaatatttttataaaaaatccagcagttcaaggggaaaatagcatctatgaccgttattctggtacatagttatacatgggagttgagggaattgtagcttgacacggtgtctcgagtagagatgctgttcgacagtaaccccgaggaaccctcggtaggcaaaaagcctattggaacctctaaatgcgatgtcatccggtgagataaactgattgtgcctaaggtgtctcgttattagggcgtgtcttctcaaaaatttcaaattttgtttcttccgctgtcgtagaatttctgataattcgtgaggttcgcattcgttaaaatcgcatagaatttcaatgagagaattcattttgagcaccagtaggcattttcatattcgttgcaaatccttatataccattacctcaccgccgtatgatgaatttttaccttttctttttatttttaaaattctgagaactgaaatacagatgatgaccactaccaaatcgacaattgacaaaaaatatacccaaatatttgaacttgaaactttaattgtctcaaattctttgaacacgacaaaattaaagaattcactatttgtgtctgccacatatttgggaagtatctcgtttgagtcaaatcgatctttatatattttcttttccttaatcagataaatttgtccctcaattattaggaaatcggtaaatgaagacggcattgatccgatcggtttagtaataatttcggttttattatgatgtgtccataaattttcgattgatctaatgtcaatttcatctattcgatcgtcactgattacaaaaagtcggccattaatgtgatcaaatctaaggtacccactgggaaaattcctaacaaccttttcttgactccctctggttatcgaagtctcatttgtattttcgttttggaaattaataactatgatcgttgtaataaagcacgctcggggctttaattgtcgaaaatcctggtaaagcttaacattagttggtccgctcttttct

SEQ ID NO: 1030 - DNA, 1378 bp, Heterodera glycines
ctttttatatatttaccaaaattattaattaacaatttcttagaaataaacaaaggttaaattattgttaaaaatgaataatgatccgcccccaaatatgagaatctgaacagatgataaatagatttaataaagcaaatttttaagagagaaatcacaataaagattaataaaaatatatatatatatatatatataaaagaaaattaacataactaattgttactcagtaagaattgtttgctaaatttaacttacaatttactaatattattcttattttttttttggagaaaaggaattataaatctaatggaaataataactacctttttaaaaaatttaattcaacgatcgtaaattcttgaatgtaaacatgatttgattaaaatactaatgttcaataacaactttagaaattttcataaaaaattactggtggatgagacaaaaaatcacaaaaattttccctgataattagggttataattgtatgatttttttctggaaacggattatttttctcaaaaaactcctttcaaaattccaatttcccattcgacgctgccctaaaccttaaattttctttaaaaaaagattggctcaaaatcaccaatggattaatttttagacagaatcttttggcaagttgcacataaattttcgattatcaggaggcacctatcgaccaccggcccacctcctgttcttcaatttggacacacccccccccccccctccagtcccatcgcaaattttgtgtgcaccgggacgcaccggaatttttattaatttttatttgaaaatttaaagttttttaaaaatatggaaattttaaaaattggaaaaagcagagaattccaaatccttttataaatacctttctactaagcattttatcttggtttgatgatcctagatctttgcttattcaacattttcgtacctaatgaataggcttgtaaattatatggattaacatattttttctgcgcatatgctatgaagaaaggggctaaaaaatagtattaaagaaaaaaattttgaattttttgtaagaacttttggaaaaaaattgttgatataagaaaaatgtaattttgttttagcatatgataaaaatttaaaaaattcgaaattgcatatataaatttagaaaatcaaaatttttgcaattctctaaaaacgcgccttagctatttattgtttttgatgtttttaagtcaattctgtatttttgcaaaagtttttgcgtagatttttagggctgtattttttgaaaaatttttgcgttgatttttagcggtgtatttttgaaaaattttttggccgattcttaggggtgtatttttccttttcattgcatttgcaaaacgtc

SEQ ID NO: 1031 - DNA, 2480 bp, Heterodera glycines
  misc_feature (2327)..(2327): n is a, c, g, or t
  misc_feature (2433)..(2433): n is a, c, g, or t
aatttgagaatttttgtatttttttatattttggtccttcgaacacatcttactaaaaaactcagggaaatattaaaaagaattagttagagtaaaataaataaaatcatagtcattcaattaaatttcttttagttttttcttcgaatttaacacaataatatctacaattaaaaatgctttaaatattgcgttaaaaagaatttgaataaagcttttaaaattcactcactaatttattgaatttctccaaaaaaactttagatatttttaaaaataatttcttaaataaatatcatttaaataaacacaaaaataatttaacattatttcatttactgaaaattaaattaacaaaaaaagatttatttgagtcgcaaattttatatcaatttaaaatctgggaaattgttttaaaatttgaaagggatttttttggtacaaaatatttgattctccatgattaattaacaaatacaaatttttataattatcattaataaaaatttgcgtattaaataaatcctttaaaaggaatatatcgatttatttattcatataaatgcattttatatagatttttacgatacaaatttcaaacaaacaaaaacacgtattaaagctacttaaaatatttgctagaaagaataaataaattcttaagaaaattagccgaaacttatttaatctaattcattcaaataaataattaaagaattatttgacaatgaaaaatggaaatttatatttgacacaaaagataataaacgaattataaagaaataaagtaatcaaaaaagaagaattgactaattataacttatttgctccaccttaccatattaatgaaatagtgataaggaatacaaagaaaatattaaagaattaaaaaaatggaaattatcaagaaaaaacagagaatattcttataataatacaattaatttgttttttaattaaactcaaaaatttgtttattttaagttagtaattgaaaaaatgaaatgaaaagcttaaattaagacataataatgttttatgaatttgtaaaataaaaaaaaacaaatataataaaatttttattaatgtgaatttcaaagaaaaaatctttagcaaataataacaacatttacagaattttataccacacacaaaatatgttaacatagttttttggaataaatgaattaaataataatttagaaaaattctcatcatgtttaataaaataaccctttattaattgtgaagtaaatgaaaataaataaaaaataaaacagaataaactataaaaatagaaatctttagtcttaatcatttatgttattcataatattaacttcataaaatttaaagagagaaaataatttataataaatttaacatacatattaaacaaaacttgtgaaaacattaagcgattcaaagacaaacattaatttttcaaatacacattaaatttttatcaattttaactgtattgcattaaaacccagcgccaagagccattatgattccgaggaaccatgaagaaacaaacatgaaaatcgatttaaataaaaacagattaaaattaattaacaattataaacaaaattaatatttatatatttaattatattattaaaagaaataacatattttgaaatgctcattaaaagttacatccgaatataataaacaaaacaaaaataatttcatttgataatataattaatttaataatgcattaaataattaaatttattttatttattcggttctattttcatattaaacttgtcaaatgtttataaggaaaatataaataaaaaacaaaattataaattaaaaaattctcaaaaaagaaaattaagataatactttgtaattttacatgtgaattaaaatatgtaccgaatttatttctttacaaacaaaattttgtcattatttttggatatgaaagaaattggattttaagaattaaaaaagggagtattaacttgaaaagaatcatattcataactttgtttttattaataattaagaagaaaaaatgaatttgatttaaataaagaaaagcataaaagatagcaaaacaaatgtttatgtgctttttatatatttaccaaaattatgaattaacaatttattagaaataaacaaaggttaaattattgttaaaaatgaataatgatccgcccccaaatatgagaatctgaacagatgataaatagattttttctacaaaaatgaccaatcattgattaattggattttttggctattttaaaaataaagaaaaaataatttttaaattttacaattaattaaatttcaattanaaaaatttcgagaatggaaaacgaatttgtgcgggacgatattcccgaatgggactaccgtatttttttccccgtcccagtaaaatcccgccagggaaaaagacgngaaacgggacccgggattcccaggttttcctgcgggatatttaaaaa

SEQ ID NO: 1032 - DNA, 6761 bp, Heterodera glycines
tttaaatagagtgcgccgggaccgggacgggaggacgggaattcccggtcatccgaggtcccggttcccggattttgaaacgctcaggtcccggtcccggtagggcaaccgggaaaaacaagcactggtaagaatgggggtctgagtgaaaacttagagatgaaaattagagtcaaatgaaaaaaaaaataattattaatatattctttaaaagtaaccctgccaagtgtgcaaataacctagtggctagtctccttgactttcccttattctttaacctggttcaatccctctacagaaattaaattattttgaattttctttttgtatactcgtgggtttcctatagagaaaatatgattactcatagttttttttaaattgatacatattttatcattttttaaatgaaaatcctaccaattgagcttaataatcgcaaaaaccaacctttttttgttgaaaatctgttaacaaattgcacccaaatttttaaaattttccccggcggcgcctatcggcaccgccggaccccttctttcccaaaagttttttgaaaaagcgctctgaaaaaaagtgatgtgaaaatcaaatctgaatttctattaatattcgatgatttagtccaaaaatgattaattgtttgaaataattgaagaaaatttgtttgaaaattttcattaatttaatttattaaataaaaaaccaaataattttgtattattttcacttgatataaattaaaatttgaattttttttttaatttttaaaatttttttgaatttttaaaatttcccggttggtcccggttcccggtcccgaaaaaaaatcgaggtcccggtcccggcttctcaggtcccggcaagtcccggtcccggttttggcaaaaattcccggtcccgtggcactctagtaaaatgacaaaattaagtcaaatcagtattgagttaatttttaaaatcacaaatttttgtttaaataaataaatttggagatgattttttaagaaaatttttattcttttatgtattttttgaaattttggggtcaattcttaggggtctatttttcttttttattgaatttttgttaataaatagggctgggatttttatgtgctaaaaatcctgaaatatgtaataaaatatgtgataaaaaaacccaaaatatgtgctaaaaaccaaaaaaaaaaggcctaaatatgtgttaaaaaatgcaaaaatatgtgctaaaaattggaaaaaccaagtgtatttacgcaaaaaaaaatcatatttaatatcagtctttatcaattttcgcccgacctccaatcaaaattttggcgatatcaatcaatttgtaaagtcccggattaatttttccatcagttgaataagttccttccgggaactttgaaatccagtgacgatttaaaacagcgtttgatttggctgctttaggcatttgaatatataaagaaattttctaaatgcttaataaacgtaaagtagtcaatttttagggtgcattttcagattttcttgtattttttttacgatttttctcaaaaatgccaaaatatgtgccaaaaccccgaaatatgtgccatatgtttttatgtgccaaaacgccaaaatatgtgtttttatgtttttataactcgctctaaatcaaacattgttcggagaaaatgctatttttgggcttctctcgccataactaagccgcaaaaaaaatatgttaaaacataaaaatcccagccctactaattaagattttgaaaattttaaaataaatactaaaaaaatgtaaaaatatgaccctaataaggcgcggtttcgttttcacctttcacatctttcacctttttggcattttaaccaatcagttaatctttcacttttcccggcaaaagggagtttcggacccgggattttgtccctttcccatttcaaaagtttcggtaccggtcccggccatttgggtcgggattttgaaaagtgcggtcctgtcctggtccaggccaattcaaattaataaataattattaattggtaacaattctgtgttttgaaaggaaaaactccatcctcaatgaattcatttgtaagttatttttttaataattcaacaaattccttaaagttggttttggaggcttaaatattatgtgattaaaccaataggctctagtagaaattcattacttttatttcaatgatttacaattcgacaaaaaaattaataataaattttcttttttttctgcgtttttttaatttaaaaacaaaaaagcaaagaaaaacaactttatttaattcttttagagtaatttaaaatttacataaaagaacaaattaaattttatatttttctttcagcaattatctattaataaattttaaaaaagctgaataaattaatttttttttaaatatgttaatatatacaaaaggtttaaaaaaaattaataaaccatatattatgtaaaaaatattttaaatagattatatatataatttaaaatatctaagaataaaaataattatgctggtgatatgctccccacagacagtccaaaaaattttaaatacaaacttatttattcaaaaaattctttgatactcaaatattttacttaaatatactagattaataattttaatttcttttttacccatctttttctaaatttaaatgtattattaagtacgaggacataaatttataaaggcggcaatctgtatatgaaactaccattaatcatcaaaagagattatttgctaaatattattttataatcgcagtgtaaatcactacaaatcaattcaatgctttatcataattataattcaataaaagcatttgtgtgaaattatgatttaatgggtatttaatgcagaatttagtaaaatagtttcataaataatattgtataaaaatctaaaaattaattaaaattatttaaattgtataaatatcgttaacttaattaaatgttcagcattagtttattttaaatttcatatttatttacttgcattatttcaaaaataaacatataagagtattttcaatagaacatttggaactgatgagtatcggagagatctacaaataaaaataaaattcattaaaaaacaataaagaagatgaataaatctaaaaatatatcaaattataaaaattaattaaacattaattgacgaatatttgaataaataaaataattaagtgctaagaacttgttctataaaagtgattataaacagaaaaatatcatattttattgcaaaattggagtaattgaaaaaatgagaaccaaatatttgaaggatttttgaataaaatagtaaatttattagcaaaaaaccgaattcaagattttgattaatgtttaaaactctatcgaataaaatacatgtctgatttaaaattaaaatattaaacaatatgtaaagattatcaagtgataattcatctcacagagaataaattttgttgttaattaaattttaaatgaaaatatcgaaaaattcttatatatttaagttaatttaaatatacgagaataatcacaattaatataacaaatttacaaatattacttttcagccatttaaatgtttaatagaaaaatagagaatataatgaggaggacctaatttatttttaattaataatttactattttattcaaaaaatccttcaaatatttggttctctttttttcaattattccaatttggcaataaaatttggtgctttttttaatatacatataaacccttaaaaaatttgttgttacttacttattttttttaatttttgtatattaaataataatatttagcaaataatctctcttggtaaataatggcagttctcgaacaatttggttcctttataaattttgacaacacaaactaagcaatttcagaaaacaaataagaatatgaaataaataaaacagaaaagcaattaaatctgaaggacaaataaaatattaaaattattttacttttattaaatcattcaaaaattactaataaagtttttaagaaaaatttaattttaaaatatatttaataaaatcaaagaacaggattaaaaaaattatttaaaaattacattatattatttattttgtaaactgaaaataataaatattgagtcatttgattgaaaaaagccaattaaatgtgttatatcgttggaaataattattaaagaatttaaatcaattatttagttagtaaaataaaaaaaaaactgttaaaaattaaaaaaaaaatttaaaccaacattgataaaattatttatttgctcaatttagattaaaaatgtaatttaatatttcaattcttttaactatctataatcaatttttaatagttaaaataaataaaacccacaataaaaaatttcatttcatttcaaataaataaattaaagtttaacaaatacacaatattgattaattatatccaaaaataattttaattttctaccctaaaaaattcgaaaatatattagaggtgaattatattgagaattatatcaaatttaatgtactcgcacttaaattatatcgagttattgaaaattgtaattttggcttagaatgcttaaagaatgaaagtttaaacatataaatctaaatgaatatttttttaaaattcttattcagttattttcatggtgctatgtcatttcgcgacagtgcaaaaatgggcacttcgcgaaacgtgcaaatttaaccgaaagagaccgggcctcatcagtacggtgtctctttgggttaaataatttaaattaattattatgtgtgtttcggccctaaaccgtatacacacaaagccacagcaatcaagcaaagcaaataaatataatataccatggcatataaaaagagtatatacggtaaatataattttatttatattggtttatttattatttatttaagttaaaattttttaaactaattttatttgaatatgtttaatcaattttataatttgttagtaatattttttaaatttattttgagcttgcaaggctccaacatttgcattattctgtgtaaattagttacacacgtacaagtctaaacgttttccattggctaagcaatatagcaggataaggggaaggttttcttcgtctttgtggatttctttctgcttcccgtttgcatcctgaaaacagattttatgaacgtgggatttggcagggcaatgacagagggaatgccgtgccgtgttgtcccgttgggaggcccctccggcagctccgatgagagtggataatacggttttagcagttttaaaggtttttagggaattaaataacatttaacaaattataaaactgattaaacatattcaaataaaattagtttaaaaaattttaacttaaataaataaaccaatataaataaattatatttattttgcttaataaaatttatttgctttgcttgattgctgtggctttgtgtgtatacggtttagggccgaaacacacataataattaatttaaattatttatattataacaatggcactaatgctatttatatgttaaagcaaatagaaaaggaataaataatttatgaaataaaacaaaaatataattttaagaatacaaaatcataaatattataatttacccagcagtgatgccacaaataaaataaaacaaaccttatcagatttttattggtaaaaaaaaacaattcataattggggcaaataaatggggaaaattaagcggtaacttggacaaggatttaaattgaagaattaaaatttataatttttttatgaagaaggaaacaaatacattaataatgtttagacaaaatgaacatcaaaaccataaaaagaaacggtccctactaacaccaatttataaattgtaaatttggtaaaattttatatggaacaattctttgttttattagaaatgcataatcagctcagtatttattgaaaaacaataaatattatattttaaatataaacttttacgttaacaattaatatatattaaaatattaaaaaattttaaaaataaatgaataaaaaattttatattatataattatgaataaataatattatgttttgcatagttggctattctataataaaaggtaataaattgaaataataaaaagttttagagaaaactatttcaatcgcatcctgaaaattgtatcctattaattatctatgaatgggtaaacattattaaaaatttgtgttaatgtaatccaattttaaatttcttgttctgactgtgagatggattaataccttcatcaacattttcatttatttaaaaaaattattttgtggacaaatgccaatggaaattgttaaactttaatttattttgctaataatttataatagaatgcagagaattgttcataatatgcatttgtatgcattttttcaaactttatcttttcttttaattaaaaatttgattaatttactacaatgaataattcattaattattttttttagttagtgtagtttttgccttttattttatctaaataatttttttatctttatttttctgtttaacaaatctgtttctatgcgttttaatgattataaattttcttttatttatgaatttgtttattttttattctaattgttgtgtaaaacgagtctttgacgttaaatgaaatattaaaacaatcaatgaaatagcacgataataatacatatttcaaattgaattagctaatatt

SEQ ID NO: 1033 - DNA, 3700 bp, Heterodera glycines
aattgttatgatccactgaatattctggagaggagctaaatctccgtctttgatcatttttgtttccaaaatatttgtgtttttgttcattttgaacttttttccattcctctctaaattttactgcaaaattcattgttgcctctgactcgtatttgttgtaatttacttctttttgactcgtactgaccttttgtctcacttcttgtctgtttttaatttgctcaattgctctcgatagagcatttctaaatttggtagtattccaattttgattatcttcggcatcttttataacgaaatacttgtccaaaactaaaggtgataatttcccttcaagcgataaataatgaggggataaatccatgtcttgatttaaacttgacaattgtcggcaaattttttcaaatttaatgtacaatttttcatcttcttcaacagtgtcactttggggaaataaattaatttcttgattgagtgcccttattagttttgtacttttaccgtatttttccaaaagtaaatcaattgcaatttggtaaccatcttccgaaattggtattccctcaattagctccttagcttccccttctaaatttgactctaataaattatgcttttcaattttggtaaccgaatcatcctcgtggacatgtactctgaatgtctcccaaaatggtatccatttttcaactgacccatcaaatttttcaattgtatttgtagaattttcactcttttgattggctgatttcttggagtaagaattgtgctgtttagcgaattttgagggtttatgtcaaaaatatcttccaattgttcttttttgttttgccattcatttttcttaatcactgctcgattaatttttgcctcaatgtcaagctgtgtacaaaagtctacataaactctttccttattttcgcgcgctgcaactgcaattttttgcaaactttctgccatttctacgcgttttccctgaatttcttccaaaatttcgcttaactcatcacaagcattttttgctctgtataaatgtctttggattgtatttggggttgcattttgaccgggatttatcggaatttctctgtttaattcaacctctatccgattaactaacccgtgaattatatccaatattggcgaactcattttaatcttttgctagccaactagctttttcgaaatttatcaaaaaataatttgtccacctttaaacaattcggttcgcaatggccaaatggtcgccacgtgtcctaatccggtgttcgtccgcggttctcttttgtcagttcgtccaatgacagtagaagaatcaatcaatcaatcaatcagcctttgtttggtggaacaaattagagtttgccaatcacttttaattcctgatggaccccttgatttttcagattttgttttcaaaaagtccccggtggaccaatctctcgtttcccgttgaaacaaattttagcaccaaattttcccctaccgtaaccttcaaaataatgtcccggtgacaagtttttattacgggcgaaaaatacgaaattgacaaataatatttttttaaatcggagagcaagaacgttgaacagattttttaaaaagttaagcgaatgaataacagattttaatttttcatctttcccccttttttcgctcacggacattttccgcctaaattcacatatgctccattgaaaataatatgaattttgaacaaagaaaaaacattaattaaaatggcgatataaactttttctttcttcatttaaattttataattacatttaatcttgccaattcttatcttaatacaaatatttgcaaaatatttacatttatttgattatgttcagaaagaccacaagaaagatgggaaagagggaagaacatacccaaaaaacaaattccgttcaaattcgaatagctcaaataactctaatggttcaatttttatctttaatgactataataggcacttgattttttaattcctttagaattaatatcttgaatcctatgacacgcataaaaattatttttttaattgctctagttaagtataaaagtttaaatataatgaatttttataatattcatttgttttttaattttcatatgttttttttaatgttggatttttataataattttaaattatcaaattgatctctaacccaaaaatttcacctgttgaacattcaattgatttatataacagtagctttctgtgttttcatatttgaatataaaattgaattatgtttttctttttgggttgagttttattttaacttttttataaaaaacaataatattatcataaaaacaataataaaataaatataaaatcattgagtcataatgtatttttactttaaaaaaaattatagtttatatataatttaattataaaatatatttagtggaatttatttaattttctaaattttagctttttgctttcttatttttacctacgctcctttcctctaacaaaaattttccagtcacggttattgtttcttaattatcttgttaaatattatttaagtggaataattgttactttcttttcttaaaagcatcattttaatactgtgaatttcttgtaaaactttaattttttatatttctgttaattaaaaggaagctgttaatatacatatacatattttctagatattaaaaaaattatctttttttcattttttggttttttattttattatctaattacagataatcctttatatttatttttcaaattataaatcttcttatgtaaatacgaaaaacgagtatcctctttgtgtggaccaggatctatcatttgattttttatattttgctataattgggtgcagaataaatatatcgaataacttattttcttataaccagttaagtttttaatttcttttaaaaaaagaatttattatgcgtggaaggttaaattattcagcaaatgttttaattcattaaattaataataaagttaatttattgtagagtagagaatttaatttttttacattaactaattttcttgattggtaatgaataacggcatattcagttgttttaattttttaattttgttaattatcaatatataaataaattcaattattgtttttattttttaagttttaagaaattttctttaattacagaaatctttttatatttatagtataaaatataaatgttgttctttatcgctttctttgtctcaaattttatttagacttcatttcttgatttaaattattaaaattatttttttctctatttttaattatgtaattcccctgctccttgcaccagtaattttgtacattgttggttcttttcaaaatttatttatttgattaaatatcttcattattttatttatgttaaaataaatattttttattatcaattaaatttctatattaacaaaatgtttaattgattttgatatttaaaagtgattcaatttataactaattattattttctttataatgtatatttgtttcggaaaaaaaattttacaaattttttccatatttaaaaaaaaatttccataaactttacaagcagtgtattatgttggttaatttaattttgatttgaataatttaatatgtaatatttttggaattttttgtatttttaatacatattttgggagatagatttttcattt

SEQ ID NO: 1034 - DNA, 7913 bp, Heterodera glycines
ccatgtaagccgaacccagcctcatcctgggagaacctgtgtgttaaactcagaaaactcaaaaagagggcaagatatattaattgggctgatattttatttttttcactattttttttctgagctccccgtaaccttaaatgcgcgaaaaacgtttttttagctgttgttaagctatttttctagtatttttgaaaaaaactgttttcaattaagtatttcggcagtttttagcaactataaatgttggataagggaacaaccctattgattatattttccctttcactccctctcttattgtctctcgccccgccccttgaccagccccataaatatgtctccctttccctcactccgggcattctcccattcattccaccatttcattattttattttattattatttatttcctgctgtcctcctcctcatttatttgtttaataaattatttatttatttattggacaacatttgttttggttaaaaaccaaacatttttattgttgtagcaaatacacaacaatttggcgcagtcacaaacaaaggacctgctctacatcttcgggtgagaaaaggcatcaaattttgttttaaggaccaaaagccgagacggcaaaacaactcatcaaaaagccgggattggctctgagttttgttaaagccgagtcggccatttttcaaaaagcagtaaaagaaactgctagcgtctaaagccgagtcggctcatcaaaattcgtcaaaagccgggtcggctcagcaaaaattcgacaaaagccgggttggctcgtcaatttcgtaaaaaaaaacaggcaaaagaactgcttattcttctaaagccgggtcggctcgacaaaattcaacaaaagccgggtcggctcgacaagttcttcaaaagccggttggctaaacaaattgatggaccccaatcagcttaaactgattttggaggctgttttgaaggcatcggcgggacaagtcaacaattctgcggcattggcgacatcaatcgatgcgcgcctttcgacatttgattatgaccctgagttagggcatacatacgacgtttggctcaagcgctatgggcagaccatcgcccaggatggacaagcactcagcgaccagtcaaaagtccaactattgattggcaaactgggcgaagtcgagtacaagcggtacatcgacagcatcgcaccaaagtcgcagaacgacttcaactgggatgagacgaccgcaaaattgaaacatttgttcggtgaaacccgatcattgtttctccgccgttttgattgcttccaaattcgtcaagacgcgcatcaggacgtgcaaagtttgatcgcattgatcaactcgtcctgcgaaaatgccgatctgtcgctgagcaaagaggagctcaaatgcatgatactgatcattgcattgcgggacgaattcaccgatctgaggcaaaaatgccttcagcgcttggaagacagtcgaacgagcggacggtcgacctcactgcaagagctgggagaagagtgccgcaaataccaaatcataaaggaaagcgcgctctccctcggctcaaatccctgcagcaccagtgccatccgagccaaaccgcagcagatcaaggacaagcagaagcccaaaacgaagccgcagcaaagccacaaaggccaaaatttcctgccgaaaaattcaacggcacctaaaggaaaagtggaccaacgtgatcagccctgctattcatgcggaggcaaaagtcactggcaaaaagactgctggttcaaaaactcgacgtgtgaaaaatgcggacggaacggtcacattgcgaaagcatgcaaaagcggcacagagatccgacgtgttcgtgcagtggccactgattccgtgaaggacacgcacattcacaccgtctcaattaagccaaaatgtatggctattgaaggaagcagcaacaaatggtgggaagtgatcatccaaatcaatgggatggatcacccaatgaatgtcgacaccgctgcccaaatcacggtgatcaaaacggactcatggcaaaagcttggcaaaccaaagctaggcaaaacggccatcaccgtcaggaattgcaatgaaaaagcattctcaatcgaaggcaaattcaaatgccaagtttcgtacaaaggacgaacggcaagcctgattgcttacgtcagcgacgaaatccatcaggatttgctcggcatgccttggattgaagaattggaaataatcccgaaggaattgatgtttccaaattcgtcgcaaatcgtcaattcactgccaacgaagccaatttcatcacaaatcagtgatgaaaagtcactcatttcggcacttcaaaccaattacgccaatacttttggacctgaacttggccattgcaccaaattcagagctcatctgatcctgaaaaaggaggcgaagccggtctactgcaaggctcggcctgttcctcatggagcattggatgaagtcaatgccgaaattgatcgtctttcgaaaattggcgcaattaaaccgattgagttcagccattgggcggctccgattttggcagtgaagaaaaagagcggaaaaacgcgagtctgcatcgatttttcgaccggcctaaacgatgcgatcgaactgcatcgtcatccactgccaaggcctgaggacatctacaacgcagttggcggcgctaagtttttctcacggctcgacttgcgtgatgcctatctgcagttagagttgtcggaagcctcgaaaaatctttgcgtgctcaacacgcaccgaggcctgtttcagtgccagcgtttgccgtttggagtcaaatcggcgcccgcgatttttcaaggattgatggacaaaatcatcgccggaattccaggcgcattcgtctatttggatgatgttgtgatcgccaataaatcactgaccgatcacacctcaacaattttcgcggttttcgacaaaatcagtgaatatggccttcgaattcaattggaaaaatgcagtttcctgcaaaaggaaacgcttttcctgggccacattatctctgaaaatggcattcgacctgacccatcaagggcagaagccattgagaaaatgccggcaccgaccgacaaatcaacgctccgatcattcctcggcgcactcacttattacggcaaattcatcaaaccgatgcgtgagctcagaggcccgctggatgaattgcttaagaaggaggccaaatgggaatggggagttgagcaacagaaatcttttgagaaagcgaaagaaattatgctttccgatttactgttgactcatttcgatccagaattgccgatcgtagtcgctgccgacgcttcgaaagatggaattggcgcgacgataagccacatctttccggacaagagtgagcgcgtcattgaacacgcctcttgtaccttcaacgcggcacaacacaactacagccaaatcgaaaaggaggcacttggcttggtcttcgcagttcaaaaatttcaccggatgctgtacggtagaaaatttacgctgctgaccgaccacaagccccttttggccattttcggatcgaagaaaggcattccgatctatgccgccagccgacttcaacgttgggcgttaatactctccaattatgaatttgacataaaatatgtcaacacaaattcgtttggaaacgccgacgtcctgtcgcgactgattgcaaactacccacggcccaacgaagacattctgatcgccaacatttgcgaaaagacagaatgctacgtcaacttcgtttttcaggccaaagttgagcaattgccgatcacggccaaagaaattgctgatcagacgaaaacggacgaagtccttcaacaaatcagcaaattcaccaacaaaggatggccacaaaaatgcacagacactgatctgatgccattttatccaaaaagagaccaaataaccgaaatcgatggttgtctcacttatggcgaccgtgtaatcattccaacgacacttcgcagacaaattctgaaatcccttcattttgcccatccaggaattgttcggatgaaggccattgccaaaaaccatgtttattggccagggatcaacagcgaaattgagcgcactgtccgccaatgcgacgactgtcaaatggccgcgaaaaacccaacaaaggcacaaattcagccttggaaagcggcagacgaagtttttgagcgcatccatctcgactttgcgggcccatgcgaagacggccaaacgtatctcgttgtcgtcgacgcctattcaaactggccggaagtttgggagatgagtcgtgcaacaagcgaaaagaccgtcgctatgctaaaatcgttcgtccatcgaatgggaattccccgagaaattgtgtccgacaacggaacacaattccgatcagcggaattcgccaacttctgcaaggaattcgacattcgtcacacgttcacgccgccatatcacccgatgtcaaatggggcggccgaacgattcgtcgacatcttcaagagggccatgaaaaagtgccgaaaagaaggcaaagattggattcccaaagcacttttggcctacagaacaacgccaagtgcagtgctcgacggacactctcccgacgaattattccttggacgccggatgcgaaccaaaatttcattggtccatcccaccaatcagaaaatgccgaaagtggatttgaaaaattttggcaattttcaacaaaattaccgtcaaaagatgaaacggcaattcaacgacaaaaacggcgccaagcccatcattttccaaaatggagagccagttttcatttggaatttgaaaggcaataaggcaaattggttgccggcgacgattatcgagagagttggcaactctccgacttatcgagtcgacgttcagacgctccgtcgcgcagtacatcgccatgccaaccaaattcgccgtcgtttcccaatggaaatggagacatcgcaaattggccaagcaaatggaaatattttggctgggaaccaaccaaatcggacccccattaaggagattgaaaaagccaaatctccaattggccaaaatcaaaatgcgccgcgaagatcagcacgcgccaagagggcacctcagcagctgaacatggacccgtcgaagcggaagtacgatgtattccggccatgatctcgcgcagagggatttttccaaaaaagggaggtgttggataagggaacaaccctattgattatattttccctttcactccctctcttattgtctctcgccccgccccttgaccagccccataaatatgtctccctttccctcactccaggcattctcccattcattcctccatttcattattttatttatttattccctgctgtcctccatatttatttgtttaataaattatttatttatttattggacaacatttgctttggttaaaaaccaaacatttttattgttgtagcgaatacacaacagaaagtataattgaaaatattttcttttattattatcgctttaagtaataatgactccaacataaaattttaaaaatcttattgtttctttattatcgctttaagtaataatgactccaacataaaattttaaaaatcttattgtttctcattaattttaattttttaaatatatttactatttcaaaatatattaataagattaaatatataaacaatttatcccacccaataagttcttatttatctataacataaagttaaagatttaataataattttattaaaattcatatataagactgaacgctttcttctttattaatttttaatattttggatttaatttaacaaattgaaaagaaaataattattatctgaataatactcgcactgttgacaacgccaaactgaaataccgcatcaaatttaaattttagttcccgcatatttaataagttcatttaaaatatttgattaattttttaagtatccgttcaagctaatttataattcattgggaaagtatttttttgtgtattttgatggttttcgattcacatttcttttttcgcacccaattctcgtttttgaaaaatttaatttattttttattgttttctgaaaaatttctttgtgtaatatccgaatttatatttaaccttgtcttttggacttttttcaaggtcatcacttgcgaataaacattaaattttagtctatttagttatctattcttttaatattgtagagataaaatttataaatattcactgctatttttgattgaatttttatgctatatataaaagattttcgggtaaatggtactgttctctcgatttgttgaagaacttgttggttcggttaattttacatttctcgattacgtcaattactttaattaacttatttaaatttttctaatagattaaaattttgtcttcttacatgaattttataattatattaattgattttcttctttttgcagtttttaacgagataatataattaataaatgtttattttataatattaatttaactatttttgaattattaaatttttaggttcattgacacttttcattatttatggttttataagtttttaaattccgatgctagaatttttattttaatttttaaataggctgcaataatttaaataatagttttaaaagttgaattgacaaaatgaactgacaagttcaaacactcattatgttttattcaaatgaacatataatttataattcttttaacatttctgcatattttagtttttaaatgtgtggcattgaaaaattctttaacattaaattaaattcttaaattaggtgaaattatattttttctgacttggcgagccttatttttttcttatacacagaatttttaaaatttatttaccagttcattttacattttttaaaattattataagccgataatgtttttaatccatttaatttaaaatatatttgtaagttatgtgaaaatttatatataatattgttgtccttgtcacgagaggctcatttgttctactgcgttccagaaatttacatcttgttcgttttattttagtttgttttattatttgtatttgttttttggttattcaatcataataaaatcaatattttatgggccaaaaattctgaataaatacttgctaatctgactttttatgctgatcaaaaaagtctttccagggttgttccgggtcgagaaaaaggccgggtttcgggtatcgggtttcgggtcaattgacaaatttttaatttgtttaaaaatcaaatggcactgcaatatttgcagcgaattgcgccatttataggacgatggaaataaaaccaaatggaatcaggtttttcagccatctgctttgcttaaattcaagaaattcatacaaaatatctttagaaaaaggataataatgaacaaaaacgaatacaaaattttcgattccattgaacacaatcgtttcaaaaaaaattctcaatttccttatccacctaattttcacccagacccctttcttaccagtgcttatttcgacccgaaacccgacccaaaatcatcgggtcgggtttcgggtttcgggtcgagaaaaaggccgggtttcgggtaacccggaacaaccctgatctctactgtaaaatgcactatttacttaataaatacagtaccttttatagatgaaagtgcccatatctcagcgagcataagtggtagaatcaatattcaaaaggcaattcggtagtaaattttgtgctccttccagtgggcctactaaaaatttccagaaaaattttcccaaccccctagggattttttcgaaaattttcaccatttcaagccatttttgggttttcagatcaccatgaaggagtgatctgatcaagttggtgttaaagacttttttgat

SEQ ID NO: 1035 - DNA, 5099 bp, Heterodera glycines
  misc_feature (50)..(50): n is a, c, g, or t
attttccccgaatcggaaaatttccaaactgatcggcctttctcgggggngaaaattggagtgatcggcgatttggagatgatggcgtgcattttcgtgatcagctcctcgcattccgttgccttggcgtgcacatacggtggagggcaccaaaatatctgcacgtgcgggaagcgctggcacaggctgacgatcatttcgaattgggccgcgatcgatttttcggtttcgccctgcatcagagaatcacgtccagccaaaatgagcagtgccttgacacggcttgacaaaacgatcggctgaaattggcggattaagtcggccatggaactctctcctccgatgcagtaggagctgttgatgtgtttggcgagcatttcggccgatgagtctccgagcagaacacggtcatgtgccaaaaagcggctcgctttatgcacaatcgtggcccgcacacgttcgagtgcccatgaactgtctttgaagacctcgtgccatttgtttttctcagaatcgggcagcgaattgactccctctggcatttgcatcgacaagggcttatatcccgactcggttaaagcctgtcgagccacaaagcacgatccgacccacttctccaaagcctgccgttggtcctcctccgttgggtatttgccggtgctgatttggtccccccttttccctgtgtacatacacaactccagcttcggttctgctccaacaattgtctggaccaaagtttgggctgccgtgagcgatgaagccacgcccgatcggagcagaaagatgctgagaagggcttgaagcggtgttttgactaccgccgatcccagattcgacatgttcaggaccgggtcgatacttcccagcgtgattttctcgcacagctcgtgccccgagccgcctccactgcactccgaagtccatccaaatccggcactgacacttccgacatccattggctctgaaaaggagtcgcttttccaatttccccccaaacaatctgaagcaattgtccccaattgcgattcgctttttcccccaatttcgcggcacttatttccagtcatttcgcaaatttctgaacgaattcctgcgtacatcgacaacaattttaggtcgtttttaaacggatttttccctttaggcagtgtcgaaatgtctgggacgccttttgggactttaaccaatcgttcaatcggcacttttattggggtgatctcctttttgtctattggtaccaaatttgccgatgaatcaccaatttctgtgatcaaatatggtccaaaatgtgaccaaagtaactttttgtgaggcgaacgacgattttgaccaggaaagacgaccataactttctctcctttttggaacttgttggccgtgacttttggtcgggaatcataccaaattttcgactgttccctcgcttcttccgaatttttctgggcttcttccaacatgtttagcagattttctcggaataattgaatgtattttccggaatctatcgtgtaaacaggattaacccgaaatggtacgtgtttatcgagcggaaattttgcattccggccaaacattaacagaaagggtgagtaccccgtaacatttgacggtgtaatgttgtaggcgaaaacgccatacgccaatctctcatcccaagtccaattgctcgcggtcgactttttcagaattccgatgataattctgtttattctttcggccaatccattggcctgagggtcataccccgctgtgaaggacctttttatgtccaaaacttttgaaatttcttccattgtcgcattcaaaaattcctttcctctgtccgaatggatcttttgtggggtgccataaaccaaaatgaatttttcgacaaaaacttttgccactgattctgccgacttatccggaattggttctgcgaccaaatattttgtgaaatgatcaacgatcacacaaatatattttttgttcgattggcttgggccgacatctaagatgtccatgcagaccaattctaatggttctaacgatttgacgacgttcaacggcggttcattagcccgtgaaatgcgtgtgtgagcgcaaattcggcaactttcgtgtgcccgaatgcaatcagtgagcatatttggccaaaaatactcttccgaaagttgcttaaacaattttttgccactcatatgtcctgcacaaattccttcatggcgatttttcaccaactcatttctgaatttttgtgggacaaaaagtctcattttgccttccttctcggaaaggtacaaaaggtctttgaagacgacaaatttatggcatttatcaatgactctttgctgatctctttggtcatttggcaaaactttacgttcaagaaactcgtaaattggcttcatttcgccaattttggtctgttcgacccattcttgtctttcttccatcaaaccaaaattctccaaatcattttctgttgttcgaattttaccgatgaatgcgatttcttcggaattttgttcgctttcttcaatttcgttgccagttcccgatcgtgacaaaacatcagcaattatgttcttttttccgggctgatattcaactttaagaatgaatcttgaattcaattctaatagccagcggtcaattcgcgcatttcccgtttcgtttttgctccgaaacatccaaattagcgctttgtggtcggtaattacgcgagttggaatcattgtgacgaactgcgcgaatttcttcacaccgaaacggacagcaagtgcctcaagttcggtggcagaatatcgagactcatgaacattgcactgtctcgaagcaaaataaatcggtctgatccttttctcggcatcaggctgacttaatattgcagaaattcccattttgctggcgtcagtcattatgataaaacgccgactttgatcattttgagctgcttcgaaatcgggaaagtacagcaagacgtcctcaacgatttttcctttcagataattaatgattttaatttcgtcgtcacaaattttgaactcaactttttcgctcaacaacttaaacagaggagcggcgatcgtaccgaacgagtgaatgaatttccggtagtatgtcagaaatccaagcagtgaatgaagttcctttttatttttaggaattggcaaatcaacgacgggcttcactttgtctgcatccatttttattccgcttctcgttaagatgtggcccaaaaaaggcaattcttcggcacacattttacattttgacattttcaattttagaccggccgctttgatcctttcaaaaacttcgtgcaagtgtttggtatgttcttcaaacgattctgaagcgatcaaaatgtcatcgatgtaaatgaagacaaaatcgttgatcatgccgtcgaaaagacgagtcatgaatctttggaaagtcgcgactgcgtttgttagcccgaatggcataactttgaactcgtaaagaccgtactcagttgtaaacgccgttttttccaccgaattgtcttccattttaatctgccaataccctgacataaaatcgagagtactgaaaaacttttttcctcctagcattaacagtatgttgtcaatgtttggtaaggggaagctatctttacgcgtaaccgagttcacagctcgctaattgacacaaaaacgtaatgtaccatcacgttttggcactaatacgatgggactggcccatggagaaatggacgattggatgactcctcttcccagatagtcttgaagcattgccgcaattttctcgcggtatgcatatggcacattcctcattttgattttgatcggcggtgcgtcacccgtttcgattttgtgctggaccagatttgtttgggtcaaatcttcgtcccttgcagcaaaaatttctccaaaaccttcacacaattctcttaattcttcactctgttcctcgttcaaaattccaacatttttctgtaccgtttcccacaacaattgttgtttttcaagggtttccccgtttggctcagatagcatggatacgatgaccgggcttatcaacatatcatcactttctcccagttcaaaaatcggctcaacttctccgactttttgccctttttcaagcgcaattttggaatgcgaccgattcgttacagggacaatgattttgccctcattggcaatagcaactgtcggctcgacgtgcagatcatttgaattatccgatgaaatcagaagctcactagcttcatagttttcattgactcccatttccaaaatcttcgttgaccgtggctcgatggttgtaccgtaaattacagtaagaagatttttggagttcagttctgaattctcaaattcaaccatcgaatcatttgcctcgtcataaagcttaaagcccaattttccaagtccatttgtgccgatcagcatgtcaaaaccgatcggagcttttgtcacatgcaccgcgattttaacttctgatttgagaccacgacgatgaattggcaaattcacttttaacaaacatggcaccattttgccgttgacatcgagaactcgcacgtttgtttgcgacggttcaagggagtcgaaatccaaatttttctcttttaccaattggtaaagaaaattggcacttatcagtgatatttgggcaccaccatcaagcattgagtccgtttccactccaaacgtcgaggttttcacgaccatcacttttccgatgggaggaactgcctcattttcacgaccaacaacaagtctttccaaaaaatcatcgacttctggcgcaatttcgattttgccaaggcaaacatccgttgtcacgctttcttgttgctccacgatgcaattttgtcgaagaaaattcgaagaatttggtttcgttgaaccaaaatttctatttgaattttcaaaagttttgttcgaaacgtttacgggttgggtttgggccttattttgggcgtttgcctcaaattgtttgggccttggacagttccgcgaaatgtgcccgacttcattacaattgtagcacttccacagtttttgctcaaaacttggattgttttgtctgatcggtccattatttggttgaaatccggg

SEQ ID NO: 1036 - DNA, 4421 bp, Heterodera glycines
  misc_feature (4165)..(4165): n is a, c, g, or t
ccaaagaatcgtcgacttctggcgcaatttcgattttgccaaggcaaacttccgttgtcacgctttcttgttgctgcacgatgcaattttggcgaagaaaattcgaagaagttggtttggttgaaccaaaatttctatttgaattgtcaaaagttttgtttgaaaggtttccgggttgggtttgggcgcttattttgggcgttggcctcaaattgtttgggcctcggacagttccgtgaaatgtgtccgacttcattacaattgtagcatttccacagttttggctcaaaacttgggttgttttgtctgatcggtccattattcggttgaaattcgggctgccaatcacgaaaaattggttggaattcgtgctgccgttgatattcccgactaaaattacggcggggttctcgaaactgagtttcattccgatcaatctttgacttttccgcagacacaaaacgttgcgttgcgcgctgtgtcgattccgcacgcgctgctagcgagacgaaatggtccaaagacattcgaggcgttcgaatgagttccaaattaagtgacaaagttgggtcaccaattgatcggatcaaatatttgatggagaattcgtctgacaattggaaagaaagaccagggtaggctctcttcaccaaccccgaaattcgacctgccaaatcatcaatcgattcgttgggttttcgtcggacccctaacatcagctcatcaaaagcattcaagttttttgagtccgtttcctccaactgtcgcatcatttcaccccgaagcagttcatactttatcggaatgactgctttcgccgcttcaaaagctctttcagctcggccatacactttgctttctagtcccttaattcttttttcatccggccaactgtcggtgtaagcgtcgaattttttgaaaaaacgcttaacttcgtccgtcccttcctttccgttgaggtctgggatcctttcaaggaccatattgtactccagactacttaaaaccgctaaattttggctttggggtggcagcatttggttttcgtaaaccgtaaaattttgctgctgtcgcgccactggacggtacaaaacactgttttgttgctgccatccacgctcttctcttggtggctgttgatgcatttgcctcggaatctccgttgggtgcatcttttgacgtccatcctcaaaaagatgtcgtccgacgaattcgttgtgttgccgttcgcatggcaaaaagccgaagtttgcgttttgttgttgccgcgctaacgcaggttgttggcgaatttgaatttggcttgagcgaaaattttcgtgctcccggtaggggccaaaatcctcataaatttctcggtgccggatttggttgcttacaattggaaagttgtgcaattcgccattaaaatttattggcgtcgatgtacacccaatgagttcgctttgcgaaacatgacgtgaatttggcgccgtttcccgaaccaaatttctgttaattcgctcgaaatgcctattttcggtgccattctcaacgaatctcatccttactccttcttcccgcaccaataagtttccaaaatttggtctcaaaacttcacgcaaaccttcaacaaagtcctcgtgaccaacatttgcattgcgaatttgctgctgttcggcaccattgttaccaccaccgtttgctcgcggcggcaaattcgattggatggacacatgcagaaggcgccgccgaatttcaatttgctgctgctgcttccatttcactaaaatggtgttcgttttcctccgccgacaaactcaaatttcggttaagtcctggcgagatcggagcgttaaccaatggttcattttcaccatgaactccttcaacctgttgttgttgctgctgctcttcaaccgctgcgttttggttttgcgcaaaggttcgcaaattcaacgctctttgtcgtgtcaatggcggagagcgaattatcatttttgcacctggctcaggtatagcaaaaacaaaacaaaagtttccgctgtcgacacttttccactttttcgtttgatggcgtggcgattaggacggcgaatgcgatagttcggctcgaatttgttgcaattttaaaacgttcgactcgaatcgttttgttgccctttatcctgtctcaggatttttaactccacttcttttcaacttcaactccaactcttttcttcaacttcactccaacttcttttcttcaaattttgaaatttgccctggctcagggtcaattcaattccgttgattttgttgtccggttcggacttcaaacaaaactacctaattccgatctcgcctttccccgtttacctgctgttcctcaggagcgccaaataggaaagaaaaaccgttttccttcaattgaattggggggtggagaccaaacacacgaagacaaagccacacacaatatttttttttgaagtccgaggagatcaccaatgtgaagcaaattgagaacgaaatttagagaggaaattttggaaaacaaattaatgagaataatgagaagtgaaaagtaccaaacataaattaaagaggtcaacaaacataaaataaatagagataaaatgccataataatttaaaattaaaacaaatatcttaattaaattaaaatctccaacaggaatgccaaactgaatggaaagcggacaaatgccaaaactgaaaaaattggtgattgcaaattattaccatttagcagactaattacaaatttttggtgtttgttaatgtgttatttgtattagtttaaataagtaacgatgcaaaaaatggtccaagcgatgtgaaaagcaaaagctaaaaataattggagtgaaaaaacaaacagataaaaattataaaatttattttttaactaaaaataaataaaaatttataacttttttatttaaaatcttaattcatatatcggcgaaatatataattttttattaaatttttctaggattatgaatttattttccaatttttttttggcactttgtttacctaccgtaaacaggtggtaccgttgttgtgccacggcttcgtcccgttttgtgtcaataacttgggttaacaacagccgttgctgtagcccgtcacaaatgccaacaacaaacaatggcacaagcagcaggaatagcatcgacgagagcactccaccgtcaagaaaacagtaaaaaattgccatgaaaaacagacaaacggttttggccaagttcgacagaaaagcgggtggacactgctttaatctaaaatatttggagaatttaatgaaataaattttaaaaaattagttgtgtatataagagcattttattcgtttataaatttgaaattattcttatttaaaaaatattatttaaacacatgaaatttgatcggactattttttaatacaaaattaattgaataagttaatatcatctaaatggataaggaagaacttttgaagcaccctaataaaatttgaattaatttaaaattattaaaaaatcgaaattcattgatttaaatttcttatattatgtacaaaaaaagaaaatatttttaatcgaaaaaatgcaataataataaaatttataaattaaaatttactttaatgaagctggatatattacggcaccaacaattgccgaaacgtggtggacaaggtgaaaaattagcggaaaccaatgcaaatgctcaacgcaagaagattttcggagaaaaagcaatggaaacaatgcccttgacaggccaaaagcaatggccataatggccaaggtcataggatcgagatgggattgggacaacattcctttactaaaatttaaaattaaaaaatttatttgttttgaggtgccatgtttagtgccatcatggcaatggcatggactcgaaattggactggggaaaacattcaattttctcaaaataaacaaaatttgataggagtggatgaatttttttaaattatgatttttttttcggtatttgaactctttttggctaatttgagttttaatttttttttctgaaagaatttttgagacattaaaaattttaattgattaaaattaaataaaaaattcaaatatttaaacaataacactaaaaatggcattcaatgtcaccataaaacaaattacaaaatcacatcaacncatttcgagtgccatttttcttcgaatttaaaagataaatgccggatcatcactattaaattttgatgtcatcatatcagaaagcacacaaaataattgctttacgccccaaatgatgtaaaaaaataaggaaaaagccgcggtgtgaaaatccgccgtcgcacagataagccaacagcgaaaaatgatgatggcacggcactgtgaccgagtgtgcccgtgcccaaaaatttgccttttctctcgcccccccccc

SEQ ID NO: 1037 - DNA, 1246 bp, Heterodera glycines
tttttttaaatgggaattttctaagggcatgcccttaaattgccctgaattttttataaatgtcaatgaaattggaatttcactctgcttctaaatctaattctgtatataactcggcgatgaccaaaaaagaaattttctaaaatgaaaacgaacgaaaatatttttatttttatatttattgatttgtcaatgcataaagaaagattgacagcttttttgttaatttaaaaaattttttatccaaaaaagttgttgttactgccttttccattattttatgcctttttcgcttttcgtgttaattagaaaagttatataattgattttttaatgaaaatttaaaaaataaataggtggtataagaggcggtcgtggacgtgttggcggctttggcgtgagcggaggtggttttcgttggcgcggtgctgctggcgggcgcggagttggaggtgttggcggacgcggaggtgttggcggacgcggaggtggtggtggacacggaggtggtgctggtcagggatggcacggaattccgagttccgacttccgacatttttggggtcggaattccgacttccgacttccgaaaatttttggggcctcggaattccgacttccgacttccgaaatttttgatgaaaagtcggaatttttttgagttttttttttcaaaaaattagcaatttttgtacaatttatgttaataaattgcatagaaattttcaattttttttccgacggcacctatcggcaccgccggacccaaaaaaaaacttaattttcttgaaaatttgctcaaaatcgcaaaattttccattttttggacaaaatttgttaacaatttacattaaaaattacaaaatctttcccggcggcgcatatcggcaccgccggacccttccttccccacagtttctccaattctctttggataaagcgcgccgcaaaaaaagggtgtaactttcccaaaaaaaaatccaaaataatagaaattacttaaaatattttgatctttttaaaaaatatagaaataaactaaaaacagtttgaaattaccttttacatggttaaaaatttagcctattaaatatatttttttaaatttattatattttttttgaaaaattccgacttccgagttccgacttcgacattttttgggggtcggaattccgacttcccgaaatttttggggcatcggaattccgacttccgacttccaaaaatttttggggcctcggaa

SEQ ID NO: 1038 - DNA, 5398 bp, Heterodera glycines
  misc_feature (4467)..(4467): n is a, c, g, or t
  misc_feature (4545)..(4545): n is a, c, g, or t
tgaccgtcctcaaattggcactgatttcgcctcgtttcaatgtgttggtggataaacatttcgatggcaaacaagtgaattcttttttagggtttctattgttttcaaagatttcgtgacaaaaacgggcctcaaatttcaaaggattttgcataaaaataccgctgaaaaaatttttttccaatttttttagttgtgtccgtttttatgttacggcaagttttttttagcttttttttgttgtaaaagtgattgttttttatagtgtttttatggaatttaggcgtcacaaacctttttaggtttcaaaaatgactgaaaattattattattttcaaaagtcagtatttttttttgttaaagtgccgggtttttaagggctttttggttatctaactaatttattgtaatttcaaatagaataaaaacggacaacacaccaaaaattgaaccttaagaatttaaaattggtctataagatccccgaattgtcagtttcgttgattttctgtggcaaaatcaaaaattcttaaaaaaaacacttacaattagcagaaaatttgctgaatttactgaatttaaaattttcacgtaatagaagctctaattttttaggaagattttcttttttaatcgataatttggcgatttttttaaggaaaaaacccgtaaaagtgccaaaaaatttttatcctttttcgttacagcattttttgaattttataaaatagtgaaacgggcgggccctcccaggatcattggcgaccaaatattatccagaattactttattctcccatctcaaacttgggtaattaaaccacacgtattggtgaataaaacgaaatgtgaaaatgaagtgaatgatggatataacgcggatggcgaaggatggaaatgaaatggataagaaaatgactgattgaacggagataaagagatgggaaagtgaaggaaaatgcgggaaggaatttgtcccggaaaaggccaaaaatccaattaagaaatcccttttacacctccatcccttgaagcgatcgtccccgatcgatgagtaaaattttggtggtatccgaaaatttaaatttttttttttaaatcactttttgataaagcccagaggtgaaaatgatgaaaaaggaatgagtgagaaatatagagaacagaaaaaaaatcacgttcggcatcgtttttcaatgtgtccgaatcttccacatctgcggcatacaacatccgtccttcgttctttcggtgctggtcggccatgttcgactgcttctgcgtaactcgttcgtggctctcgttgtggtggataaggcgtcatgcgtacatttggtcctgctcgtccagtccgagcatacactgctggcggtggaacggaagtgtcaatgaccatcatgccgaatgaatgtgccgaggatggtgcaagggaagaagtgttcgcacagggcaaaacagggtgtgcaaaaactgagaaagaattgcctaagaaactgggagaggaaaaattagttgtgttaatcctttggcctagactctcatgtctcaaagtgctatccctttctgcgtaaaactcataggccattgggactgatccattgggccgggtgattgtatttcccacccgattcggccaggggttgcttattaggccaatatagtcaggggttaccgcaaccgtcattttaagtgcttggtcgagaaaccgtctccacacttctcccttgtgccacaacagagtgaggtcgccaatgacaatcaaaccaaaacgtggtcgagaaaccgcaacggttgtgcgcgccgcatccgcccagaattctttcccaatgttaacatcttcagtccgtccagctccggtgcgtgttgtcaagacgatcacgagatctgcctcttgactttggatcgaatcaactgtaccagctttgacattttgccaattcctcctttcaatttccaatgtcacctgctttcgttcggcctgataaaaacaaacaatttgaattagtcccgaaaaggtccgctgaattatccccaaaaattccaaagccgtttcacgctgttccggattgtgtgaagagaatgacacgctttcctgttgagcgggcgttttttggtgaatgagtatgactggacaattttctgtgacaattcgtggtcccatgaaattcagaaagaatgacatctcagtgtcgggttttcctggaacgagtcggtcaccggctggtgcgtacactcccgcgtctaggcatttgacaatggcactgtgagacctgtaacaacgcgaaaggacagttcgatcaattcctttggccctttccaaaacctccaaaaccgactcaaatccgtacttaccacgaatcggaagcatttgacttggcaaatgcactcgtaattgttgcttatcgccagttagtagaattttccttaccttgcgaaattgggttaatgtggacagaatggctgaaagcgtggcttgaccacattcgtcaaccaacacataattgatgtttcccaaatccagtgccaactcctccgccaatgccagggtcatgaaatacacacggtatttcgtcatgttcagtagagcggcagtggtcgtccgctctcgtgcccttctcggtgcccggttaaaatcgtccacgtatttctgaaataatttttcctcattccacctctttcctggtgctccttccgtgggagggatatttccatacctttggactgcctcaaccaacaaattgtccccgaggggccgaattctgtccatatatcgccctttaccttgaccagagaaaagtgccagcattggaactttttcagttagtgcctccattgtatcttttaccaactcacacaccgcaacgttcagaggggaaacggcaagaatggcggcatcagggtcctttttcagcacactggcaatgcactccgctacggaaacactttttccagtacctgcgggggcttgcataaaaattactcgcgtctcctggtccaaaaacaatgagtgagcaatccgttgctcttcgttcaattttccaaccttttctgtcagcctgacggctgttctcgtttcgtccgttccttttcccattaaaacccttaaaatatgagagacgggggcattaccctgcgcaatatcggacaaaatcgttttttcgaagcacatttctctaaatgttaatccgccataattcggtaccaagaccaaataagactccatctcgtccaaaatattttcccagtcctcccaggccttttcataacccttttttgcctgaaaactcaaaattaatttcacctttattgtgaaaattcccgggtttatttcacttgccgatgccgaaatgacgtgtccatgagcgcaccaatgggccttggtgtcattggcaatttttgcattcaccggcgtatcttcctcccatgcttctaaaaagtctgcgactgaagatttgtttgttaaggtccaatcaaaagagagaagttgcgcctttttcaaatttctctgaacttcctcatccctgacttgtggtctgtcccagaccaattgaacagtcacagcttgcttggccaattttaccatttcgtgggtcctttgtaccgctgctgctgctcccatcaatctttctgaaaatgtatccaagggaaagcagaaagaatcattacaatctttggcaccaataaccacgtggtttgcatgggccttaatctcatctcctttcatgtaaggcgttggatggggcaataaataattctcacccatccaccattcttgaggactcgtaatggatgccaactgcagataaagcacctgattcaaagttacccttccaggactcatttcggtcaaatgacgggcataaattgtctgtggtcttagcatttgggatgccattacgaccgccgaccgaaagtctccgcccttatacctttttaagtcagtgactatccctgggcaaaacgtacctgtaacgaaactcacatcagaaatattttgtgcgattgcttggacattgattcggccttgtacgtaccatggacgtgtttcatcaacggggtttatgtcgtacgacaacctttcaaaaccgactttccatacccattgacttaccatcacaacatcacccatttgcaaacgccttttagcgcttacaatttcatccgggatgcccataaagaaagggccctgaccactcaatttgcctccaactacgcttttcgcgtccgtttggcataccaaatattttaaaaccgaattttgtgattcgtccatttcttccacattttcaaactcttcctctgtttgaatgggtggcacttcctggttggcattcacatccgtatccatttcctaatttttgcatatcgatagagaaaaaaattctgaatttttctatactgattttattttggtttatactcccattccaaaattattaaataataattttaaaaaataatatttttnaaagattaaatggctaagcggaccgtaataaagaaacttcaaagcaaaaaatcagtccaaaaaacgtggaacaattgngaggagagaaaggcgcagacgcagagggcgacagaagcccgtctggccaagaaaagtgagttttttcatcaattttaactcaaaaaaatcatgactcggtgtgtacaaacattcttggtatcattcgaaagcttaaagattagggaatttataaatacaagaaaagagcaaatactgcaatgagaaaaccggaaatgcatcattttacgcgtataatcacgaataattgtttgtctattgccattatctcataattttgcaacagaaaaacttttgtagacttcaagctctcgaatgataccaagaatgtttgtattgaccaagtaataaaaaaaggtatgacctataaaagtgaggatagtcactgattggacgtgtaaattggaatagagccaaaaaatcaacaatttataaaattataaacagaaaaacttagtggactttgatttgggcaaacactttatttttcctaccatcagttttccatattatttcaaaaaaaaacaatttttttaatgggaaaggtctgccgaagaagttttgcactatataaattaaaaatttttttattatttaatataattttaatttaattataaccaaaaggcattatcataccagcagattatcagtttgtaaatttacataattaattatttaaataaaatttctaactataattgtctacattcttttttcccaaaggcgttttacttttttaatttaaataaaattttgttattagcaactattttctagttttttattttagcaactaaaaaactataaaatttttgaaaaaactattttaaactattattgcttgtgaataaaaatttgttatgaaaaatgc

SEQ ID NO: 1039 - DNA, 3395 bp, Heterodera glycines
agaaagggccctgaccactcaatttgcctccaactacgcttttcgcgtccgtttggcataccaaatattttaaaaccgaattttgtgattcgtccatttcttccacattttcaaactcttcctctgtttgaatgggtggcacttcctggttggcattcacatccgtctccatttcctctccttcttccactctgtccagacaaattcgcttttcaccttcgcttaactcaaggcctttctcaaactcttcctcgaggccttcagacacaccacgtgtcttttcaattacagaaataacagtttcaactgtggttgacaccacatcctcaacaacaatttcctttgaagctgacgcttcttcaatcacacacaactcttcctgtgtggctgacgccacttcaacttcaccagaactctccaaaacatgggtcggcgaattgtccttgcggcgacgtgctgaacgtttgcgaggcattagcaattaattattttgcttttgaaaaaagaaaaagaaattatttgttaaaattaaatacaaacgtaaagttaaaacaaaatttaaagtcatcaataattgaatgaaatgatgaatggacgaaagaaggacgaaaaataatgcctaatctaaatatcgcgctggtttgttaagttttgtacgatttcttaaagcataatgaggcaattgtgttggttcgcatgtatcattttctatgttttgagtatcactaaccaggtcattagcatggttttgcgcaggtaactctatttgttcttttataataattggatgagaatgaccaggtaaatcagcaatttcttcgctttctgcttccacaagagcattattttcttcgggactaagccagggagaagtgcaagctggtcctaggatttcaacgcatttcttaagttgattaatgtgaacgcggcgcgggttgctttggggcgaattgcaacttacaatggtagcataaataccgtcaattttaattatcctaaagacgcccttccacggcaactggaattttttagatgtatttatttttcccgcataatttcttagcaaaactctatcaccttcctttagcttaggcgttctcattgttttgtcatactgtattttcattttttcttgtgcatctgcatgcacttctgaggcacttttccacgctctccgaagagagatcactagtttttgtttaaattcagtttcgtcagtaaacgctaccgggtctctaactttagggtctaaaatttgatctatgcaaaatataggatcgcgcccaaacattaaaaaataaggggtctcgttagtagaagaatgaactgatgtattataacaaaaattagcataatcaaggaattcgtcaaaatctggctgttctttcgtaatgtacttagctaaaatattatgaaaagtcctaaaggtacgttcagtcgcagcattgccttgagaccaatggggtacagcatattttttatttatatataatagtgaacaaaattctcggaaaaattccgatgtaaaggcggtggcattatcactgactaattcagtgcagccaccaaattttaaatagcagttctttaaaaaggctatcgctattgtgtgtgatttagcgtcaggtaatggtaccgaaatgacatacttacaaaaccagcaaataatattcaaaatatatttatttccactaatagtcattgggaagggcccggccaaatcaaggcctacgcgagcaaataaagtatttgcgggaaccatttgcatttcagctctaaaagctggagatggagaatgccttaattggcaagtaatacattgtttgtaccaggataaaatatcagaatattgtaaaggccaataatatttacgacatttctttaatgtctttttcaggtccatgtgtccccctcctaatggtgaagaatgaaatgaatcaaaaatgagagatcttaatgaaattggtaaataaattcttggtgattgttcggaatatttaaaatataaaattcctgagtccataacaagatttttagcattttcggtgagattttccatagattgagggtccatttcatcaggaaatttgcctctttgtaaaaaattaatcaattttgaacactgagggtcttctctttgttctttctttaaatcaatgtcataagaatgcccgtcctttcctctaagaattaaattatttatgaaaggatcaaaaattactctctggtcaattgtcaaagacaagcaaattggaaattcagcaatgtcatccagttcgtccaaattttggacttccttaattgaaatattttcctgtgctcttgacagagcgtctgccaaactgttttgttttccactgatgtggacaattttaatttgataggcctgtaactcaattagccaacgtgccaaattgggatgagcttctgcctttttaagtaagtaagctaatggtttatgatcagtatgtaattcgacatcagacaagaaaataaagggtttaaattctctaagagcataaatgatggcacctaattctatttggactgtgggccatttcctttctgaggcacttaatgttctgctacaatacgaaatcgccgaaaatactccattgttattcttttgcattaggactccggcctgacctactaaagaggcatccgtaaatacatgaaaaggttttgagtaatcaggaaaagtgagcaatggctcgtgtgataaaaggtctttgattttctggaaagcctttatttgttcgtctccccaattaaagacagaatttttacgagtaagacttgtcagaggttcgacaattgtagagaaattaggcacatgccttctgtaaaaagaagccataccaataactcgttttacctctttcacattagttggtgcttgtaaatttttaataatttctatgcgacttaaactaggtctataacctttggcatctaaaacatagcctaagaaattcatttgagaagaagcaaagacgcatttcttcggacttaattttaaacggaattgcctaaatctctcaaagactttacgtaatgcacttaaatgttcttcaaaatcaggagattttgtgaaaatgagaatgtcatctacatatgcaattacattgtcattgagacctgttaaaactcttgccattgcccgggaaaatgccgcagtggcattttttaatccaaaaggcatatgtgtcatttgatagactccgtcttcagtaattacaccgcattttcgggatgcttcctcactaagtttaatttgaagataaccactggacaaatccaaagaggaatagtaatggcaattagcaactctttccatgatggcatccattctaggaagaggataatggtcaggaattgtgacatcgtttaat

SEQ ID NO: 1040 - DNA, 2209 bp, Heterodera glycines
ctggatcatccgtggtagttactatgttatgctcaccctccgtaaatgaacctaagtcatattgagattgactaaaaacatcataaaattcatcgcacagcgattttagtttttctaagtctttacctactacagaacttttggaaagatctattttaaaattcgggtcgacaacaacaccttcactaattgacatggccattaggtcttcagagctattactcattgtataattgttaatttgtctgacttcgtcggcataagccaaatgtttacccttgtaaatttgaaaaggcatagcagttggattaataataagaattttcactgtccctcgaaagggctccacaattaaaggaattaatccgaaatgttcattcaaaagttttttatcaagagaatgaatataaatgggtttatcagaaactattgagggatcaaattgagcctgaattatggtccctttattcggaggaagaattagagaattgattgcttggattcttaaattattcaagagagaattatttggtaaagagcctaatggggtgataaaattacctacactgaatttactattaggatagtcaaaagtaaaaggtggcaatttaccaaggatattacaaccaattagaagattataggctgatgttttaaatttgttatcgtccacaagataaatggtttccttaatttcaaaattccctatagaaaaaacaacagaaactttttcagtaagttcaagtgtgtgacccgaggcacttataacattgacaaatgttggatatggtatgcattgccaaataggagccatcaattttggcgctacactaatgctagctccagtatcaaccagacttgggtttttcacattattaattcgtgatgtaataattgagcaattaggtgaaattgagccaagaaaattaacagaaatcttttcaaagcgaggtgattgatccactttcttcatcaattgaattggattgggagtgaggcttaaaacgcccctttcttttgaaccgttccgaagtcggtatccgttttttgatactttgttcactttctgctactgaaatttcatttacttgagaaatgggagatatcgccctaacattatttgtgagagtgcaaccaaaaataatttttcgttcttttggaaggattgtgactccaccaaaacgatcgattaaattggcaccaattattaaatcaaaacattcgttttcaaaaaccgaatgatcagtaaacaataaaggagcttctcctaaaatatcttcaccttttgctaaatgagcccatgcaactatttttccaactaatgaatcacccgaaacttcgagtgggttcattccaagcgatctgaatcggatattaacttccctttgtgcacttttgggtacacttgctaaataaagaattcgatctgagccaactgaggtttcagaagcactatcaactaaagctctaaattcaacaccattaatcttaattaggaaaatcggaaggtctaaatttgcaggaataaatccaaattctttaaattcagcataagaacgaagcataaatattgattcacaaatagtttcacttttgctgtctctctgaggagagttcatttgctttgaaggggatggaattttattaacttgaacaaatttaatgtcaaaagattcaatgggagattgggagggttgtgaattggatgattgaggcaatgattgaattatattttgagctgtcctaattgtttggtttcctaaaagaagtgatcctaaacgaccatttcccagatatatctgtagtgcaaaaattccaaatcttaacaaaacatcgatcaatgaaatcaaagaaataatagtgattattactttccaaatataagaccaatctccaaaaatttccttctgtaattcatccctcgttttttgccaagtattggaaaaagcagaagataatttagtatcatgttgatgaatttggtaagttatgtcacttactttgactaaattatgaataaaagcatgaaagttgatatctgtgacattaaacataactaaatgatgaaatgcgatgatttgggatttgtggaatagggtttatattccattccaaattgtcgtccctcagtacatttaactttgataaacgtgctgatatttggtcaatcatcagtacctcattgtcaagctgaaatgctatttctcta

SEQ ID NO: 1041 - DNA, 1175 bp, Heterodera glycines
  misc_feature (1147)..(1147): n is a, c, g, or t
caaggactagcaaattcgtcgaaatggaggttgatgaacattggaatggccaggacgtgctctggcaactaattgtggttttttaaataatatgcgtgctaaaatagttgggtcaatgagcagtgcagtttctgcccaacgatgtgactctaccatgaggtcacaaattgaggtgacagcattctgaaatgcatatgtcattgtttcagatacttcagagtctaaataagtcaattgagatgctaattgtgaattagtcactaaactgtctaacattcttttgctcctggtctgacgaccattcttaatgatttgataagctaaattttgttcagttaaacgaagtgttatgttacagctctttacggtaggtttaacccgtgagtctgttagtgcaagctgagtttcgtctgctaaccaggtattgttcagcattcgaccattaaatacaccaaagatccgaaattcgcaattcctccctgattccggtttccaaataagttgggttttatcactcatggtacaactaccctttgtatatggacaatttgaaacatctccaagaggagaatgaatagatttatcaccaaaacgagagcttactaaagttttgaaaagataacaattttcactggtggttttttcccatgagaatgagccaaaaatccatgtacgtggtgtgagattgatctgatgatttgtgtgatatagtccttctgtcattataagtgagcccaaataacaccgtttttgatcaatcatgagtttacattcattaaaagagacactaagaaattcggaatcatgaaatttttcgaccggaacccctgttaaggaagtgtacttagacatggctttcctgacgattctacaagcccaagcttcagtattatattcaagaaaattaggagtaaagattctccttctttgtggtttgggcacatgagaatgacttaaggctaaagaggaacagccacgaaatttgggaagttcccatatcgcaccttgaaaattagtttgacaaataagaggatgctcaggaacatgagaggtaaatgcatcagtaccaattgataaaagcaaaaatagagtcatggataacataagaattcgactaagtcgtgggccaatgccagtgcttccccanattagaaactttaataggagagggagaa

SEQ ID NO: 1042 - DNA, 6524 bp, Heterodera glycines
atgaaacgggtctggggttcaaatccgcttggctgcggattattttttatgacagccaatgaccgttcgtgctttatttgcgcacatttatttaataatgacatacaatgtcaattgttaaccggataataatacgcaatactctacaacatctgtgcttgagtttttacgctcatttaattttttttaaattttggaaaaaatcaattacttgatgaaaaatcatagataaaatcaatgattttgcaaaatctgagctcagattcgtaatcggcacattttttcgccctaaaaaaactaaaataaaattttttaattaatttttcgtcgggaccgcaattctgaaggattaccgaattccgatttccgaaaatttttggggcctcggaatgccatccgtgccatggacacaaaatgtcatgggacgcgtaaaatgccatgggacgcgtaaaaccgtctagaaccttttttaccctagaaaaaatgctttttgaaattttactatttttccgtcgggaccacaattccacaccattgccctagaatgggtgtcaatcaatcagaccctgaaaacccaggaaaggcgttttagattttctaaaaaatttattttcagaaaataggagggacatgcagaggtattacccgcctgcctcaaatttaaaaaaatcaaatcactgtcaaactcctcacacgccaaggaataagattttcctaattactccaagcaattcataaaattaaatccgcctctatatattatcatttttaaattaaatacgccaatgacgaacagcaataaaaagaaaatcaaatttgatctttccaacatttccttcctcttccgcctccgtgcggacatcaaacagccgctcacaatcagaagcacttgcggtgcacatcctcatgttcagcccggccaatgcaagaatttggaatttgtcatgagtcatgatgttggaggagattgagtgtattaattaggcccgtacccagaaaatgtgcacaaaatctaataattttaatgaggaagggagaaaacttaaatcgggtcgtgccaaatcgtccgccccttttttggtattcccttagaaagcacccatccgttaccgtaccgccgtttggcatcccttgattaaatttctaaactttcccgataaattattttctgggtgcaggcattattagattttgctgacttcttccgctttccaaattttgtcaattcatgtcattgcatcatggcaccacagcagaagctgatggtcacaacgacgcaatcccgttggcactcattcaatttcgcctgagaaaattcgggagtaagccgaaaatttatttaaaaaattgttggagtgtttgcactatgtttcagcattttctatacccataccaaaaaatggtttttccaacatatttacaaaaacctaaatttttcgtaaatggatgtacgtctaccatgtaataggcctatctctttttttaaaacaaccgctcatcaaactgatcatcagccaatgccaatttttcataaagctttttggcggtaaaattgtgcaattggttcatacgttgaaaaaatatgtaaatataacattaatatatattaagcaaaaaaaaacataaaaacttcgggaacgggtcgttttggcgccgccgttttggcgccagcctcagtttttttattataaccttttttcttgttgaccaaatctaacaatcttggtatcattcgaaagccattcacaagctctattagccttacaaaaaacaaacaaaaattttagcttctaaaaaagtcattatggaaaaaacctcaaaattttcgacttttttgcaatttcatgttataacttttttggtaattgtctaatcgcgaagcaatagcttagaaatatcttctaaacatgttaatctttcgaataataccaagattattggatttggttaacaaataaaaaagttatagtccgaaaacttgggctggcgccaaaacggcggcgccaaaacgatacagacccgccaaaaggaccctcccccccccctcgggcactctggcagtttttaatgcaaaattttttttttcataagctctcaatcgtcaaacaaattgtctatgtcaaattttcgcttcctccttccctccctcatattcccacaatttcattggtgcccatgtcgccgccccttttcctccctccgtttctattgaaacaattttcggccccattaaagcaatcaatcctcaaacaattccaaaacccgggaccattggacataaaagtgcaaccattttttatttttaattccttaaaattttcaaatttatgaaattgaataaacaaattgattaattcttctgtgttttcaaacatttctgcttatgtcgctcccgcacgtgtgcagagatttgcgcctatgcttaaaatcggtttcaaatttaagttttttcaattttgatacttaaaattggggaaattaagatttgaaacagattttatgcataggcgtatgtaagtgtcacataattctggaaaatttatcacaaataaaaatccaaacaaaaaaaaagatcagtctccaaatttttaagtagagtgcagcgggaccggaaaatttgggcaagaccgggaccgggactttttgggttgaaaaaccgggactttttggctggaaaaaccgggaaaaaagccgggaatttcctggtcccggtcaaaaccgggaccttggtactcagttgtccttgttcaggtcccggtcccgctgcacctatttttaaggcatcaataagacaaagaaacactcatttatactgatggctcccgtaattatgaattttaaatttttttttatgaatttttaagtaaacaagataattgatgcaaaattttctgtcccatttgaaggctctttttttttactccctcacatcgttacggcactaattcattagtgcaccgccggctgtcacaacataaacaaaaagcgagcggttgtgccgccatttggtgtttccactgctgctgcgttggcaccctcccctccccctcccccattaaccaaccactcactaatttggtgcgacaacaaattgcactgctcatcagtaaggctgggattatatttataaaaaatctaaatattttaagaaaaaccccttaaatatctatgaaaattttggtcaaaaatgaaaaaacttagaccaacaaaaaattgtaattttcttacatgaattttttattcactggttgcaatcacaaattgagtacatttcatgcgtttccgaggaaaagcatcggcaagaatatttttgtaatcggaaaatgatcgttcaatgtcgcaaaaatagagaagcatatttgcaaaattggatttttgaatttgttcgaaagttcaattcctaagggttcataaaaacccaaaatgccaaaatattattaaaataaattgataaaaaaattaaaaatatttttgtaaatatttttatttattcaaacattaaatattttttttaatttatggataatcacattaaaagcgaaatattttcggctaaaatgatagtttttcgtaaatttctcatcaaaatatttaaataaattaaaatcatagccttactcatcaacagcaacaaacattcattcacaaataggcaggccaattagtcggacgtcgtcactgacagccgacaacgacggcgacgagtaaaaacggcaatgagcgactatcatcatcagcagaagggcggtggtggcagtggctacccacaacatcaatccagctacggatatccggcaatgtgagctatatatgttggcacacaattggtggtcggtcggtgagcaaatgcgatgtatcggcacgggaattccatggaattcttttttggcgattttttgccaagcgttgaccgtgaaagcaaaaaatgattggtgttgcttatggttctcgagtcatgaaaattgcttgtttcggttgaatgggatcgggattctcgagggggattcggtcccagttaaaattgattgcgcgcgaacttttctaaaaacaaatttttgtgggagacagaaatggttcaacagagttcagcagatggagttatatacatacagtagggctaatttacatgatttatgggttcttttctgttttgtgaccccccctgaaattttcaaataaaaagtcatttctagggtaatttggggcgtaggcttagggttcagcttaggcctaggcttaggcttcagcttaggcttaagcttatgcttaagcttaggcttaggcttcagcttaggcttaggcataggcccaatacgtattcagcgacctcgaaaacccataaaaatatgttttccttgtaatttatgaatttcaaatttatgttcgaattcgggttcgggattcggaattttgaaaaataaatgccatattcgtgatcagcgccccaaattaccctagaaatgactttttatttgaaaatttcagggggggtcccaaaaccacaaaaaaagttcgatttatgttttgttttcattcattttttgttgggacttttttatggatttattttgaggatttcaagccgtttattgtggctcctctgttcgcacaaataatctaccaaaaactttttattttccaaggcattgcaacatttctcggtcgtatcttgaactcaccgaattggagcgaaaatgtttagaacaggtagaggaggaagtcgtaaaaattttttcattaatgatcgtaatatttaaatttaattattatttaaattttattttgcagaataataaatcatgatgtagctcaaactttatcatatttttatggtcaaataaaatatttgaggatgttattccgtttaacatcaaaaggttgtttataatttgattaactttgagctaaattatgatttattttctgaaaatgaatttaaaaataataataataaatttaaatttgctattattaactcttattattttcgttttatatgtgctaaaaatttgcacaaatcgtccattgaaccgatcccgatgaaaaaaaaaaattgacataaaggctagcagtctgcaaaaattttcgattttttggttggagtgccatgtgacagaaccgtttagtgaactattagtaagcctcagggcttctagttcacgaggcggggtttatatttaaataaatacggattttgcgaattaattctataacaatagcaaaattaagagaaaatattgacaaaacggtagattaatttattatgtaattaataatagtaattaagagaaaatattgacaaaacggtagattaatttattatgtaattaataatagtaattaagagaaaatattgacaaaacggtagattaatttattatgtaattaataatagtaattaagagaaaatattgacaaaacggtagattaatttattatgtaattaataatagtaattaagagaaaatattgacaaaacggtagattaatttattatgtaattaataatagtaattaagagaaaatattggtgctttctgttgtcctccattgtcactttttgcttgtcaatgcttttggtggtcatttggagggtatgtcaatttgaaagtcatttcaacaaatatttatcttagagtaatggacaaaacatatttatttctttaggcgattaattcgacaaaatgttgatcaaaaaaagtggagaaaaatctcatttcaataaaaaaaatttttttttgtatgaatataaatggaattgatcatcactgttgtttttggcgtgccaaaattttgtcgggcaaaagtttttttcagtttatgtcccaatcaaaaaagttggaaatttatttgttaccaaaaattttcataattctttctaaaatatttttaattaagttacaattatttttcagtaaaataaaaataaaattttattaaattaaaatgccaatttatgatttttgttgcacatataccacagattgtcacccatgtgtgttttcaacagcgcgaacggggcgccggtgttgagccacttgtgcagcaacatgacgacatcgaagggtacaaacaacaacagcaacaagcagccaagggcggtggggtcggcggtatggatcagttgcgcaaggaggagccggtccaaattggttggatgaccgaggccaaggattgggccgggtatgccatgccataattattagagaccggacgggaccagcaggggcccacgccggagcttttaaccagctcccggtcccgtttcttttagacaaaacgcccagatcgggaatgccgggatcccgtcccggtagcattttccaagttcaggcccgatcccggccatttcaaatttcaaacaacaaaatttacgttttttgcacgctttttagtgaattgatttctggccaaagtatgactggccgaattcttgttgtgctcgtgtttctgctctcaatcggctcgctggtccgttttgcgacttcttttttctgggatgctatgatgggcgggggggggga

SEQ ID NO: 1043 - DNA, 934 bp, Heterodera glycines
aaaatgtggcaaaatttttcaggtaatttacttcatcgacacactgaaggactcgttccaagtcgagacttgtgtgccatggtaagttttgttgaccccagagacggtcttcccccaattttttctaaatgcaccgcaaaaaatccataaaaaggtcccccccccccccctctcccctcgggcggtaccccctccaagtcgaaatcctgggattgtccctggttaaaaccccttgtaattcctaaaaattttcaaagtttgaaaaagttatgacatatttttattgtgactctttaccattgtgatgctctttaagtgagtagaagaaacagatggcaattttttgtgatttttttggtcatcaatttaccgtactcttcccttcccttccctacgatcccatggtatttcgccatgttctttgacatttattttcctattaaggagtgaaagtcccacacaacaaattgaccttggtaagtcatttacacaaagcaatatgaattaaaatttccaaattttccatttctccctcccaatttgtttttttttggaatactgtataataccgaattttcttaaattaaatataacacacggattcagcagtcctcagaatagaaaagtcctgcggaagaatggggagtgggaattaattttttcttaataaatttggagaaaaagttaaaatagtttaaaaatattttcgaaaaaaactttatatttcaaatttctttttttttcaattttcttgaagaaattttttaaagaattaagctaggagtgaaaaatttttcaaatagttaaatttaaacataaataaattaattaattaaataagcaaggaatttagtttttgctccatggttttcatttcctaccattccgcagggttcaacatcttcttcctcatctacttcttcatccgcttcat

SEQ ID NO: 1044 - DNA, 2018 bp, Heterodera glycines
atcagtttcatgaacaagaaggggtgttcaatcatgccccatatttgtcaggtctccgtttcttgcgtgctctgcggttaatgaccgttccggacattctccagtacttgaacatactcaaaacttcgtcatatattcgacttgctcagctgctttcaagtgatttcggattttgactcatcaacaattcaatacgccataaaaaatttaaaaaaaaaacgcaaatttcaagttttcatttcgacctctttggccggtgctggtgtcatccatttgctggagaacagtggtgacccgtggaagtaagtgatcctcctcttgtttgttatttttgtcacaagaatttatttatactctcaaaactttgtttgactgtattacgggttacggtgttgcgaattttcgaaaatatcctttacgggttactgtatttcgatcctcaaaaatctccttaattaatggttacggtgttgaaaactccccattataggggggtgacttacggtatggagatactcgaaaagccccttattttttttgcagggattttgtgaattcacatcgcatttcctatcctgattgcgtctactttttgctggtcaccatttccaccgttggctacggtgacatttactgtaccactgttctgggtacggttttcatttttttgtttttgacgcattttgcattcattaaacatatttcacaggacgtgtctttatggtctttttcatcctcggcggtcttgccatgtttgcatcatatgtatgttagtgtgtgattatgttgtcattttttgtgatgaacctcttttttgagcaattaaaatggtgataattgataatttaagaagtgctaaattgcctatttcccaaaaaattggcaattaatgatatcgaaacgaacataacgccttttttgagagattaaggcatttaattgaatttaaaaaacaacaaaatgtcaatcatcatggaagccattttaaaatgaattctcaatgtgctaacatggagcagctcgtccccctcccctccccgtgtcgtttcccgttctgaatttttttttaattttccaaaaaacagaaaatgaagaaaattttaaaatggttttttcaatttttgtaatttcatagaattttgaaaattaaaaaaattttttgggccgtagatatggcggggggggggaacgtacttcgcccgagctaattataaaaacaatttgttgcatagaaaagttaaaaacaataatttgcaaattcccaaaaggtgcccgaaattgctgatctgattggcaaccgacaaaagtacggcggcgagtacaaagggtaattacgttcatttttatgacactttaattatctcatattacatatcatatttcttgcagagaacatggcaaacggcatattgttgtgtgcgggtattgtctattttttttaatattgttatttattgcaagaaaaaaaattaaaattttaagggaaataccgtaattgacttggaattcgaatcacccaccaagtcgccaatttctcgaacgtttttttttggccataacttaaaatgacgaaatttttgaaattttctagtttaatagtagagaaaccctagggctattccatgacaatagattaatttaattagggcaacaatgaaagaacttattatactccgaaagcgccgggagagcgcccaggatttgcaggattactcccgggaatccgattcggcaaaaactttgaattgatattttttttttgaaatttcttctccttaaaccatcaccacatgatcaggcacatcaactacgagtcggtgtctcacttcctgcaagactttttgcacgaggaccgggaggacgtggatgtggaggtggtgtttctgcatcgagtggtgcctgacctggagctggaaggcttgttcaaacggcattttaccaaagtcgaattcttcaccggtcagtggcggcggcggctttatatgaaaaataaaaaatgccattttaagcttaattag

SEQ ID NO: 1045 - DNA, 1145 bp, Heterodera glycines
acgctgaggacgccggtaaggggcaatttgtgtgtgattgaagacaggctgactgctgctggagttggttgttgttgttttttcctttcattttatcagtgcaatcaatacgttcccccttcgaaaaattgttttagttttataaatttcttaattttttcaaaacaatttacctttttttactcgataggagtatacggtagtatgtacccgtctactgtatcatgtacaagggtagtttcatcattgttaggctaataaacgattgggacaatgggtgggtggggaaggagaggaagtggggtgtctcgtgagcccagcccaggtgccaatgccatgaaatcctttttagccaacattatgcgtgtcatctccatcaaaaactactcgtccgacatccgggttattgtccagctgatgcaataccacaacaaggtgttgttcatacatttttcatgccattatatgcaattttattcaattaatttgcttcttttttttaaggcgtatttgctgaacatcccaagttgggtaagtttttattcatttactataatattttaaattatttttatgatttatatgtaacaaattcaatattcattttgtttcaaggattggcgacggggtgacgatgtgatctgtttggcagagcttaaggtaatctccaaagatgggtagtgagtttttaaaagaattatttgaaaaatacgagagaaaaagtccgagcgtttaggcaatttaaaccgaacataaaatttaatccgggaaaattttttcaatcaatttaattgcgcgttactacatatacatatgtatgtaccggaacccgtcagttggaccccggcacgtttgggccccagcggttttttggctataacttttttctttgtcatccaaatcaaacattgttggtatcattcgaaagctgtaagtgtcctctattagcctgcaaaattttgaaaaattatgtaaaggttcaaaaaaattatggccagaacaactcaaaaaaccagattttccaacttttatggccataaatttgtacaaaattgacgcaattttttgtaaatttgcagactaatagagcatctgaagggctttagagtgataccaatgatgtttgatttggatgacaaagaaaa

SEQ ID NO: 1046 - DNA, 3708 bp, Heterodera glycines
  misc_feature (3659)..(3659): n is a, c, g, or t
atgaggaccagaattttttggcgacactgatcccagctggattatttcccgcaatttccaaaaaaaagcgggattaatgtacaggggaatccagcaaaaccctcccgcgcgggaactcccgtgtccagcgccgatctctaattgccatataattttaacaaattgcttgtttgcccttgattttttctaataatgcgaattgatggctttttcattttattttcgggaaactttccaacttttggcttggatggaaaaaatgggtttttcttaattttcgctttaatcatacgcatttcttaacccattctctttaacccaacagtcgcctcacatggccgaatggctgaacgaatatttgcgaggtgctggcatggagtaagtaaattcatcaattaacaaattaatgactaggtcatttcgtaaaactgacatattaagtgttttttcaacaattacataatttttatcataaatttaattaaaattaacaaaacatacattcttgttatcattcgatagcaagtaaattttcctctactcgccaagcaaagcaaaatttcaatgaatttcatcaagtttaaaaatatttcttggaaacgaaatacgatagtatgataatttgaaatcttatccctgaatattgattatgaaaattttttttaataaccatttcacagtatatttttttaaagacatttaatttttcaaaattttattaaaattttgaacgagttccaaagtctgtgactgtttcagaatgaagttttctcaattaatgttctacatttctattacaatttaaaaaaatttcaaacaaaatttttcaaaaaaaaaactacaaattctttcgaaaattttgaaaaaatcgcttcaaattttttctttaaatttttctaatatacatacctaattcctaattctaaaagagaattggccccgagaccccaatcgagtgaaccagaaccattacactcttgcatatatctcaactaaccaatcatttgattgattgcattttcaaataaatgccattgactgaccctttctttctctatgctaatttggaggatgtacaccgaaacgatgagtcactcgttcgccggaatgcgcttccgagacgcggctgagtgagtacagcagtactgttgttgtgtggtgcgaatttatatagtaataatttttttttaatatttccctccaataatttgtaaggctagactttcaaaaaattgaaacactccctaaaatggaattcattaaatttttatgaaattaagatgttttttcttgaaatatttaaattttttgttgcttttcctcccccatatacatattatttaattaattaatttgttttgccgtttctgtgcattgtttgtctaaaaaagtcagtcagaattttgaactagatatgagtattatgcaatttattaattaataattttatatatgtaaaatttaatttataattttttgttaatctccttaaaaatatttcccaccaaatttagtccaaacatacaccagattggctgtcattgtgagttactcgccataaataaatatttttggcttggagcaaaaaataaaataaaatatttttttcagtataaagtataaaaaatcgatttttaataaaaaaaattaaaaaaaaacgaaaaacattttaagcaaattgatatttaaatgtatttatatttatgagtctaagctccaacgcataacatattatcttcaaatattcaataaaacttaatgaatgtcattcatttccagctatctttgcggggcaggcatggagtaagcgcttaaataatcttacactttcgataggttctttggccttacattgggattttttttaccaaattttttttcctaattttgtctagtttcaatgaacctaacatgcccaatttttttttttctaaaatcaaaggctattttcgggcatatccgtaacctgaaattttcgaccggcaggtggagaacctgaaaattctttttttttctctaatttttaatttctccccccccctggttacggagcctgttgtcggtagtatttctgtcacatccattgcgtcatttctccttttttgggatgtacaccgagacattgagccactcttttgtcggcatgcgtttcccagacgcggctcagtctgttttttttctttctctttttgttatctgagtgctgttggtgatcggatggaataatatgggtcagagaaagcctaacaaaagtgcctaacaaattggcaataatttgcttcagcttttaatcttatctctgctcgcaccagagacgtccccaggaattctgcttggacgggatactttttttgtttttgtttttttgcttttacctcactttttcgatgcgcttttttgggtttagtgtggataagtttggtctatgaatgagttgggtgaacccgtcaattatttttattttaagctttaagattttcaaatattaatttttatttttttagaattttgtttttcattatttgactttttttttaatatttttaaattttactatgtattcatttcattcgaccagggaatttacatcttttaagttttttacatcccttttcaggcacaaaaaaaatcataaattgtttttctcgatggcaattatatttctcagttgatgaatcttatattaatagataataatatatagttttcgaattattacttaaagtaaaaatttcagcctaaacggttcatgggaaaggtctaacttccgaaaaaatggggtgtgtaatatcataacagccaatcgaattgaatttctgactgactttttgctgttgttttgttgtatgtgtatttaaatcttcataaatcacgaaaaatccatttttaaattcaaaatccgttcaacaatttgcagacttttgttcactcgtctgggccttttgctgttggccattgagctgaaggatgatgaaaagaaggagtgcaacattgccattaatccgggcccaagcacggtgatccaatcccaaacccaaggctttttcatcgcccaatcggcggatgaagtgaaacggtgggcccacttttttgggtggagggagagccactcgagaattcaactcgagaaatttctcctctcgagaaatgggaacgagaatttcgggagttcttttttctaacattttagttaggggctttatttttaggattttaccttatgctaacatatttcttgcaaaacttccaagtcatcctaaaaaaaaatcttgtccgtatgcgtcagttctaattgctaaaaatatgtagaagcccctaattatagtaaatcgttgaaaactttttcattaccgtacacgcttcattttttattcctaatccactgaatttgctgctggcttactgtattttttccttactgtagtgccttctattggtgtaaaatttgtcacgctgatgtgtacgacgtttcgttgatcaaaaagtgcaaatgcaaaaatttgtcactgtttcgcaaaggcggcaaggcaatgatgaagcgtggtgcgtgccattcaatctaatgcaaaaatggggtcatttgatgccgtttcaactttaatgatgcttgacaatatggatacatataaggacaagatcatattacaggacttcccagngccctagtcctgtagtgttgcaaaatgcacaggacccgccggggtcagg

SEQ ID NO: 1047 - DNA, 5459 bp, Heterodera glycines
  misc_feature (11)..(11): n is a, c, g, or t
cggcgcatttntgggcagaaatcgaaattgggtcggtggcctatggaatttcggcaatttccttaaaatcaaagaaacaaaaagacaatgctttcaaataaaatgggaaagtggcacttggaatatttggcaaaggcgcggaggtcggacgtcttcgatcggaatttgacgccgaacgcggtggaaaagctgttggaacatctccagaagagtggtcagatggtaaaggccgggtacgtaatgttttctgaaaaaattcagttgtcgttgggttttctgtccatttttggtttgtcactttgtcgtcggaatgaacggggaggggtcgtcggaggaagggcgcaacgacggggcgaactccaaattggcgggacagtccggcgaaacgatggcctgggcgacgcgcagccaaaacgaccagcagaccatccacaacgggtcgggcaagggcgcacttgtggagagatccgtctcggttctactgtgtggggatgaatggacattgggttgggttgacacgattttggcccattttttgcagaattgtcgtttttatttccctcattttctccccacctgccgtttgtcgacatttgttgcttcccacgaatgccaattgtctgttgttgttgctgtccctccgtttgctgctgccgaccgaacagcaaatcctgcatatttttcagtgctgccaaactcatctcggcactgtccgcttttgcggccaattcgatgtgcgttaacagctgcgaccaaaagtcgggaaaagcttctggaattgttaaaaaaaataattagtgtaaattaagtctgtacccaattggagcagcattggccgttgtgcgttgaaaatcttcaccacgccacccaatgtttttacgctcgtttcggcccattgctttgattcgctaaatgactttgcacattaaaggagaagattagcccattcggttgatacgtgtctcgggagtgatgaatcattaagttcggtgcgccgagcgtggaagtgttggaacggtgggtagacgccgtttgggtgaggtggcgaacacggtccaacattgggaagagcacctaaaaggggtgagaggaatgcatttggcaataacttaaataatgattggttaattaattacgaatttatttttccgttttacaaacaatacatctcaaaaatcagaagaaagtatttgtttcttaatctttggcttacatctgtcagcatttctgcccatttttgtgtgccgagtgcctgtccgtgcgctgcgactgtttgcaaaagggtgtcgcacgcgcttttccgcaccggcggtcgcgcgtcgacgcacagtctgcccaaggcggcgtaaatgcaaagccacgccgtctccgcctcctctttgcccacgttttgctgcgccctgcgcacaaagtcggaaatgtcccacttaaaggaatcaaaattaaatttcaattaaatttaataaacgaaaaagcaccgaccaattggccaactgaagccaatgcgacgttaaggtgaatttgctgttggccataaagtgcgttcgtttcgacgagcatttggacacattcgaaagggacgacggcgagaaactctttgatcaccagagaaaggacacggaaagactgatcgatcagctggggatcagtgctaaaaggaaaatgatcagaaaagcaaatcaaacaatcacagacattgtgttcatccgcgaatcgggcatcaccacggaagagacaatttgcacgacggaaggccacaaagacggctcaatggggcgactgtcggactggagaatgcgcataagacaatctgtggggaagagcaattaaaaataatccaattagttaaatgaatttgatattgacccaattgcttagcgcggacatccaaaaattcgatttcgcaaattgccgccaaagggttcagaataagttgttccctcttctgtaaaaatataatcaaaacaattaagacatgctaattaggcaatttacgattgtctcttcgtttttcgctgtttttttgttcgtttccaactcgcgttgttccgcaattgtttgtttcatcgcacttcggaccaactgagtcaacgaaacggcgccccactcgcgcgttgcggcgctggaatgagcgcaaagctgaaattgaaaaaaaaattaatgacaattaaatttaattgtttaaagcctcgagcaaatgggcggtgacaggtcgccagaacacatgcaaacgaggaaggttgaccagtgcagtttggagcagtttggcgatggagaagaacgatgtttcacgagaactcgtctgggccacctaaaaattggccaaaattggacggatggcacaaaaagtggcaaaataaggagagacagaccgtcatcgactcgttggacaatttgcaaagagcggcgatgatgtgatggatggacacttcgtccagggtcgaggtcgactcgaacaggacattcagctggtgattctgacaaagagcaaaaattagtgtcaaaggctgcagaatactccgccgttttcccgaccaaatccggcaattccgagctggctgctgtcgtcaaaatcaccgtactcgcggccgaagctgacgtggtggacataacaccgccgccttccgaggctgattttgtctcgccaccggcacgaaaagtgccggtggaagtgggacggaggccgacgatccaaacaaagtgcttaaataaacggaacggaacatttagtccaatgataatccctgtgcgcgtttcacctggatggtagtcaacaccatttcccaacagtcgcccagcaaatggccgttttggtggacgcaaccgatcaaaagtcgcgcaacttgcaagtttttggcggtcatctgaaaattatgcaatgctaaaacttcaacagataaataaatgttatgttatacaaacgtgaaatgcaataaaaataggaaaataaattcaaaaaaggatttacgcaccattacggtggtgttgaagaattgggagggatggtgcggactcggacaaacagtgcccatcgcgaccacttgggttggttcaaccgacgaatctgcaaaatgtgacgggacaccgaatgaccgaccaaaatggcaaatttggattggatgggccaccttttaagctcaaatcgctgttggcgccgactgaaccattggccattgcgccgctttgcagcgcaagcgaagccgatgagtgggagtcgacgaaacgcgagaagtattggcatggcaaagcctgggaaattggaactcgttttggcattttgtaagggactaactgcgcgacaaaacgcccgtaacagcgagtgtttggcatcggcatttccaaatttgcatgccaaagtgaccaatgatgagagacaggtcaacaaatgttcggtgattgaatcgtcgacactataaattgaaaaaggaaattggcattggaatgtcactaaaaaggcacacaaaacctgaagtcgagtaaagtggaaatggccgaacagagaaaggaatgggccacttggaacagctctttggcaatgtctacaattcagcaattaaattatcaattagaaaagtgtgccttcccatttcccaccggagtatgcttgaggcagggatgccgaactgtccaagttggctttttggcacttctcctccgactttggcatctcctcctttgccgttgttgcgccgttctgtgccggcaacaattcgccgctctcaaccgctgaacagacggcgcccgtcgcatcgaccaaagtggcaaaaccaacggacagacaatacgcctcggggattctctccgcgctgtgtttgtcgagccaatccaagctgaagggagagagaggaggacaaaagataaatgccaaaaacataaataaaaatggcaaaaagacgcacagaatagaacgcttttggctcagttgggtttcgtcgagtggcaaaaacacgcctaaagcggaaaaattaaatgccaatgatgaatgaattaaacacgtgcctttgaagataaagccctgttggccaatcttctcgtcacggatactcggggaatcattagcagctaaatgagggccaaagattagcgtaatggaatgactattcgtccaaaacacacgaaaaccgcaaaaggttcaccttcctccaaacatttgcgcaggaatgaatacaaacgggaaaagagcagctcgacaaactttgcgccctcttccctcgcacaaagccatctgcaaattttaaaggcttttttggggtattttttaacaatttcttttacttcaaaagcgtcggttggccaatgatttttcgaaaaacttcgacagccaccgccgcctcccacgaattggtgggcatccagagaaggtccagcaaaatggtgaggatcagttcattttgggaggcctaaaataaaagaaaaaaaggaattgctttaaaaactaaattaaaaaaaggggaggggaaacggaaaaaataaataaaaaccgaccaaaattggatgataattggtgagcagagcgagcgaaattcgcattgaccgaattgtgatgggaaagtcgcgcgctttggtcacaatttggccatgctgctgttgtccgtgtgggtattgttgctgcgtgaggagggcggccgaaattgggagggatcgattttgagaggaggcgccgttggccgacgatgccggagggacggtgccattcggcgcaccgatcgacgatgaagaagcagacagggaaagttcgcgctctccgccaatcattttgatcacttggggacagatgagactcttgagcagttcggcgaattcggaatgcttttgatgagggagagaatgccatgtgaattctcaaatacattggcactcttcgccggcggcgcttacccggaagaaaatgctcgggtaaaatttgaccaccgactcgagcagttcaagcgacagaatcggcgttatcttttggattccgataagccatgtggggttctccctcctgatcagaatgcaaaggtcgcgcaacaacagaaacgcgtcggccgccgccgggcgcagcgtcggcggcgccaaactctgctggacgttcggcgccaaattggcacgctgctgtggcaacactttcatttggtcggcaccggcgcgcattccgtcttcctgaagggcgcgctcaaaaacggcgctgaacaaatggcggacggcggcggaagcggcgtttatcacggaggaatctttggagaaattaagacgaaaagccagcacaatgcactgaaatggagattattgtataaatggaagaggagggcgtttaatgtcaaagtttcaaatgataaaaatacaaattcaaattttggcactcactttggccatgcccagtcagtgaccaacagttcagtgcttaacaatgccgttatcggttgcagcactgaaaatggcttaacggagtgagcacgtcttccctcccccctcctccc

SEQ ID NO: 1048 - DNA, 4357 bp, Heterodera glycines
aagggtgcacaatttcggtgcacaaagtgcgcaaatttagcaagagatcatcgggggacgaggcggaggaactgatgttgcgcactttgaccagcccggactcggccgcctgaggggacaaaatgccattgaattacgcggtaagaaaatgaacgcattccaaagggtcatgggaagtgcccgtcaggcattactgccaaaaggccccaaactaaggaatccaaaagataatttctttgggagaggtgggaaggggagaagcgggttacgtaccccaccccccacaaatttttagagaaaaaatagtatttttgataaaattttcgatttcccttgttggtaccccctccaaggcctccctcatccagtctaaaactgttattaaattgcactcgaattttctaaaaattttcccgtcggcaccgacccactgtccccacttttaaaagaatgccgcaaaaagtggcatgaaaatcgtaaataagtcgtcgcccgagggcgatgtaccccaccccaaacagaaattccgcgaccgtcccaataattgggatagaattttggccaattattagaaataaaaaattctccacacctctttgatgtgattgtgcttcttcttcgcctccgtggaaagtgttcgcaagtcgcccatcaaataatccaccaactttttcggatcattttgctgaattccgccggttgaagcggacgaagaagccatttttgtatctgttctttcaccttttctcctttcgatttattcaaacaaaaaaataatttagcaaatgaaatcaatatgcaaaaagcaaaaaacaaagaaaaatgagaaaaagacaaagaaaggtgaacaattcattcatcattcgtcatcaaaggacgaaaagaaaaaacgaaacgaaaaacggaggaaaaggtgaaaattatgaaaaaagtggcaaaatgcgagatccaaagttggttggtcctaacagaaaacagtcgatggattaggcaaaagtgagaatttttgaccaatgatgacaagtttggtgtgtgtgctatagaatattttcagtaaatggagaaaaaacaatgatttaacggaaagagaaggggagaaggacaaagccaaaaaagagagaattctgaaaacaaattcacaaatggccgattttatttcaattttcttttttttcgttttggctatgtcttgaatgaacatcaaaattttgattcaaaaaataggaattgctgaaaatgccggaaataattgagtaaacaaatgggcgatgattgattggcactctctcagtgatggccgccagtggcgggaacgggtggcactgccgaaggttttgaggctatcaaacccaaaatattttcggggataagcgtccatagataatcccaaagtgcgaaaattgatgccaacacatttttggccatctgaaattggcaaaataaagttaaaaacggggaagaagacgcactgaatggatgaaaaggacggtttcatcagggtattggtggaagagaatggcaaaaatggcaatactgaaaagaaaactgtaagcaaaacagaaataacggaattatgtgtaattgtaactacctgcaagaaaacatcgacgcaaaaagtgtccaaaccggaaattcctttttgggatagacggacacttcgtgatacgcttaatccaaatggtccaattaggtgatggcttttgcttttgacccacatggaagcaattctttgtctgccgcttcagtgcaagcggggtaagggaagaacaaatggcccttctccgtcggatttgggagcatccgaaaagctgaaagtgaaaaaaattctaaaccaatgttttcagttttttttttgttggagtttacgagttcaaaattgttttctcacttccttcccacgtgtattgcaacagctgaagggcgccctccacccttttccagtgctgcaagtgccaaaaggcgtaggccaccgcttcggagtcgccccgcttcaaaatgtgttcgggcggcaaagtgacggctttcaattccaacagatacaaaggaacgtgtgggttctcaaattacttatttcgattaattgcaccatttggtttgcttcttacaaattcgaccgctctatgaattgcttcgactgcgcttaattcggccgaggaaaagccgcgctttcgcatcgtttccggctcaaatttgtcggccaccccgcgagctttgagcaaagcggaagtgaaacaaacggtagcagactttgtcataatgcaatcttaaaagtcaattttatgctaaaaatgtgcattatttgttgcgctaccatcgtacgagtcgtatttggccagcactgccattgtgtcagcataggcgcgttgttcgagcagtgcttcaatcagattctcgtggatgttcatcacattctatcaaatttattaaatgctgacatacgaaaaaatggtaattaccaaagtggggaactctttgatcagctgaacaaacaaaaaaagattaagcaaaatgaatgtgctgtcgtcgacagattaatcactcacatcccgcatcattttgatcgcctcccttacacgtccctgccgtcgtgcgcacatggcgagccggcggcgaatgaacaccaacatgttgatgtccctactctctgaaagaaaatgatttgaaaattacaataagccaatgtgggcgtttaatcggatccaaacgcactttgctgtgactcggggtccgggtacatggcggcctgactccgtttgtacattccctcgacgattctcaatgctttcctgggaaaatttagaagtgatgaggttttaaatgtcatattcattcacaattccacctcagtgtctcctcgacttctgcaactgattggcaaaattcttctgctaatctgaaattttgaaaatattaaagtggaaaaaattcgagctgacaaaatcagtgccggcgcacactccgaattcactttcaacgccctttttgcttcggaaattcgcacttggctgtccctctcgcgccaaaccattgacataacttaaaaaagaattatgttttgaaacattatttgaaatacgcactttccaagtcctcttttcctgcgtcggcttcgcaacagaaaaaggtttggtggtcctgcgcggagagattcaaatcgtagaaagtgagcggttcttggcccgtctcgcgtgtgaaccgttggtattcggcaccgcgaaaaagtgccatcggattgcgccacactttgcagtcgttgccttcatgcccattctcgtcgtactcagtgagctctgaaaaatttcgttctttaaaaacgcaatttacaaatgaaaaccgacctggtaatggttttgtgccgtcgtaattttcgtcgatgtcgcttccgtcttcactttccaaagcgttttcgatggcattgcttaaaagaaagaaaagttttgaaaaccatgccaaatgactaacttcagcaaaaatatcatcattcaacccgttttattggaggtttaatgtgaaatatatttacaataaattatggaataaatgcattacgcactcattagaaaaagtttattggtcttttctttgttgccatcggcgaccaaagcggtgcaatggcaattaataattatggcattgcacctgttcaaccgaccgcctaatttacgtaatgggaagaaagggaaagcgaatggggcgagagactacaaatttatgagtgaataatttcttttttcagtgaaaaggcattaaaagtgccctcattaattgaaaagttttagttgcttttatttgactcttttttttgttaaagaattgaatgataaaataataaattattggttagaaaaataagaaaattaaaagaaagaaaatatcctttactttttgaagtaccaccattcaaaaatgagaatgatgccggatacgagactggatgtgccggtcaatgcaacgtaaaattttggcgtgagattattgaagtacatgctcattgaaagcacttaaaaagtaatattacttaaaaaatagaatatttaaaaattgtagaaatattaaactccttacgcgactcaaatttctcataggctttgagaggaacacggaaataataaatgaaaagcacaataactcccaggtaaagcagccacaagtagcccttgaagaatgtcggaagacgaagcatctttttgcagcgttgggaaagcgtcttaaggggaaaagtgccgaaaatttgaaagagtaaaattaaaataattgttaacctgtgccattaacaaaaccgaaacgaacctaaacaaaattaaataaatatgaatattaacagtagctatagttaagaaagcataaattaaattga

SEQ ID NO: 1049 - DNA, 2582 bp, Heterodera glycines
aagagtaaaattaaaataattgttaacctgtgccatcccccccaccgaaacgaacctaaacaaaattaaataaatatgaatattaaacagtagctatagttaagaaagcataaattaaattgataagcaattagcaccatcgctgccttttttgcatttgtttttgacttggatttcatttatttttttaaacatcatgccaaaaatggcggaaaattttaattaaaatttatttattttcaaaaccataatttaaagagaacaagagaactcttattttcttcctcttcttctccctaatgattcaggaaaaattacttagaaaggaattctaaaatttaagcccttacaaaaattgcgaataaaattctgcatcgacgcatcactcactgtttgtcaaaacatggacgacgccaacatcgctgctattttggcatttgttagtaaactgcgattctctttttgcaatgttttcaattttagtataatttattggccgccaaaattggcctggaagactgccaatcgctgaaggaagtgcgcaatttgatgccaattttagccaattacatgtaacatttatttttcgtttcctttttccatctatctttttactttgaatttctcaccagaaagtccggcacacttactttcattgacgactctaactttggttttcgaaatgccattgatatcattgcgcatggtttggatgaggagttccattcgcatttgcgtcctgaggctgcggagagcggggatttgtccgaggcgaccaaagttgcacccattttttgtcttttcacttttctgacactaagattcatttggctatgctttacactttccgtttacttcaaacggaggcattttcgactatttgtgaacggttggaggacaaacatcaacggcactttgccactgtcgtaagcttcgtcctacaaatactgattttttgtccttgtatttatttagattgaatgtcttgacgaccgtcgctgttggacttccgctccatggcctaaactgttgcacaccgacagcaatgaggaggacaaagagaacgtcgagtcggtccaacggcgtcggaagagttcgctcaacttaacgcaaacgccgaagctcgactctgccagaaagtcgtttttccctagcgggaacagtccaattctcaaggtccgtggggttttgcgaatacatttacgggtgatggatgagcacagctgaactggttttctggccattctcgaaaaaatatttcattcttgagcaaccccaatttcaatgtaataccgttttatatacaggtcatttcgtcaccgcgaggcgaggaagtggttcgaatccatgcgcttcagcgggaagtgaaggctctgcgccaaatccgtgacgttttcggtcgcgagaaggacaaggcggaagagttgtgtcagcagaaggaacgcgaaaacaacaatctgttgaagaagatcgaaaggtaaacacatggaatgcttcgtactgttatggatgctttttactacggtttgggttaaaattaaaaatcccgagctctcttcaggatgcaggctcaaatcgcatgcattacaccgtgcgccgaacgcactccggtgctggaggatcaactgctgatgatggagacacaggcagcgacaaacgccaggcagctgcaggacgcggagaaaagagcacagaatgcggagaagttcgcggcggacttgaagtttgagttgaagaagatggacatcaaacacgacaatttggagaagattgtggaggagcaaagcgcaaagatacgaatgtcacgggacgattcggacgcggtggaacaactccgtaaggtaaagaaaacactcggaatatgtgatgaaggcatcccatctactcccttattttgtcgaacccaagagcgaatcaattgagagagttattgacgaaaataaatgcaaagaaaaattattatttagggggggggtgatatttgaacgcataacccctgcacaaatatgttaagataaacgggtttctgaaaagttttcaggagttgatagaggcgcaacaccaaaattctgtgagcgcatcgaccatcagggagctgcaaaacaaattggaataccaagagagggaattcgcaagtcgattgaatgataaggcatttctttgaattgtgatagatttccaatcggaatatattttcttaaggaccaagaaaaggacacttattggaagatgatagaccaatgcaaagcacgatcagaagagaacactcagaaggcctatgatgagctgaaaaaaacgcaggaggagaagcgcaatttggagcgcgagttggctgagggtaaacggacgatgaacgaactccttgaacttgccgagcaacagaaggaagtcatcacggcatgcgacagtgacaggacggagctggagaaggcgcagaaggagttggacacggtgcagaaacagtcggcggagagggagcgcttttggaagagcgaaatggagcgaatgcaaagggaaattgtggctcaggaaaagacgaaaagtgcgatggaacgccaacggagcgaggcagttcagcagat

SEQ ID NO: 1050 - DNA, 1596 bp, Heterodera glycines
  misc_feature (43)..(43): n is a, c, g, or t
ctcgctgaaaattgccatgaatgaacttagtgccagatcaacncaagcgaatgtccagcagcagaatgacatggaacgatcatttcgctcggggatgaacagaacgcagtcaatgagcgtcacattcgtttcgcgtcttggttctgcgatgtctcaccaggaaacgttgtccaatttggactctgccggaatgaacgacgatgaaaggtgagcgaaaaagttgaaactgataaaacaaaagatatttctgatatttatgttgccaggctgaaagaattgcgcgagcggaaccggcgttatcctccgcacatgcgctcgtattatttgccggagtctgctcatctgaagaacagcgagacggatttgaatgttatgccgtgagagggaataattggcaaaatctttatcaatggaatgacccaattcgcttttttgaactcattattttttctgtgatctgaatattgatttgattgctttaattagaattatcatctcagaataaatttgacgatttgaaacaatggtaaaattagccagaaaagtcattttacggtttcaaatcttaatctttttcgaaaaatggggggggggacaaggtaaaaaaaattcagtggaatgaaaaaggagaagtaccgtatgtccaacgggtttgtgatgacacgctgataggggacgaatgcttaaacaccaaaaaacttcatgccatccaaatgtctacgtcaaacagagagagggagggagaggaccaaatttcagttaataaattgacacacgcttaatgaccatcaattcaatttatttcggaacacagatggaagtccgtcaacgtggacatctcctgcgacgccttcgaccccggcagcgaggacaccaagggcgaccgtggagtggaccaacacgccggacccagccgccaccgcgttcaagctcgagtggttccagggagacgggatggtgcgccgaagaacttgccgatcgagtacaacgtctgatggaaggatgcttcgtcgcctcaacatggacatgataggatcccatcccaccgtcctaaaagtgtcattttgtcccccatcatgtaaattgttgtgtctgtatgtaaatttctgtgatcatcgcttcaaatgaatgtatatttaattgttgcctatgtaattgtattgttgttgtgcttaataaatgctcatctgtgcttcaattccaatgcttttgtaggaagggcgggggaagggtggtaaaatttggcgtctgtttggtaggaggatagctcgcgtagaactcggtctgctcactccttgtaaattcaggtcaaaatgcgttttagacataaaagtggtccctcccataagtctatcagtcacacatttcgtttggaattcgaatgttagccgcccaaatttggagataaactgaaattcagttgcctgcccttccttctgtttcaattcctgagataacactggtacaaaaaatcacgaataacaagccggacaatcaaaatccttcctttctttgatcacttggcaatgttttagcatttgtctcgacgcttgtgattgatggtgtggcgttgaaacgagaaattttttgactttt

SEQ ID NO: 1051 - DNA, 4624 bp, Heterodera glycines
  misc_feature (57)..(58): n is a, c, g, or t
aatagaagagcagatctcgagtaaaaactagacagctaaaaaataactgtgatcatnntagggggtcaaactatgggcctatgcaaaattcaaaaaaagttaccaatggacacacaacataaggaggacttgaacctggggccccctttttggtgactaactcacagaccactaagacgaaaaatccaacaattgtactgggagcccgaaattgactcgccgtgtttattggtcctaattagttctatgagcggatcctaaaaataaacacaaaccaagtcaaaccatttggaatctgttatagaatgctgctgcagttttctatttgcctcctccaactttttgcgctcttcaaatgccaagaatttgtgtcaaaatttagaataaatttctaattaaataaaaattgtggtcttttttagaataacattcgctgcatttttctgtttttgcctgctgtcccattgctttttaattgcaaatggcgccctccgtttattccaatttcgcttcggatgcgtcggttcaattggcactgaatgttccccttccaaggaatgtttgttgtacccaaattgacaatgtccatacccaaattgacaatgtccacgaggtgggcacatcaattcaccaaattgtttgcagtttctcattttcagatgctttaccttttgcttcgccaccgccgtttccgtgagaagtttctcaacgacgacgataaccgcgagctcaaaaagcggcttctccgtgcgctgatgcgcgaagagataatcccatcggaagaaaactgagaaaatcggcaaaatttttggaaatatgccatttgaaaaactgctttttgattgttcattgctttatcatttcattttattagcgaaaaacatcgggtcaaataaaattgttgattatgctcaattatcggtaattacatttgggtaatggctctgataaagaaaaaaagcaaaaattcgcatgaaattttgtgatcaaatttggcggatcgcttcaatatttctcgagctgagttcccggttaaagctgacagactgaatgccttggcatttcatgcggccgttgtcattctcgcgacagtctcccgcgcgtcctctgccggtgattcggccgcgtcttccgtcacccctccggcattctctgcggaaaattgcgccgcttcttccgccgtcgacgccccgggggccaattgggcgccccactggaggagaagttgctgcagaaactgaccaatttcatagaaggaaaaagaaatcaaaatattttttggattttaatttccaaaaaccaaatcaaaagtggtgcatatcattaaatccataattagtgtgtgttttgctgctaaaattagtaccaattggggtccgaacattgcgatttgggcggccaacgccgacggatcggtggcgagaaaggtgggggcgcacgacgcgtccggggattcgggggaaaggtgcggggacgggtcgctgggcgaatcgcgcaaatggtgggcagaggacgaaatggagcggaaggcgggcagcaacacctcctccatgtcgaaaatgcgacggccacgcctcgaagggttctgaggggccgaatgagtccctaaagaagggggcaatgatcaattaacggctaatgagagtgacaatgatatcgagtaattaagatggataatcaatgattgagtttgatggctgagatgaaaggaacggccgagaaattaatcgggacaagtgacccacccatgtgcacttttaagttgcctcgggttgtgaacgcgcgcccgcactcctcgcatttgaagggacgatcacctgacaaattggcaaggagtgatcagcatggacacagagaagaagcaattagggatcaaatggatactaattgaaggaatcactgactctgatcattttgattaatgctctctgttctgatcgtttctcttattctaattgtttcagtcattccattctgatcagtcttccccctctctcctcactgatctggtcagttttgatcatcctcccccctcctttccccgcccgtttctcaccagtatgcgtgcgcgagtgaatgaccaacgcggaactgctgctgaacggcttcatgcaccagcgacactgatgcttggccagcggaacacggccaccattaacagagaaagcggcggaggaggacgaggcgccgaagggatcgttggggaaggcgggcggcggcgaatcggcggcagagaaaatgcgttggatctgccggaaggaatggccaatcaagcggaaaacgggaggacattcatttggcattgttttgacggaattttacttgaaaacccccggaaagaccaagcttttcagattggtctgatccgacccttccaaaatgatttaaaatgcccaaacggatgggtccgatcagtaatttgatcaatcagcactgatcaatgatgggttgatggtttttcaaaattgtctctttccccaccttttccaatgggttctccccatcgccgttttcttctgcgccgtgcgccgtcgttgggtcggcaacgatcaaatcggaagtgcgtgacgccacaattgccgtgccgttttttgtgccccgcggcggcgatttggaaacgcaatttctctgctgcatttcactgctgctactgctgtcaggggataatgttttttgtgctttttcccttctcccgcttcacttacttttcctcaacggcactctctccgccgtccgttccctccgcgtgcctttgcatctccgtctcctccttcaccaacaacgggggctcatttggctctgtgtcgtttaagctttcgcttaattacagtaattagtggctttgattgatagcaaatttatgccaaatgatttgtactttttggtcgcgagctgttgtatgaaaaatgccggcaacggtgccaatcccaccaacggtgccggcgctgtttcctctctccggtgtcgctcgtcgcctcctccgtcatccgccttaggcataaacatatttgccaatgccgcgccgtggtcaactttgtccgtctccgtctccccccgcctctgtccttccccattcccttctgacactgctccaaaatgttgttcccgcggagaagtgttctgctgcagttgtgttcgctgttgttgggcaagcagaaacaaaagggggtgaggggggacaatcatcggagggaacggcgccggaggcattccgtggggagggagaggggcgaacatcgccccggggaacggcgcctggggcgacggatgaaaggcgttcaaagggcggccgaaaggcggcggaggcaccgcggggagcacaccgtttggtggcatacagaaggggagcctggaaaaggaatataagctaaagcaaagacagaaaggacacccaagagaaaagttagcggaatttctattttggatgccgtcactgccaacctttgcatgccgtgaatgtccgccatgtgctgctgcaattggcccgggtctccacttttgtgaccacagcccattgggcatggaatgtcggcagtgccaggcgctgagggcgaaccccccgggcgatgagcgtacaatgcgccgccgtttacgacgttgggcacccctccgccggcattttccgccttcggcatgccgttgttcagcaaatggtgcatctgatgacgcagcggcgctttggaacggtgcacgcccatgtgcgttttcaaattgccctgcaaaattgcaaattgacggcatttatttggcatttaaattgatgtgccatcatttgttttggcacctttgtggtgaatgccctctgacaaattcggcatttgaacggtctttcgcctgaagcagaaactcattggctgacagattctctcgtgtttgatttttgacctgtatgagtccggtaatgcatttgcaatgcgcttttgcagctcaataccctccgacagataatctaaaacggaatttatttgcccttttctaatcgaccaaaatgccacattccgataaatcctctatcccttccgtgtcatttcagtcgaccttccccccttcaaaatgccgttcctaccaaatttcctctccccctctaacaaaagtgtcctctaatcaatcccgcaatgatcaaatgccattccgatcactctctccccccccccttcttacgcattgatttgggtccgtcgttggcaatgcgttttcgccggccaactcgcgaattttctcttgctgaattgaaattgaaattcatttgcataatttattttcgttcattcacctcgtccgtgttgcttatttccatcatcgcctcccaatcgtcctcttcgttctgttgcgtcgtctgtggtgaagcgcaatttggtttcatgtcgaagtttggcattggacggacacaaagcaaatcggaggaggaggaagaggaggagcagggagggccaagggagaagggcacgaacgggggcgagaagagaggcggtgccaaagctaaaggaaaagccaaacaataaggggaaaggagggaggggggaggggtgatcagagagaaaagagatcagagggaaaaggatcagaggaaagtgatcaggaaaagtgatgtgagggaaaagtgattagcagagttagaaagaaa

SEQ ID NO: 1052 - DNA, 4848 bp, Heterodera glycines
ttacaagagattaaatgaatccaataagaaaatactagcacatttctatcttctattcgtttttaaaatttttagaaatcttttaaattttaatgttttaatgatttataaataatataagttaagaagacaaccagtaaaaatactaattatatgagcacacaaaaatggcaaacgcacgaactatattacttggcaagggaatgaataaacataaattcatagataacaacaaaaaatatatatttattttaaattaaaataaatacataaaatctacatgcattatcttaataaaaaaaatttatattaaataaacaaaaatttaacctaatataaaatgctacctgctctgagaaaaaagaaaaaataaactcttatttgttagttcacggaatgctgttttaaattgttgtaatactcaaaaatataaattaaaaattatttatttataatatcaagttttggcataaattcttacaaaaagtgccagttaatcggctgagcgccattaaattacttaattatgctgttttcatctatttaaactagaaatcgaaggaaaattatatatttagctgagaattttaccctaaacaaattaatacaacatgaatctattcaacatttagctgcatccgtaagaacgagcgagtcgctctcatcatcacctgagcgagaagaacaatgagtaatatttattaaatattaattacctaatgatttaatctataaatacaaattttataggaattaattaaataaaattaatttttgctattttaattttctttgaatgcgcatgacaatgaatatggataaaaaaatatcaaaaacgaatattaaacatgaaattagaaaaaagagtaatttatttagtaatagcatagtagttagtcctacagattttggcccctaaagttcggaccctcttgactgcaactcaatttttatcattttttaattcaatgcgtatggaattaatctccataagcccttaccgtttaaaatttttttccccaaggaaacagataattgataataatttaacagaaaaaaaggataaaatatacaaaaagatcttaataattcaagtaaaaaagcaataagacaatagcaccaatggccactgtagtggttccccataaatttaaagaataactagcacagtgagaaagtaaattttaattgatttttatggtaaaaaatcattaaaaatgtaaaacaaaaaataacataaaatcaaattaaaaaaagagaaaaaacatcctataatagactttttttttgattggttcacgaaaactatatttttttggtaaaagacgttgaccgcccctcgtattgccgactctgcaagcaatttcatataaaagaagacgacgacgacgggatgaacccctgtacgaaatgtttcatccaaccattaaaaatgccaaaaatcaagccgtaccgcattattgcatatgattttgaggcaacacaagacaaaaaaatggagaacaaatttgagcacgtggtcaactttgctgcggcaaccgttatttgtaccgattgcatcaacaacggctactggaacaactctcttcttgggaaaaagtgcaacatttgtggaccccaccggaccatcaccttttcgccattcgactacacgaaaacaacagttgatcaaaaaatcatcacccaaaatcctttgcacaaatttgtccaatggttgtttttcgaacgtaacaaaaagtatccgacggtagcatttgcacactttggtggtcgatacgatatgacaatgatcatcaaggaggtcatagagcaaagtgaaattaattttgtaagatttattttatatatattaataaaggtattcacaatccggagatcatcaaacaaggaaaccgactttacgaactgaagataaatgcaaatgatcatcgcccactcacaattcttcacgatagctacaaccttatgcctatcaaattatctggcctcatcaaatcctttggactccaaattgaggacaaacaattttttccacatatgttcaacaaggccacaaactatgacaacgtcctcactcatctgccctctcgcgtagactactgcccaaaccaaatgaaaaaggcagaccttcaaaaatttaacgattggtacagcaacaacttgaaaattttgcaattacgatttataatttaaaaaatcctaaacagctaaatattaaaagaaaatttaaaataaaataattatttcgcataaatgaacaataaagaccagatcgtgaaaaacaagtgattttaggaaaaaaatcaaatttaatatattataaatcaaactttaaataaggaatatttgtaaatttatacttaacaaacttcaatatttattaattcttcttaatattatgattcattttagcagaacggaattcgtatgctttggcttattaaattgtaactaaataaataataattaatatataaaattttgaaataaaaattggcttattataccttgaaggcggtgccagtaggcactaccggtaaaatttttgaaaatttgtagcattttgttaacagatttagaataaaaacacatcaataaaaaagtttagcaaaaattaataaattatttcctacagatgccaataattttcaactttttcataaaatgaacctttttaagttatttgtatttactttatttttataattataattatggctctccgaaatttgtcaaaaatgcgttgaaaattaaattttataaaaacaaattcctttggttttgagttcactgatcaaatgcggtatccatattctaaccccggacaagaactcgaacagtcaaaagtactatttatcaaaaataaaaattttataatttagcatttttagttcaaatgcattgaaggattaatggctttcagttttgttaagagtatttaaattgattttgaaccaaaaatgctatttcggaaaatttttactttaaatatcgttaatttataaaggattaggtaaatcattatttatttaattgcaattgttttataaaacttttaaatttaattagaaaatgattttttttacaatattttatcgtattcatttttactgctttatttttttattaatgtttcttttattaaaatttaattataataggtttattgaattgtcggatctccataattagcattatcccataccatcaatataatatatttttcatcgattttgcatgtttaaaatagatgaaacatcataattaatatgttattttacagcttaatgaatgcagtctcgaagaatttaattttctattctgctagcaaataataggtaccgtatttcctcgattataagccccggggcttctattgttcaaccccctccaaagggggcttatattcgagggggggcttccaatcgagggggggcttttattgttcaacccctttccctatataaattcttaaaattttttgctttctgcataatggtacaatttaaatcttaatctgaaatttttgaattgaaaagatttttcattttttggcccttggaaatttaggcgaatgtttgaaaattcataattcacttctaaatgaatcaattaaagtgcaaaaaagcattaaaaatagagaaaaatctggagcattttatacctttttagaattttctatcttcaaaatgaagaagttattacataaattttggaaaaattcgttttttgagaaaaaaaattaatagcgctgttctgaaaaggttttttgaaaaacatgaaattcttcctctataagcttctgtttattctatatttttataagacttttgaaaaaaagtacaaaaataaactgattttggaattcgggatcatagatggaagcaactgctttttttgagccatgggttaagatccacttgcctgtaaaaatgttttttagggtttttgggaccactaatcaagaacttggcatccattttgcccaattccaaagcattgatccgaactcgaaaccccaaaaataatttttaaaaaatgttgcaggcatgtggattttaacccatggcccaaaaacccatttttaacaaaacaaaaatatattgggtataatatttctatatttgcttgaaaattttttagtgattttcatcaaaatcttttccagtgcaatttattaacagaaattttttctaagctattgcttcgctattagacaatttccaaaaaagttatacacgaaaattgcgaaaagtcgaaatttttgaagttttttcgtaataaaatttttccaggcttgaaaatcttttcgcttttggtaaggctaatagagcatgttaagagctttcgagtgataccaacaatgttgtatttggatgtcaaagaaaaaagctatcgtggaaaaagagctggcgccgaaacgcgagcgccgaaacgcgagcgccgaaacgcgtgggtccgtttgtacatttagtctttctaaaatattttatgaattttaaaaaaatactattttttcagaaaattttttatgttttaaaagtttttaaaataacaaataaatattataaaattatccataaaaagcgacgaagaaattgatgcagaagtttcctaatatttttttttgttaatgttttattaaaacaaattgttcaatagtttttacacgtttctgacttcaaaagttttgaaaaaaaattttttttgagttgggcttatattcgaagggggcttctactcgaggggggcgggcttctatttttcaacccccctacaaggggggcttatattcgagggggggcttccattcgaggggggcgtataatcgaggaaatacggtaaata

SEQ ID NO: 1053 - DNA, 1621 bp, Heterodera glycines
ccgtttgtacatttagtctttctaaaatattttatgaattttaaaaaaatactattttttcagaaaatttttgtgttttaaaagtatttaaaataacaaataaatattataaaattatccataaaaagcgacgaagaaattgatgcagaagtttcctaatattttttttgttaatgttttattaaaataaattgttcaatagtttttgcacgtttctgacttcaaaagttttgaaaaaaaaatttttttgaggggggcttatattcgaagggggcttctactcgagggggggcttctattgttcaacccccctacaaggggggcttatattcgaggggaggggcttccattcgaggggggggcgtataatcgaggaaatacggtatatcctaagattatgtttatttcttgcatatttgattaattaattttttaaatttttttcctgaagagcgaacggcgttgacagcatttcttttcaattatacaaatgattgcatgtatgtgctttaaattgaaaatcagtgttgccaacgacgttgtcccacttggtaatggtagtgatgaacactacaactcaaagcctcattttgaaaatttagtctcattgacctatcaaaaaaccacataatgaggctaaagcctccgatctgcgagccctgtttataccactgaaccacgggtgaaaacagacgaaatttatacattgactaataatgacaagcaatgtgtattttaaaaagaaaaaaaatgatgcatcaagttgttatggtatagatttcttttccttatctcttattttaaaataaataatgatttaattaaattaaaaaataattgcaatattaaaatagataaaatagttaaattgaaaaaggatgaattcagaatgaaaattttaaaaataataatatcatttttctaaattaaatttaactagtttaaaacaattggaaattcaaatataaattttaaaatttaatagtaatatacaattgcaaaaaggacttatttaaaaaaatctccactattataaaggcaattatttatatgttaagtaaattctttattcaacaggagataaaaaatattactacaagaaaaagtttaatatttatttaataatcaaataaaaataaaaaggcttaattcatcaaaaataaaattcataactgaaaatactatataaaagtaaactgagcaacgcaaacacaaagactgcgaagttgtacttctcagtggctgtgcttcgttttttcgatcgagaagcaagacgtttacattatgaacccttcaacccgttcagttgtgtaatgtgtaacagaagcgagtttaagattattctacttctgcaacgagaattgaattaaatatgtatttgaatgaatatgaacaaaacataatttatttaaataaagtaaaactacaaaaataatttctaagtaaatagcatttatggaaaaaaatgcaaaaacttaagattgattagaatacagaaaataaaaatgaattaaaattttttaccggattttttttttacttgggtgaattataaagcaaaatcagaaaaatacattcaatatttatatgcctaaaaaggtattataaataaatcaaagta

SEQ ID NO: 1054 - DNA, 1995 bp, Heterodera glycines
  misc_feature (19)..(19): n is a, c, g, or t
aagttacttcagtcttttntaaaataataattgcactcggcaggtaatatgtataaggaattaaaaaattgaaaatccggaagcgaacaagcggagtattttttatttatgcaatttatgatatttaaaatttttcattatttaaaaaaaagtgcaggtcaatgcggcggacctctatcaaaaatttaaaaaaatattaataaaattaaattaagcacaaaaacgaaaaccgctctataaagctgtaaaaaatgatgatatcatttttaaaataaatcttagcattaatttctgcaagtttataaatttttaacgataagtcttaataataatatgatttaaaaacaatatttttatttccacttttaaaacgaattttctattgtaaaaaataaagaaaagccaatgtatatgaaagaacgatggtcttcgtataaaaagttttgaacgaaaatgaaaaaattagaataaaaaaattatcaagaaagtttaacgaataacaatattaatataaagcgaagaaaaaattttaattgatgttcaaagcagaagtaatcaaatagaaacgatggaaattttcaaaataaatgtgcaaactttggcacatactaattacatttaaagaaaattaattcttttttataattaaattttcatacaaatgaattaatgttttattttacaaaattaatccacaaaaggcctaaattgacttatataaaaattaatggaaaagaaatattatgaagtaatataataacaaattttattgaatacatatttacattgatatcccaaaaaacaaactcaaataataattttaaaaaatcaaataaatttctattgcaagccttttcgaatttattatctttgctattaagatatgacttcatatgtttggaattttataaaaaataaaccaaatgaagcggactctaatttttgtggaaaagtttgtagcacaaaaaaggatcaacgaaagcaaggggccagccatcacatggtccataagtaaaaaaaaaccaaaaaagggtgagaacaagaaaaggccgtaagttataacataactaacgaaaacatgtaatcagaatttttgctttaaaaaacaaacttaatttttagaattacagagaaaaatagacaaaacacaattggattatacttattgaaagctgcctataaaattcatttattataatcattaactcaccaagattttttcgacttttagaccatgaaaaataataaaataatgataaaaaataaatctggatgaacaaaacagaacattgcttataaatagagttgctttatttaaaaaatttaaaaacaaaaatttttatccaaaaaaacctttaatcaattttaagatataaatttagattcactacaatctttgtagtttctccggagctgctacatttgcgcccctacatttgcgccccgcacatttgcgcccctacatttgcgcccctacatttgcgcccctacatttgcgcccctacatttgcgcccctacatttgcgcccctacatttgcgcccctacatttgcgcccctacatttgcgcccctacatttgcgccccgcacatttgcgccccaattgtgaataaaaaatatattcataaaattgcctttcccaagggctaacgggagtagttttttttttaattttgcttcaattatgtcatgttcaaccacaacaaggcaagttttgtagtttaagcaaacaaaaaatcgaaatcaattttcagaccgattagaacccgataagaggacaacgaaaagcaaaacgatgactgtttttgaaggctatgaaatgcgtactgatagaataatagcagcaggccaaacccaggctatttttcagtatttgtatatattaaatattttatcttaaataggtatggagatgtgtcaagaaatcatgcccaggcagggcccattcacctatcgacagcacaaacttatttggaagaacaaatcataaccatt

SEQ ID NO: 1055 - DNA, 1426 bp, Heterodera glycines
aaaaaattttttgaaaccggccgtgctattggatggttgcccattttgacaagcaaaatccagaagatccgcaatgaacatcattggttacgacatctgcacgcaatttcatttcgtctgaccaccaaaggaattgataattggattgaataaacaaacaatcatattaatctcgcgttagcccttgggaaaggcaattttataaatatttttttttgttcataattggggcgcaaatgtgcggggcgcaaatgtaggggcgcaaatgtgtggggcgcaaatgtaggggcgcaaatgtaggggcgcaaatgtgcggggcgcaaatgtaggggcgcaaatgtgtggggcgcaaatgtaggggcgcaaatgtaggggcgcaaatgtgcggggcgcaaatgtaaaggcgcaaatgtgtggggcgcaaatgtaggggcgcaaatgttcagtcaccgtttctccagttatatatgtattaagtctgaatctttgtttatattaaagttttatgttttaggcttttaaataacataatgggattctatttgaaattgatattataatgttatttttcaaggtttatttaaatatcagtaatatcgggaaaactgttatcattttaataaaaaaaaattagattttaaattctgtttagcatatatttatatctttgtgaaatttttttttaaatttaaccatcacaaaaaattgagaaggcataaaagaaaataattaaattaattcaataaaatttgtttaataagacataatctcatttatttgtaataaatctcactttactcgatcgaataatttattttttttaaattacatttggtaattttgttttgaaaatttatgaacattcaattttgttgcttaaaaattttaaatttgttaatttttttgcttttgaagactttctttatgaatatcctttgcctatttaaatcttgttttttttaaatttatttatttatttttcttttatttcttttattgacattttttgtattattttaaaaaaattcccttcatttcaaaccagaatattttttggttctcaaataaataataataaaaatgttttattttttaaattttgcatatgttatatttaaagtcaaatatttttttatacaattattgtattaaaattttatctatcccagatgatgaccgcatataaaatattataaatacttagattcaatgaaaagtgtatttatttgaaattaaaattctgtttattttaaatactgactgtttgataaattgcttatacggattttaattcttaaaaaaattctcacaagatggttgcccatttttctaacatctcagtacgtgtcgcataattcagcgccattatttaagccaaggcacaggagaccagctttgttcactttcttttaaatgaacaatcgat

SEQ ID NO: 1056 - DNA, 5119 bp, Heterodera glycines
  misc_feature (146)..(146): n is a, c, g, or t
cagccccataaatttattaagttaaagtataaaagaataatactcaaatgaatgaatgtagtgatgtgtaactatgaaatcactataatattttatagagaaaacgctaaagttatatctcggataaagaaaaactcatttttcanaatgaaagaataaattaatagcttcaatgccaaacgaaaatagaattaatattcataatgcaaaaagcttaacaattgcatgtaaaaatggaaaacattgcttgcaaaattatacatgtgaaaatgtttttaacactatcaaaaaaaatttaaaaagtaaattagaataatcattttgcatttaaatttagatttctatttctaaacaattgaaaatttaaaagaaaataaaaagaatttagtaaatttaaataccaataacatttattaaaaaaataaacataaaataataattttttgttttctttaatgcctctgtaaaaattacctaaaatgaaaatttattaccctactaaaaaaaataaatggtaaataatttaaagaaaacaaaatatgttttttatgaatatggcaatatttagataaatatactgttttgttattattaaattctaaaagttaatgggaaattatgaaaaaaagttgcttcaaaatgaaggaatgcgtcagaaaccctggacatgaaagaatctaaattagtcaactataaagtaaatacggcataatctcaaattaaaaaatacaaatgattaaattaaaaataaaattttttaaaataaaacaaagatcaaaatattaataaattttatgaaggcattatttttcaaaaatgcatattcttattacaaaggataacggctacaaataaaaaacttataacaaagagtgtttatgtttattgatcaaaacaatttctgaaactcaaaaaatttttcaatttttctcctattgtcacattaaagattgaaactggaacaattttccaaagacaaaaacacctaagtgtgaataaaaaattatattatctttaaaatatgtaaatgaattgaacatatgaataaataaaactcaatttttcgttgtactgatttaaatgaaaaattaataagttatcaattaaaatacattggattttatcaccatatatgtaggaaatcccataattacaaggttttaaaatgaaatcattttaaaattaaaaaatatttaaaatgtttaaaaagaaatttcttgcgccttacaaaagaaataataaattttaaaataaaacaaagatagaatccgttattttattaaatattaacaaaaattaacaaaatatattatatgatatttcaaaataaagaaaaaattaacacatctcaattcatcacttgactcatattgagtaaaattattattttatggtatccttaaaatcactagtgcttttttaagaaattcaaaaattttactataataaaatatgagttttttaaaaaatatggagtcaaaatttttcttaattttttgaaaattaatattctgatagagaaataattagatttagacaagctatttttatataatttttttcattttacattaaaagactaattttatggtcactataaaaatatttttttttaatacaattataaattcaaaagaaaataaaaagaatttagtaaaattgaaatgccaataacttttatttaaaaagataaacataaaacaataatttttcatttattaatgcctctataaaaatagcaaaaattacgaccaaaaaaatatgtataatgtgcatatccttggtgcaaccttaagaaattaaaaaaaaactctttatccttgactagaaaaccgtggctttgaatcatgaaggactttaaaaaacagacagttgtccgtgctaccaaagttacatcgcttcaaacccaatttggacgacaaatttaaaaattcgtaaatatcgtgaatatcctaggtgcaactttaaaaaataaaaaactctttagccttgaatagaaaacccgtggctttgaactagaatattaaaaagtaaatagaacacattcattgcaacaaaaatgaaagaaagaatagaataaaattattcaattaaagaaggcatcatttaatatgaaaaaaacaaatttaaccacctgtattaaaaaaatagccaaaaaaccaaggtcagagaacgaaaatctacgagaataacaattttaatacaaacgtacgaatattaaaagataaataacaaaaaaatatgtcaataataataaataacaaatattcattgctttatgattgcttaaatattaccataaatgtgattttgatacaatgataacaggtggaaattatcaatttctaataaacttgatttatttttttatgaaacattttcaaattcaaaagaaatttatgaaaaattggagtaaattcataacaatttggcctttttaacataaagaaagaaataacaaaacatatacattttgtataatctatcagtctacacagattaataatatgattgcctctattattttagatgaaccttgaggtttttataaaaaaagtaatattttatggatgtattttttaacatgtaaagaataaaatttttcacaatttttttttattatattactaatattatttaattttaccggaatttttatagtattaccaaaatttttaaatttttttaaatttttcaaaattttcaagatttcttgaaatgatgcgagtggcagttttaagaaacgtgcttgttttttagtttcacggctacgggaaaactaaatttaagaaaattaaaatcagttatgagcaacaaagagcaaaattaaaaaattttaaaatttttcaattttgatttctccacttaaataaaattaaatttatgactaagaattatgagaggcctacgcatactgcggcacgggcacgacacatattaccaaaaaattttaatttattttaccgcatattctactgcgaagcctcccggtccccaatgctgcacgggtgccatgcatgttctgttagctaaaattttatgacaaggggcaggtgcttcgcacctgcccttcgaggtgcgcgaacgaggagcggagcgaagcgaagcgacgagcgagtgtaccgagtcaatacgagcctgatcaattttaagcataataaatatcgatattggttttttttattaaattttttaactaattatatttgaatatgataaattaattttataatttgtttgtagtatttttcttctttctgtataagcattttactaccgctaatggaaaatgtcaacggaatttattaattatatgcattataaattttacattgtttggttttaataggcttttttttttgttttttataataaattaaagtcgaacacaaatgtatttttttggtttgtgccaaacatatttgtaataaaataaaataaataaattttttgggtttatacatttttttgaatttttgtttgaatttattgtaattatgttttaattatttgtagtatcatttttggttttaattttttaaataaatgtattaaaaattttatattttacacatatccttcttatttatttttgcatttgttagatatatgaaaagaagaagctaatattatataaataaaatagttcatgtcttcgttaggttacttttcgggaagacgtatgaattttaagttgtttcttcatttttgactactcaatttaaatatttcattaaatttcacatatatgtatttgtaatttatagttcacttggtaatttgttttatgtatttggacttgcttcgttacacatttcgtttttcggtcaaattttcatttttgaaaatccaaacattttttattaaaaaatatttatttaatcatttctttcttcaaatctgactaaaaatttaactttttgatttttttcatttattttttaacttaattttttttgcgaaaatcggcgaaaaattttgtaaaatcaccccataattcgggatttcaaaaaacgaaaaatacatgcctaaaaattgactgaaaaaagaaaaatacacacctaaaaatcaaaatttttaacttcagccccccgctaaagccaggttttggcttcgatcttgatctgttcagttaaagaatgattcaggttaaaaaacacccgtaattttattattccggtaaatgccggtaattaatgtatttcttattaattttatagaatttttcattgaatctattcttgggcatcacttttcttttgtactttcaggtgtttttagcgtggacgcgcattttttaaaataaatatttcaaaatttattttgcaattttttttagaaattattagtatgataatggttctagcaattaaaataaatcacaaataaacttttatttcgctttgaattttttctatatttttaaattttttatcttgtagactcggctaatattcttcttggtatgcataaacatttaattatattatttttgctttttttgccattttatttttaattttataaaatgaataattgtttatttaatttaaatttttaaattttgctattttaataacctaataatgagctacatatttataaaatatattttaagggtagaagttataatcattttttctgatagtttattttttcacttctattataaaaaaattttgacagattcctttttctttaaattttttatctccgtatcttgttaatttattatgtttctgcgatttattcttctcttatttaaattaattttttgaaattaattgtccagacccaaaaaatcagacttttgtctgcttcccatgttgaatgcgttcagatttcattcccaatcaatatgagtttgaattatttcataaacaaagaccgaatatttaaaatgtttataccttatgaattccttttaaaatgtttaatttatttaatttttgttttaatttgtttatttcatttttgaatatttatacttatttcttcttttaatttttgatttgcaataaaacaaattcacctatatgggctttaatttaatttcatcatattacgaacctgaattaaaattattttctcatgatttaaatttcattatggtattcct

SEQ ID NO: 1057 - DNA, 1373 bp, Heterodera glycines
  misc_feature (1000)..(1001): n is a, c, g, or t
  misc_feature (1279)..(1279): n is a, c, g, or t
gtctaatatagtgaacccccacaactgaatgcctgctttagccgggccaaaggcccagcctcagcatgcgtgttagcaatagcgcaatcaacgaactgctctctacgacgataaattgaactaattaaaaaaagagctggagatgaccgctggatagccaaatggacacgatttaccatgtgtaaaagaattgaccaaaagccaaagacaaacaaacaaatatctcactcactttttgatgaaaagtgaaagaaaattttcatgacacaacccatttaaaattaatagatttgaaaaaaagaacgagcaaatctcattttaattggatcattagcattcggatgataattatgttctttttaataattatttacctaaaacattaagaataagccatagcttttattgcatatgtttagtatatttccttgtaaattcctttccgttgagttcagtcggcgtttggcagccaatctttggagacagtacccaccgccggcctatcgacgacagaacgacggtacttatttgttagcaggcgggagttttgtcgcttcattttatctcctcccatttttgtagtggcggatggaaattacgcccctttcaatttgtacgacggcggcgaattccaacctccgccgctgccggtgccctttcagccgagtgggtttcttttttgcattgaattcggttgcttcgcttcttcagacgttccgccgcctttcgcttttccgccgaacgatccgcgcttttaccgacaccacggcggatataatatgatgatgtacaacgacaacaacagccaagcaccaccgcaacaggtgccatttgaatgatcagcataatcagcgaattccgtttgtttttagccgccccttccgtacgcgacgaatgaccaccaaaggcaacaccaccacttccaacaaccagcacagcagcaggacccgcgcatttacccacagcaaatgttttacaatccgccgcagcctatgccggnntcggttgggcagtcgccccctcccctccccgtgccaacaattcgaattgtgtgcgaattccctcccattttttcagcatcaataccaccaccaaactctgctgaaccgtctgcccaatgttccgcagccgtccgttgccgatgcgcaagtgatggtgccaccgccagcgatgaccgatattgcgcttgccggtgccgaacaggccattcagatgttctacaacaatgccgggattcacaatcaacagacgcaccagcagaatggtcggccccaatagnggaggggatgaacggcacggcaaggacccgacgaagcgttcaaattttgcaatttgtctcgccccttctctttcccatgactccacattttcct

SEQ ID NO: 1058 - DNA, 2954 bp, Heterodera glycines
  misc_feature (1244)..(1244): n is a, c, g, or t
ttttattggtcactaaaacacaaaactttttgacggccttttgtgatttaattcctttgcttttatctctgtcgatccatgcgcctttttttgcttctttgacctatgtttttttcgtcttttctttcataaattgtcattttcctatttgtttttctaatatatcaatcaaatcattcatcattcgtcccatttcattttcttcgtcgtcacttttcgcatttcccccttctcaaagttaaaatcacaaacacacgaacattcaaatatcatcctttgttctgcttaagattacacctttgatttgttatttttattttatttggttaacgcttcacaccgattcattttggactcccaactcaaaaagttggtcgttttttgagtttagtaattggacaaagggtggtggatttggatttcgcccaatgtttaaaagtttagcatctcaaaactgggcaattttggtacaataattacggtgttttcttgattctttctttattggcgaatctctttgactcggtgtgtttagtgttcgaaaatgcccttattttcgtaaaattctcataatttttggtgcgcctcggcatatacgtaaaataggcaataagaatttcatttaaactggcaacgcttaaatgatttgatttgtgattgattatctcatgtcaatgcattcgctgtttttgtaattcatttccacgaattaatttttgattttaaatcataagttgaatatctttgttcttgtatttatcgctttttgcagttaagaaacttttaaaacgtttatttttgaaaatgggccgacggaggaaaacggcgcctgcccttttgcgcaacaaacggacgcgaattgacgaggacgaaatggacgaagaagaagaaggggcatggaatgggcatggccaccaaaatatgggacttcgaccgagaaaggcgaggggaattggtggttttgggggacgaacgaaaggggggggggcagcagcactcattaagacgaaatacggggattgatgtgcactgatttgagtgttcatttagcagatccaacggacaatcagtgcccagtgggccccgcgtctgcgcgaaaggcaccaaaatggacagaacacaacggaggaccaattggcggacatggaattggaggacgtggacatggatgaggacgaaatcgtcaaaacattggtgggccaccggggggggggggggggggaatgagggggtcatacctctcncgttgagttttgtttaattttttttaaatttcgaatgctatttgtatacctatgacatttttcgatgctccgtcccttaaattcaaacaattcgtttgtcagaatatggtgttcaccaacctcgacctctcccaattgcccgctttgtctcccggcgccggactttatgcaatggccaattatgcaattgaagagaaatccatcccgaaaagaaaggcggcggaggttccctcccccttctcatctcaaaagtattttaatgagtttagaagaaggttcccgaggatgtgttggagcccactttcctctccctggagcaagccatgcaaaggcatcgaattgcttttcgtccaatttcatttggtttttagagatcagaatttcaaggggaagctgttggacgcgttcttggaggactttcgggagcattttcagacgtatttctcccgtccgaattcgcaaacatttgacaaggatttgtgtgtccgtttccttcttcaacacttccctttcgtacgtttttccttttcctcaattttgcttctgtttgtcccttttccttcagtgccgtgttccgctcattgaacgactcgccgacgaattcgccggtcgttacgccgtcgccgcgtgggtttgcttttttgtggagagtcgtttcggcgttctcatgcgtcgatgtaagtgctgacaatggcacattttcacttggtaataaatatattttttagattttttgcacattgaacactccgaatgggtcattttgtccattccgaacgaaaacgcgcgaagacgccgcgccaattggctgcccgacccgtcggaagaggacgacacaacgctggccaattcaattcgcgagttccgcgctcgtctcgcccgtttccgtgccgattatccgcaactgttcctacccgactccaacaaactgagtcccgtccgtattttatgccattgatttaatttaaattattgttttccttttcagaatgccgaggaagtggcggtgtacaccgaaatgccgggtcttccgctgatcgaatgcatcgtttgcaccggtcaattccccgtcgcacgcactgtgtgttgccaaaacattgtcaattggaccattaccattgacccgactttgccttgttcgcctcccccccccctttccattttattttttaccattttccctccttttcagccggcctctcttcccaccgtttctgtgtcgagtgtttgattggccactctcgcgccgccacccaagaaatgccattggcggacggcggcatcggattgcgatgtatggccagcgactgcccaaatgcgatacttttttgtgagttcattccaacggaatattggagccaaacaaaataaatgtcgtggaaaattaagccgagtgtcgcttttacattccgccaaacattcgccgacaactgaacgcacgcattttggaggagagtttgggcgaagcgaagttggaccaattggaaaggtgggcaaatggaggggacgggaggggaaggaaggacaaaaatggggcggggacgtttaaatggcgtccgaaaagacaccccttggataataatgaagaaattggccgattcttttcattttttatttagatgcaaatcgtgcaactttgccatcattatcgagggaaaaaagggggggacctaatgatccgtgtaattacgacataaaatgtctgtaggt

SEQ ID NO: 1059 - DNA, 1723 bp, Heterodera glycines
aaaacaaaaaaaattgaactcccaggccgggaatcgaacccgggtctcgcacgtgacaggcgcggatactaaccactatactacctgggacatgttagtagaccattaaaattattctatcaaatgaaaattaaagcaaaaaataaataaaaaatgagtggaccaaatgaaaaccttgtttttgaacagtaaaaggtttttcgatctattttcagacttatcaaactcattttggcaatttctaattttttgtgcccaataattcctcgtcccttcccaccgggcgctcttcgccagtcgtacggtgcaccgatgacatcgatgccgcgttggtagcccaatttggcgagggaggcgacgatgggcgcgaagtaacggctcggcgaccgtttggaggagtcaatcataaaatcaacagaaattccacctctttttaataattgtgaattggctgcccatttaagaagaaagtgtccctcccctctcatcccaaccctttccgtctttccgtccctttgcgtttttcttcaaatggatgcgttttgctgctccattcccccccccccccctctgaccattccacggttcgcgtgtgtccaaagccgggcactcgcactttcactccctccaaatcctgcgcccttccgctcgttctgttgaagttgaggcgcatattgtcggcccaacaatcgatgacaaaagggccaaattgctgggcaattagggaattaaaagaagcgaacggaagagatcacttgcaaatcgagccaaagcgcgaagaaatcgttggtctgtcgctggcaaaagtaatggaccaccgacggtttgcctaaagtgcccttggccttacccccttcagcccctctcttctctcacccgtcaaattcgcctttagccgacttcccccgtcgccggggactaaaattagacaaaatgaatggccaattggacaaatgggcgacacacagacaacgcgaactcactgagaacaattgggtttcgtttggcaatgacagaaaaatggccaaatcggcggaagggacgcgacgaaagggcgggggaaatttggcggacattttgagggattaaaatgaaagaaagagagaaagggaggacgatcagaagcaatagcagaacagtggacggggagaaaagcatttgggaaaataaaagcaaaattaaatttgaaaaatttaaaggagagggaaagagtgactcaatgaaaagggaatgggggaattccatgggggggggggggtgccatcaatgcctttgccttatcattcactgactttgtcttatcatttgacgcgccgagcgacgaccgccttaacttatccacaaatacttaagtgaaacgaatttgccaaattattcgaaaagtggagacgatctgggatgagcatgaaatttcgattctgtcatttttgggtctcggaattccgaatttcgaaaatgataggcgtctcgcaatgccatccctagcgccgatagtacttatttaagacaatttgtaacagatacaaataacccgattttgggccaatttttttttcacgattcgaaactgagactctctagcatctcctttaaatacctttttttgtttaccttacacctcatgtcatgcgtatcctgaaaatctgaataatcccccaatgcttggccctctgttattgccaaattgatcaacaaataaacgtctaaaaaaaacaaaaatttt

SEQ ID NO: 1060 - DNA, 1503 bp, Heterodera glycines
  misc_feature (1459)..(1459): n is a, c, g, or t
ccatggggaaaaagagtgagtggttggcttatggaaatggaaattaagtgatgaatgtaatgtgtaattaggggtaattaggaagcaaatataaagtgaagacaaatcaaaggaccataaacagtgcccatcacagaaagagtgaccattcacattgtgaacagcaaatatctgcttgaattaaggaaaatagaaaagaaaaagatattgacaaaggacaattcgatcaaagggatgacagtgccagtggcaggaataatttcagtctttggagaattggaaaatgggaaatgagaaaagaaaaaaaacgacgacggaagaaaattaccaaaagcagaaaaaagacagttaaagcgaccaaaatggaaatgcaaagggcaatctgtggggggggggggaaatggggaaaatgatcaaatttggggaaaagaggagccaacggacggaccttttcgccagaatcggacggcaaataaaagacgagaatggtcaagaaagagatgccaacgcatggaaaaacctaaagcagaaaaagggggaaagaaaagcaaattgggccagagaaagaaagagaaagagagagagagagagagagagaggagagagagagggagagagagagagagagggagggcgagagagagagagagagaggagagagagagggagagagagagagagggagggcgagagagagagagagggagagagagagggagagagagagagagaagcatttgggaagacaaaaggggaaggaaaagacatttgagtggagacgactcaagcaactaatctgattgatcagtagtgatcctcagtcccattcaatcatcacatcgcccattgctttggaaaactcaccaaattgatggtgtaaaagagcggcttacggcgcaacgccaaattgtactgaaaggagagagagagagaatggcactgtaatggcaatgcttcaccacaatgtcatcaaagtccttctgccgcacatttggcggggggcccaccggcggaggaacgggccgaataaaagtgggaatggcgcactgccttaacggacataatgtcccattcgacggaagggtaataatcggacaaatctgatgagaagagagaggggggggataatgaaagcgaaaaagcgtaattaagagaaaatgaggagcttattagcaaaaagcaacgaatgaatggacaaagtgcttgccaattccgtcctccctttccgtttccgtgccattggcgtcctcccaaaatgtgagacgaagcaaatccgcgggataactccacgaaccgaactgtaaacagcaaagagatgccaaattttggcggggattcctccaccaccttcaattggcaaagctgctcatcgaacggaaaccattggacgtcgatttggcacaacgatttgaaaacggccggaggctcccaaaagacctttaattagagggaaaatganaagataattagccaattatccgctgaatgtttcggcacattacg

SEQ ID NO: 1061 - DNA, 6295 bp, Heterodera glycines
tctagagtcgtgaggtgagtcacctgcgtattccttcggctcccacttcagacgcgggtccatccatgactgacgaagccaaacactgaccgtcattatctgctcaatctcgtgctgaagaaggcgcgttaggatggactatcacccgtcctaattacctaattaccccgctttaattgcttaattcccctcttcgttttttcattttccaacccaaatgcctaaatattgcttttgtgatagtgtctcattattagagctttgttgtccaccgaccacgtcaatgatttgcgagagtcgcaatttcagtctcactgtgctcagtcccacgcgtttttccgtcggctgagcgaccgaagggcggaggtggcgattataagggagcaaaaggtcgtcgaagagacgcttcgcctgctcattggcgcggacaaagcaaacttttgacgagaggagaaaaacggcgaaccaaaaaaacgcaaaaagcgggggaaaacgcatttttagggggggggggggaaggaagtgccgaggacgagcgactcctgacaagggaaacagcaaaatgagtgaagcggagaattgccagaattcgaatgccacgcggcattccctcgggggaaacaatggccaacgaaaagggggcaattccctcttcttcatgaccccccatctcattgacggaatgaaagtattaactaaaagcatagagacaaaacatcactctttttcctcctttctttttattcttcaccacgggcaaaaggaattggccgaaggggaggggaccatgacagccgctagcatagaacggggagagggatttgcaatggcaatgtccggcaatagaagtttgaaagcaaaacaaaacgacaagagaagtgataccagacgaatgcagggttttaaaacagtcaatttaaaataccaagcgtctccaaattcattgatcaatttacttgaattctgacgaaatgtaaaacagacaaatctcccatcaaacttagtcttccgtttcttcctttgtgtcatccatccgcatcttcttctctgaaaaaagattaacatgaaaaaacatgcaaaaaatccttgacatttaagagtatttagaaatgcaaagctatgaaagccaagcactaaagaggacgcaactttttgctctcgtgagtcatcatcattagggacttaataggctacaaggtcgaacaggcccataattttaaaagctaataggcgcgtttgtctactgatcgcccatcacttggactggtcgatgactcaccagcaatattcccttccgacgatgagtctgctgcagcggaggcggcgcctgcagggccaccaccgccgttagcagaagactcatcgcgactcaacggccttttcaatgatgctgcacctccatttcccacgggaggcgcaggagcggggcgcaaatcgggcaagcgctcaatgccgagaatcttgtagagctgattataggcgatcagacgaatcgcgtgctgggccgacgaagtgatgtcctcacgttcctgatccgtgatatgagccaaaatgtccacctgatccttttcgcacggatcggtcagtttggaacgttctgagaaaaagcagaataaacaaagagaaacaaaagcacagagaattgcagtaaatcagaaatgccattaggcaagacgatgtgtaactcactgctcaagaattgtccgctggaaataacttcgaacagccgacgcaccgcgtcacccggacttaatggcatcgaaatggaagcgagcgtcttctcaacaagtaattcaatagcctgaagtaaggctcgtggatcagagaaattttggaaatggaaaattacccaacaattcaatgcggaccaagtttggacacgatttccaatgtcccgtacaattttcacagtcgaattgaccgaatgcaacggcacacacttcgcctgaaaataactaaattatgaatgaagatgagataaccgtaaaagtcagaacagacaaattacatgacaagcatgagaaaaagaaatccgagaaagaacagacatttttatgggtgaaatgtaagacagcttctaattaacatgattaaatggtttaaaattctcatttttaatgcatagaaactgtctaataaaactcacctggaaaaatttagcatgacgcaactccgccaacgctttcaagcaaggttcctttggcaacggatcagtgggtggcttctcctccacttgagaaacggctgatgtcccgtcttacatagaaaaacacacgcaatcaatcaacggacattccattcatcaactcataaattcactaatgacttgctaattatgttattagagttttcaataaatatcgatcaacggtgactgatcgggtccgtgtgttttgctactgtgcagatggggccaaacgcaaatggacgactcaatggaaagcttcttatttttaaaaaccgtcccagccgcatctcaacataaacaacgaattttgcacccctataagtctcagacaatgcgtttcagttggcggaattggattttacaagaaaaaaggttttccaagtgaaccttcggtaggcttttgctgaggctcacgaagaagaacgcaagtgagcgtgacacggcaggtgaaagagagagaattcagcgagacagaaaaagcggactcttcgaccaattcggatacactcaatttgtcgtcgggagaaacctaattacattggaagttaaggttttaaaataaaaaaaacctcggcatgttttttgaagtattcgaccacttggtaaagcaaagtgaccgtaggaatttttgaacacaaaacgaccaaatcaaacttaataaatatgtttaaagtactcgaagaatataaaatcctaagtgtttagtaaggcacctgcgtgtccgtcttgagcatcaggtgcttggccaacagcccaactctcatcactcccttgagaactcgatgttcttcttgcgtttccgggggacaatcagcctcggaaagcattgaatccgaaacagccttcagagttttctaaaaagtatacaaattgaagatgagtgatctaaaaattggtttataaagtctcacttcggataaaacggctaaactttcaactgaattcatttcatccatggacaattggatctgctgaagtttgtgcaccacgtgttggtcatccattatctcatggccacgttgcattggaacaaacggacgcggctgctgtggtggcgggtgatacctaattaacataatcaactgtttagggggtactgaagcaaatcacatacgacatagcataagcccctggccctccgaatttgtgcttttgttgctgcttcttcccgccccactgtttcatttcaaccttcaagctcgggtcgactttttgctgaattacaatgcaattattcattcatttgcaataaaaaactactgactttgtactgaagtcgatgacgacgtcccttgagatgaatgtctttcgcatttttgtcgctaaatttgcaatcacacaatttgcaattgtagttgatgaattttccattagtgtccgtctcctcctcaatatattcttgcccaatcggttttatgtcaacgtccgccaacagagccttctataaatcacagagcattaaaaatataaaaaggagaatagatatattagcctccaaatcctgtggtttcatcgctccggtaacaacattcgcaggattgccgcctgttttcaactcctcgcctgtggttgtgagggtcgtgccaccaacaaatttggtgccagtcacaccaacgacttttttcaacggcacgttgccaccaacggtcggaattggtttgccaagcgcttgggcatttgccgaagtgagaacagccggggacacgtccaattgctcggggaccggcttgcccatccgtctcagaagtgcaacggtacgttggtgcttctgtccttttatgtgcgcatcgtaagtgtccttgctgaatagaattcattgaaaacaaagttcacagtgcttcttaccttgaacaagtcagctcgcaaacttcacaacggaacccaacgcccttgtaagtgggcaccgtactcttgttcttggccgccatctccttctttttgtgtggttttccctccaagtggtctttataagcagcttgtccagcacagcttattttgcacacttcacaaaaatgctgttgcacatctcgattttgatgacccaatccgtaacgcttcttgcgaaattcttaaaaatttctagaacgttaaaaacgaagaaaaataaaaacctttgttgaagttcccacccgacgatttgttgacccaatttccttgcggttgtggagcatggtttttggactgaaggtaagaggaggcagccgcataaacagccgcttcgtaaccggtgtaatgggaagcatttgcgccggtggccgcggaagtagcgttggccccggtcgccttgccaccgccaattacgccgtaagcgccggtggtcgacgaagctgattgtgagacaaaccaatgactatttggctctacaaagaaatcattttctaagtcaacatttgttccaagtgccgttaaacattccattaccgaattcctaaggattccaaacctgaatagtcaggaggtggtggcggaggctgaactccgtaagttgcagcaacggactgctgttgtgttgcggcttggctgtattgtgcgtaagccgaagcagccaacgaatattgggaggcactaaaaaaaccaaattttgcgtcgacaaaacacgaaattcttaaggagccttacgcatatgcatttgttgtggcatttcccgccaccggagcagtcgccgaattgttttgttgctgagcataattgatgaaactttgctgctgaccgtttgctgaagcgtaagcgccgtaattgaattgagtctgctgatatccgaacattctctgctagtgtcaatttggcgagcacaataaaaaaggaaggctaaaaataaaaaaagaataaaatacattaaagcttattatatgtaatccaacaaatttgattaagctaaaaatgagattttttttacaaaatatgtaaaaagcagcaggagaactcctcttgcgacagtcctctattgttgtaatcgataaaaaataatcgctctaatgacaattttcgttaatttttttcaaaataatcatgaaatttatgaaaaattttggcacccccacaaagtgtccaagccacgaaatgtccaaaagagtaaaaacccacgaaatgtccaaaatgtttcaaaatttataaaaacaaaatgagtctaatttaggatttttagggttttcggggtcgctgaatacgaatataccctttatattaccccttgcctaaccttaggcccatctgaataataaaaaactcaaattcgagacttggacatttcgtgggctggacattttgtgggtcagcgaaaattttatttgttacaacgtttctacttttacatctgaatctataagtactacttccctattttaaaataataattattaagtgaattttcgacttatctataaatgtttctgacccgcagcgaatacgacaggggagtgaacactttttccccggagggccgtctgttccaagtggaatatgccatcgaaactgtcaaggtgagttggaagaattcaattcagattcaccataattttcatagcttggttccacaagcatcggaattcacaccaaagaaggcgttcttttggctgcggaaaggcgttcaatgagcaaattggtggtggacgactcaatgagcaaaatttcggaagttgagaagcacattggtaaggcccattttccacaatatatgtatttagtcaaatgggtactaatgtcgtttacagaccataaaaaatagggtaatactgccgatggccccccccctttttttggagaaaaattcttcctgttctaaaaagtcgtgaaaacacgttatgggctttttaaagtcgctgatcacgaactgacattcattttgaccaatttccaatccaggacccgaattcgaacataagtcgagaattaattttaccaaaattcacttttgttagaatctgaacggaattcaggtccggggttcggatgcaatggtttatagttaattttttgcttttttaatctattttagaacataaaagtgaatttgaaattttttgagttttcgactttttgttcgagttcggggtccggggttcgaaataggtcgctaatggatgccggattcatgagcagcgaccctga

SEQ ID NO: 1062 - DNA, 1575 bp, Heterodera glycines
tccccaagaccacttatctctcctaaaattctgaagggattttaaaaaaattttccttgatagataccaatcgaaagcgctggtccaaatccctcaacctttttcaaaaatacaaaactcatctttttttacaaaatctgataataaagttttactgcgctattatggaaccatcggatcacttttcccatttagaaagtctttttgttttaaatttttgcaaacacttttttgcttaatcatttctcttccattggcatttttccaattcattcttgctttcagatcagtctcggccgtccgtttggagtttctatgctttttgccggcattgatcacacgggtgcgcatctcttccatttggacccgtccgggacgtacattaaatgtttggccaaggccatcggtgccggctccgatgcagcggaacaaacgctgcaagagcactgtaaaaactgcgacaaagtgaggaaaatgcactcattgcttttcacattttatcattatcattcgcagaaaatggaaatggccgaggcaaaacaagtcgcactgaacacactcaaacagctgatggaagagaaaatcaattccaaaaatgtggaaattgttatgattaagccgcagacggacaaggaaggcaaaacggtagcaattggaagaaaatgcatattttgttatttattcccattttcagttgggcaaaattgtgtggttagaggaatcggagttgcaagaaatcatttcgcgattgtagtcgaaggggacggatgagagaaggaaaatgggctttgcactgccccttttatgattggatgaccttttgttattctctgcctttttgtgactttttcagtgtataaggcaaatgaaagcaattaattgagaatttggctaatatccaataaatgtttcaattctctgctgaggcacagtgtccgccactgactgacactaatgacaagagtttaacgatgcgtagcactaataaaccgtatttctcacacaccacacaaaattttcatatgaggaggctctgatcgctcccaaaaaaagacattaaaaaacaatgtcagatgataaggcggagtcaatcagtccaactcttatcagaatttattgaacgcttttttgttggaataaaacgaaatatcatggaactaattgacatatttttgggcccggtaaatgccaaaattggtcgaatctttcagcagacaagaacgggacggcacaacagacagtgccgtcaatgtcttctggcacagtgtctccccttcgtgacgttcctctgcgtctctctgataagccctcccttccctttccctcccctcgccgtttgaccaatgactgtccttcttccccttctcccgctccgatcactttgtatctccgattggtcagttgggtctgctcaatgagtggccttctgttcggctacgcttcttcctccattaatgatttggtaggccttttccgtccccatcccctcattgtccccccccccctttttcgctccctttcatcgtccgtgagatgcgtctttggcctgctgaggttggcgtggtcatctcctgc

SEQ ID NO: 1063 - DNA, 2588 bp, Heterodera glycines
ccacgaccacgaccctccgaatgaaaaaaagtgatcagaaaatagtttaaaggccgagttaatgggaaagttagctaatcagaagatgactaaatggaggaaaagatgggtcaaacaaattaagtgatctgatcagagtgatcaatcaaatgcgacgctttcccttcccttccaaaggttgtctctttcttcgcctcatgggccggactttttctcgtttctcggtttggcagacgaccgctgctgatgacgggacaaattggagtcattggaatgaacattctgatggcaatttgcttcggctttttccccttcggaccaattcggggatggctcacattggcacttttgctcgttttcctcacatttggccaaggatttatttctacggtcacatggtctgtgaaatgattctgtccactgattattgtatcaaaggcttctgacggctgaaatctttccgctgcatttgagggggatttgctcagggattggaatgtccgtcgcgtggggaactgcgttcgccgtcactatgcttatccccgtaagaaatggaacgaattccccgctttttatattaaaaaaccatcctgacagatcggaattcattccatcggcatggccgccaacttcgcatgccttgcccttcttggcctcatctctctattgtttgtgtggaattttcttccagaaacgcgcaacaaaacattggaagaattggaaaaacaattccaaaagagggattggacggcattgaaaagagaagggcaaaatgagagggacagaatggtggaagagacggaaggaaaggaaacggaggaaggaacagcaaaagaaacatattgtgaaaaacatttctaatgttgttttacggtaaataccagtcaaataacagatccaagacacacagctcattgttaataatttgttgttttgatttttcaaatattaaaaaggatttaattattgaatttgatcattttttagcaaagttctattttactatagtaagttcattataaaataaaaatcgcaattataggaaggatcacttcgtttatcgttgtaaagaaaattcattaacacaacacagccataaaagattaaaacattttattaattaatagtttggtacgtatgccaaaattccttaagcactaatgtggtacctcttttcaaacaaaaaaaaattcgaattgttttgagattattttagggttttcggtgttgaagaactgattacgatatctaatatcgacccatttcaaatccgaacccactcgaacaaaaagtcgaaaactcttttgccaaaactcacattttgaccaaaaatcaaaatacacgtgtcttcacactctaagtttcatttccttttttaaactaaattagtttggctgcgtagaaagtttaaaatttcaagctaaaaaatcgcatcgaagaattggctttttttggtgcaagaataagactttgttaaaagtaagttctacacttttgttcgagtccaggttcgggggttcgaaatggatgtcagcatgaatactccgacaaaaaaaaacgagaattatttctgaaaaagagggcccacatatattaccctaattaagtatagaaatagtaaagtaggaacacaccaaagctgcctttttcattccccccccccccgatctttttcctttacattgtaattattcttatttgtcaattttcgcttgtcaaatgcccgcctcctctcggtttctctttcgtgtccctctctcttcgtctgcgtcggtctcttcgttggccgtcgtttcgacgcccgtcgtcgtccgctggctgagaagggcgtccaattgagggccgatcatttggccttcccctctggtggaattgttctgttgcgaagagaccgcagcggcagcagcttaatcaaaaaggaaaatgacagaaaaaaagaatcattaaaactgcaatataaaaggtttataaaccaaaagatataaagcgccaaaatgcgatttatgctcaaattgaaagatacatttttgcccaaatgttatgcattcttaacaatttttgacaatcggttagttatacaaatgatcgagaatcaattcaattccaaccggcagcagcggcagccgccgccgcttcggctgacgagccgttggcgttctgctgaccggtggccatcgcttgcattgtcgcagcgtaataattcgccagtccattagaagaaccgtccttaagtatatgtttgtttagtacaaatgtctaacacggggtactcttttcttctcacttactgcccccttgcgaagttcggcttcgccatgggcccaccgacattggtcgccgttgttacagaagccgcgctgctggtaaaaagtgcacagagatgttttgtagaagcgactcattgtgtcatcttgtctaaaaggaaccagaaggaatgaaacgaaaaaattcaatcctacagaatggatgtccctaataaagttattttgagctaaaaattggtatattggggttttcatggagctgcaaaaatgaggcaaaagcttcaaaacagtaataggaaaaacacattaacaaaattccgtgta

SEQ ID NO: 1064 - DNA, 436 bp, Heterodera glycines
gcgcatttttctatcctagaaaaaatgcttcttaaatttttaaattaattttacgcagaaaccacaaaactgcaccattgcccggaaatccaatatttattcaaaaaaataatcgttttcaatttgattttaccaattttcaatgggtagagcacgtagaaaaaaggtaaattaaatcatttgttaaaaatataatttcgtttttcccaacctaatttacaggggaaaactgccagaagagctcggcaaggattgcttggatttacacgaattgcaagagaaggaaagaagccaaaacaatttgtgagcaattttatgctggttttaattctcagaaaatgtttttaggagaagagagtcaatcaaagactggacagaaaagacgatgttcgaacggaggaaattttgcgtgaaaatattgccggacaaaagaccc

SEQ ID NO: 1065 - DNA, 2113 bp, Heterodera glycines
ctccagcattccagtcgccgggactcaattctccagcattccagtcgccgggactcaaccctccagcatttcaatcaccgggactcaacccaccagcattccagtcgccgggactcaaccctccagcatttcaatcactgggactctatcctccagcattccagtcactgggactcaattctccggcatttcaatcaccggcactcaattctccagcattccagtcgccgggactcaattctccagcattccagtcgccgggactcaaccctccagcatttcaatcaccgggactcaacccaccagcattccagtcgccgggactcaaccctccagcatttcaatcactgggactcaatcctccggcattacaatcactgggactcaatcctccggcattccgaacactgggactcaaccctctagcatttcaatcactgggactcaacccaccagcagttcaatcactgggactcaattctccagcatttcaatcaccgggactcaatcctccagcattccagtcactgggactcaattctccagcatttcaatcactgggactcaattctccggcatttcaatcaccgggactcaatcctccagcattccagtcactgggactcaattctccggcatttcaatcaccgggactcaatcctccagcattccagtcactgggactcaacccaccagcatttcaatcactgggactcaattctccagcatttcaatcaccgggactcaatcctccagcattccagtcactgggactcaattctccagcatttcaatcactgggactcaattctccggcatttcaatcaccgggactcaacccaccagcatttcaatcactgggactcaacccaccagcatttcaatcactgggactcaatcctccggcatttcaagttttttgtttacatttcggcacaacatttggcattttcctcgtctttacttgtttctggcattttcttatggcacacgtctcttttctctaccttttcttccctttttttcattttcttatggccagacatttcttctcaatattttaatgacaaaacaattttaaaaacttcttacttggcaaacgttaatgccaaaataagtgtaaacatatagtcatttactaatcaaagcacaaatcaaattcaaagtcgagctttttcctattacaaaatgaaaacaattcaaaatcttttgcttcttcattttttactaaacaaaatcaaaaacacacgtctctttaactataaaattcttttctctttaacaataacaaattctttaataccattaacaaattcaaatgaaatcgcaaacaaaaaaacattaaataatgtagaaaagtaaaggcaaaattttctcacaaacaaaaacaggaatcaaaaagaaccattttcctctttcttttattaaatattttatataataaaagatgggatataaataaggaagggatgcgagacaattttctattttctctccctttaatttcttttctcttatttcttttacttttccaattactctctctttttttcacactccctccctctcccacacacacgcacgcgcccaacagactgctgctgcacagcagcacgcgtctgttcactgtatacccctcccccacccgccgctgcctcgtaaacagacagtcagacagtgcactactatttcccacctttccctctctctaaccaccacttcacgggaagagaaatcttttccctttcaactatttcttccgctttttcttttcctgtactatttcttttgccttcttctttttctaaactatttcttttcatctctttttcttttctaatctctcctcacagcaaatttactcaaaacagaacaccacattcaaaccgtgttacatacatagcacaaacactcaactttattatataagattaattagtaattttttatttctcttggtgttacgtttttaatatttaaattattttttgcaatggtttgtaccttatgtcaaaaggatgttcgatttaggaaaattttgattggacgcgtaaacttttgattggacgcgtaaaagtcgattggacgcgcaaactgtgattggacgcgtaaa

SEQ ID NO: 1066 - DNA, 10067 bp, Heterodera glycines
  misc_feature (96)..(97): n is a, c, g, or t
  misc_feature (99)..(102): n is a, c, g, or t
  misc_feature (528)..(528): n is a, c, g, or t
ggggggaaaaaaacaaaaacaaaaaaaaaaaaaagaaaaaaaaaaaaaagaaagggggggagggagaaacaaaactacaaaaaaaaaaaggggggnngnnnnacaaaaaaaaaaacaaaaaaaaaaaaagaaaaaaaaaaagaagggggggggggggaagagaaaaaaaaaaaaaaaaaaacggcaaaaaaaaaacaaaaaaagaaaaaagaaaagagaaaaaaattaaaagaacaaaaaaaaaaaaaaaaaaaagaaaaacaaaaaaaaaaaaaaaaaaaaaaaaaaaaaagggggggaaaaaaaaaaaaaaaaaaaaaaaaaaaaaaaaaaggggtaaaaaataaaaaataaaaaaaaaaaaagaaaaaaaaaaaaaaaaaaaaaaaaaaaaaaaaaaaaaaaaaaataaataaaggggggggggaaaaaaaaaaaaaaaaaaaaaaaaaaaacggaatgaaaaaaaaaacaaaaaaaccccaaaaatctaaaaaaaaaaaaacaaaaaaaaaaaaaaacaacagngaaaaaacaagaaaaaaaaaaaaagaaaaaaaaaaaaaaaaaagaaagcaaataagaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaagggggggggaaaaaaaaaaaaaaaaaaaaaaaaaaaggggaaaaaaaaaaaaaaaaaaaaaagggggggaaaaaaaaaaaaaaaaattttttttttttttatgaaggaaatgaaacgattgttgatggaatgcttttttttttgttttggctatttattgtttgtttttggatgggttttcagttgaattttttaaaaattttatcagaaaaaaaaattttcggggggggggggaatctgaaggcctttttttttgctcttctgccaaaaaaatttttctattaaaattcgggagcaaaaaaaaaaagtgtcataattattcctaaatttttgaaaattatggtaaatgtcaaatgatagtgcagcaactgcaggtacttccgtgttttgctacccccccccctcccctcgaaaaattttaaaaattcataaaagggaggaaactcaaaaattttttggtggacaattgggtcagttaatgcgctaatggacaaattggtgttatagcattatggtagtcagcggttaggcatacggtaagggtgcttatggcgcgcctaaaaagcctgatacatttgaccaataaattctcagagtttgcaataaaatgtttctcttcaaagtcaaaccgattacagtatgaaaactggcaatggattggaaaaatgcccgattaaaaatttaaatttttagagatattagggctcgatcccatgtgtcgactttattttactttgtcttgaaagccaataattcctcccgtcttaaaaggaaaattatgacaaataaaaaacctcaacatttaaatttggttgtttccatgtgcctttgtccacattttccaaccccaacaattaaaagtgccgttctcaactctctccccctgccatagttgtccaacgaccaacttgacgaggcggaccaattgctgtcggagacggatgtccacctggacactctgttggcaccgccgctggggcgtggcctcttttacatgtccaaatttacgttggcgcgaaagcgatggaaacaatcgccggcggagaatgaaaaagttttggaccgttttgaagtcagttttacataataatttcattttgtttttcgtttgacattcgttgctccccccccccccctccaatctgtaaaagtctgtgtaattcgttggtcgtgaatattacatcattgtgcagttaaaacccggttttgactatttttttaaagaaatcaaaaaaacaattttatttgaaacattttatgacttttgaaaaaaaaatcgaaacgggaagggagcaaacttaactgtttgttacccattgaatatgaatttttggagaggaaaagaggggaatgaaattgggagattcactctccataacactcccattttttactttattaaactttcttaagcctttctcacaaattgccatattttcaggtggctcttcaacatgtgtacagcttcttcttgacctaaagaaactgcgatggcacaatttttaatatgtgatggagagacaacaaattaagagagattttttgtttgatttatatgtgcaactaaggaaaatgactctataaaaatagttcgaaaattgtatcttttttcttttttaaatataatcagtgtgaagacatcaaagtcttgctttttcaccacgtgtttataaacatgaaatgtttcactttttttgtgtgtgcgacacttttttactgaataaaattgtgtgacggaattgtttttttggcccgacatatttgttttggtgtcacaatcttttttcacaatgtgtctaattgttttataattttttctcggacggacaaattcttcctatattttgtgttatgcccacttctgcaacgcttgaggccattgagagcagaaaattggccgatttgaaggtccgtcggcgaggggaggggggtttggggttgaattcgttcccccatttaaatttggttgtttccatgtgcctttgtccacattttccaaccccaacaattaaaagtgccgttctcaactctctccccctgccatagttgtccaacgaccaacttgacgaggcggaccaattgctgtcggagacggatgtccacctggacactctgttggcaccgccgctggggcgtggcctcttttacatgtccaaatttacgttggcgcgaaagcgatggaaacaatcgccggcggagaatgaaaaaggcgtgcattctttaggatttcgtttctcaaattgtgatttgtcaacagttttcattttaaattggtttaacatccatcgacagtttgttgatcttttgaaatagtgggctaacagatattacattcaatttctcgaacagatgttacattcaatttgtaggctcaaaaattacaaaaaaacatttaaaaaaatcaaaatttattaggttaatatgagtcgtcatcagagtaaatggactaacccttcagacggcatatttttatttgagaataaatacataaaaattaaatattaggacattaggagggggagtagatcggctgacctctcaatacaaacgaagtccgggggagggagaattggcacacaaaaatatagtccattaaacacaaattgacgaatttttatccgttatgaattggggggacacaaattctggtccacttcctcctcctcctccttcaacatttgcttgttctgctcgtcctcctccgtttcctccgctgtgccgtgcccttcttttcctccctcctccccctcatcattcgcctcctcctcctcccgtttcaatggcattgtgtagagaattgttgcggccacattgcgcacccttttgttgcccatttcgtcgccaaacagtgccgcctctttcaccgcttttgcggccattgcggggaaacggcggtggaacactgagcgctttgtccaggtagaagcaggcccggctcatttctgaagggggaagaagtgaagagctttgtgattgttataagtgttcactgctcgtgaataataaaaattacaaaaaagtttcaatacttttttgtagtgttcggaccccgtgggcgggggtggcttttcgcgggggcgggggattgcgggggtcagagtcgcggggcgggggcgggggtttgcttttaattagctccaaaatctcacaaaaaaattaattttttgaatgatgtgtttggttccacattcctttattcgttgtatcgcctcgatttaattctttttggtataattgcacagatattgtctaaaaatgaccaaatttagggattataaattatgccagaatagtcaatttttatgggtgtttttgtctattaatccagggtttctatctcaaaattttcaaaataacaaaggccaaaaaataagactatagttaaaaatagaacattttgcaaaattgcttcaaatatttttacattttattcaaccaaaaatgtattctattattatatatcataaatttcagagcattcgggatcactaaatcagatttttaacattttttgcggcacatttccaaaaaacatggtgaatgtgcgaggggagaggtcccgccggaaaaaatttttgaaaatttgaatgcaatttgttaacaaattttgtccaaaaaggacaaacgtttaagatctttggctaatttttaagaaaaaataggattttttgggggctggctgtgccgattggcgccgcaaggggaaaatttttaagactttatatgaattttgttagaaattagcaatttttcagaaatttccctcttttagatgaaaataaggcactacccccaaatcagaacatttcttacaaataagaacatatagaaaaacctgtattaatttgaaaaaaataaaaataaaatcaaaagaaaacgtcaaccggtgtcgaactcataacaaaaactattgttaatgttgaagcactagccactaatccacaaatatatgtaaaaatgaaaataaaattcactttatttcataaaatttgtcaaaatgatttaaaaaaattcaaaattgtatatattttttgccttttatccacgaatatgtcattcttaggggtgtatttttcacccccgcgggggtgaaggtcgcgggggcggtggatacgggggtctgaatcacgggggcggggacgggggtgagccccaaaaacctgtcccgtccccggggacgggggcaggggcggggctcgaaccctactccgaaggaagctgagagagcaatggaaaaagcaatgtaacaatttttaaaacatttttcgttttccatggtaatcattttgatttttcctttttcagcttcatctccggcaacggttggctggcggtgttcaatttgctcgcgccttctcaattgggtctcggaattgcgatgatcagcaaccgttttgactgcttcgtggacaaacacttcaacatgcgcaaatgggcattgaaatttattggaagcatcgatatctcgtaaaaaatggcgattatgtaaaatttttttaacaatttcccatttttagattcatcgaccgcaatgccatcacttttctccaccgttttcgccaactcttcgcctcccgtccaattaatttgttcatcaatacacacaatgatcgtaatgcagaattccttttgcgcaacatttggccaatgttcggcaaaaacattcagtcttcggattgtccggcacagttttccgccgtttgcgtcaattggtctcatcaattctcaacgatcttccattgttacgcgttgtcgatttgtggactgtcaatctcgtcgccttcaacgaattttcggccgatgacaatgccaatgcttcacatggacaagcgttgatcaaatggctgttcactccgcgtccggacaatgtgccaaaagtgttgaaatacccgttggacatggatggttggattttggagtcgaagcttgaagtcttcaaagcggtgcttattaatatttgatttatttggcaattttacggtacacattgacaaaaaatgatcattcgcttaattaaaactgtgcgaaccaaattgcgcgtctttgggttttcatggccactccccaatcataaaagtgtcatacatttgttgctatttactttttcttaatcaattttccacattttaggtgtttgcctatgcttcttcccccgtcaatttcattgtccgcatttggcttcgtttgccttttgctgactccgttttggcctttgatctgaccaacgaattgacccgtgaacaattgaaattgaaaagaattgacgccgaattttttctgttccagtggagtaccttaacattcatttgtttctgtacaagtgtttccctgccggcaaattgagcgacgttggcttaatcccaaacgactggtgccaaccagggatggcacggaatttcgatttccgacctttttgaggcctcggaatgccatccctggtgccaaccgtacacgacgtacttgtccacgcattgttcatggcctttgatgctcaagtatttgggcggcaacaccgacactctcttggtgattccggtgaaggtcggcacatcgccgaaggcgaacgacgcctccttcagcacctcagggtccgtggtcatcttcaggctgttgcgcagctcatccgatatttccgcctgcagctgcttcactttgtccagcttctgcttcggcgtcttgtaggtgttctcgtaggcgtcgaacactttcttcatggccttcctcccctccaaatttgcatgagagtacgtgacaaagtcgtccgcagggctgggacgcgaccgcgatccgcgatgcgcgatccgcgattcgcggcgttttttttgcgcgatccgcgatccgcgaccgcggcaatttgaatccgcgatccgcgaccgcgggatttttctgtgcgcggcgcgccgcgcattttttagggcaaaatttttataaagaaaatttattgaagcgattttcttttttgaatatttagatttgaaggtataaaattttgaaaacgaccaaaattccaattttctcgcgcatttaaatggaatatgcaatcagaaaatatttatacattcatcgttcattttatagacaattttcctctttgtaatttagaccaaatgaccaacgaaaaagactttatttggttttattttgacaaaattcacaattcttcttatgccaaatgtaagattgagcttaataatcgcaaaaaccaacctttttttgttgaaaatctgttaacaaattgcacccaaatttttaaaattttcccctcggcggcgcctatcggcaccgccggaccccttctttcccaaaagttttttggaaaagcgctccgaaaaaaagtgatgtgaaaatcaaatctgaatttctattaatattcgatgatttagtccaaaaatgattaattgtttgaaataattgaagaaaatttgtttgaaaattttcattaatttaatttattaaataaaaaaccaaataattttgtattattttcacttgatataaattaaaatttgaattttttttttaatttttaaaatttttttgaatttttaaaatttcccggttggtcccggttcccggtttttcttgcggtcccggtcccggtcccgaaaaaaaatcgaggtcccggtcccggcttctcaggtcccggcaagtcccggtcccggttttggcaaaaattcccggtcccgtggcactctacttttttgtatgcaggatttattttgaatgacctccgaaaaagtctctcgcatgaaaatctcgaacggcttatttttcttcatcataatattatcctttacaattttgattattgataatatgggaattttctaattatgcttttacaaatgtgcgatccgcggcgttttttgcgcgatccgcgatccgcgaccgcggcaaattgaatccgcgatgcgcgatccgcgaccgcgggattttttttgcgcgatccgcgaccgcggcaaattgaatccgcgatgcgcgatccgcgaccgcgggatttttctgtgcgcgccccacccctggtacaaacgcccccgactccccgcatttacatttacattggcattgtcaagaaaaggcaaattttacttcttttttttgcaaaataatcgatgaaattgatccaaaaggaaaaaatgaattgttggcaaaattattgcagaaaaaaaaaatgtgtaagtgctcatttaaagcggctttagagctttcgattgaaattattagggttgtaaattatattgactaaaaaacgcgaaatatggacattaaatatggactaaaaaagcacgaaatatggactaaaaaggccaaaaatggccaaatatggacaaaatatggataaaaaatgccaaaatatatgttgtaaacccccaaaaatcccaaaaaaggtgtgcatatttaatatttgcttaaataaacctaaaaagtacaattaacaaccaaaaaatggggtttaaaacttaaaaatgcatattttttattgttgttcgttgtatcaaaaacacctccaagtttgccaaatttcgaaaaaattctcattaaaaaaaagaaatgttcgcaaaaaaatgactaaaatatttattgaaaatgccaaaatgacgacgaaaaatcaaatttttcgtgttttgtggggtgtaatttttaaaaatttccaaaaagttgatctttaggggtgtatttttcgtttttttttcatttttcttgtgaaaatttccaaaaaaatggccaaaatatggactaaaaacccaaaaatggcgaaatatggatttattcccgaaaacccccaaaatatggatttatatggactaaaaaccttcaccaaaccaaaaaattttaacgcagaaatgctatttttaagcccctttcttcatagcatatgcgcagaaaaaatatgttaatccatataatttacaaccctagaaattattttcactctttaaaaaatgaataaattcttataaaaaaatcaaaaagaaaaaagcgaaattaattaattaaattatgcgaatttataattatgacgaaattaatggagataataataataatatttattgactttcactaaaattattaatcgaataaaaaaatccataaaatttatattttattgggttgatgaaaaagttctgaccctttaagcacttcaacattaaacaattttttatttcacaaaaaacaaatgttcaatcaatgatgtactcaccatttgatcaatgatcctccccctcgttcgggcaacatttcaatcccctttttataaaactgatcatttttcgatccaaaaaagtcatccaatgcattttcgacctcgttttgatcagcaaattctttccctctcaagaagtgctccatagatcgaaacagatagtagtcacacgggctgatgtctgggctgtatggtggacgaggaagaaccgcccatcgaagtttctcaattttttgttgcgttgagaacgcaacatgtgggcgtgcgttgtcatggagaaggagtactttatttgattaattgcaaattatgcgtaaaaaataaacaaatacaattttttaatttttattattgaattttacaattcgggttttaatatcccaatttttcaattgatttgtctcgctaattgtgccgtcgctcgtcgccttcgtcccgccggtttgaatgggccaacgccgggctcaaaagcctcttgaaaaccgccggccggagactcctaaaattttgatggattctaagttttgaaattctttgttttacccccgccccgtggtcctcattaaacgccgtgccactgaattgagtcggattggtggcgccggggcgtctcccgggcgacgggtggtcctaaaaaggtgcaatttggacaattgcaaaagtgattaatgagtgactccgatcagtgccgggtacacacagaacgggttgggcccgttggcattggcctcgctggtctcgtctaaattggcacagttcggcgcgggaggcgcagcggcgggcatttcagcttaaaattgaaaaaaaagattcattctcatttaagaatattttttgcaaaatccacggaaccctttttttcattttgatcattttggacactgactgatcagttgcctcaatttgagcgaaacttagtctcgaatgggtgggcccaattgtgcggacggtcaatgggtttcgaataaattttcaatttttaattaccttttgactcatagccggcgattgttgctgaagtgaaggggaataaaaacagagacaattgaaacaaaaagcagcagcacagcatttcaattttttaattgaaaaaatcaaaaatataatagttaaaaaatttattcgttgattaacggaaagaattaa

SEQ ID NO: 1067 - DNA, 1012 bp, Heterodera glycines
cggggaatttgagcaaaagaagttaactgataaacagataaaacacacaaatgtatgcatatacaggcataaaaatgtaaaatgtaatcaatttaaatttgtcaataacggaattttctctcaaattagggaaattttgtatttattcgttcgtcaacaataaaaaaaaacagacggccaatgtcgaaaattggctctattccgccatattttggtcgtagttttcactcagcatggcagtttccatcataattatggacaaaattgggtgccaaaatggaattatcgacttttggccagacgatggcatagcggaaaatgtaaaatgagccgggggcttcccgttgtaggcgattccctcatcaggaataaaaattgactttatactagagttgagcgggaccgggaattttgggcaaaacggggaccgggacctcgattttttttcgggaccggaaaattataaaaattcaaaaaaatttaaaaaaatccaaaaaaaattttaaaaattgaattttaattaatttcaattgaaaacaatacaaaactaaatttttattttgttaataaaatccaaaagttaaagctaaattaaattaatgaaaattttcaaacaatttttcttcaatcatttcaaacaattaatcattttgggctaaatgactaccggtattagaaattcagatttgcttctcaatcacttttttcggcgcgctttttccgaaaaacttttgggggagaagggggtccggcggtgccgataggcgccgccgggggaaattttgaaaatttgagtgtaatttgttaacagattttaaacaaaaaagggtggcttttagtattactaggctcaatttgtatcgattttctttaaaaaatgataacaaatgtggaaattagacaaaaatatgaggaatcataaatattttgtcgataggaaaccaatgagcctacaaaaaggaaattcaaaatattttaattactgtagagggattgaactaggtgaaagaag

SEQ ID NO: 1068 - DNA, 4486 bp, Heterodera glycines
  misc_feature (15)..(15): n is a, c, g, or t
tgaaatttggcattntaattttacattgcttttgccatttttttctccgcttcttttcggctgtctgacattttgttgttggcaaattattaagacagttttcggcacttaaatgggctttattttcttcaaaaattcacataaaaaatgaatgtttttgcataaaatgtcataaaagatgttggcaataaaaggaaaggaaaagtgagtaaatgaaaggaaatgtgggagaggatgaatggcttttataatcgcgaaaaaattttgcaaaatgcaaaagcatacaaatggaaaaacagtaaaattaaatttaaagaaattcgtggattttgttggggttgaaagtttttacaggaaacagatattccacaaaggcacacaaaaatttgcagcaaaattaaagcaattaggtaaaatcaaaatccatttgattaggttggcaactgaaaaaagggaaaacaaaattaaaaattgaaaattggcattttaatttaattttacattgcttttgccatctcttttttcgcttctttcccattgtccgacattttggtgagggcaaatattaagacagtttttgacggaattaattagctgattaaattgttgaaacaatcatttttttataaaaattggagagaaaaaaaaactgcgtaaatggtcaatttgaatggaattcttttcgtttttggtttttgtatatgaaaacaaaatccgttttttaattcgttcaaattaaacaacgaaaactaacaaaaaagaaagaacaattggaattttagccgggaccgggaaccgggacctcggaggaccgggaattcccggcccggttccggtcccgctcaactctactttatacaaaggccccggaagggtcgttggatttgccgaaaggtccataaaaaattaaaaacactgaaatgaacagaatagtattttaatatattttaaaataattaaatatttttcgcaccttttaacttttcaccgaaagcggcgaatggaaaaagagagaaaaggaaaaggtgagcccagacagaacaaaacaaatggtgagcccaagggaggaaaagcagaggtgccattctgagcaggatgtcttgccaactaatcgacaatggacgatggcattttttgcctccaaaagagtgcgggggaaacggagcaatgaatgggggggggagggaaaaagatgaaaaatagcagaaaatgccatcaaagacgtacagaacggaagaggtaaagaaggaaaggaatgaggaaaaggagaaaagaccaaaaaaggaaaaaaaagggggggggaagcagcaaaaagcaacggcttcagaagcgagcgggtggaaaatcgaagcgagcgtatgtatgatggagaaggaaaaaagcccaccctcagcagaagcactcgccaagcccccccccccccccgggggattggccggaagggacaagcgcagcacacagagacactcactcactccccgcccctcccctccccccgctcatccattcgcatcaatgatggattattaagacaaaagccaagtaggaaaagggagagagagggcgaaagaacagaagaaaagcgtaagcgttcgattagcaaaaaaaaatgagagaaaacgcggaatttggaggggggggggggggggagaaataaataaggaaaaatgaaagggaagaaaaaaatgaaaagttggacggacagagaaaacaacggaagcacttcccctatcataagggcttcaaatgttttaaaaacaattcggaagcaatttaaaaatgttaaaaaagtggccacgaaccaaaaggacggaatgggcaaaaatggcaataaaaagaaagtcagggcataattgaacaaaaataatgacagcatttaatggcaattgaaaagacaaaatgccaacggaaagaatgacgaacgaacagcggacgaattcattcggatgaggcgaattcgacttatcacagctgttactgacaattggaaggaaaaagtccacaagtgattttgaaatggcttttcattcgaacgtttttctctttcggcgatggatgaaatttgggaaaagggaaagaaaagcatgggaaagaacaaatttcgatggattgagaaagacaaaatctgatgagaaaagaaagtgaagtcccccaaatgagaagaacataagaatgttaggtaagcatttaaaaggttgcatgcaacagccattcttcgtaaacaaacctttttatttccaatgtctaaattcttctgctgtaataataaaatcgctacacaataaaattcaacaatttttgatatcaaaaaccaacaaaaacaaacaaatgaacgttgattggaagcatttaacagattgtactacggcaaacaacaatatggttgatttgtgatggcatttcagtttcataacaataaattgttcattatttaatttgaaaaaatcagtttttcttttggagtgcttttagaaaacaaaatcaaaatagcagaaacgaaaattccaacacaaaataataatggtaatataataataatattattaagagaatccgctgaggtgaaatgaacgaagggagagaaaggacaaccaaatgaataaataatggagatgacgccgggcgaagagagcggagaatcgtcggcagcggcggagagaaaataaacgaagattaagattattattgtttttttcggtcgtttgtttggccatcgcactttgctcaaaaagcagcgcctcactcaacgatcgctaggagaggaagctgaacatggacgaggcactgaaggaagggagagagaggccaaggcttttcccacaattaccgccccatttaacttactattgcattgctcggacagtcgggtggggcacggcttcgaaggagtgcactttgggcgggtacaattggtcgccagtgaatgtgataaaggcacctttgttgccaatggtgtcacaacttttgaaagtgcaattaattacaataattaatttaaaaataaaaatgctttctttgtaatttgtcatttccttctccctaacctaaaacggaaactcactaattcggtgcgctgaatattgtccagcactttccctcgtgatggctttcgtatccttccggcttaacctcgtgactcctaaaaggcataacaaatgaaagaattataaatttttaaaacacttttacctgacaacataaagcaaatcattgtctttcaaaaaccgttctgttacgtcaggtccgaactgaatgccgacgccgcgtttggagggcgaatagccggacaattcttgcgggtccgacctgaaaaaatgacagcgtaaaaagtcggaaacaaagcatttaccatagcaaatcgcacattattccatcctccgggggctgtcggtttcgattggtctttctgatcttaaaaataaaataaatgcaaaggttgttccgataagagaattaaatggcaccttctccaacgttacgccgtcttctttaaacagaccgccatggcaaacctgagaagccatttattacgaatgtaaatacaaagggaaaaacccacaaaaattttcgaattaatgacatgacacaaaggaagaaagttgaaaatttcagtgaaaagctcagccatctgaaaaaaaaatctttggaaattctgtcatttaaataagataaaaaaataatgatatttaaatttggtatccaagaaagaagaaacagacctttgcagtgtatttgctcttcacttcgccctcaaacccgtacattttgttcatcacatcgctttcatggttaccccgggacatgaaaaagtgattgggaaacagcaatttgaagccgaacaacgtgaaaatggtctcaacggaaaaggagcccctgaaataacacgaacaaaattatgaggggaacaacaaaatgaaaagacctgtctacgaagtcaccgttgaacaggtaaggattgctttcagatggaaacccattgagttcaaaaatattacataaatcgtagaattgaccatgaaccttaattttgtacttggatcattgtcaaatgttaagaaacgacttacgtcaccgcaaatggtaaatttctgtttgtcaggcaccgaaatgtcaaccaaagagggcaattcaatgagatatttcctgatggcaagcaaaatctgtaaaaaaaatagtgatcattcttcatcaccctgtcagtcaattatgaatactttgtacgcgtattgcgtgtgtaacttccgctgatctttgaacgtggcgatcatttcctccatgaactcaacgctgatttccccgtccaaatggggccccgagtagtcactttcgatcgctagcaaatacttttcaatgaaatttacaccaagtctttaaaataaattcaaaaagtatgtcatgaactaaccaaaatcttccaaatttaatgtctcggccacacttctgcaataggggtcagatgcaattgctttttcgaaagccaattctc

SEQ ID NO: 1069 - DNA, 4012 bp, Heterodera glycines
tccgccaatgccaacccatacaattcgcgcctcaaataggcgaaagagcgattgccgtaataatgggcaattgaagggtccaattcaatgcatttgctgtacaattcggacgccaagtcatacacctcatctgtgaagaacaatcactgtgagaaggaagaaaataacgaaaaacccttaaaaaattgattggccttctccttcagagcaatcgcaagtccattggcatctgttaacttctctttgcaattgttcaccacatttaacgcacgttcctcagcagtcatcgcaaaaaatttcagttttgttatgaagacaataaaatttaaaaaatttaatggcttatgagtccattccattaggaaaaagcgaaacaaaaataaattttctattaaaaaatgaactaatggcaactcagaataattcttctgtccccttctgtttcggcatgttctgctcaattttctgttgcacaatttccctttgtaagttgttttctttgtaaagctcctccgcgtggcgtatttctgccaaatattgcacaactttcctctaaaaaacccattttgtctaactaacccaaaaagtaaattagtaaaacatacacccaattccacttgcttcactctccgattaaattccgactcagtggtgaaaggaagcctacgaccatccacaaaactgaaatccggcccacgctccaatggattgaccacgggactttgataaatactaaataagacattaagaccaatccaaaataataatttaaaacacttacggctttttccaccattgaggtccaatgcggtaactgctgctggtactgttcatacatttggacacgatcaaagaacaagaatttcttatgtttctcataatctaaaaatagaaattcggtgatggagttatacagtgttaacgatacacaatacaatagcagtaattaaaaaaggaagtaaaaaatccgtatgaggttagagttcaaagcaaatttttaaatttctaactaactacatttagccaataatttatttaaaatatttaatgaaaaaatgactggttggtctaagaccagagcaatatatgattagctgattgggcaaatcagcttaacattgtttcgtagtatcgacataaagttgctttttagccatacaatatttgcttagatggatttgttaaaatcttacgacggctcttcatcatcggacaatgaacaagaattggcagatataccttcttcgtccaatcacaacaaattgctcgctttgaaaatcccatccatcaacttaacacccaacgtgattgaacaacgcgccattcaacaggttgcggttgtggatccaaaaaccaaagagttgtatcacaatccgcgcttcgacgaattgtttagaccagaggtagtgccttatgtcttattgtgtagggttagttatatcttttaatatttgtgatccaccggatttcgaacccttaaatgttttccttttgtgatagtgtaataaataaatttttccctcttcagagcggcccacaaaatccgtttaaaagtgaacatcaacgagcagaaaagaacacactgaccggctatgtggagccagcgcatttcaacgccttccattttgagcgttcacttcgctcctacgatacgcttggctatgcggataatccaacggcagacacaaccagcgcaaagttcgttggtgacgttggacaagcgcaagaaaaggccggcgagtcgctttttgaatcagtaaaaactggcggacagaagcgaaagagagtgataaattacgacgcatcaaacgttgacggatatacgggtaaaaacgataggaaatactaattgtaagataataacttcatttgtaaaggaccgtgggcaaggtttgaggacgagaagacaattgctcgaccggacccagaattgcagaaggaaatggacgaaattgtgcggaaacggaaactgaaaagtcgtgctggccgaagagcggccatcgcggaattgcatttggcagaagagagcaccaaattgcacagtgaacatttatcttttttcaattccataataaaacaattagactttggtttcatattgcactttatcacaccaaatttaattgcagtaaaagatgacactgactatttgggccgttcctttatggaaccgccgaaatacacgggcaccaatctgcgcgaggactttgtgcccgaccgctgtttcccgcccacaaaacaagcacacacctacagcagtcacaccaaaccggtgaccgccatccgatggtttcctcgtagtgcgcacatgtttatctcttgttccatggacggaaaagtaagacggatacaccggaattgggaaaataaacgtacggcttcaggtcaaattgtgggaagtgtacggcaaccgtaagttgatccgcacatacactggacacaaagtgcccgtgaaggacatttattttaacaacaccggcactgaatttctaagtgccgcttatgacaattacatcaaattgtgggacactgaaaccggtgaattcttcaatttaatgttcaaatatttattttgtcatctaaaggtcaggtgaaaaaccgctacacaattggaggccatcgggcgtatgtggtcaaattcaacccggacgatgataaacaaaacattttcatggccggaatgtccaacaaaaagatcatccaatgggacacgcgaactggcgaaatcgaacaagtggaaaaataattcaatttttgaactaattaatgtaattttttaaggaatacgaccgtcatttgggtccagtgaactcgatcacctttttcgacaaaaaccgtcgtttcgtttctacttcggacgataaatctcttcgcatttgggaatttggcattcccgtggatacaaaactgattcaacatgctggactacattccattccttcaatgactagggcaccaaatggtgttagaagaatatgcaattttaaataaatgttaattccagaaaaatggatcgttgggcagtccatggacaatcgaattgtccttttccaaatcgtcgatgacaagttgcgattcgctcgtaaaaaggtggttttacgaaaaagaatttttttaatcgtgccttacaaattaggccttccgtggtcacaatacagcagggtacgcctgctcaactgatttttcgccagagatgaggttatctagcacataattcaaaaggcattcctttcttttttttcttagttttctcgcttccggtgatgcggacggtaaaatcacaatgtgggactggcgcacacacaaaattgtctccacatggaaggcacatgataatgtgtgcatttcaacactgtggcatccgcacgagaaatcgcggatgatttcttgcggatgggacaatgtaatcaaaatgtgggtctgacaatgaagtaaagctgacgacgattcaatgatttaaagtgaatttatttgtaatgtctcaaccgataaaaggaaaaacgtcctatttttttatcaactacctcaaaacttttatcaaataaatgaaaataaataccttaacataaataatgtagcaatctatcaacattaatcacatgtctcactgaatctgggcgtgatacggtcacccttttatttgtaacatcgggaacttgtcgatttgtcagtcacctaggctgaaatacaaggaaaggaaaaaaattagtttaaaaaaagaaaagtaccaaaatgaacaggcttttcggcacagaattgaaagtgtgcttcataatcaaatgattaagttgttccaaatcctcactgccgaattccaaatcagcatagtcaggaatggaagagacacagcgaatggtaggttttgggaaattgacgaagccgagcgaaattgggacaacgcactgctcaatgacacgctcatcattggggaaaaacaaaaaactatcctaaatatggataattaagtattcacaattcatagtctaaatgtacaactagtataatacaataa

SEQ ID NO: 1070 - DNA, 5202 bp, Heterodera glycines
  misc_feature (1177)..(1177): n is a, c, g, or t
  misc_feature (4432)..(4432): n is a, c, g, or t
atgtacaactagtataatacaataaaaacaaattgtaatttttctgacttccaaaattccatctatagaagtgccagcagactgctcgaaatttaaatgcacagccaatggtcccccagaagtgttcctcaagtaatatctgatgcggaatggtttcagaattctgaaacaacatccactaatcgcttcattagtctcttccccgtcgttctcgttggccaattccacatttagtgtcatcggaatgaccaaaatgggtggcattgtgggcaatgccaacacggaacgaacatgttcaaaggaaagagtgctaaagatgttcgaaattagttaagaaatccggtgcggtctcttccccctaacctgctccactccaccaccacgtctccgagctgtgtctggtgctcgtcgtcccctccattgctttgtcccgtctctctcattggcgattggccgtcgccatttgttactttcacccaaacagaatgcgtgttgaggaattcgcttgagtcaacagatgaaattttgagtttttcgaagtgttgctttatcaaagaatccaaaggaatagcgtcgaaatgttcaaatgcgtcattctcaataaatatttaacgcattaatcctttactccaaattcaaattgactgaccaatttccaatgtacattatgcactgccactcttccgttgcatttgagttgtaattgcacccgaaacttttgcccaaagaccaaacattgtgcctttcctccctaaaatgcaaagaccaaacgtaaccgatgaaattcgatttctcgcattttcacaaaaaattgcgattttcggttcgaaaggatcaacgcaacggatgggaaagtgctgcaccaattcggcaggctcttccaacggttgaccttcattttctgattttgaaggaagggtacaacaaacctggaaaagaaggtaattttatgggaccagttttagcccaaacttgaacgcgaagggaaatgcaattgttagatttggattgaagccgaatggagaagtcagtctgaagaaatttaaaagttaacaataagatgaagtggcaaaacctaccgattgttcaggcgcaagcaatgaagcgagctcctaaaagttattttgtgtgatgaaacaagttattgtggcgatttatgcataatttgcctggctanacattggcaccaaaagtgtcgttgtctttccgtccttttcgtcgcctatggacacctgctgctgttgcttatggcctttacaagacggaagaacaaaagtccgtcgaatgacgccagggattggtgattttgttgctgccaatgagtttagtgtgtgcgaattctgctgctggttggcgaactcttcatcctcacggcagactttgtggcagattaccctttatagaagtgtaaagagtaattactagttcaatttgaaaatagtttttttcaatttgataaaaaaatgatcaattctcataaaatttaacgaaatcaatttatcttaggtgaagttaagcgccatcggaaaaagtgtaccaggctcaccaaatgttcttcagcagtgttccgttgcgctccgcattacaaagggttaaagtcaattgaacgcattcgtcaacaaataattccaattcggtgctatcagccaaaattggacaggtcagtaacacattgcaccgttgtggtcgcaccataaaaatgatttgtcatattaatttttgttagctgattgttaacattgtttacttcactgcatagttgttcttgtccatctcctcaattgaattttggtgatgtctattactcgtcgatcggtgatcgatgtcccagctgagtgatccggacgatgtacgcaatgaaaagtgtcggacctttaaataatatgcatacacggcatagactaacaatcgaattggggtttacgagaacagaagacggtaaaatcaaaaaaatttcagacgaaactttttattttttccgtgtatacaatgcgaaattgacttcaccccacccaaactcctatttaccacgatgaattatacaattggtttttcaaatttgaataaatgcctaccgttattaaaatttccttggcattctgttcatccatcaacggactttggcatctgctagtcggtgcctttgaggctggcaattgcatcaattgtttaagagatgttgcaaatgtagttttgtagataaagaaaacgcggcttggtcttttgggaaccaataccaacgtagaattttttgacgaatttcccgccgtagaccattcggacagtgttttcgactttttggcaccggatgaatttaaaatttcatccagagtcaatgaacaatattcaaagcgcaatggaacattggaaatattatacagcacaacctaatcgaaaatgattaaacaaattttgtgttttctaacttctatcagaagagagtcatcggcagttgcaatttgaaacccgtcggctatttcttcgtcaaaagcaaatttttcatttgtttgtcgcttattgttagcagacgaatttataacgagaaaacgagcgttgaacttaatgggcgagtagttcaggttggacatttccaattggaactgcagaggtgaagacgattgggcaaccaattggcgccattgactttggaatgaattcagctaagaaaggtgaaagttcatgcagtgaaaaatttaattctgcgataaactaacttaatcttaccgggtgcaccacgctgcatcgatttccccgtaaaatttaaaaaaattaggtactaaaagaaatctttcaagaaaaaaaatcagtaagaaattttctcgaaaaatttggtatttttgaaaatcgggggggggggggcggaagagctgctcccaatattacctgttctatggagaaaattgagcgatgatcgtttgcagaactcgttaagggaaacggtagaaagttcagatcacctaatagaaaacgccgaagattttccatccaaatgctttggtcattttcgccgacagaaaaaacacgcaaagttacggatttattggccaattgcgggtggagaagttggagctgaacagaggcatttaaaatatagaatgcgaactgaatgtaaccacaccaatgcccacgtccattcgttgagacttagcgaacaaaaagcggcattggcaaatgaaaccaatgcttcacgtaaaaatggataaaataacacacttgtgtcctcaatgcataaacgatggagaatctaaggagaaataataaataaaaaatagtgtttgaataaacttttacttgaagagcctttgaaaactgttgcgaggcaacacactcctcggccatgtcaaacagcgacaaattggcaaacctttcgcaaccgtagcgcttacattgagcaacagccgcggaaagcaattgcagagaatgggcatagttttcatgaatgttgttctttaagaaaaatttgttaaccagctgtgggtggataccccactgggccatatataaaggggtgggaagggcagcggtgaattttgcgaaggggtccaaacgcaccttttgatgacctttttttggttttcaaaaccttttgcggcgcgttttttcttaaaaaaactttttggggagagggggtccggcagtgccgataggcgccgccaggaatataacagttttattaagaaatacacatatttttcaaaaattcgctatgaaccttccccacccctcggctgccctctttgcgagcgagggggggggggggggagtcgacgcccgcccctttttcatgtatgcattggacacctccagaaacagcttggcaccgtgttccaatagttgaaggctcaacagtggtaattttgtcacattttgtgctgttgaatcactcaactgcgttgtcattcgccatggcctttgcccgtaatatgtggttgtcatggaaaagtctgaaaatcataattttgaaataaaaatccaaagataatccatctatgtgagcttctctttaaaagattgccgaatgattggagagggtcgccggccaacagcgatttctgtctttgttgcggtgctgcggccaatttcgactttaatattctaatcaaagagttggcctttttgtaatgggtcgccgcctcgccgaggaaacggcctggattttgtgaaggataggccgcgagtccattggaaaccgcacggctgaacagttcagcaaaaagtcgacactaaaaaagcgagtcaattgacaatgagttaaattttgaaagattatggacgaaattatgtcaaatgctctatggatttcaacctgttgtgccttccaccaagtcagttcaatagcagccaactctcggcttgggtaaaaggccgactcgcgcttgaaaaagaagttgtggtgtcgcctgaactgattgatggcttcaacggcgctgtntagcacaaagttcagttcgcatattttgaaattgagcagactcgcgactgaacactgctcgtaaacatcaacatccgacacgtcaaactcatggcaaatctgataggcttgtttgtaatagctgaacaagtggaaaagcgcataatcaaaactgacagctcagcagacaaatgtaccgaagagcagaatgccggtcctcacggagctccgaaatgaatgccagtttgtactgttgtctgactagaaaatgggcatcattattcggcacattccgagaccgaattcttttgaaacaagcatgataaaactccttaaaacatgttaaaatttacaatgtcaatatatatgactcacttgtgcaatattgtgaaaagccttctctaagcgattgactcgctcaattagagcccgatcatcagataggcggggaaaaacgaacaaaagacgtgagttcaaacgacaatgctggcacaattcaagcgctttttcattcgctattgggtcgtccatggatgttgcctttggaggttggatcaacaccagtgctaactttgtctcccgctgaccaattttctgtctaaataaataaattgatgaaaaggatagcgaatttagggctcttaatccactttatgagtccaccaattaaccatacctgattttatacaataagtttgttcatgttcaaacaaaccctacctatttggtatcatttgaaagcacaaagtcgaaagaagctaaaatatataaaatatcagcgtatagataat

SEQ ID NO: 1071 - DNA, 837 bp, Heterodera glycines
ccgaataaatcattcattttactttattatgtcatttttcgaattttcttcccaaaaaaaaaaagaaatttcagattctaataggaaatgccaactgttcacggaaatatttgagagttctgcaaatgaagacggcgtactgaattttgaccggcgcccgtacgggaccgggcttttttcaaaatttttgggaattttgattaaaaattcgaaaaaattttatagtcctttattttagcttagaaatgtcaagccattgtaaatcgaccttttttactcttcaaaagaattttaaggtgtattttttcaaaaagattttgacgacattggtggggggggggggggggtccggcagtgccgacagggccgccgggtaaatttttgaaaatttgagtttggtttgttaacagatttacacgaaaaaatgacaaaactttgctattttgagctacattttagaaaaaaatttagctttttgtaactaggcgtcgctgaagaaaaactttgacttttaatgaaatttattaagaaagtttttggtttttcatgaaattcaaatttttttttttttgtaaaaagaaagttatgaaaatgttgttcaatttcatatggattttggggtctttttaagttgaaattgcccaaaaatttcaaaaatccaaagttctattgaaatttttgaattaaagacatttcgccaaaataattatttaaattttcaaattttggacagtttcgctagcggaatttaagcccgttttagcccggtcaaattgaccgggcccgggaccgggaccgggcttcgaaaattgatcggggcgggccgcccgttcaaaa

SEQ ID NO: 1072 - DNA, 1329 bp, Heterodera glycines
  misc_feature (66)..(66): n is a, c, g, or t
  misc_feature (1171)..(1171): n is a, c, g, or t
aattattttagctgggactgaaatgggttatcaaatggcgtcgaggaacggatgaatgccgcatgnagtcatggaatatcaaattcggcacccccccccccacattgagaagaaacggacttggatcttctaattcgatgaaagagattgaattaaaaaatgaaaatatatttcgttttttattatattcttccataaagtaataattgtattatttgtagttcatctactatgttaattagtgtacatggaaaattcttcatgtgcttttaatcaacttttacaaatatgatcttaaacacatcgtctcaagattaatgcattggaaaaaagtcaatttttgttctttttagagttttggtttttgcaaaagaaataatttcatttgcaattttaaaagaaaattaataattaattaatataatttatttttgcactgggttcttcaatttcgaatcccactgatcagtggaaaagacattatgagagcttgtaagagagtaattaattaatgaaatatttttaataggaattattaaggtcatgggtagggatgggattcttagtttttcaactatttttctgcggctttatttcgacgagaaatacacgaaaaacacattctttttcgaaaatttttcatttttaatgccactattcatcactaggaatcattattttggagcttcgccaataaaaaaaaaactatttcggaagttggccactaaaataattttttgccactattttggcgtttcgtcattatttttgccactgttttggcatttttggaaaacttccaaaaattgcaataaaaacgaaaaatacacccctaagaatcgacctaaaaattttcaaaaataccaatttattatagtgacctaaccaatttattcataggttttttttcaattcgcgcggtcttctttctatttatttttattcgcataatttagttccatttttcagcccatcattgcttttaattgtaaaacaacatataaaattatattaataaccaaaagaatgttttcaaattttaaaaatcgttgggccagagccttttttatccgatgttaaagcatgaatttgatgctttcagttcaggcaatcgcgtgattcgcccgaaaatccgccctcgagttcaatgcgcccaatgtcgtacaatttnggacgggtttttgccacttgacacataaccgtccttgattttaatggtgaatttgcggtcgcatggctataaaaataaatgattaaaaaatagattgccacgggaccgggaatttttgccaaaaccgggaccgggacttgccgggacctgagaagccg

SEQ ID NO: 1073 - DNA, 9498 bp, Heterodera glycines
ataaaaaccatcaataagggcgttcgccaatatgtacagattagctcagaattctaaaaatataatttttcaataaatgaattttcaaatattttcaatgatgaacaacggattaaatatggtgctatgtcgtttatttaaaaatcatcaaaataaaacatgttgcttttaactttgacctaaagcaaccaattttatcatttgatagcccaaagtgttctctattagcatggaaaatttcaaaaaaatttattaactcataaataagttattatgaccaaaaatgttcaaaagacaattttgctcataccttttctgaaactaaactaatttttttatattttgcagactgatacatagagaacatttaagactatcgaccgaataatcaattaaaaagtttgttgctttggaacaaagttgagatagagaagaagaagcttccccgagaggaagattaatggatcaattgaggcaacattgatcctatatgatcgagcaaagtggggagctggagagggcagggtcggtagttcagctggtagaacactggtccggaaagccagagacgccggttcaaagccggcccgccccatagtttttccctcaaaggcttccccgctcgttcatatatttcaatatcataagattcaatgcggcattcatctgtcccacggcgcaatttgaaaagtccgttcagttcccagctaaaagatttaaatggatagatgatgaaattgctatgaaatttcaagcctgtaaccggcgtcaggacaataaaaatccatcatggaaaatccattagtaatggacacaaaccatcggtaaaaattttaaaatactgaaaaaattatacaggtttttacggcattataactcgttgaaactaatttatattgactgttaaaaatatagtaaacaatttttatagaaattttgataaaacaatttactgacggattatctttttgttgaaaaaaggtatgctgtgaaatgaaatatttttctaaaatgaaacttgacttgaaaacttagatgcccccccccttcctaagccagtaaattttttttctaatttagggccagataaacctaacaacacatttttacctattgccccacgaattgacgcccagccaaaacttgatcagttcgccatttcccgtggtttcttcaccccatccgatcagtttcatgtcatggatgaatggatgctcgtcgtttttcttgtgctgatcaatgaaaagtattttattttatccttttggctcccagaaaaaaagtcagtgatacataattttgaagataagattctgtagcattaaataattataatttaaaaggatcaaaattatatgagaatctcattgtgaattcgtcagtcaaatattattttatgaaaagtttaaaaactaataaaactgaaaattgtttttttaataaattttatttttatttcctatgttggctttttatttgtctttcttcttcagatgcagccatgggacacaaagtgcgaaaacaggtgattttttttcaaattatgtaaaaaaattaaataattcaaaaggaaacaaatgcacttatatttaattgctttgataatgtcaaatgttttatttatgcactttttgtccattgctcaccccacttttaaaaattcgttctttacctgcgtaaaattttttcgtttagtcaagaataaagaaagggtttattttacggatttgctcaaaaatttcaaaaaacttcacttgttgattgaaattttgccatcaataccctcaaaaagcccaaatttagactaaactctcaaatatgagggcctcgctgttcattgtccaccattatccacttaccgcgtaaacattgattcgtttgctgcttttaccataaaattcaaaatccaataaacgcccaaggtggcggtttatttgtaactttccattttttttaaattttttaagagattagccctaggcctctcgtcttccttccctgccatacatataattatttctgtcattgttcactttttcccgcttttactcactgaacactcttaacgaccataatagctctcaaatgacaattagttatctctttttttattgctgtttgaccaaaaatgcaaaattttaatgaacttattgggtcggcttaagtttacgtaggtgtcatgacaataatttaatgtcttctgatttttaaggcgataatcttctcatccttttttaaagtaaaggaagaacggatgaagcaataaaattaattttatcaattttaaatcactaaaatatttctaaaaatatttatttaaacaattcctcatcactataataatcatgaacaatattctaaaagtctaattcggtatatcgcttgacacatcatattggtttggtcacccatcagttgtgaattgtcgtgccgcaaaatggcgagtcaaaaagtgtgccaaatttgtcgtcgaatgcggcacttttggcactgatcaactccttttctgcctcgctgttctcttctgctgaatgctcttccattttatcctccatcacttttagctttcctctttctctcgttgctatttgttgtgccactttcagcatttcctttagcgttttgtcaaattgctcttttttgtccgattggcttttccccttaattgctgcttctcctgcctcattaaacgcgcctttaaatatttgctcaagttttccaattgaaattgacgaattttcgaaaacattttcaaatttgtattctttgcttttgctaaatttcgtgtcaaaatagaatttggtcaccatgttcagcacttttatgacctcaattaaagtcccgaaaagttcaattcttcgaattataatctgagaatttatagcaatcacggggtcttcatctaaaaaaagtaaatttatttttttgtataaaaatttagaaaattttcatagcaaattgttctcttgggaattaaacaaaactactttggtatatccttaattagaacactattttctcgatactttcttatccttttcaccttttacagtactatttaaaaaacaccgtataccttcacggaatacgtgcaacaaatattcataaaaaatgtccaaataatttcggtatttttggcattctctccgttcgttctccgcaaattcattcccaattttggcacagtgccaattgtccatcatcaaagacaaaatgccaagataagccgcatatttttcctgcaaatgtatttttctctgctcagcatttgcctctgctgccattccattgcaaatgttcgccaattcatcagcatattgcaagcaaaaatgttcaaaattggacaaacccttcacaaatgcattaaatgctttgtcttcagtctaaaattgcatttgtgggaaatgtttaaagccatttcgaaatttgaaaaccattatttggcattaaaagctcaaaaaccctcagaaaatgtgaaaaagccttatattttcaaatgaactcataattcctatacatataaaagttttggcgccagtttttgtgaaaaggcttaggaattggtcaaaatagatgtagattcgtgatcagggactccaacatggatgagtttatgattagacaatattttacaacaaaaaaaaatattacaaattaaaaaggcccctttttggttttaataaaattcaaaatttccacttttaaattaccgccaaaacttttagtagacaattttttcgaatattattcaatttattgaagtctaggcgcgagagaccaagctctcgtcgtcagagatcaacagctgatctaaattttgtgggctttgagtttacaatctctcgtcatgcctagtttaattataattggtgatacttacccttgaaattatgtcataaaatggcttttttaaaaatgggttgtaaccttccaatttgttacccttttcatggtccctccactttttaagaatgcttttcaatttttgatcaaatttgttgcgaagtgtttcagttgaattgccaaaatttgctgtgtaattgcccagtttgctctcatttaacagagtcaaccatggcaacttattggcactcatataagctttatattcgtcactctttctgtattctgaatcaaaaaaaattcttgaataatcaaacagttcattcatgataaaagtttgtgacacttgatcattttggcgttgaaattttggctcaattatgggaatttgttgagccaagagcggttcttcatctgcaattaaaaatgataattaaatttaaaaaccagattctgtaaaaaaatagattaaggagttgaattttggaaagaaatttcttaaaataccgaaatttggcactaaaattatgaaatttgaaaaaccccattattaaggctcgaaattgtatggattaacatattttttctgcgcatatgctatgaaggaaggggcttaaaaatagcatttctgcgttaaaattttttgattaggtgaaggtttttagtccatataaatccatattttgtgggttttcggaaataaatccatatttcgccatttttgcgtatttagtccatattttgttaaccaaatattgaatattttggcagtttttagtccatattttggtccatatttggccatttttgagctttttggtccatatttcgggcatttttagtccttattttatgtccatttttttagtccatataatttcgagccctacccattataaatcaatcattacttttcgcatataccatgaacagatactcataaagaatgtgcaaatatttctggatcttctcgcattccttcaccatctcttcatcccccataatttcttcgaccattttggcacattgccaattctgtctcattaaatacaaatcgactaaaaaatactcaaaacgtttttctaattcttttgtggtttgttcacccctttgtgtttcttgacaatattgataaaatttgggtggagtcaaaaattggatgaaaaggcttttttcgatctgaatgacataatttaaccgactataaaatttaactttaaaaatgttatggctccaaaaattttagaaattataaaattgaatttaaaatgctttattttattatttgtttttcgaataatgtttcactgttaccttcattctttctctgcggattcctatttcgtacaaataaaacaaaattttgttcaaattttccccatcatttggccacaaattccattctgagaattgtgtcccaactgtaatttgttgtccgattagtgattccattgttgtttgctccatttttctaaatattttctccaaatttttgccaaatatatgcctcattaatttgcgaagactttcatttcccgtctcaagtgccgtttgtacaatgatatcctcaaatgtttcgtttgggttgtccaattcaactttgtagtccaatttgtcctcattggccaatttgggttcgtaatattccaaaaaatatctgtccaatttgtgccctttcattttgctgaatttcgaatcgaaaaagaatttgaaaagccagctaagactaagcatcacattggacaatgtgcagaatgtgaagatttcggcaaaataaaactgcggtttcactgctggcagccccataaattcagtgaacaaatattcgtacaaaatgtccaaataattgcggaatttttggcattttctctgctcattgtctgcaaattcgctcccaattttggcacagtgccaatgccgtcgcatcaaacacacaatgccaagttggctctcatattgaagcatcaaatattccttcattgtctgcggtggcggatattttatttccaaatcattgagctcttcctccaccaaaaattgctcaaaatttgactgtcctctcacaaatgcaagcagcacattgtcatcgtcaaactgttaaaaatagcgaatttttttaaaacatttattttccagacagaacagataaaaaattataaaattcattttaaaatacgaaaattttaatttttggaattttatcaaattacaaaaaaaagaggataaatatcggtcatattaaaaacggtctgaatcgatataaaaggtttgaaatgggttgaaaaaatagaataatttttataattttttactgcttaggatttggcactcaaatcctggcgctttttggcctgaaaagggacaagcgcgccctaattctatcactcaaaataaatcttattatgttcaaatatcaaaaaacattaattctaactcaataaattagttttactttttttcttaacacaatttttagggggttaaaaaatgccatttaatcaagacgaaatgcgagaatcccaaccgatacagaaaaacccgaggatttcccaactcagaaacttgagcgactctaattcttaccaattgctttgcgtctgttattgttgggaatgaaattagaaaaattaatggaaaaagcattttaaaaaagaaataacaattctttagataaatgtgaaaaagccatttgctaagaaagcatttaaatactcataaatatttttttatttgattacatcattggataattgagttaatttttccatagttaaaatcaatttgtggttataattttgacaaaataaaatttcaattcacttttaacgattttaactcattttatttgtcaatttacattcattcacatgcattcgtgaaaagtggaagtgaggtaatacaattatttattaaaaattttgtaaatattttccaccattttttcttatatttgttggataatattttttggggaatttttaacaatttttaccttattttttaagtcagtttacgtgaaattcaccgcgcagcttccgatgaaaatttgagcataaattattattaagctagaatcaaattttcaaaaagtttaaagtcttatagctaataaacaagctcttaattaggacggtatcccgcaaaatcccgcgccgggctctattagaggatacaattttaaagttcttaattaaaaatgaaatttgttgaaaaattttcggtttttcgtttcgtttcgtacgaaaatggttattttaaaattaaaactaaccaacctaaatacaactattagaaagttttattgaaaaaattgtaaaattctagaattgataatatagtaaaacaaaaatttattttaaataaataaaaataaaaaatcattaaataaagtaaattttcaagtgggccacgatttacaaataaatggcgcagtggggttgtgaccacaaggtagaatagtacaaattgggtgctatgtcgttatataaaaaccatcaataagggcgttcgccaatatgtacagattagctcagaattctaaaaatataatttttcaataaatgaattttcaaatattttcaatgatgaacaacggattaaatggtgctatgtcgtttatttaaaaatcatcaaaataaaaaatgttgcttttattcaagcctgtaaccggcgtcaggacaatgaaaatccatcatttcatgtcatggatgaatggatgatgctcgtcgtctttcttgtgctgatcaatgaaaagtactttattatttatcccttttgcccccccccccttcctaacaaagggaggtggccaagtgtccgtgggatttcggaatgagattttttgggtagatagagcacacctgggttcttaagaaaaatgttttcaattctgccaaatggacccctgtgccgagataaaaaaatgccaaactttttaatgatgaaataaaagaaatacttatttgtgtctcggcttcttgtgctgatcaatgaaaagtacattattttatccttttggctcccggaaaaaaagtcagtgatacataattttgaaaataagattctgtagcattaaataattataatttaaaaggatcaaaattatatgagaatctcattgtgaattcgtcagtcaaatattattttatgaaaagtttaaaaactaataaaactgaaaattgtttttttaataaattttatttttatttcctatgttggctttttatttgtctttcttcttcagatgcagccatgggacacaaagtgcgaaaacaggtgattttttttcaaattatgtaaaaaaattaaataattcaaaaggaaacaaatgcacttatatttaattgctttgataatgtcaaatgttttatttatgcactttttgtccattgctcaccccacttttaaaaattcgttctttacctgcgtaaaattttttcgtttagtcaagaataaagaaagggtttattttacggatttgctcaaaaatttcaaaaaacttcacttgttgattgaaattttgccatcaataccctcaaaaagcccaaatttagactaaactctcaaatatgagggcctcgctgttcattgtccaccattatccacttaccgcgtaaacattgattcgtttgctgcttttaccataaaattcaaaatccaataaacgcccaaggtggcggtttatttgtaactttccattttttttaaattttttaagagattagccctaggcctctcgtcttccttccctgccatacatataattatttctgtcattgttcactttttcccgcttttactcactgaacactcttaacgaccataatagctctcaaatgacaattagttatctctttttttattgctgtttgaccaaaaatgcaaaatttaatgaacttattgggtcggctaaagttaacgcaggtggcatgacaataatttaatgtcttctgaattgtgaggcgaaacagccccccccccccccccttctttttttttttttcttttttttttttttttttttttttttttttttttttcccccggcctctttttttctttttttttttttttttttttttttttttttttttttttttttttttttttttttcccccccccccccccctatcgaagcataaaaatatatatgtaattgtaacgatttaattataatatagaatggcaacaaacattgtaccaccccccccccaccccccccccccccccccccccccccccccccccccccccgcccccccccgccccccccccgggggggggcggcggcgcgcgcgtccttgtttttttttttcccccttccctcccccccccccccccccccccccccccccccccccccttctttttttttttttttttttttttttttttttcccccccccccccccccccccccccccccaaaaaaaaaaaaaaaaaaaaaaaaggaggggggggggggggggggggggggggggggccccccccccccaaaaaaaaaagaaaaaaaaaaaaccccccctcctttttttttttttttttgagaagaaggaaataatttttttttttttcccccccccccccccccccccggggggggggtgtggggaaaaaaaaaaaaaaaaaaaaccccccccccttttttttttttt

SEQ ID NO: 1074 - DNA, 2338 bp, Heterodera glycines
  misc_feature (188)..(188): n is a, c, g, or t
  misc_feature (231)..(231): n is a, c, g, or t
gaaaacgaagaagaaaatgatgaggaggatgaagacgattttgacgaggacgacgatgatgaaccatccgacgaggagacgctgcgcgacattccgctcgacaaaattgacatttgtgcttcatgcgattgttcaaggacaaggacgaagatgaacagggcgaccgcctgatttgtatcagcctggcncaggtggggagttcaagcagtaccaggagggacaacccctaancccccatttgacattttgccgctttttttagcgcttcactgatgaatcgcattacattatgggagcgtcggacgctagtcaactgcccatggatgtgccgctgatctccatcaaccattgtctcgcggatttcatcaaaccggaagacattgaaggctcacgctgtgcacagtgcagcaacgcaacgccaccgccgtctgcgccaccaacgcttgtcaagcagctgatgttcacgcgattgcccgacattttggtgattcattaatcattgattaattgatcatcgattgattgctccccttttttgccccttcacagatcatttgtttcaagcgcttcatctatgaaccatttgagcgccgatacatcaaacagcacgtgcccgtttcgttcccgttggacaacttcagcctgagcaaatacttttcgcccgatgtgccggctgcgctggtggcccaacttcctctctattcctgcattgcaattgtggtgagttgagagtgattttgatcagcggcaatttgaatgacatcattaatcattcttcccctctttcttttccttagactcatcacggccacttgaactctggccattactgctcgtttgtgcgtgacggcttcactgacaattgggttttctgcaacgacgacagaactctcgtaagaaaacaatttcgaatcaattaatgccagcttttcatccattctttttagcccactgaaagctgcgatgtggacacgcgaaatgcctacattgtgttctaccaacgcgcaaattcagtcgctgcccaatgagatgaaatgagaggataaccattgttgtatatatatgtgtataattgttgtcgtatatgtatgtatgtgtatattatcgtatgtgtatattcatttgtatgtacaatatgttcattggtattaatgatgtgttgatgaataaaaaaataaaaaccgagagaatttcattgacaaatttgaaaagttttgttatttattgtttttcattcagagcgatcaatttttgaaatacatttcgtttaatcggagttctatgtattcatttggagtaaacaaaatttaatgcagcattatcaatagggctgggaatttaagtcactaaaaatcttcaaaaagtcgactaaaaaagttaaaaaatcgccaaaaagtcataaaaaacgcaaaaaagtcacgaaaaatggaaaaaagtcctgaaaaattaggcaaaagttaaaaaatcccatttttaataatttatagaataacatttgatcatatttttaggcacttaattttataaataggtacctaataggcataaaaaagtgatccttccaacaattaagaaaaaattcatccaggtttcattcattgcctttttatcgatctaaatttatttttcgtaattattaattacgttgttaattgttggctaattaacacaccataccgaaaaacgagaagtgtaccaataaatagagagtgccagagaaaaacaatatcttttttttctctaattttttgtctccttttggcgtactatctaatattttcttattaggaaaaacaacattcacttcgctatgtttagcttcttttctattccttttatttattcattaaaatcatcgaaatacatcaatagcatgcactgggaatcgaacctgagacccccattttgaactctgtgcttatgtaaaaacctcccattccagtgtataaattaaattttgttacggtaatgggcgcccttttttaagaaaaattgtttttgttagaaaaagtcgcgattggagttttaaattcggagaatagtaaaagttcataatcagttgtgatttcatcaaattagctgatcatttttatgcagaaagatggattaaacgaactgaatgtaaattgaattgcttttaagagacgctaattgcaccattactgctttgaagaacgggctcaatttttacatttcagaataaaagaagccaatctataggttttcggggtcgctgatcgcgaatccggtattcatttcggccaattccaaatcccggacccgaattcgaacaagaagtcgaaaaattaaaattttcttatttttcatctagtctaaa

SEQ ID NO: 1075 - DNA, 3382 bp, Heterodera glycines
agaattttctgaaactttctaataaaatgttaaaaatcttccccgagccgtccgatctgtcccacctgtccaatgcctggtcaatagtttccaccgtttggcccgtgtgcatggcatagatttcgttgagccgttttcgcattcggttgatctcctccgctctgatcacaatgtccgccgccgtgccgtaagcgccaccgctcggctgatggaccataatgcgagcattgggctgaaaaaagaagggcaaaagcaaattttagagcatggaaaaatagttggaatgggcggatgagtcaaatccgtgccaaggaaatttggtttaaaggaaaacaaaatgggacaaaatttaaaagtttttgtgcatttccaaaagtcatagaccaataaaattttgaaggttcatttcttttaactgaaacctaagaaatttggggaaaaccctagaatttattccgcgtttttttatctagcaaaaaatttaaatggtaaatttcgcagatcttcaagaatatgctgatttttaagaatttttagaacaattttccttcgtttttcgtcattcttattactagtatttattttttgcttattgttagaaaaaaagtttctaaaatggctaattgtaagtctatttttctaaaaaatttataggttttgctaattttaaaagaaaacatttctatggggggggggggggtgaagtatcccctttttgtgtcacaactttagcaagtgctattgctaaaaaaaagtaccagcgaagtgcgcattcccttggcaccggccgtcaacaaaagactgcccattgaactcgcctggccaatgcctggggtgaaataaatcccttttttctgaattccaccactccaaattaaaaatgcctaacaccaagtggcgacaggggccgaaatgtgctgcattgtgtcgtaaatgccgaggccagccgtcacactgccacctgaaaaggaagaaaatggccaccaaacccacggaccacactcaaaaatcggagcagctcgttaccccccgcgtcgtttcccatccgaaccaatttaaaattttttgttctttcttttgaaaattgcacttttcagcgtaaaaatttgtcccattgacaattcataattccacaaatccaatccaatgccaggtcatgacaaacctggacaattgatgtaccttaaaatggaaattccttggcaactttgctcgtccaatgttccccccccccaactcacatgttaatcgccgttttgccactttcgctttgcagaaaaagcagctgagcgatcacagaggcagcaaaaaagtcatcaatctgaacaaatttcaatcactcatccaaatatgccaaaatttcttctttttttcattttataaaatggaatttcacaatgacttgccgggttcatgacgcaaacgatgcgatctttgagcagccgcgaataaatgtcgtagacgcgttctaaatatgcgaaaatcaaatttacaacgaattgttaatggatcgggatattattttgtctgtagtttaagcgaaccctttttgagaaccaattttgacggataaattctcattgggattgaattcaatcccgtccaatttcggcgaattttcgatttagaaaaggttaaaaaaatagaaattctcacagtaatggaatcaaaaatgctcaattctgtatttttacattttcagcattgtattcccacaacaacctgttttcccgtcattgtccaccactaaaaaatggaatttgttttatttgttgtacaatgtaaatacatatataaccaatttttgaactcaccgaatggaatgcccactggcgcggtggtcgacctggaaaatgtgcgggaaattgtgcgaattgcatgcatttcgagaaattaaacagaaaaacaaatctgaaaaaaaacgaatcaaaagtgaatcaattaaaaaaggggcaatcaattaaaggtacgacgcatgtgaccaaagggaggagaaaacgcagcaaattttaaaaacgaatacataacagagtgaaatgacggagaaatttattagacgaaaatttaccaataaaacaccatttatcatttaacagattcatttttgtagaaattgcttaaatgagcacccaacgagacaaagtgagcggaaaatcttatttttagttcaattttaaagtaaatttgttttaaagaatgtattgaatctgatcctgaacccaatgcttccattcgatctcgaagatggggaggaaaatgaatgcaaaagcggtctattttgacttcaaatcttcccagttttatttttatgtgttttaagaagaggaaaaatattcaaagttgccaaactttggccaaagtgaacagttgggcaaggaaggcgtggaattggcagaaaagggcgacctcgaaaatgcaatgaaaaaattcaacgaagcgattggagtgaattgggcattagggaaattatatatttttaaataatttcgcacagatgtgtccacaaaacccatccaactacaacaacagagcacaattgtttaggctaatgtccaaaattccaggtaaatccaatatcaatcaactcaatagtgaattttttcatccgcagaagctctcaccgatcttgaaaaggctttggcattgtgtgaaggaaagggccgagttgcggcccaatcgaatgtgcaaaaagcgctaattcatcaattccagggcgacacggcgctggcaaaagtgcgacggcatttttaacttggggagggggctgggggtgttggagtttttcttttttattttgagtgtcggggttggaagtgtcggggataatctcgaaaaagccaaaaatgacgggggtccaaccctacacaaaaccgttgcaggtgaaatttgaacaagcggctaaactcggctcaaagtttgctcagaaacaagccattgccatgaatccgtaaattcaatgccaaaccacgcggataatattccatttttattctttcacagatatgcggcaatgtgcaacaaaatgctcggagaaataatgacaaaatttcacacatgatttttttaatacaaataattattatcaatatttaaaaaattatttgtggcttttaaaataaaactaaagaaacaataaaaagaaaaaaatggtaaaaaaattctgcggtaaagcgttttaaccggctaaaacctcgcaaaataatgaagtcgatcgagtgcacgctaatctttagcgcaataagcaaaatttaattttcaaagttgacggtttttttaatttatttttcattttgaagaggattaccaaaatggtaatccttcagaattgcggtcccgacgaaaaattaattaaaaaaattttataatagttttttctagggcg

SEQ ID NO: 1076 - DNA, 4975 bp, Heterodera glycines
aaaataagaaagagtcaattcgtaaaggtgtatatgtagtgattagcagagatattttgttgtttaatttaggatcttttttggaaaatagcaacttgccaccacaaaaatttatactttttgtgtacttatgggcacatggtgtctcttcttcttgtcaagaatctctttgcgagatgtcatcaagcacagtgtgcgactggtcaagtttcatgcgcgatatttgttcgcgatggctcgttgaacatccaattaaattgggtggactgggaagagtggtccaaattggtaatttatcaattaaatgggctttcccatgatttttttgtagacgagtctcttatgtgtaagagaaagtataatcgcggacgaattgtacccgagagatgggtatttgggatgtatgacattgaacaaaaagttggtgtccttcggtttgtccacaacagacccaggcaaccctgttcccaataattcgccaatacgttcgtggcggaacaatcattcattcggactctgctgcgatgtacgtagacaatgcacggcaacgcagccatatagtgaacatccccaccatcccgatgccggcataccagcatttgtgggttaatcacacagagaattttgtggacccaaatactggtgcatgtacgaatgccgtggaattattttggaagaatgctaagaaaaaaaataaagaaatgagtggcacaacagccgaattgttggaaactcatcttgatgaattccaatggagacagattcatgggaaaaagacaattgaagcgttcaataatatcttggcgcatattgcatattattatccggttaacaattgacattgtgtgtcattaccaaatatatatgcgcaaataaagcatgaacggtcattggctgtcataaaaaataatccgcagccaagcggatttgaaccccagacccgtttcatagacccctaagggccagtaattaaatttcaaaaaatcatataaactttaaatttgccttcttcataaatttaatagttcattcaaaagctatttttaaactctacaacatctatgcatgagtttttcgctcgtttaattttttttaaattttggaaaaaatcaagtacttgatgaaaaatcatagataaaatcaatgatttttgttgtgttcctccaattgaacacacaaagaataaaaatatttattgatcggtcggtggacaaatgcaaataataataaaaacgaatgaatgagggaagagtccaaaaaggaggggaatggtctccttataaacacaatgagaaggggggaaagggcgtggagaacaaagtacaaatatgaaaataattaaaaaggtcaaaacgccaatttaacatttccaacacaatttgttgtgttcctccaattgaacacacaaagaataaaaatatttattgatcggtcggtggacaaatgcaaataataataaaaacgaatgaatgagggaagagtccaaaaaggaggggaatggtctccttataaacacaatgagaaggggggaaagggcgtggagaacaaagtacaaatatgaaaataattaaaaaggtcaaaacgccaatttaacatttccaacacctcccttctcaagcttctaactccttcagcggccggaaggcgagaagcgaatcaccggcttcggcttacgctgcgatcgtcgaagagccattgtcggcgggtcatttgcggcttgttgatcagtccgttgatcgaccggatcagcaatttgatgcgccaaattttgagcttgtccgttgactggtggaattggctgctgatcgggaccaggattgtgtttcgaattctcttcgaaaacacaatttcgacgaagttggttcgaatgtcggtggacaattcgaccaagaactggtacatggactcggtatgtaggcgaattcctgactcgctctacaattgtaccatggagccaataagttttttggttcctgtagttcaaaaggaggactggttcggcggggaaaaagactttttctttggcaccatgccgttcatcgaattgttttgccattttattcgaatagtcctttcttcttttgtcgagctgaattttgtcgatgttctccgaatcgtttcggtgtcctttcggaaggaccaatgccaatttcgttcggagtttccgtccgaagaataattgatcgggagaatagccatcaatggcattgtttggcgttgtcctgtaagcgagcagcaccttttcggtccaatttttatcgtcttttgaacactttttcattgctcttttaaaggtgtcaacaaatcgttcgacttggccatttgactgcgggtgaaatggcggtgaaaaggtgtgcttgatgccgaattctttacaaaaagcggcaaattcagcagacttgaattgtgtgccattatctgacactatttcctcaggaatgccaaggcgatggattatggaacgaagtgtgaaaactgtggacttggccgtaattgaagacatttgatagacttccggccatttggaaaaggcgtccaccagaataaaataaacatatccatcttggcagggtccagcaaagtcgatgtgtacgcgttgaaatgctttgtcggtgactgtccatggggccaatggtgccttaatcggacatttctgtgcaccttggcattcatcacattgccgtacaactctctcaatttccgaatcgattcctggccaatatacatactggcgtgccaaggccttcattcgcacaattcccggatgtgcaaaatgcaatgcctttaaaattcggccacgcagttggcttggaacgataacacgacttttgtagagaaggcagcccccaatttccaaaatttcatttcttttcggatgaaatggtgcaatttcgggttccctgcacttcgttggccaaccagaaataacaaaattaacaattttctggagtgtctcatctttggttgttgattccgcaatttcttgtgccgtgactggaagatgatcggtttgcgactgtaaaatggtgttaatataacagtctgtttcgacgcaaatgttggcaatcaacacatcttcctcaggctttggataattggctattagccttgagaggacatctgcttgtccaaatgatgctgtattcgtgtatttgatgtcgaaatcataatttgccatgatcaacgcccaccgttgtaatcggctggcggaataaatcggaattccctttttggaaccgaaaatggcaagcaaaggcttgtgatcagtaaataaggtgaatttcctgccgaataacattcggtggaatttctgcactgcgaacacaaaagccaatgcttctttttcgatctggctgtaattctgctgggaatctgacaaaacacatgatgcgtgttcgatcactttctcggacttatccggaaaaatgtggccaatcgttgcgccaattccgtttttggacgcgtctgctgccacgatgattggaagagccggattataatgagtcaacagcagatcagatgtcatgatcttcttcgccttttcaaaagccttctgttgctcttcgctccaattccaattttcgtcctttcttaggagctgatcaagcggtgtgcgtatttcacgcatttctttcacgaatcgcccataataattcagcgctcccaaaaacgatcgaagtgatgttttatcgtgtggcgcgggcattttgctgatcgcttcagaacgtgccggatcgggacgaatgccttttgatgacacaatatgaccaagaaaaagcaattctttttggaagaatttgcacttttctaactgaatacgcaggccaaattccttaattttcgtgaaaagctggtaaagtgccgaaatatgtccttccaacgtcttagaagcgatgagcccatcgtcgagataggcaaacacgccgggtattccagcacatatttggtccataagatgttggaaaatggacggtgccgactttactccgaaaggtaaacgttggcattggaataggccgcgatgcgtattgataacacaaaggtccttggactcctcgtccaactccatttgcaaataggcatccctcaagtccaaatttgagaaatatgacgctccattcagtgcggcataaatatcatccggtctcggcaaagggtgtcggttcaattcgagggcattgtttaaccctgtcgaaaagtcgatgcaaacccttgttttgccattcttctttttcacggcgagaattggtgcagcccaatggctgaaatcaattggcttaatggcaccgatttccaaaagtcggtccaattcagcgtttacggcttcagttgcaccgtgtgggattggccgtgctttgcagaaaattggcttggcatcctgtttcaggatcagatgtgccttgattttcgaacattggccaagtcctggttcaaaaacttccgaaaaatccgttttcaaagcctcaatcagtgatgcttcatccttaatgtttgcctttcgcattggtgccaatgtggcatggatgctgattggctcgcacatctctttttgctgaaccttaggaaacatgacttcccttgggatcagatcaaaagccataatccatggcaatccaaagagattgtaattgacagcactgctaacatatgcagttagcctttttggcggcttgtcaaagcaactgacgacacattgaaacattccttcggtgggaaatggttcctcattacaattatgcatttcaatgtccgacagttccaattttggtcttcccaatttaatccatgtttggattgtgatgattgttgcttgggctccggtgtccccattcatctcacaatcattgtcatttatcttcacttgaagcttccaccaatgaccgcgattcagtccgacattcaagcaatggcttgtcactttgactgtgtgcacagccacgattttgacgtcttgaatttgatgtcgaagctgatc

SEQ ID NO: 1077 - DNA, 1220 bp, Heterodera glycines
  misc_feature (449)..(449): n is a, c, g, or t
atatatatcctttaaatactatatatgggtgccaagaatttcaaaattaaacattgcgtcgtgaaaatgagctgctgtaccaaaaaaagattaaattaagaatttttgctggcttttttcatttgatcaatttttctgatcatttttggttcgggtggttcattagacgtacaatcttaatcttttttgtagctaatgtgctttccaatgataccaatcgttaagccaaaaaattttgcaactacggtacttgaaaataccattacagtaacccatttttgtgaaaaatacgattcaatttccatattcttttcagctgacccacaaagttgtaagcgtagaaaacggatttaatcatttgacttgtgaatggccacaaatacaatacaaaagtgttcatttgtcacttttatgagtcaacgttttcgctcgccgtttgcccaaatgtnccgttttcgttggccaaaaaaaaggcgcccttttccaatcgatcgaaggaacgcttttgaagcgctttaaaaatatacggagaggaaacgaaaggggcgtcgagctgaaaagtcggctaattcagtcaattagttgattaatgaggggcattggtcgttcatttcactcaccgaaatggccgacaacaattggttgtcgtcttcgttgtcgttgaacctttttgaaagtgcgtcgaaatcgaacggagacgcgtcgaggcggtcgaacgcgcgtttgggacgcggaagagacgaaacgccggccgacgactggggggcacttaattaaagcaattaattaattagttaattaattatagcgaaatgtgtacttttgtgggtgctggagaagactctgtatcatataaaaggttggatacgcactgacactgatgagaaaagagaggaggaggcaaagggaaagggcattttggacaaatgccattgggagacaattaaaagggagcaattaacaactgctaattaatcaacgatgatccaactgacaaaaatatatatatatatatatatttaagcaattttaaggaattcgaaaacttaagaccaaaaaaagtgagtcggcgcaaagggaaaaaaatttggcaaatcattgaaagagtcggaaatgggcaatctgtgaaaacgatggaaaggagtgaattttgaaaaggaatttaaaaagaaaaaataaattggattccgtcgaaaatttgagaatgaataaacgaaaaa

SEQ ID NO: 1078 - DNA, 1366 bp, Heterodera glycines
agatgcatttaaaaattcataaaaaaataaaagggccattacgcaccgccctccctttcatgatcgagagtatttgtattatagaaaattatccaaaaaagagatagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgtcctccctctcatgatcgagagtatttgtattatagaaaattatccaaaaaagagatagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttgtattataaaaaaattacccaaaaaagagaaagccatttttttggggatacagatgcaatttaaaaaattcattaaaaaaataaaagggccttacccaccgtcctcctctcatggtcgaaagatttggattaaaaaaattattcaaaaaagaaaaaaccatttttt

SEQ ID NO: 1079 - DNA, 1504 bp, Heterodera glycines
catgattgagagtattgtattatagaaaattacccaaaaaaagagaaagccatttttttgggatacagatgcaatttaaaaattcattaaaaaataaaagggccattacgcaccgtccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgtcctccctctcatgatcgagagtatttgtattatagaaaattacccaaaaaagagaaagccatttttttgggatacagatgcaatttaaaaattcattaaaaaataaaagggccattacgcaccgtcctccctctcatgatcgagagtatttgtattatagaaaattatccaaaaaagagaaagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtaattgtattatagaaaattaccccaaaaaaaaagaaagccattttttttgggaatacagatgccaatttaaaaattccattaaaaaaaaaaaagggcccattaacccaccggcccccccttctcctgtatcgaaaaaattttggaataaaataaaaaattacccaaaaaaaaaaaaaagcccttttttttgggggaaaaaaaaaggaaatattaaaaaaaatttttaaaaaaaaaaaaaa

SEQ ID NO: 1080 - DNA, 1146 bp, Heterodera glycines
cccaaaaaaagagaaagccattttttgggatacagatgcaatttaaaattcataaaaaataaaagggccattacgcacagtcctccctctcatgatcgagagtatttgtattatagaaaattatccaaaaaagagatagccatttttttgggatacagatgcaatttaaaaattcattaaaaaataaaagggccattacgcaccgtcctccctctcatgatcgagagtatttgtattatagaaaattatccaaaaaagagaaagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgtcctccctctcatgatcgagagtatttgtattatagaaaattatccaaaaaagagatagccatttttttgggatacagatgcaatttaaaaattcattaaaaaataaaagggccattacgcaccgtcttccctctcatgatcgagagtatttgtattatagaaaattacccaaaaaagagaaatccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttatttgtattatagaaaattacccaaaaaagagaaatccatttttttgggatacagatgcaatttaaaaattcattaaaaaataaaagggccattacgcaccgccctccctctcatgatcgagagtatgtgtattatagaaaattaccaaaaaagagaaagccat

SEQ ID NO: 1081 - DNA, 6433 bp, Heterodera glycines
gtgtagaggtcggcgtacacattgcggtcaattttgcgggaagttgacgcggatggcacgatgttcgccgcccccgtacacgtaaaggtcgtcattgtccaaggcatcatcgctaaattttttttaaatttatttacaaaattaatgcttaattgcaaaactcacattggtccgtcaatgttgtacgtggccagcgtcaggttcttcattgcctcaaaggtgagcagctgctgcgcagtataggacaggcggaagctgcggattttgaggttggcgcgctcgtcggtgccgtcccgcgcagtgtggcggatgccgtagttcttggggccacccgcaacgaactcgacgatccgtcggtcggtgtgttcgcgcttcatctgccccagagcctcgccctctgctacacacggaccacccatcttgttgacgtagtagatggagtcggtgtctaaaacaaagggctgtccaaaaaaaccattcgtgacaaataaacataccacagtagagcagctccgcaccgacgatggctgacacctgctccatgtagtcgtaaagatgaagccggccgtatgaggtgacaaacgcagcgaccggaaggcagttggtcagcggggctttggcgaattccggtcgcttccgcacgacgcagcggtccatgtggtcggacacgtggacaaagtccaacttgtccaccgttgggtcgtcgaggagcgcgtggaattcagccggagtccgcgtgtagcaaatctccgtctggcccacgcgctgcgctagcttccccctgtggatgtcatttttttttttaaatttaaaacccaaaatatttaccacaaggagttggccaatgttttggcgatgaggcgcaggccggggttgaactccattttggtcgagtccaggcggatgccttccgtccgctcaaaatcgtctacaaatgccttttgctgctcatccgtcacacatccttctggccagcccgtcgcctgcactttgagcccgacgaaggtgttgacgtagctgctgaacagcgtaccgtcccactcttcgtagtcccagacctaatttgtgttttcgtacacaaaattttttaatgagtggacaacctcaaaaagatcggtgaccacatagccaagctggagcgctttgttgagctccacgtgggtgtaggcggtcacccacgagcgcttgtcgtcttcatgtcggcacggccgctgctgccgacggtcggcacaccacgcgcacaaagggaaggtgaatcgcccgtcctttgtgcggtagccgagcaacggcacccggatgttgcgtggagcgagcacccgggcgagcagcagcccccggaagatgttgttttccggtgcattccacgggagcggtaccgttggcggacgcagcagcacctcgcgcgtcaggacccgtgggttgcccacagggaagcgattggctttctggtattcatcatgaatatgcgaatgtttaaaagaaaaacctaccatgacgtatgggtagaggctgacaatgtcaatgcacattatctcctcgtcgtcactgcacacgtggtggagcttgaacggttcagtgcgccctccccgcagtgcgtcgttgcgcgggtccagcgggcaagggacgaacacagcatcgtaacggcgcttcaggttcggatcgtggcggagccgctccgtccactggcaggcccacactttgtggatttcgcagccgtggtcattctccagctcaaagaggcgccgctccgtccgttcgtacagatcttccgctgtccgccctgccgccaattgttgctgccggtcgggaaagcacgcgggacagcctcaattttaagatattttggaaacggaaaaaagcctttaccgtgataatagcatccaagccattcaatggccaggggacggagaggcgcttctcgtcgccaaagtccgtccacgcggtagccactgtcctcaatgtgcgcctctccgaccgaccagctggcgcactgcacttgcgcctccgggtgctccagctcgaagaagcggatgtagcgctgcgattctgccgaagcacggcgtccgcgcaagtagccgccctcgggtgagtgaaccagacgattggcgggcaggaaacagcggcgaaaagttgccagcgcaagaccagcagctgttgacgcgtggaggaatgggtcgaggccttgagtattgtcggcgatgagttggcggaatcggatgaccgactccctcaaaatggccacgtcgttgacgcagtacattatgagctgctcgcgtagctggaatccattgccgttgttgtcggcgtgccaacgccaacggagaaattgcgcccgtttctctgccttcatcgtatccggtgcgtaaaactcttgagacggaagattgatgaggcgctgcgacagatgttgtcgtcgtatgtagagataagggaagaatggcttcaatgtggccagatggtccggcacttggaagctcttcaccaacgcgtccaaggcacaaaagaagtaattgattgagtctttgaatgtgactcgccgttggtgacgcccggacagacgcatcgagtagatcttcaatccggtggtgcacagatgcttgggtggacggtttcggcggtgtagtgcctcaagtacgagatggaaatcgtactttccaccgttgtgggcgatgcacacggtgtgtgccttctttggaccatggtgcagcaaaaaatccaaaaattggtccactgggtcgttgccgtcgttgtcaaacgaatggaagaagaagcggcgctggttgaacgctggtgctccaactggcgaagcgctgttgtctcccggtgcattggcaaagggtggcgaagaccactggcgaaacagttgacccctcaccattcctgtcatgcagacgcagccaggagcccgtcttccaaggccatcgctcacgctgatgccagcctgcagacaacgttcgcagatgacttcggcgacgatgagcagcggcacgtgcttctggacggtgcggttgttcagctgtaatggcgtgtcctgggacgtctcggcatcgaagaagcagagacgaagcggcaattcttcatcgtcgtcgtcgtcgtcgtcagaatcgtcgttgtcaacagcaatcgatgcacgttgtcgaactgagccgtcgtcaatgggctggatgtagcaaggctcatcgacggtgtggggcccattgcagcgccgacagattccatcgtcggctggttggtcacgtgggcactgatgtgtggccacgtaggcgatacgtccacacgcacgacacacccggcgccattgacagattggctgacgttgacgctgtccacgcccatccattggagctggaggattgttggccaaatggaagttgtagcagccatcgtttgggaagacgaactggcaatcagcgcactttcgagcactacttccaccattcggtagcttaatatttttttttacacaaattgtttttttttttggcatccatctacctgttcagtttggcatggataaccaggcccgtaccgcaaacaaaggcggcacacaactttgcatccgaacgcgtggtaacgcgcgtcagccctccgctcgcagtcgatgcagtagttgggcacatcaaacagctgctcaactcgtccaatgtagttgaagtgcccgcgctccaacacaaggcaaaggttgaatttcgcagccaatcttcaatcaaccaatttccaaaaaaaatgaaaaaaaactcacccttcccctttgaagacgatgcgatattcctgctccttttcaagcaccaccaggcgaatttggcccacaccgtgctcgttgttgatccactgctggagacgttggacatcgtccagcgtgtacatgtcactgttggcagcaatgccggcacgagtcagcatctgcgctgctgccggaccgtgttggtcttgacgactggcgaacaggttgaatgccgctttgccgccaccgccagccattcgcgtctcgcggtcatgcatccccatcacaacggcacgcgcaaggcagagccggtcgttggggttgtgaatccggacaagtgactgcacgttattggaaacatggtgctccacgtcactgtcacaggctcctattttttatcaatgcgttaatgcaataagaacggcacctcacctcccctttgggggtcagcacgaatggagtcaaggggccagaccgccaagactttggtgaccgttgttccggcaagcaagtcaatgccggctgccgactgctcattgagacgctcgattgctgccgccaatgccgctgcgttgtgttgctctggcggacgaagcccgatgacataagggcgatcaaatcccggcgggtggagctgaagtccgaccatcgatgggcgtgggtgacccgccagcacacggtcgaggagttgctggatgatcgtctccatcaaaagatcaggccgctgtgcctcctccagcggcaggaagcgcagttcacaaatctcgccccgtgtgttgcgtgggacgttccgcatggctgttgagcgctcaatcacaaagcattcatcaatcgatctctctgcctttaattaattcaaaaatttattcatggcaataaatatttacaagttggacaagaacgatggatcctaagccaaggaacaatacaacccgtgtgaaaaatatgaaagcaatggagagaagtggccccctccccaatcacaaaggagcacatgcaaattgggcagtcaagggatttttcaatgtgaatgggtgaaatgtcaaaattgggcagcaaacgaattttacgggcgggatatggcttttgtctttctcctctcgggatttgttcaatatcgggggacaaatcgaatcggaccctcaaacgaaccggttcagcagcccgtctttgtgttggtcgcgcaccagcagttcgactcgcgcaacgactcggacgtggctcaagaccatgattgtcctgagaccaaaagtttattcatcacaatgtaacaaaattacacaaatcgtaataaaaagatcaattcctcacattgttgttgttgttgttgtccaggtccgcgtcctcgcgttgttcatcaccagcattggtcacgtttggcagcgcccggactgcatcacgccctgcgccaacttgaacgggcacaactggtgcaatgtttgccggaaactaaacataaatttcaagaaatatcaatttaaaatttaaaaaaaaacttacctctggggccacgtgcggcaccacaagcgcattggggcctccaaccccaatgcggaaccagcagtccagtcgctggtatttggcacggctcacgcagttggtgaaccagtaggcactgccaacacacaaggccgccagcgaacccgcatgcgcctgccatcccgaggcttcaacgcggtggccgtcacccgtgcgaagcacacagttcgtcacggcaagtggcccagctggcgtctgctgcgcagggcgatggtcaaccgacacgacgatcaggcacagcgggctaaaaaaactcgcgcacaatttaaatatcgatttgtaaattcaacttacggcaatggctgacccaacgcagcaacgcatccaatcaagaattgaatgttgtgcgttccatccgcacaaaaaggttcctgaaattacaaatagcaaaattaaaaaaaaattaaaaaacaaaaaaaaaacaagtaagcaccgccaattgctggtgggacgcgttgacgaggatgggctgcaccaactgcgcaacctttaaaataataaaatattagttttttattatattttaaattatgacttggccaaagggcggcatttggccgaaaacggttggtagctgttgagccataaaataaaggacaatttgaatttttcgctgtaaaaaaaatagaaaatttgtctttttttaaatattgcgtagcttttcttttcttaactaaaaaaatttctatttttcttggcttttcgtttgcatttctttttaatatcgcgctgcttttcttttcttagctttgaaatttctataaatttttcattgcttttcgtcttcttttttttaaatattgcggagcttttcttttcttaattttaaaatttctatttatttttttttcctggctttccgctttttttaaagattgcgcagcttttcttttattgactttaaaatttctatttattttttcttggcttttctttgcttttctttttaatattgtgctgcttttcttttcttagcttttaaaatgtccttaaatttttcattgcttttcgtattgtttttttaaaatattacgcagcttttcttttctgaatttaaaaatttctatttgttttttcttggcttttcgtttctttctttttaatattgcgcagctttttcttttctcaaagaagaatttaaatttttcattgcttttcgacttgtttttt

SEQ ID NO: 1082 - DNA, 2448 bp, Heterodera glycines
ttttttcttggcttttcgtttctttctttttaatattgcgcagcttttttcttttcttaacttaaaatttaaatttttcattgcttttcgacttgttttttttaaaacattgcgcagcttttcttttcttaactttaaaaatttctatttatttttcatagcttttcgtctttttttaaatattgcggagcttttcttttcttaattttaaaatttctatttatttttttcctggctttccgctttttttaaagattgcgcagcttttcttttattgactttaaaatttctatttattttttcttggcttttctttttaatattgtgctgcttttcttttcttagcttttaaaatgtccttaaatttttcattgcttttcgtattgtttttttaaaatattacgcagcttttcttttctgaatttaaaaatttctatttgttttttcttggcttttcgtttctttctttttaatattgcgcagcttttttcttttcttaacttaaaatttaaatttttcattgcttttcgacttgttttttttaaaacattgcgcagcttttcttttctgaattaaaaatttctatttattttttcatggcttttcgttgctttctttttaatattgcgcagctttttcttttcttaactttaaaaatttctatttatttttcattgcttttcgtctttttttaaatattgtgcagcttttcttttcttaattttaaatttctatttattttttcttggcttttcgtttgctttctttgctttcttttctttttttttgttaaattaattaattaataatttgttagttagttatgataagcaaaataaatgcacaaatataaaaatattggacagaacaaataaataaaatggacaacaaatcaatataaacggaagaaatggaaatgaaaatgatgcgttggtggagaacggaccgttgcagatgggtgatagataagaatctagcgaatgggaggggtccgcatcgctgtgcacagttaagtgacaacagtggggagggggtaaacatttgaatttttgaagttcagatggattttataggccgtcattgcaacaccccctaagctgaacggcgaaagaatttcgcctcaggcaccatttcaaacaatactttcccgacgccccgccccctcgcgcaccccgagactcgcgcaccaaaactcgcgcaccccttgtacgattgacttcaaatttcacaggccatcattccaccatcccctaagctgaatggcaaaagaatttcgcctctggcactatttcaagcagtactttcccgacgccccgccccctcgcgcaccccgagactcgcgcagcaaaactcgctcaccccttgtccgattgacttcaaatttcacaggccatcattccaccatcccctaagctgaatggcaaaagaatttcgcctctggcactatttcaagcagtactttcccgacgccccgcctcctcgcgcaccccgagacttgcgcagcaaaactcgctcaccccttgtccgattgacttcaaatttcacagtctgtcaatgcacccatccctaagctgaacggcgaaagaatttcgcctctggcaccatttcaagcagtactttcccgacgccccgccccctcgcgcaccccgagacttgcgcagcaaaactcgcttgcttaccccttgtccgattgacttcaaatttcacagtctgtcaatgcacccatccctaagctgaacggcgaaagaatttcgcctctggcaccatttcaagcagtactttcccgacgcctcgccccctcgcgcaccccgagactcgcgcagcaaaactcgcgcaccacttgtccgattgacttcaaattttatgggccgtcaatccaccaccccctaagctgaacggcgaaagaatttcgcctctggcaccatttcaagcagtactttcccgacgccccgccccctcgcgcaccccgagactcgcgcaccaaaactcgctcaccccttgtccgattgacttcaaatttcacagtctgtcaatccacccatccctaagctgaacggcgaaagaatttcgcctcaggcaccatttcaagcagtactgtcccgacgccccgccccctcgcgcacaccgagactcgcgcaccaaaactcgctcaccccttgtacgattgacttcaaatttaacaggcaatcattccaccactccttaagccgaacggcggggtgagggggtccgcgccgtcggagagagggggtccgcggctatggtgagagggggaccgcgccgacggacggaggaatggtggggaggggtccgcggcagtggagagagggggtccttggaagagagggggtccgcgccgactgacgacggaatggtggggaggggtccgtggcagtagagagaggggtccgcgccgacggacggcggaatggtggggagggtccgcgg

SEQ ID NO: 1083 - DNA, 3446 bp, Heterodera glycines
  misc_feature (184)..(184): n is a, c, g, or t
tttaacccccccggcccaaaaatttcggggcaccccccttctccccacccccaaatcccgacccccacaccattcccgcgcacctccccaacatcccggaacccacatcttcccgacgcatccccccaccccccatccccgtcagagacgcagacacaccacctaaaataggcacggacccgcncgctcatcctctctgcgctcagcggagaaaatcaatcgataattcaagtggtcttaccatgtagtgttggctatggcacaattatgagatggaagaaacaattttgcatttgctgtagaataacggagaaagaaaaaaatggaaaaaatgaatatttattggcaaacaaaaatagaaaatccgaaaatgagtgagaaagaaattgcaaagatgttgaaaattgatagaaatagtataagtaattggaagaaacaagttgagatggaataatggagattattaattcggaaaattttaaaaaaatttaataggcctatttcagataaagttactcacattttacaatttatatatgtcgatttgttagaaggttataataaaataatatttagcgccattttttcaattatatttattaagaataattataatttttgattttttgaaattgatatttttattttttcgatattcaaaaacaaaagattataaaaacatggacaacaaaagcaaaaaaaaaaatttttaatttcataatttttgtcataatgtcacttttatgagaattttttaatccaggaaaaatcgtaccaatttatataaaaatttattaatatttaatttttgcaaaaatacgataatttaaaaaaaataaacttaataacaaattcgatggatttaagaaaattaaatttattgaggtttttttggccataacttttttgtttctgagataaattttttgaaattttgaagacgaataggcactgtcaaacgctttaaaaatcctgccaagtttatttaattcgtatgacaaataaaaatgtgtatagcatttggcgccaaatgggatgaacggttcccccaaattgtttgtattcctaatgagcattttgtcccagttttgcaccgcttagcatcatttgctaatatgccttaaatccattttatttttgcccatatcgaaatcttaatctcgaccaaagaaaattcttggatgtcctcgggcacatgttcagtcttaatcagccactaatacgtaattgactgtaaaaggtgccaagaactgaatttatgatatttctcgagctcatggctaatttcagaacccatcataacaaaaaaaaattttcggcatagtcgtgaaaaggtgttaaaaaattgattgaacaagcgttattaaatcatgtagaccaggggtggagcgcgaccgcgatgcgcgatccgcgattctcggcattttaaatccgcgatgcgcgatccgcggaatttttgaatccgtggcaattttggatatttaaaaagaaaatttttttgaagcgattgtttcatatataaaataatttaaaagtaagtttttgtaaatgaaaaagcaagagatttgattatttttttcgaaaattcctttcaaataagatatattcattcatttgtctagacaattatcctaaaaagagtgaagcggaatttccgagcttgcgacggcttatgaaaaagtatcatagtgcgccgccgggaagtgttgagtcggaacgactattcagctgcgcaggatttattttgaatgatcttcgaaaaaacctatcgcatgaaaatctcgaaaaacttatttttcttcatcataatcttatcctttacaattttgattattgattaaatgaaaatttttttgaattatctggaactccttgcaatttccccccccccccccattcagtcttcccaaatttgtatgcatcggaattttaattaattttttatataagaaaaaataaaaaaagtgtaaaaaatggtttaaaaaataggaaaaaaatgcgcgaccgcgatccgcgattcgcggtaatttttttgcgcgatccgcgatccgcgaccgcggcaaattgaatccgcgacgcgcgatccgcgaccgcggcaatttgaatccgcgacgcgcgatccgcgaccgtgggatttttctgtgcgcgctccacccctgatgtagactctttcagaaaagaatttaatatttaaagcaaaaaatatttgtcgtttggatattttatttaatattgcaataattttttttaaatttcattaaaatagtatctatttcattcaaatattcatttattaattattacctataattatgaattagtatcaattaattcaaaataaacatttggaaccatgaaataaataatttataattatggaaaaaaatttatgttaaaaattcattggttatttatttcttattaaaaattaatagaaaaactagcttaatcaaaaatattatttatatttccaattaagcaatattttttattttacaggaaatcaattgaaaggcgattttaacatcaataactagccaaaataataatcaaaaattatattttacaagaaaaaataaaatttattatttttttaatttgtgaagaagatgaaattccgcctattataccttccaattttattttttgtgattgaaatcaatcaaattaaaatagaaaataaaaaactaccgcaaaaatcatttgatgaaatatttggagaaaaatgggaagaaaaagaaggaaaacaacgaaatgagaagaataaaagagaaataattgaaaaatattataaaataaaagagaaaataaaggaaaaaggaagaaaatactcagaaaaagaatggagaaaaattgaagtaaaaatagcgaaaaaattggggacaaatcgcacatatattcaaaaatggaataaagaatttggtcttcaaaaaaagaaaagctataaatcaaaaactgatgaagaaaaacgtcaaattattcaaaaattcattaaaatgaaaaatgaatttaagcaaaaaagaaaatattcaagaaaagaatggcaacaaaattatgaagaaatttgtaagaaaattggcgtaaaccgtggaacaattaagaaatggaagaaacaatttggcattagctgtaaaataacggagaaagaaaaaatggaaaaaatgaaaaaatattggaaaataaaaagagaaaacccaaaaatgagtgacaaagaaactgctaaaatattgcaaattgatagaacgaccatttcaaaatggaagaaacagtttggaggagagattttggaggatttaaatggatgattataagaaaaattggataaattttcaaacaagaaaattatttacgacataaaaactgattaattcttatattttatcgaaccattgtcaaaataactggcataaaatccgtttatttttctcaattggatacgctgaatt

SEQ ID NO: 1084 - DNA, 1938 bp, Heterodera glycines
ttattattttcctcatccttcgttgaactctcttccttttcatttattctttcaaattattctatgtacactcattgcataaaaacaatacaacgaaagttaagaaattctgtttcttgttgaattgggccctgtttctcctcagtaatacagacccattttgacacggccggcacttctttaggccgtgccaaatggacgaagggtccgccaaatggtccgatcgttgcgactgccttttgctcgtgtgcccttccttcctcccttctctgtctgcccattgtcattgtgcttctcttccctcctctcgcagtgccaatgcgtcgtgcaattccttccgttccgacaaatgcgacgcgtccgccaccgccacactttcggcatttaaacccgtgcaaaggcccaccgccacggccattcccgccagcgcttcgttcagtcccaaaatgccgccgcccgccctttgcctcggccgctcttcccccgcccccaaaatgaccaccgattgtcccatcggtggcaacggcgccgcccttttgcactcgcttttccctcccgcgctcacttggccattcctccatcggtcggtccaatgaccgtactcgcccggctgcgccgctctgtgtccccccgggatacggtatttgctgattgtgcactgtcccgggtagttcagctcgccgctgagtgcgaaatggcaagcggcgattggggagccatggctgacgatcagcacattgcctagggggtggggatgatcagcaaaagtgatcggaagaagtggggacgacagacaaaaacgaaacgaccaaaggcaatcgttgtaaaagcaattcaaatggattcccaacaaaattaaaaggggaggacgagacaaaaactgatctgatcaccggaaaaggtcctcagaatgtgccgaagtgtggcgattactcgtcggaaacagcaaaagttcgttcgttcgtctgttggcaatcggtcggcggcgataaacggccgaaaagcgacgtttaggcaaaggccggggaacgattgactgagaaaggcacacaatgttcgacaatattggcattagagtggccacaatgtgccaaaatccctctgagggattcatttacagaatttcgtcggtgctgggaaagccggggggactttggcacacgttcagcgactcggcaaggcccggctcaatgcaaagggacggcaaattcgacccattttgactcattctgtccacgatttgctgagcagtttggacacagcgtgtgaacggagaacagaaaatcaaatggatgggctcggctgcgagggcatcgccaacttcggaagcctggagaagcccacgggcgctgaaagaggggagaagagagagaaataaaaaagagaaaggaagagggagacaggaagagagaggggcggagaagagagggaaagagagtgagacagatagagagagagagaggggggggagaagagagggaaagagagtgagacagatagagagagagagaggggggggagaagagagggaaagagagtgagacagatagagagagagagaggggggggggagaagagagggaaagagagtgagacagatagagagaagagagagaggggaagggagggggagaagaggaacgataaacagagcgagataaagcgtgaccggaaaatggtcagtggaaaataatgacgaaatacggtagtaaggagatttgaaattttaagcatgattatatgggaataaatttacaataagcctaaaatagaacagtgttttacaaactttggtaatttttttaaattaaaatttttactaaatttttaaacctttcaaaaaactgaattgactaattcagaatgagttttttacatttttattacaatatttaatgctacagatgctttgtgaaatgtcccgaccaaactataaag

SEQ ID NO: 1085 - DNA, 6112 bp, Heterodera glycines
  misc_feature (11)..(11): n is a, c, g, or t
  misc_feature (43)..(43): n is a, c, g, or t
ccccccccctntcccttcccttcccttcccatttgattcgtcncaatttcggatttccccccccccccgcccaattggcttttcttttccatgtccaccattgcatttctgattatcttcagccttttgctattcaatcgttcagtcgaagaacgaacgcgaaaggccagcaaaagcgcagttgaacaaatcaaaaagattttcaacgaaaaagcgacgcaacggtaaaaaagaagagaaaaggaaaaggaaaagcccactcgcctctattgaaatcggcagaatcattcgctttcagtgcctttgcacagaatgacgcggcactgatggcggatgagccccggcggggatttgtgccgagaagggacccaacggcaagaaggcaccacgacgaattggcggtgaacggagaggacggcgactattttgagggcgatttggaattggcggaatggcaggcggagagactgtggcacaaattgggagaagcgaaagcgaacgcaaaactgaagaggaggaggaggaagaagagaaaaatcgcaaaagtgaatgggaaaaggggaaagaataacgttttccaaaatttaataatggggaaattgaaatggaaaatccccgggaaaagtcaaaacgaaacgacgagcagagaatgggacggcatttcgctttaagtgatggcacagacaagagattgggtctgaatttccatgcttctcatcttggcccctttctcggctccatttaatctttgctttgcttttggaacccttctacaaacgatgggaccgacggcgaccgatcaattacgaaatggcggaaaatgtgccggaaaaggtgggcacggcaattaatgggcaaggccaaatggtcggccttctcacttcagacacggcagaaaatacggcttgcattggccatttggcagaacgcaacgtgccttcgcttcattgagggcgggccggacaccgatcggatcgaattttttgacggcggcggatgctcgagttttgtcgggagggcgggcggaacgcaagtgagtgatcgagcagagcagctagggaacgatttgcgcaatgaattatggcacttgcccagggcatttccatcgctacgcccggctgtgatttggtcggcataatcgcccacgaaatcggccacgccctgggcactttccatgagcaggcacggcccgaccagtcccagcacatcgctgtccattacagcaatatcccggccatccgatggaacaatttccaaccaattggcgacgaccaagcgcaaactttgggtctgccatatgacgcgggtcagtaagtgttcagtggcccgaccagcagaaggtcacttggaagtggggaaagaaacggcaccaccaaattcaattggccattcttggcacatttcctctctctctctctctctctttctcccatggcttacttcgtttggccattggcatggcatgggcaaaggcatttgttaaggctcagtgatgcattacggcccttttggctttgctgccgaccaatttaggccaacgatttcgacgttggacaaacattggttagtttttgattggcttatgctttctttgcctttgctttgtcaactttgggtcactctttcgttaattaaattcgattttctaattgcttttttgcccaattgtctgatcactgatcgattgtctgtcccttcctctctttcctttcttttccttcttttccccctttttggcagtttaccatcggtcagcgtgaggcgccttctttcctggacatcgaagcggtttctgtttttctcctttggaagcagcaattaaacccccggggcaggggacagtcccaggggaaaagcaaagcataaaaggggcccccgaagggataaaagcttaatcacctctcacagattaatcgtgcctacggctgcactggtcagtgcccaaccgatctgtggtgtttgcatggcggttacacggaccccaacgactgttcgcgctgcgtttgtccgatcggatttggcggcacattttgcggggaagtgcagccgtctccatgtggcggagtgatcaaagtatggggaggctgatcaaacggataaaggaagtcccaatcactcgttaaaatcattctcatcatggtcatgacaaataatcagttttcattccgatcggccactggtcaaattttgttcaaccattttagctccattttttgtaccgatcattcaccccattgattgctgcttttcattgatcaccccccacaggcttctcccatggttcaaaccgtcgcttctcccgacttcccccgcaattttccgtccgatttgttctgtgtttggctttttcgttcgcctccccagggccaccttttcattgaatttgtcgaggagtccttcggttatccatgcgaagatacttgtgacaaggctttcgtggaactgaaaatgggcccggactttcgtgttacgggttacaggttgaaaagttggaaaaattttgcttttttacttttaatttttcaattcgaccgttagattttgctgttcttcgcctccgttaatgacttttcaatcggttggcgaagaagcagtgatcattcactatggaggaacccaaacggagcaacgcgcgggtttcaggcaaggaaaaccaatcgattgggcttgtacagacggatcagcggtgctgatcagcgattttgatcagattgcgctttttcaatgatctatgcttttgatcactaacattgaccggtgtttaggttctgatcagaaatatattagcaagaacacagtcaaatatcagtcattcagtcaaaagaatcaattattggaagtgataattgccacgacccaagcttagggcacgcgtgtggagtgaaaagaaatggtcggtaacaacagaggaggaagaacaaatcagcaccgaaacaaaatggggaaatgcagtgaatggagccgaagtcagtggcacagaaagggcgagcacaacagaagcgacaatggcacagacaaacggagacggacagaacacgacgacgcgtgagaagccaatgccaacttcgcagccacccccagaagtgccaatgacatcttcgtcctcctccttcccttccgttatgccaatgccattctcttcctcctccccctccgttatgccaaggccattctcttcctcctccccctccgttatgccaatgccattctcttcctcctccccctccgttatgccaatgccattctcttcctcctccccctccgttatgccaatgccattctcctcctcctccccctccgttatgccaatgccattctcttcctcctccccctccgttatgccaatgccattctcttcctcctccccctccgttatgccaatgccattctcttcctcttccccaccgcctcctccttcctctaatgagtgctctttatgcctacaatggtccgaatggaatgactgttcccaaatgtgcggcggatgtggtcgtaagacgcgtcgtcggcactgtccttccgctgtttcatgccaaagggaggaaaagcggatttgcaatcgaatggcatgccccgaaggcaccaattttctgttcaataacggcgagttccacctgttgtggaagggctgctgtgtagggctgttcctgaacaacagcacggcaaagggtgatgggtgagtggggggggggggggggaggacaaacaaacgatggccggcgaacgagccgaaggatccgccaaaactcagcaaaatctcactgccaatcatttcatagtttcatggactaatattcccctctttttgagttcgtccgtccgcggagagtgcggtccgttggaaaacagtgaaaacccttttttacgaattatttcgtctctgctgagttcgcacgacggacaaaaagaaaagacgaaaagaaatggggggaaaagcaaaagtggtgaagacaaaaacggacaataatcaagcgcattttgttaattttattaatctctttgttactgtaaaataaaattgacgacttcaaaacaacatttgacagcggcgaaatcgcatcgtttctcaacggatttgcttttctcatcggattttgtccttttttaatttttaatggtaaagaattgcggtccctaatttaattttttattttggactcaaaatcagtttcaggggctcccatttaattaaagtcattaattttttaaaatttgttcgagatcaaaaaaattgccgcgaattcgcgcatttaaaactcaaaatttccaacttttaaacattcatttttttaaatcaaaaataattaaaatctcggtgcatacaaaatttgcgacgggactggatggaggggggggggggggtcagtgtccaaatttgcgaattccagttatgcaaaacgtggagagaaattgggggataaaccatacaaataagaaccaacaatgaagggataaattgtacaaaggataaaataggtaatttattcaaatgggctgtgttcaaatgcgaaggagttggagcagtatcagcacagttccctccctccctcccttcagagatttcgtccttttggcgtccgttgcgtttggcgttgtccgttctctctgcgcccattgccaatgttccgtttctctccctttcgccctcttttcctcgtttcgttttgtctccaccgttccgcccgggtgcccctcgggcagtgccgagtacatctccaggcatttgcggaattgcgcgtttttgaagcattggctggagcattgggcgcgcaaattggggttcacgtgggagaacattccgtggcacagttcacacaattggtccgccattatgcgcattatcgggtcgcgttcagcctgccattccccccattttccgtaatttttctcttttttctcaccaaacatttcttcgtcgtccgattgtgcagttttcccactgaattcgacctcacgcggtaaatccttcgggccgcgtcggttacgttcgcctgcccaaatgttaggacgcccaacaaaagcagaagagttgccaaattcaatttcttcggaatacctccaaaatttgctaaacatcggaacgaacctcgtagaatgggaaaagaatgtgtgacaaatggccttttgcatttgcacacggtgcacttacgacgaatggaattgggcgcgaccactgacaaaacgcaaattttgcttttgtttcatttttcaacattttgcaacgaaaagcgatggaccgagagaaatccgttgagggaaaggcgactgactgcggaggaatgaataataaggagaagggaaatgaaaggagccgaggcttttcgcctatttatgttccgttccgtccgcccgtccatcggtgccttattttttgtaattgccataaatgccaaattattattcatttctcaggcgcgtcgtccgtttcattcatttgcttttttaattgatgaatgagcgagcggtggtccatttccgagaatgaaaaagtcgcaaaaaggattgtttgtttgtgccagatcaaaagtgccaaaatcggcacaattcccatgacaatgactaaacatccatcgaatgagtgggaaaatcacaaaatgggaaaggaaaaaaactgttggcctcacttcgaagacaacaaatgaatgaatgaatgagtgcccccccccccttctgttacatttttttgtttgtttctaattttggcgaatgcacgtgaactctctctctatttgaaatgagaaatggagcgaaagatctttgttttggatgcctttggttggcacaaatttattttgagttgtagtgaattggtttcggctgtcagtgaaccacataatttgtcggtacttgtgtggtttaccggagaaagcgaaacgggtcagcacacgaacacagttgaaataaatattatgattccgtttcattgaggttaaaatgctttaaaaaaacaatgtaaaatgaatacatttataggcatttaaaaatctatgtggaattgctccggtaaaccacacaagtaccaatttgtcttcaaaatcagcgctttttgggtacttttggggccgcattttcaaattgtaaaaatttatctgctgatggatgcaccaaaaaa

SEQ ID NO: 1086 - DNA, 943 bp, Heterodera glycines
gatgttttgtcctccaacttttttctggacgaatgccccgctttactttcacaggtcgttaaaaattctttgacatcgtttttgttaattaattagtactttctatttgatgagctcctaccatttaggatttgataattaattgcattttgaaagttttccactcctgggtacttctgttccttgcccacaaacaggtgccggacagtttcgatttgggccgaacccgagttcggctgaattcgatcgctgcctctgctcggcacattgccatcggaagtgaatgcggcgctctttttctgttcaatcggagaattggccaaagtgtcaaaccgtaattcatttatttacatttttcacttttaaaaatcaaattcgatgtggcgattattttatttactataaacaatttgtaggttgagaaccgatcattgcgaagtgataagtgccatggagttttgtccggatagtaaagacggcactgaactgcttgcgatcgggcaccattctggcaaattggtcattctgtcattgccttgcgctgacgcagccaacccaaaggttgtgctagggcagtcagtggttttcggaaaaattactattttatcgaatgtgctttttcagcttttgcagcatgttcaggatcaggcccaccggcacagcgctgtccgctgcctttgttggagcttcgatgggcgaatgcttttttccggggatgagttcggcatggttttggcgactcatgtcgactttactaacgtcagtgatgcttcaaaaaggaaactgcattcggtctttttccatttaaaggaacaatttccaattggggtggtggagagcggcggagtcggaggagaaggaccaccgattgtccaaatgctttcttcaggaccgctctttgcctttgctaagggccaaaattgcaaagttttcaattggcaaa

SEQ ID NO: 1087 - DNA, 6365 bp, Heterodera glycines
ggggatctctagagtctgaattgggctcatttcctccgatattttccacggccgacaattgcgcattttgtctttctctgattgcgatgggccgagttgggcactttggacccaaaacgggcacattgaaaaatgttgtctgagtgcagaaggatttgcaggttgacaaattggcattggagggtcgcgtagaccaagtcggtgaaagggggggaggaacgggaaggggaggggggtgaaaaaaccatttttggatttctcacggttcttttcccacttgaggttatctctgtctgtgcttcctcctccgcttcatcttccccctcttcttcggatgagctgtttctcctctccgccccttccctccatcccctccaacaacgccgtcgcattttccgtctgtctcgtcgctcctccgcccatccttccctcaccatttgctcgcctcctcccaccaacggttattctcttctctttggttacctttacggcactgtcggaagggccgtggacgaattggggcgactaaaggacgccgctgcaggaagcgatggcattgagaagagtaaactgttgccaaaaagttcggaggaactgttaggtcgtctgaaccgggaattggatctttttctgatgggagatggagcgaaagaagtcgacgaagttggcgaatgtgagtttttccctaatgtcactgcattttgtccaacatattcctttttcccacaggtaaaactgccaacactttgacggattttctccccgaatttggctccgtttttcccgatggcactacaaaaattgcctcagggctccatcaaatgtttggccaattctatcaacagtcttccaacttatttccctcgtctgccgaagacaaaacatctcaaaatgaaaaggcaacagaaaatgagcgtttgtccgtgggaggaacttcttcttcccgagaaaacatttgccaaagatgggagcgaagggattcaccagcaaaaatggtctttctaaaaggggttttatgtgtattttaaaaatgttttcagtctcttccgctgaccgaattcagctgttccgtggagggcgacgaatttgcacatttggcggaccaatttgccaatggtaaaatggaggaggaaaaggggagggaaaaagtgcgagtggagcggaagagaatcgttgtacgacgcaaaaagctgaaaaacaatggtcgacggagaagggaccgcgaagaggaaaagggggaactaaagtgggaccaaaaaaaaacaaaaaaacaaaaacaatgctttaagaggaaaacgacggaagccatcggtggatgaagaaaaacggcacgaagaaagagacaacgaggacaacgcgacactgacagattgggaacagcagaggacgaccaattggacaacgccggagggcgtggggacggagggaaggggcggccgatggacgccgggggcagtgcccgacgagcgacagcagcagattctggaaggttggaaggagaagcgagaaagtctgctgccttagttcatgtgaccctttgtccgatttagtgttgggaattgtgccaaaatcgatggcatcttccgaaaacggctctaaagaaatgctaatacttcaaaaactgcaaaaccaaccaatgaaagacgacaatgaattggaggagggaccaaatggaagtcaaatgagtaaaaacgtaaatgaaaggacaaaggacggcgaaattgacagtgaaccattggccgatttgaaagtgcacaatgccaatgggtactctttcccgccggcaaaccgtggacaatttgtggaggacgaggtgggcagcagttactcgtaattcaatacaaaatgtacttacaattagtggatgaacaatttaacattgcaaatttattgtaatttccctggacagtttccgacaattgtgccctccgtgtctctcgccgatctgttcgctctcttcccttcgtcatccgttgcgcactcttccgtttctgccgcactttctcctcctccccctccgttctcttcctccccttccgtcactttctcttcctctgcttcgtcttcttcctcctctttttctgttcatccttccccgcactatcaaagccttctgcgtctttccccacccgaccaatgccaatggcgtcgtttggacgtgcctttcactgttagcgacttaacattgtgccgccattatttaattgcatgtcccggacacaaacggactaccaaaagcccatcggtggaaaagcagcggccccattatttgatggcaaatttgttggaagacaaaagggcaatggatgagtgggtcccactgagagtcaatgcatccgccgtggccgttaacggtcagtttcaccggctctattggctcttccaacgtattttgtcacttaagatgagggcacacttttatggcgaatctatgacggcgttgcgtattcgccatgctctacgcctgatccaatttgtccgtccgcaacgctttcccggacaacggcttggatggaaatgagcaaccaattcgagggcgacattgtccaaattgctttgaatagtcaaaattcgtggtttctcgccgacacgggcagaacaaagaaagagagaacggtgagtgacgggaaaacattgcctttcatctaaaaggatttcccccccccccaaaaaaaaaaaggtgtgggtccaaatgtttcttcctgaaatgggcatttttcaccgcgctgtagacgaggacaaccgccacttttttacccaattggccgtttctgaccatgcggtttggacactgagtggcggatttgttgtagcacgagttggcctcaagttggacttggctccgatgggtctcgactgggcggagtgagttgactcggataattttaattcgtttccttccattcgatttttgactcaaatgaagcttttgaaaacgcataaagaaattttctcgcgtaaaactgccaattttaagcatcgacggacaaccgcgcaaatttgtgtcaattgttcttcatgagcacacggggttcggacttgagcgtaacggaaatgtttggtttgtgcatggagtggcggagaacgcgcctttcggactcggtccctggttcaaagtaagtcttacaatcagtgcgtttgggttcacccgtctctcccctctctctttgggtctgttccccgcttggcgacccgtctctcggcctctccccttcttccgaatggcgtcttcgtgtcggcgcccccggcgttttcgttgttgtcggttccgctttgctccacacaaattctcctctgatcggcgattattttggccacgttgttcctgatcgacttgcactcaacgaccatttcacgctgatcaccgcctctggcttctgcggtctcgccaacggttgttgtttaaaaaaatatacataaaaataaacgttttccgccactcctcagaatgtctcttcctgtgtcaacctgcctccaatgaattgttctccttctctttgcgaaaacggcacttcacttctctgcctccgtactgctccaactcgtcggccaaagtcaaatgtctctccgccacttcaacgcatctttttgtgcttgacaatagcggcaaattatacgtccgaccggtgggaatccaagcggaagtaaacggaggacgaattcgccgtcaatggttgcgagtggcgatgccaagtgaaggtggcgattggcatgaaaagctgtcattgggaggggaattgtttcataatttcagacacttccactgaaatggaccgtgcctttgttggcctttcctcgcctttctctctcgtctctgtcgctgtctgctcctcttctgtttgggcggtctctgacgaaggctccgtttgggcttctcacagtttacattcggatcattcatctccatccgaaatcgatccaaacgatggaccaattgaaatgacttggattaaaattgaaggtcctacgcccgggaaggaagctgatctacaagtgggctgttcagttttattggctttcatgcacatgaattcagattcgagtttcgccctcaggaaattccctttggttgttctccaaatcgtctgggattggctggtttcgtaccgacctatcggagcacaatcggatgggtcggcgatggacgacttcgaaggtgggcaatcactggtgacaggggttcatggcacaccctccctcagaccattcaaagtatttacatcgacgaattggcggtgagcgatgtttccgtgtgggcacttgccaatgggacgggccaactccaccggcttttcccttttggctggcagccgatggatgttcgtcttaaggcgctttctgtcgatgccttcgagggtcgtctttgggcgttggacaacgaattccgaatcgtccgtcatgaagtaggccataccactccatgttaattaccttacgtgtaaaaactgttgttttttaaaatttacccaacaaatttcaatgtgataaaagaacggcactgcaataaagggaatcgagcaagttctggcttcaatttcgtatacaaatgttagtttggcgaaaagaattaaggcacattttaaaatggaaggtgaaggggaaaaatggatagatatattaactaaaaggaggaaaaacaatcgaatctggccgtggttcttcttcgtcaccctttggtcacttgatggcattggcattgcccagggaactcctcctgtacactaactgtcggtggctgttcaacgtgtccgagtcaccctcctctccctttacttccacgaccgttttcccagcatttccttcactgcaatttgatggaattgcattattttgggatttatcaaccaaaggctcttcaatgctgtacatttgatgtactaaataatttaaaatatgacaagaagcgtcattttgtaccaactttgtctcatttgtatgccgtacggtggtggcaattcactgggcattggtggcactggcggagggacgcccaattcgcgccggaagggctgccgtttttggctttcgtggtaattaggcggcaacatcgcaacaacagctccgctcgccttattattgggaagggtttgtttggtgccattcgtttaccatgggatgctgctgctccgcacgctctctccgggcatcgatggaatggtcgcggatcagtcggcggcatccgccttcgccacgtcggttgggcggtcccaacctggtcagcaacggctttcccactgctgcaaccgctaaaaggctacagtactcgaaaagaaagcaaaagacgggaaacgctgcctccgccgttcgaaattccaatgtcctccatcgtctgctgttggtcaacaaaatccgactgctgttgctgcgcaacgcccgcgaattgttcatgggcgcagtctccaccaaacgaattcgtcccgacaaaagtgctgctgcacattttgtcgccgccagtcacacgacgacgtgaagactcggagtattggtccagaaaaacgttattaactggtgagtggttgacagcggtagcactcacaaaataccgtctaaattttcgattttgcaatgataagatttttcaaaattttccggagggggaacgactactctactttttggtggacgaactggtggaagaagtggtgctcaatgacggttgacgttgctgctgttgttggggtgtcactgcgttcccatcgtcgtcggtcggagtcgagacaacatttgtcggatgttgcaacagttcttctgaggaaggggacaaatccaccaacattgttggctgatgagacggatggtcggtggaggaggaggaaagtgacggatgttgggaagggggggcaccggcgtggagctgttgttgttgcgggagttcagaagagggagtggtggcggaaattgattgctgctgattgtgagacagcgcaaagtcactgaaacaaaatgacactgacaccatgtgcaatgtcggatgccctggtgttgactgtgagactgacctcggcctggcgatgttcggcagttttggcccttccgcgcagctacttttctccgacgttttcatttgcgcccgtcgttccgccatcttccggcccaacccctccatcctggcaagcacatccaagccgcagccgtgtgacctatcctcataaagtgcagcaattcgtgcactggtgggtaattcggcggatgaacggtggcgaaggttttggtcgcgcatcgaagcgtaaggcgagttgcggtgttggtaaaggaggacagcgccaacacaacccctgtacggagaaacaacccccccagcgtccaaaaatgcgcctcccccgcccccttgaaatgggcaacaaactttgactgcccttgaaatg

SEQ ID NO: 1088 - DNA, 1500 bp, Heterodera glycines
cctccaaacggggccagcagatagaatttgttgctcaatagttgcttggttgcccttctgactgagtgtggtcaaatgatggagcaaaaagttggcggattccgtctttccggagccggacttaacaaaaaaaagcgataagtccataatatgaatttcgatttaatcaggaagaatgacattcaaatttctcctacaaatataaaatagtacttatttctaaggatgtgcttgaaaatcaataattcaatttcatccatggaatctacttgtatttaaatttttatgagctaataatgtatgcagcttgaagtttatttattttgtttgaagtttgtatttgtcagagattagcgccgtatagaaattttttacctctccagaaattacgaccacttgattttctttttgtttgatcagattatggtaggtgatgtcagcaatggcaaacactatttaaaataaaaaataatttaaattaaattttttaaaaaaatttcctatgtgtaccatgcggaggtaatatgcccaaacgtcgactctgacaatacagacgcgaatattttggattataaatagggaaaaagctgaacgggttgacagcaaccaaaattgggccaatgtaagtgtatattttacctataattatatttaaaaaataaattattgttaaaaaaaattaattataaataacatttaaatccaccagcattaattaattaccattattaaaacgatcacgcaaattctccagcaatgtctgctcagtgagttcaggcagcacacaaaggtccgcatattcacggtccttaatttaaaataaagtttaattttttttttcctttctttttacttgtggttgggcaagaaatttggcgagaaacctgaaatattcgtgatttattaatagaaaaaattcatataaattgtaattaaattaaatatgctttttaatatattaaaaataattaactttattgccctttaaaagcagtgtttatttgaaaaaagccaaaaacgtacgtgtcgatggccgatgccgtcgccattacaaccatggattggtccaccgagtggcgcttcttacttttcagaacgagccgattgcgcggcacggacgggtccgcgttggcgtcaacgtccgcagaaccgcgaggccacatcgtctgcacaatcaccgggtactctgttgagtctaaatgccatatacaataataatttggaataatttagtattaatttttccgattcacgggatttgcttttgagggggattaatcaaaacgaggtcagattatggcagggatcctatgccatggattatgggttgatacttttttgtttatccctctttagtttacaataccaaaaatgaatattgcccttttggtaggaatgattgataccgaattcttttttactcaatatcgacgatttatgacttctaacttctattctcgataccgtactgatgaccagaaaaaatttgcggtgtcgtgc

SEQ ID NO: 1089 - DNA, 1712 bp, Heterodera glycines
aaaagctaaaggcgtatgtgcgttcaacggtttttgctagctgcttctcctctttccagcaagcagatggagtgttgttactagagctttccccattgatagtgggtgatggggcggggggaggaaagcactcgtccgatcgatcttgatcaaccccattcattcttttctgcctaccctgcccaagtcgtaggctgctttttcaagagcgaagcggtgaaaaaaatgcggaaatttcaacgtgaatagagagagccatctactcaatcagcaaagtgaagggggcgcggggttccccgcttcttccaattgatatgggagggggggggggagggacaactaaaatcgaacacagattttttgttgtttttataatgacactacgggttgaaagtgaagccctggatttagattcgaagccaggttcgaaacaaagccaaaaaatttatgagggcatcaataaataaaaatttttgaaggtttttaaactataacccttcctgatcaaggtcgtggctctggatttaggcttaggtaattgcacattaagttcataaatataaaaaaacgcggatcttctaatatgaaatgttgcatcgttgccaacaccgaaagaatttaactccatcatcatttttaaccgttttagcacaaaaaatcagctgctgaacgtgaagcaatgatatggtttggaacagcgcctgcttctgttcttcctgatcacttgattagagcattcatttcctgtgttgatcgcattttctaaatctccccacccctcccagccattaatccatcacttttggcctcaaggaatgtgtggaaacctatttttagagaacttttgtttacacaaagttaaaattatcagaaaatgaaatggatttgtgtcaaattaaatttcaatttgtgagattttatgagaaaaaaaaaattattagtcattttcttcagaacaatggataaacaaatatgtaaatgttttattaataattgaaactcaatgataattcagaaatattttgtaaaaaaattcaattgtacaaattccattgtaccaaagtccattaaattaattaccgaagaaggttttcatttaaagatctaaaaattagtataaatacatttagtttacttcaaaaagtgattaaaattatatgtatacaacatttattaactacaaaaaatgcttaaaattatattcaattcgtttggcgttgaaaatttaaaaaaggttgaaaacttcgattttgaagctttgaaaaccctttaatttatgttcaatttatgtaatttaatccttcaattttatttgattaaattacatttataaaacgaggaacaaagtgcatttatttattattgtttaaaaatcgaattcttctttttgtgtcgagagttgcgctgttttcagtacaacaacagcaggagaggccttttgcaaatcaattaattaattacgcgtcgttatttgtgtgctcataatattatttcaccccaaaaattgtcgtttttctgataagaaatatttgtctgagtccatccatctcattcaatggtttcataagtataaagtacaaattacctcatttttatgtttttatgtagtcaattaggaattatacaaattaccttctaaatgtgaaattatctcggctctaatgcactttatgagtccaatcgacttttatgagtccaatcgacctttatga

SEQ ID NO: 1090 - DNA, 11924 bp, Heterodera glycines
aatgatttggagaatttttgcgattggcaaaatgtttgtcgattggtggaaccatcgtggcgcgtattttgtggccaagccacacatgcgtacggcactgttggaccggccagaatggaagcacaaatttatcaaattaaaagtgaattttttaaatatttattttgttattcccaatgacataatgttaatcaacagaaaggttaaatttcaaaaaattgattagaaaatttaaagaaatgtctctacgaatttttttaccacctcgaccccagccagtaggatgattttttttgtgaaaaatttcaattttagggatttatttttataaattttttcaagtcgatttttaggggtacaatttcaaaaaagtttcagctcaggccttaagggtgtttttttgtatttaataccgattacgacgaatttttgtaattaaattctccgtaattacggttacgggttttaataattgaaaaaatagttacgtcaagcactaatttgcaaactcttgaaaactccttcccgactccaaatcgttcggtaatcttacaaaaatcaatctgtccgatccgaggcaattttttaaaattatgtatacaaattatattttttaattgtagcacattcaactacatttcgttgaaatggtggaaggcggtgcgcatgagtcaaagccggtgatgcttttcctgcatggctttcccgagttttggtactcctggcgctttcaaatgcgacatttctgtgccaaatataggtactaaaaatttaggccaaaaatctcaaattttccgatcagcctattttgaatttaaaaatttcaatttttttagagtgatcgctgtcgatctgcgtggctacaacgactcagacaagcccatcggcatcgaggaatatgggctggaactgttgtcagctgacataatggagctgatcgaacggcttggcaaacaagtggtgctggtgggccatgattggggtggcgtgatcgcatggaacatctccatggaggtgggctgtactgtattaattgaaaactgtaactgggattttatgattgactttgattatcggagatagaaattatatgcaaataaatctcacaaaatcgaaaaactgattgtcttattcattttttagttagtcagaattttaaaactggaaagtttcacataaaaattttttcgtaaatttttaaatttttacaaaaaatgcaattttttaaagcgtttattaacatatgatttccagctctagcgaaccaggatagaaattgaagtttgatccaaatttgattggaaaaatctccttggtactcctaggctcggtgcgtcgagctaaccaccctagttttaatttgttcaaacgctttcaaaaatttgagtgatcgatcaattatcctttactgatcatcccatttggccttagcgccccgaactgctccagcgacttgttgtgatgaatgcgccacatccaaaggccgcaaccaaactgatccgtacacgcagctcacaactgcttaaatcatggcaagagcttttccaatttaaattttaaattcgaaaatgtgccgtgccgtccttttcaggtacattttcttcttccaatgcccttggatacccgaaatttttctgtgggcacgcgattatggctttgttgagacgtgctttttgggcaaacccatgggcttggttcatcgcgagaatttcacggcagaagatcttgaagcatggaagcatgtgttctcgaagccaagtaaaaaatatgcaaattttaaaccaaaaagttttttttttgccatttttaagattcactcactcctcctcttaattattaccgtgcctcaatgcgcgctgtctatcggagacaattctcagcggccgttcatcaggtgaaatgtttcagttttgaaaaaattaataaattaatttataaattagttttcaaaatttaaatactattttttatattcatttttcttgaaaaaaaaaccttttttaatttttgtattgatacaaaatatttcgaaaaccatgatggctaatttcatcaggtgtcacataaaattttgataaacataacggcataattgatttacatctgacaatgaggcatttttaggttttccaataatattttaaaatatttttagccaaaaacattgatcatctggggacagcaggacgctgctttggacctggaaggggccgaactgtcggcacgactgtgccgtgacgtcaaacttgaactgatcccggacgcgtcccattgggtgcaacaggacgtgcccgaacgtgtgaatgccgtcatggaagtgtggcttgctgattaagccagccccaaacattgactatatatttattaatgctaattatgtagtaaattatgctaatgcaatttaattatcgtcggacaatcaaatgattttagtcatttaggaaaaatactgtgaaaatcaaaatttattttattttattataaaattttgcacttttcttcggcagtttcattatccccaaaaattgaaggtcaacattttccttcctaatcattgaacaaaaaaattgggtcgaccttgacaaattatcgcaaaaactgggttacacaattgttaggtttattcgcccgtttgcggacatatcaactgatttattcaataaattctttttaattttttttataatttaaatttataaatttaattgaatttaaagaatgaaaatggatttccatttaccctgtgtcatcgtccatctcattctttgcgtttttgtgcttcctttttcatatagtcatcaacaacaatcaattggagataatcaagcagaaaaaactcttgagaatgcacttgggtaaacaaattcgattcaaattagtgttatacacagggttcgtagatgaaaattttcaaaagcctcatttggcaagcaaaaaagcctcattttgggtcaaaaagcctcattttcacaaatttattcaaaacacgtttaaaatgttcaaatgtgatatttttattgtccatgatcaattgcaattttttcttagaactaagcattttgtgaaattctgagcatgaaaaatcgaagttgatttttgcggcgctttttccaatttttttggggaacaggggggtccggcggtgcctatcggcaccaccaggaaaatttttgtaatttttaatgtgatttgtttaacagaatttgcccacaaaaatggccaaattttgcaattttatgcaaaaattttaagaaaatagaggatttttagggtccggcggtgccgatagggccgccgggggaaaaattgagaattttgaccatatttttagcagattttcattaaaaaattttttattttgtggttttttggaaaatttaacaaaaaaccacaaaaagcctcaaaatttctgaaaaaaccacaaaaagcctcaaagcctcatttcgaaaatttagcctcattgacctatctaaaaaccacaaaatgaggctaaagcctcagatctacgaaccctggttatacatatttaaaaataaaattattgataaaaattcttttgtaaatttgctaacgaaatcccatatcggtagatagtgggagatgttggttctattgcaatttaatgagtccaatcaatacaaaatctcagcgtttagacaattgccaaaaaagcatccaataaaaattgactggactcataaagatcgaatggactcataaaatgcaatataaccgtgatatgttaggataaacaaactttaaattacaattctaactagggttcggaccccgtgggcgggggtggcttttcgcgggggcgcgggatggcgggggtcagagtcgcgggggcggtggccgggtcacgacaattccgcccccgcagggatggggcgggggtttgatttgaattagctccaaaaaatttcaattccttttggcataaattgcacagattttgtctaaagaatgaccaaatttattgatttatgctaattttttaagaaaaaataggttttttggggggccggtggtgccgataggcgccgccgggggaaatttttttatgaattttgttagaaattagccaaatttttcagaaatttcattcttttgtatgaaaatacgctctaaaatcagaacatttcctagaaataagaacataaagaaaccctgcattaatcagataaaaataaattcaaatgaaaacgtcaaccggtgtcgaactcctaacaagaaatactgttagtgttgaagcactaaccactaaaacacaaatatattggaaattaacagcaaatatactttatttcataaaaaatttgtcaaagatggttaaaaattcaaatttgtataaattttttgccttttatcccacgatatgcaattcttagggggtgtattttcacccccgtgcccccgcgggggcgaaggtcgcgggggcgggggtcagagtcgcgggggcgggggttaggccaaaaaacttgtcctgcccccgtcggggacgggggtgacggggtccggaccctattctaaactaatgattacgttaaaaaaatcgtgggataactatttacataaaacttactaaattaaatctagtaatactgctgctaatcagccacgaaaacgaccaacaccgccgagttcgcctcctcgtgcatttgtggacgagtttgaaaaacggactgacaatggaccaagagcggaaaatgccgaaaatcaaccaaatcttttgaatttgaatcgtcatgagttcaaccagcttgacgaagttggcgcaacaacatttgaaccgttgatcagcagactgatcaactcggcccgttttgatttgccacaacaacttcaccaaaactcttccgctgctacagctaataatattagcatggtgttgcccattgcgcaggaaatgatgttcgaatttgtgccacactttgaacgggatttttacgagctgatggtgccccaggggtacaacgaggtgggatttgacaaatacgatttcaaattattgaaaaataaattaaattaatatcattttgacggaaacaaaaaaatcgagacggatgagaatcccgcttttatcccgttctcgtaaaaacccaatcccggcaaaaaagacgggaaacgagaacggcattcccggtttttcaagggaataccgttccagccggtctaattttctgcaatttctaatttaaaagaatgtaggaatcagaaaaaagagagtccaattactgatccaaaatgttcgatttttgtttcgaactaattaacaatgaatttatttccccataggctaccaaactgatcgctgttgtgtcattttttgacggacctttcacagtgtcaccacaatttgaagtggtcgaggacaaaaacaattggttcagtattggccacattattttaagccaggtaataagcactcaaaaaatttggataaaatttgtcaataagtgaatttttaaatttaaggaattaaattacaccctcagcgaagttcaaattctacttaaacctggaagcattgtgcagtgggaacagaatgagaatggtgactacaattttgagctacaggtagaagagtctcggtcatatacaatatttgtgtaaaaatttttttttaggcttcacatggccacataaaatttacatcgaaattacgcgcaaaggtgctgaagggtatgcgcgaaattacatcaatgtggacggaagaagctgaactgacaaaacctactgtaacgacactggttacggtaagtataaaaccaacaggaggaatggaagatactgtattctctaaaattgttcaaatcaatttacttactatgcgcttttttgtttaatgcatgcttttcaggaacccactaccgtatcatcggattcacaaccatttactgtatcgtttgacgattttactgatgagaaaagcgatagcagcagcagctacaatgaaactactgcttcctcttctgatgatgagccggctcaaatcatattggatttggatcacaatttgtacaatataaatactggttcatcaacagaaccaacaaaaacaattgaatcaaaagattccaaggatgaagcactgtttatgcttgatccaatcgagattgagctgaacaacagtttaaacagcattttgtcagcgtccagagagatcaaatggacaagaaggagggaagtgatgatgaaaatgaggagaaggaagtgaccaagacatcagtgaggacaaattttgtacagaatgaaatgggggaagatgaagcggaaaatgtggggatggaagggaaaaaagcggaggaagagaacaagaaaaaagaagagaggcaaaaagataaaggaaaggaagaagaagaagaggtagagaatgtgggaagagagcaggaaaaagaagaggaaggcaaagcggaaaagaaggacgaggaagtgggaaaagaagaaaagaatgggcaagagaagaaggaagaaacgaagagggaggaggaaaaggaagaaaaggcggaggccaaaaaagaagaaaatgaaaataaagaggaaaaagaaacaggcgaaaataaggaagagaaaaagcatcatcttcttgatgtgaacgactacattaaagccattcaaattgaactcgatgcacaattaatgggccaagacaatgacacaatttggcaaattgccgttccattcgcttcattgccttctttggcccataatccagttcccaatttggccatatcaattcctgaaagcaaaagccaacctattagccatgacgaaatggattatcttgtacggcttgaacttcattcatccaacgacactgtgttggacatgcgtcctcatcacattggaccaggagacagtgcacaattatggcttaacgaccaagaaaaagtggcaaatgagccactcgatttcacagtaagtaaaatatatctatcaccataatagggatatataaattattatggaattgggtatttggaagtgaattatctcggttgagtcattagtctcactcagtttgaaactactaaaagttgtttaggtttttgcgagtctcgaagactttggattttcaattcatattttaacatttaaattaaattttaaaataatattaaattagagttggaaagaaattaattcattttaaaaatataagaatatttccttttttacagttatttgcttccgttgttgattggaatgggcatcaaatcagtcaaccaatgagcatttttaaaggcaaatttgttgttgaggacccacccaagggaccaccaccacaaattcatcatcctgaagctttaacgggctatgaatttgtgattgatgaaaatgcaactgatgggacagaaattggacgcataaaattggaaaattccgatactaataatgcggatgaacatgccgaatttgagctgttcggccacggatcacatttgtatggacaaaaaacaaaatttaaaaaatcccgaaaatttccaagattcaaaattgactcgggtggcataatgaggctttactgtggtgccgaaaatggatggaaatctggcaatggtactcatcaatgcttggaccacagcatggtacaagtataccatctaattgtgaccgctatgcgcaaaaatggaggcattaaaattcaaaaagttaaaagttaagaaaataattcagggttccgatcattgccggaggcagtaactgttcgggtacgggacgtaaatgacaatccgccagaattgaaattgttctccgatgaaattgttgttgtgaatggacagttgagaggtgatgccccgtttatgatcggcatcagtgacaaagacaggcaagaaatggtcaaaaatcgaatttttaaagccctgatcagctgggcaagcccttcttcgatcagttatcccaaatcaaaaatcatgatatggtttaaagtgtcaggtcaatattttggtatagaaaaagcggattttgttttttaggttaggtcaaacacttaatttctaaaacggtctaaaatttttgtttgccttataatgaatcacatttggatgatcagaagatgatccacatattgatcactgatctgtcaacatttataaacagtttaaataaaatcacatacgatgatcaaatgttctacgtgttgatcactgatctgaaaaaaactaattgatttattattgtaaataaatttaacaaaatttaatttcagtgcacctgaaaaccgtttcaatgccctttcattggctggaaatttgtcaattttctttaaattggaacaatttgatgaaataaatggacttttcggcgtcatattaaaagacggggtcaaattaacggaagagggcacccatgaactgttgttggttgttgtggacggaagtggtcaaagtgacacgaaaattgtaccagtacgggttacggtacacattattctgtctgtaaacggtaacatttgtgcattaattattttcagaataatttgaagctataccatttcaagaaccaattatataacaaatcgatgccagcctaccgtatccataccggtaatttctttggttttacagtaatttaattttttggtttatttgaaggggtgccaattgtgcagttgcagttaaagcacccaccgccgagtactgttacagtaaactatttgatcagtgatggaaaccctggctggttgtcggtggagccattcattggcaatgtttttggtgccaatgttccaaagtcattaaaatcttgagttcggcatttttgatcctttttttatttagggaaggtgtcccaccaggcaattacagtattcaagtggttgctgtagaccaggaaaaacgacaggtaatgcatgaattttttttataggattatttcataattagcacttaattaagacgttttgaatataatgtgatcttaaaggttttggcggaatgtcaactgttgttggagctgacgggtgaaccagtcattgatgaacagctccaattcccatcgccatacgtctcgttaagcattgcccgattggacaacgatgatgaaaatgatgtcaattccaaaaaataataatttaaaatataaaaatgtgatttaagaaaatcgttgatttggtgccattcccagagggcgaatatctacggcacgctgagttcaattatggcgatttaagagcctgggatgaggctgaaaagccggcacaactgtcgaaggtgtccattcaaattggaaaattgattatttttttaatttaaaattttcagggagccttaactgtttttatgcccggaaatgggaccatccgtttggacatggcaaagttgcgcaatgtccgttcgcttcatctcaatttcacgataaaacccaatccaaattttattgccacaaatggaagcgaaagtatggaaagttttttagttttttttgaaaaaaaaatttatttagaaatcaacaatgtaactcttgtggccatcacacttcaatcggatgaaacaaaaacattggcattacaacgacagcgcgagaagccatgttttgccgctccatggacaaatgaatcggtgccaattcggcttcgaattaccgaagaattgccggtgaaccatcattaattactgtattttcacgggctacagtatttcttagatggggcaaataaaaaaacgaaattattatgaaaaataaaaaaataaacttaagattgaccatcccatcatcaaattgcctgcttacaacccaatgaacagcactgatcggctcaaaattttcatggatggtccttattcaaaattgttcaccattaatgatggtaaaatttaatgggaaaacaggcatggttaaggcaatgtttttctaaattaaattaatggcatttttaaatatttgaatttcattattaaaatagatttttattagaattattggatttccatatcatcccaagccttgaaaaatcaaattttcagatggtgtcattgctgtgaaagctcgacttgactttgaacaacttttactggatgatcatctaattgaaatcctattgcttgctacgtcaatgaaatcgccaccgcaaagcacgacagctcttgtacagattgaactgctcgatgttgatgacatggcaccggtcattcaactggtcaatggcatgctaaaagagccaaacaggtggtgaattggagcaaaatattttctggaaaaattgaacatcaattttactgggataattggattcttacagagaaaaatcgtcctgatttttttggagtagttttatgactcagaaattccgtaaaaaaaaaattaaaacggaaatatttgagaataaaagcattaaaaaaatactttaatgaataaaacacaaatttataatagaaatttgatcaattgagcttgaacattcaactgtaattaaataaatcgattaaatacaaaatttaattatttaaaaaattagagtgctagaggatgaccaaaatgctttgatcattgtggacatagaggaaaacagtggccatggcaagcttgaacttatgctgttgaatgtttctgatgttgattcgaaaaagcatcaatgtgaactgatcggaggcgaagggaaatttgcaatcgagaaaaaagtcaaattaataattaattaattgtaattaattaacaattaattttgttttataaataattagaatgcggcggagaatcagtggagtgtgaatgcaaaattgagtgaattggatcgcgagttacaagaccattatgcactggtgttcaggtgcaatgatgaaggtggtaacaacggcgaaattccggtagaattttaaaattaatttttaatcataatatttatttcacccaatttcgaatataattattattatcatgcttttgccatatttaataatttgtcctaatcatacatatttttggaaaatattttcagatccaattgaatgtgttggacaaaaatgacaatcgaccagtgatcacgtgggatcggcaggacacgcaaatccgcctgctggataatatgccggctggcagtgcggtgggacgctttttcgcccgggacaaagacgcgggggacaatggtcgcgttgaatttagtcttggacagcgacagcagccggctgccacgaaatgtgagatttgtaaatttattccattgtatttgttccgatgaccccgatggaattcgtcgcccttggattcaagggtgtcctttaaaataagtatcgaaatccaatggtatctatcctctccgtccctttttgacagaaatttttaagccctaaaaagttggatatgacaaatacccgagatccgagagtttcggatcatcaatcatgaatacaactgtcataactcaaatctgaatttaaatttcccagcagaacagcttttccaaatctgctggaaattaaatagtagggttcggacaccgtgggcgggggtggcttttcgcgggggctgcaaatttattgatttatgctaattttttaagaaaaaataggttttttggggggccggtggtaccgataggcgccgccgggggaaatttttttatgaattttgttagaaattagccaaatttttcagaaatttcattcttttggatgaaaatacgccctaaaatcagaacatttcttagaaataagaacataaagaaaccctgcattaatcagataaaaataaattcaaatgaaaacgtcaaccggtgtcgaactcctaacagaaatactgttagtgttgaacactagccactaaaaccaaatatattggaaattaacagcaaatatactttatttcataaaaaatttgtcaaaaatggttaaaaattcaatttggataaattttttgccttttatccccccaatatgaaattcttaaggggtggattttccccccccgggcccccggggggg

SEQ ID NO: 1091 - DNA, 9113 bp, Heterodera glycines
agaaaattcaaaccggggggatcgacccttcccctatttttacatgatttttaagagtcatgcccaactcatccatagcatgatgcggtcttagtcgtggcattttccattgtgcgatatgcttgtggcattttttgtgcgtggatgagttgggcatggatgaacccgatttataacaatatttgttcgttgaggggaccattctattatatctgatgcgagaagtacctgctcctctcgtccattttcttgagttctttgtggaagtatttcgtcttgacgtcaaagtccaacaatttggggaagtgtgtgagaatagcaaaggcacttccctccaggttctgcgtgttcccacgtaaaatttgattgagcaccgatcgatgtttttctgtaaaaaataaaaacagtgtaattaaaatcaattggcagcgaaaattctaacccgcaaaagtgaacatttccttctggtatcggcccagctcatcctcgccggagttgccgcccgcagaagaggaggccaactgaggtgaagaaccgccagttggtgcagtttcagggagtgcagatggagccaattgagcagtttgcggtatcaccaacgaataagagaggaaaaacgcctcggcagctgaagggaattttatctatttatctggtgcgttatttaaaagattaccattttgaagacacaaaaaccgccatgttggaatcttcggccttctcgagaagtgacaggcaattgctcagctcctcccaaagtggcgccagctcatcgaccatgttccggaccagtgttgcctcgtcactttcctccttcgcgtgtgtgtcggcttgaggtttcgatgtcgttgcctgctgctgttcctcggctccctccttctcagtgtcgtccttcttttttgtgagttgcgctttcttccgctgttcctccacctttttcaactggttgcacaaatattgaaactgaaaaacaccaaagatatataaataagttgtgataagtgatgcaatcgtaacaaagaaaaactcaccgtttccagcgacttcagaaatttgccgggaacactttctcgaccagaaacctctttcaacacgtgcaacaagctttgttgtccttaacgaaccatataaaaatgcacaaggcaccaaacacaccgtctccagattcagcagcacggcgtatcaaaactaattgggcattcaattgattcccatggtttgtgaccgattcgtaaattgctcgcagaatagcagagctttctgttggaattgcccgaaacatctcagccaacattgaacgaccatcacgcaaggcttctccggcgcagctgctcattaaagcctaaagctattttttaaacaatatcgtgtataaacgataaacacacatttgtgaagctcttcaagcgcatcccaagccaaagcttcgattcatcggacagcttttcatgaaagtctgatggaactgcttgcgcaagctataataaaaatagaaaataaaccataaaaaacaaaacaaaaattaccgatgaaataatgcgaacaatccgatccgaaatcgcacgactctcctttgataaattggaatccaacagactgaaaagttgtgccaacggcgatttctcgatggagtcagcgatcatttcttgcatcattttggcgtcttctttgcgagagtcatcaattggtcgcccatttatactaaacatcaaattcaaataagaaaatagaatggattacacctgcgaattgtattccaaaaaagggaggccgttgctggaggagagtccgtcatcacagttggcgcacgaatttgtgtgggcataaaattccgcgcaaagctctgagccaaatgtgccaaattgtcgattacgcgttgagctgccattgttcgaatttgattgttgatgaaaactaaatgtagaaaaaccaatagctactgaaataaaacaggatgggtttacctgagtttgaagtgaccagaaggaccctttcgggccgattcaaaacattctgtaaacgaagctcattgatccatccaaattggaatttgccgccatccgcaggtgcctcgtaaccgtccactgatttgaacttgtccagcccatcgaacattgacagcagtgcccaaatggtgaaatcgcaagtgcccggatctatgcagatcagtttcaacaatttctgaaaccaaagggaatactaattgtaagcaatgaatgctgagtagtcttctacctgaagacgcacagtgtcgaacttctcctgatccaacaggaacaggacgagaagtgtgcttatggattccttgtccagtagcggcacagtgcgctcgtcaaacgaagtgtcggcttcggcagaagtgggaagaagatcaggatcgattttttttattttatgacgatgcaattcggctccttcgggcggggcgaattcggccaaaaatgcggggtccattcctataaattattttgcatgtaaattgataattccaagtaatttgagtgccttcgggaatctccattcccattattgctgcgacccgtcccactggtggcacatcggcatccacccgagccgtggtggtttccgttgcggcagttgcttcaggcatggcgctcacttcttgctgctgtgcttggatctgtgccctccgctgacgggccatctcctgctgtcgttgatggtcacgaacaacttcgtggaaaatgtcgtcgggtagcgcagccaaaaatgcggggtccattcctataaattattttgcatgtaaattgataattccaagtaatttgagtgccttcgggaatctccattccttccactggtggcccatcggcatccactcgagcagtggtattgtccgcctgactgatctgctgctgaagtaaatgatctctgataacctataaaggtaaggaatcaaaaatgcatgtgattttcaaatttgcctcttgtctcatatcttcgggtagagcagccaaaaatgccgggtcgactccttcgggcacggtggcatcgttgggttgctgtgcattggtgttggaaacagcagtagtcatttgacccgcattgtcggaagcttcctgtgatgccaaatttgtcaggtcggcttcttcggacacggcggcttcattaggctgtggttgctgttgtgtattctgatcggaatcagtccctcgctccgaattttcaatggtttccgttacggctgttgcttcaggcatggcgctcagttcagtggtgagatgtgcagagacaatggcgcccatgacgaacatcgtttgcccttccacggttcgacaccattccgccattctgtcgacgaagcagggaagcgagcgatcttcggtcgatgactcacgaggcgcaaccggaccatacccagcctaaaaccaaagcaaatattagttgaggaacgtaacgagaaaggaagcaaaataccaaggatgagaagagttgattcaaagccgtgccgttttgaagaacaccaacttgaccggtgttaaatgcagccaaacgctcaatgtccaagaaattgcgcgccccagcacgaattcgaagaacagcaccgcggacattgttcggagcaagatgagcaaacacctgtgaatattttcaaattaatattcatcgttccttttctgcacctgttgtggtcgtatggttaaagcgttcgtatcaatattcagattgatccgccgtcgaatgtcgtgcatctgttgggcgagggcattaaagtccgtcacgtagtcaagcagagtgtcctaaacaaattattgcatttaagtgaacacaacagacatgacatacgtcaaaatcggccaactccccgcctccctcaacttcggtctcgtcttcttcgtcctcctcgccatcgtcgtcgtcatccatctcctcgaagtcatcatcagcgaccaagtgcgattgcagaacctgctcattggcgtcggctgcctcggaaatgtggtcgtcctccattgcgccctcgtgcaccgctggtctttgctgcgtcaattcttcaccggtgtccatgtcttcctcttccgagtcatgaggcgactcatcttcactctcccctccctcctcgttctcttcttgagtggtgtccaacatactgtcgataatatctcctcgcaagtgcccgggttcgcccatcgattcgtccaattgttccacgtctccatgttcgttaggaattgccacatgattttcttggtgcgcgttttggtcttctcggggagtcgaagcaatgggtgggtcaatgttggctgccggtcgacccatctcctcaaaggtagcacggcttagagtcaaatcatcgtcgtcgtaatattgaaatgagcgcgggtcataagagaaggatggcaacaaataagaacgtgcgcccattgctccgaattctgcgccgtttttggtcatcattccttcgagcagcttcagcaatgtgttcacagtgtcgatacccggcttctcgtgtaactaaaagcgatttttaacattcagatcaacaaaacattgatttaaagaaaactcaccggaattttccaaatgcctctgacaaaaacatttgccaagttcttcttgtgaatgcttttaacaataaacatgccctgctttgcattgtgttgattgttcacctgttcaaaaatattccatctcttttctttaccatttaattacgcgcacctgcaaacactccctcaaatgcattgtcagctttgccaaaatggtcactttgtccgcaaatttcacatatgcaccgttgttgctctcatcggaagttacaaccgtacagtcaaagtcgccacattcgatgagaagtgatttgatgttgcccacgacatgatcggtgatgcgctgacttgacgaatttgagacgagctcgctgaccacggttttggccaagtgggcggtgtcggacaaatcgttgacgggagcggagaggaggaaacgttcgatgatccagcgaagaaccgatttttcgcccagggattgctcgatgaaaattggaacagccacctttggataactgcgaagcacttcggcaattaatttgagcaggtttggaggctgcataagacgagtgtttttgtctgcgtccgcaaatgtgtcaaattgcgtcaactccgtcacgatttgactcagaagctaaaatggtgtaaagatgacgattacatattgattaggaatgaaaacaaccgcttgaagaaattggtctgaagccgccgctgcatttccattgcctttgacgtcagcgcgctgttctttgaccagaatttcgttttgtttgatgaccatgcatttcttcgccgcgtccatgtaaagtgagggcgaccgcaccgccaaagggaccaacatgcgcacaactctctgaaagcgagtgaattacattacagactttgaatgaaaattaacaaaccttaacatccttctgataacgcttcgttctcattgcatgtcggcgcgaagtgatttcctgcatcgaaattggctggccattgcaagttgcggtgatcatttgttcgaaggctgactgaagaagtgcgacgtccgagtcgatgcactggcgaagaatgagcgttgccaatgtgttcagtgttggaggcgttgtcgtgccatttgtcaccatttgtgccgaaattggattgcgcttcatctccaacagtgtcttcactccatcccccttaaaaagggaatgtttaaaatgaaaatacattagatagacttacattcagaaactcatgcgacatcccatccaatgaaacgaggcgaagcaacaatgtcagcgcgttgtgtgccaattcgttgtccaacggttgagtgctgctcgactttaccagtttcaggatgcctttgacaagcagtcggtgtcgttcagtgcccttcctaagttcactttccagcttgacaagcttctccatattgaagtctccgcgcagatttgcttttgcgtagattggcactgatgagtgaagcggatggaagccctgctgttgctggtcaggcaacaaacgcttggtcatctcgttcaggtcgatgaagtaaacgcgctgggcaaccgtcagacgaacagaagtcttcttctccctgacagctttgttcagctgcgcaaccgacagcggagtgaattcgcgccactcgcccacgcccgtgtaatggtcatccgctgtccagtagaaccactaaaacttggtttatgtgctgcactttccaaaaacaaaagacgcgacctgaaattgagttccgtccaatgcttcctgtaagagatcctgtcgtatgtctgcactccgctcctgctcgtacatgttgaagaacagcaacatcggcgtcagcaatttcctcgtcaatttttcgcaacaattgccattgatacgcgcttcgaagagattaaacattcgatcatatgtcgaacactccggagaagccataggtaacattgaaatgatctgcaaaaatatgattcactgatcaactgactaatctttagttttttatatctgataaaagctctaattcatgcaataactattattttttgataaaataatgcttcaaattgttattgggtaaaaatgcgcggtttacgccaaactttgaccgatttgaacgtatatttttgaaaaaaaatttcaactttttgttcgaattcgggtccggggttcggaattgggcaaatccgagttcggattcgtgatcagcaccctcgaaaacccctgtatacctatttttagctcaaaataaaaaagttaaatcgaaagtagaaaagctcgagttttcaattttttttgttagagttcggtaggaattggtcaaaattagtgttagagatcagcgatcccaaacccactatgactaaaaaattgcatatttgtaacccaaaagggtcctccccttttgacttttcaggggtcttaggccctaatacggaaaagtaccccaatttttggtatcattttaatgccgctttctctacataaatgataaaaaagaataaggtgaaagaagcttctttcaaagttgggtttttatagtcgagaagtgaaagaatcaaagaatccaattttctagagtgtagaggacagagtataactatctcattgtagtgttttatttctttatctttgttagtagagaaaaactgaagttacttcgtgatgtttaatttttttcccaatgttaaatctcgtggtgagtcgaaggaaaaaaagtgcaaaatttgctataaaacaattatatttttgtattcaccgatcttcagagtaagtggctaatgcccttctgtagatattttattgactgaataaaattaattttttaaaaattaacaatgtgttaaagacatgatatttaataacacatagaaaattttcattcgcttattttataaaatcttggcttcaaaatctttttttatctggcaagaacagtttcaatttaacacacagatattttccggagtgagagaaattgacacagatggatggactgtttttcgcatccattgcttttctaacaacagtgttttctgtgattggaatgtgagttcatttgtttaacagtttgacactgaattgcataaatgttcagtgccattgtgaagttgtggttagatgaaagaaattctcgcaaaagcaaagagactttggtggcaatggacgacagtgcaactgatggtttatcagctgacaattttcatttattatgacttatttacaatgtttttaggtaacatgcaaaacgaagtgatggacagtgatgaggacgaacaattgacagggaatggcgccgctgaggaagcgatgttggatcaaggcgagtggggtcatcaatcaactgaggaaaagtgcatttactacagcactattaatattcttcgtagttggacctcttttttgtatcaaaaatgaccttaaatttgtcttttttttcatttttaaatacaaattatttagaagggacgacattttccgaaaaaagaatcggaaagaaaaaattggcgaagcttcaggcaaaggcagaagcgaaggcactgcgagaacaggtaaaagcactggtaagtcattttaaaggcaatgaatggttttcaggaacaaacggaaagagaagagaggaaacaaagagaggaagaaattagaaaagaggaggagaaaaagcgacaattggaggaggaggaaaagaggaaacgggcagaaaagaggagactcgagaaggaggaaaaggaccgccgggagatggaggagtatttgaaagtgagggacggggcaaaaagggaaaagtgccaggctcttgcagagtttacccaatcttaaataatttaaatattcaaaaaaatttaacacgacaatagaagtccatttcacaccttgcatttttgaaaatttctaaaaaaaactcaaaaaatagtcagaacaaaaaagtgtaaacaattccaaaatatgtagaaaaagccgaattataaaaaatgcaaataaaattcccaactatcaaagcacatagaacccaaaaccggtttttaataaagaaaaataacaaacagtataattctatgttttctttcaaatgcttttgttgtttattacaaaatttttaaatatattattttgcagataaaaggtgcctttgaagtgcacgaacagggctttgactatgatgaaaatgaggacaatgccgacaaccttctcgagtcgtttgtcaattttgtgcgcaagaaaaaggtcattcgttgccttattggccttttttattgtcattctccgcaggttgtccacgtcgacgaattggcgtcaaactttaaaagtaaaccaactgacattgttgacagactgaagacactgctgcagcaaaagcgactcactgggctttttgacgacagaggtgtcctcggattccgtttatcccatcagctgtcccttcccttaaggactttttgtttctataacagaggaggaattgcttgacggtacgtccatgtctttttacttgttctcccattgaaaatttttacaatttggatgcaattactaacagattttgcctaacatacgacaaaattttgtgattttcatttagagaactaagtagaagagaatgaggggaactatgaaattttgaatatt

SEQ ID NO: 1092 - DNA, 1721 bp, Heterodera glycines
  misc_feature (10)..(10): n is a, c, g, or t
ttaaatatanttattttgcagataaaaggtgcctttgaagtgcacgaacagggctttgactatgatgaaaatgaggacaatgccgacaaccttctcgagtcgtttgtcaattttgtgcgcaagaaaaaggtcatttgttgccttattggccttttttgtcattctccgcaggttgtccacgtcgacgaattggcgtcaaactttaaaagcaaaccaactgacattgttgacagactgaagacactgctgcagcaaaagcgactcactgggctttttgacgacagaggtgtcctcggattccgtttatcccatcagctgtcccttcccttaaggactttttgtttctataacagaggaggaattgcttgacggtacgtccatgtctttttacttgttctcccattgaaaatttttacaatttggatgcaattactaacagattttgcctaacatacgacaaaattttgtgatttcagttgagagaactaagtttcgagtgaggggaactatgaaattttgaatattttttagcagatattcaccaaaaaatcctattttatgtcaaatttagaaacttttttgaatccatttttaaattaaaggacaattgcggttccgcctaatttgaaaatttagaattgaaattcgttaatgaattttatttaaaaataaccaatttacgggtttatatgaattttaaaaatggtgatttggctagtacggtgtcgatatggcaccgccgggtgaaaagaaattaagttatttttaatagaaaaaaattcattttaagttgcgaagttcatcaaccaacgggggcgagtacaccttgcagaaatagttgaacaaagcaaaaatttaatttcattggagcctttgtgaattttttttttataaattttgatttttatttaattttatttttaactgtttaattcattataattatttatgtgctcttctaaattaatttatcgcaatacaagtttttcataaaacaaatggatattcattcggtgcaacaagccaaaaaagtggccgaacagctcgagcgggaaaagcgcattcgccgtcttccaatgtcggaaacaattaacgacttaattcggtgggactgagatcgaaaatgttattaaattcgctagttatgttactcatttgactactgaaattattttgttttttacaacattttgtgccctaataatgactttcgattgtttaatgtgcgttaatatttaggtacacccaggagatgcagaaagacgactgtaagtgttttgaagggattctaattacagacttggatggattaaactttgatttattcatccctccgaatcatgcaaaaagtttgcggtttaacttctgtaaacaatcaaaaaaatttttaattctgtaacatataacggtatatgacgtccctcccccataaactcacccattcctatgcttgaatttcccagtatatgattttagtatagatttgttcaatggtttcccaaccgacaagttgaacccgtaccgtcccaagtcaaattttcaatgtctcgtcatctgacggattttttccatgtttgatgaaaagaatgatttgtcatgatgtgccccacaatattataattttcgtagttttttttatgctttcaacaatttcttttgaatcatgttttggataaaaacgaatgctgcttcttttatcagaatagtgctataacactttt

SEQ ID NO: 1093 - DNA, 3364 bp, Heterodera glycines
  misc_feature (65)..(65): n is a, c, g, or t
  misc_feature (97)..(97): n is a, c, g, or t
  misc_feature (148)..(148): n is a, c, g, or t
  misc_feature (277)..(277): n is a, c, g, or t
  misc_feature (404)..(404): n is a, c, g, or t
tctctcacaaaatgaaaaaaaattagaacgaattaacatccaccgtgctcataatgataatctgntatttttcgtctttttccattgcattcgccgnccttttccctcttccgttcctcccttttccgatttctcatcactttcctcngcctttttcttcgttatttgtctgtttgtcgtcactccctgctgcgcttcgccgggtgcctttgttttcgagtcttttgctaagctgaaagtttcaacgattttgctttaattaatgtttgctcacctntccaccgttttttcgtcctttttctgtcccaacaaatggcatttcgcttttcctcaatcgtccgtcgtttttcctgatcgttgcccccttttccgccttcccatccgtctccattatttgtgccacnttcctctgtccccaattcgccgttcgttttcctccgtctcgcccttttcgctttttccaattgcttccgcgatgccttcactttgaatgttttgagcgtttttgccattgctttgtactttcccatgtttcgcgtcacaaaaaaatattttctttgaatgactttctcagcaagtgagtggttaagtaacggaacggaagtgattgaaaatgaagcaaataatggagaaaaacaaaaccaaatcgaaagatttatcaacaacaataaacgatcaggaaaggctaaatgttagccaattgaagtcagacttttctccacttgatcgagcacttcctttcggtaatcgtcaaaatcgccatcaatttggtagattttctaaatttcacaatgcgaaggtgtttcctcctccccgtccacctgatcctccacaacccacaaacgacagtctgtggctctgataagccgttcgtcgtgagttaccatcacaacaccgccactgaagtcttcaatgccttcagccaaagcttggatggattcgatgtccaagttgttggttggttcgtccttaaccaacagattattgttagatttgtttgcatattatggaagaaatttcgatttattcgattggtactacgaaaaacaacgaatatgcacaaaataattttattttgtgtgattgcaaaggcccgcaaccaaaaaaatggagtgggaacccgaagactttttaccattgttcatgaaaagaaaggaggtagacccccccccactttttaaatgtatgcctttgttaattttcaaaaattatataaactaaaaaaaattcctgaaattttgtaaattttattcaatgtaacaccttggttttcattataatttttcttaagattttttagaattttttttgtctctgcgactttttttggggttcaccgattctcacgttattatgtaaataaatcccgagaaactttaccagtatcagaatgtccggctgctttagggacagctcggccaatgccacccgcgatttttgaccgccggacaaatttttgatgtgcacagtgtgcgcgtgagaggcgaggccgaccattcccaaatttttcctcgcgctcttaaaaattgccaaaagcaatgcaacgaataatcagcagcacctgctggtcgatttggtatttgaccatcagatagtccatggcggactgttcttggttcagtgcctcgttggagtgctggtcgaaccagccgatgcgcagctgtcgatgcattgtttgctctccgtttctctgttttgtttttcggttgatttaaagtgttagaaacggcttttccgaccggtttcagtttcccgctgagcagcttaagcagcgtggatttgcccactccgttcggcccgacaattgcaatgcgcgaatccatgtcaacgccaaaatcgagttccctgaataaagtgctgcgctcatcatagccgaaagtgacatcttaaaagaattgggaattgacgctttagcaacaattgttgggcccaccatggagtccaaggatggggggcgacattttggttgtgtctgggaatttgaatttcacattgtactccttgatcttctgcaacagttccggcgggggtgcgtcgtctgtaagttttgctttttaaattcgtttccgaattcgctttgccttcgtctccgatggtggcggatgagccgcccttcttgcccctctgctgtttgctctgttttgtcgccattctctgcttcatttcctccgtcgcttgtttcccactctttcctccctttttcatcgctgtcaattgcttctgctgattttcaaatgccttcgcgtgttcctttagcttttggtcgtacattttcttgaaagacgctaaataaattaaattaaaataaaattgttttttttttccatacaataatttcctctatagtaaaacaatttctgttggtccaagtgaataatatcagtgcaaatgttgtccaaaaaagattggtcgtgcgaaacaacgagaagagtctttttccatccctgaaggtatctgacgaaggaaaaaacaattgaaaaagtcctacgaaagaatgttttatttttgttttgccataatcgaatggaattattacgtgtccaaccaaataacggcattcaaatcgaggtgattggtcggctcgtcaagaagtaaaagagtgggctcgagaaaaagggccctggccaaagagacgcgcattcgccaccgaaaacggagaacgcgttgagggaattgtgacgaattccctcccgccgccctccgtgcgcttaccccccggaaaagtcttccaccgccttttcctgcatttgtttgttaaagccaagtccggccaaaattcgccgtgccctcggctccgccgcctcagcgccgatgttcttcagttcgctggtcacttcttgcagtttctcccccgcggaaatgtctcccgcttccaattgaattatcaatgccttttcgcgctccaaaagttccgtccgcactttgtccgagcgaaggaccgtctcaatggccgatgttttgtcagcttcgatctctgaagtgggatgtttcatataagggggtgggggggaaggctcactcgtccaccctcgcgtcacagatcctccaccgacattatggtgtgtacactgttatgttttatgtgtaatattttttctatttgttcactactgcagctacggattatgtgatgtatgagctatttgttgggaaaaagccatctattgcaatagagattgcacaaattttatcgaatggcaactaccaaaagctgacaggtgactatattaattaaaaataaaaacgagttgaaaagcattttatttttttgcaggatggaacagacatactttttgtttttgaatgcctttggccattttatcaacaaattgtcactttccgaattacgtccactattgggcac

SEQ ID NO: 1094 - DNA, 3914 bp, Heterodera glycines
  misc_feature (67)..(67): n is a, c, g, or t
ccttatttttggcagtggctttaggtactgacgaaacggtcatttccttattgttttaaaaacaatncggaaaattacaattttcaaaataaaaaacccattaaaaattcccccccccctcaatatgtgatgcctctttaacttaccctgttcacaatataaaatgtcaatgtttggcggaattgccaatttgcgggcagcgatgtgtttgagcagcgtcgtcttgcccattccattgggtccgaccagcccataacgccttccgattgcgatagtgagcgaggctttgttaaacagttgacggccatcagcagaaatgtcgaaattttcgaccttaaattgatgccaatgagagcattttgtcaatggacgttgcgcctgactttgatgtccaccgcggtttccatcagactcagctgagcatccgtcttggtttgctgggaaacggtgaactgctcgcccaagtcaaccccaccaattcctcaaagtcagtgcgtcagttccgctgctttcccaacactaacctcgccgtacttcttggacgctctctttttcgacggtgttgtggtgtttggagccaagcgcctgcaatcccttctcatattcggcctttttctgctgctttttcaagtcctttcgggatactttcttcgtttcttaaaaagttcatacttttggtgaattgtaaagccatggcaattttttccaagttaagacattcttacaaatggtttattacaaaacgaaccttcatttttgacctgctgaacttcttcagccgaaccattatttgacatttcgtttaatttcttctttttaaaaaaatgataaggaattgtgaaaatattcgaatagaggttaaaccatgcataatatttacgaattaatttaaatttatataaagtatgacgaattcacaaaatgccatccagagcgttttgccttctttctttgaacagctctttccatcgtccgtttcttatttctgcgttttgtgacaactaaatttaaacaaatgactttttccacatttgtaaatgtcgaaaaataattttagaatttgattggatctgtaatttataagcaatccgaaaagtccgtaaataagtttcaaaaaaaatatattatatattgcagccaaaaaatgaaagtagtaagggtcctcctgtgatttgatgaggcccactaaaataaaaaagtgtcttcgtttgtcttaccaattcatgggccaatgtgaaacgagtgccgggctgacattgagcctctccctcaaacttttcgtttgtttctctgtgatgttgccgcgtgtccctttttgcttcgctttgtgctgtctttcgtcctttttcgagttcttttcccgcccaaattggtccaaacatcgcccggtcgtgttttgtcgcgttcgttttgcctttgtcattcattttttccaaggaattgttcttgaaaaaaacaattaaaaataaaacgctgttaataacttttcgggatgtgtcagcgtccgatttgaatgacgaaggtcggaagcccggctcttcaattcggtttatctcagcttgccttgcaaatgaatcagctacatctgtaaaacatcaattcgtatttctatgctttttagctaaatccggtttttttacttttgcacaaatttttaatttttgtttgagaaatggacaaacgttgaatgcattttaaaccacaaatgtctcactgaccatttgaacttgacatttctcttttgcctgtgttttgtttcgtcgattccgcttcaattgcagcatttaatgacgcttttaagcggtttttgacgctattaacagatcgcataattttatcagagtcagttcttcttatatgagaagacttccttaaagaatggccaattcaatcgaaataaaacaaaaaaagactcaccgatctttgctatcacattcttcgccactaaattttattaccgccgaacgatggtgggaagttttagaactccgttcatgatggtttctttccagagacttccgtccactcattaaatattaaaatctggatacaatttgtcttggctatctaataatcagagtggagattttgttgtttattttattttaatttctttaaataattattttcattaaataaatatctcattttaaatttccttctaaaataatgaattataaattcatttaatatttcaaataggtatttaatttttgttgattttgtgaggaattttaataaattagagaattaaatattttgacattttgggtttttggaaatttcttaaaaatgcagtaaaagcgaaaaatacatacccctagaattgagataaccaatttttttttctttataagtataatttgcctaaagatttttctatatttcagttaaagttcaaaatttttttattaattttttaaaaagttcggggcaaagataattgagtataaatttgtcgaaattttttggttagaattttttgtaaaaattttgtttaaatttttaattacttataattagggatgatatttttaggtttttcactattttttcctgagctccccgtaattttcacctattttggcgttttgcccaaaatttgttaacaaaaatgcaataaaaacgaaaaatacacccctaagaatcgacccgaaaattttcaaaaacacacccctgatgagaaatgaaaaatttctcaaaaattcatcttcaaaatttatttatttattttcttgttagaatttttgatatatctcattaatcatttggcataatatctttgctttttgaaggaaattttcaattttacacccctaattttggaactttttggcacctattttcccatttttagcacctattttgggggtttttagaacctaaaacctacctattttggcagtttttagcacctaaaaatatcatccctacttataatagaggaggacacctaaagctatcgctcaagatctttaatttgacaaagtttaagctaagttatgatttattattcagcaaataaaattaaaatattaattaatttaattattattatcattgatacttttttaggctcgacctaacaccgacccttttacaaaaatttccttgccgaaaatcgtatgagctttatctcaaaaggcttgaaatatactcaatttgcaactgcaacagttaattttttgaggtcatttttttcgcattttatttcaattagaagtagagttcggaccccgcccccgtcacccccgcccccgcgactctgacccccgcaatgaatttttaaccatctttgacaaattttttatgaaataaagtaaattttgctgttaacttccaatatatttgtggtttagtggttagtgcttcaacactaaccgtatttcttgttaggagttcgataccggttgacgttttcatttgaatttatttttatctgattaatgcagggtttctttatgttcttatttctaagaaatgttctgattttagggcgtattttcatccaaaagaatgaaatttctgaaaaattttgctaatttctaacaaaattcataaaaaaaaattcccccggcggcgcctatcggcaccaccggcccccaaaaaacctattttttcttaaaaaaattagcataaatcaataaatttggtcattctttagacaaaatctgtgtaatttatgccaaaaggaattgaatcgaggcgatacatcgactaaaggaatgtggagccaacacatcattcataaaaattaatttgtttgtgagattttttggagctaattcaaatcaaacccccgaacccgtccccgcgggggcggaattatcgtgccaccgcccccgcgactctgacccccgcatcccccgcctccgcgaaaagccacccccgcccacggggtccgaaccctaatt

SEQ ID NO: 1095 - DNA, 2665 bp, Heterodera glycines
aaaggaagcggatgggcaaatattttgtcacaaatttcatggggtttttactaggtgggcggttcaatcccaaaggaatttggccatttcagcccccgggttttttaatttttcaaggaattgttgccgcaaaaaatttttttggattctttcattacaggccgagagctatatattttgaccattttagtctccggccatatggccgatatttaccaaatagaaacattttaatcatataaaaatagtgacaattaattaattaaataattgataaatagttgattagtcaagaagagacgaacaaaaagcgatcctcccccccccctcccccgcccgaaatgaaaaattaaaaatttttacaggaaaaattgggactttaaaattttttttttgtcgatttttcttaataaaatcattaaaattaaaaaaaaatttgcccggcggcacctatcggcaccgccggaccacgatttactcgattttaccttattttttaaaattttgactacaaaatggcaaaaattagtctttttttggctaaaaatggttacaattcctgtttttgctgtccggcgatgaacttttttaaataacactaaataaattttaccaaaaaaattcttcggattccccccccccgtaatttttttctggctattaaaatgttgaaataattatatacatatacataaatccgattataatgatcagactttcaaaaaattttcaaaaatcaacccataaattcaaaaagatgatttgatcagacacaaaattataaattatttgtaaaatttaaataaaaaatgaagaaactccatcaagaaaatcagttttttgatttttattaatcactatttaaaaaattttttctaaaattctgacaaaaattgatttttaaaaattacggattacggattgtggattacgggaaattacggggtttttggacccccgtaattacggattacggatttccgtaactgaaaaaatcgccgtaattacggattacggatttccataattgcaaatccagttgcgtgcagccctgatccccatcctgtttttgatattacgagttaaaattttgttttcaaattattttccagccctcaaatttcagcatcatcatcaacataatcagctgcagcacaggcaacaaagtcctgctggtacggtagtgccaccattgtcgctgccattgttccccgctgctgctgctggcggcagtggccaccgtttggcatcgttttcggcaccttccgtcttagtgggtgttggcatggcacacagcaaacaacaacagcagccgagtacgacaacaagcagtacaacaacggcaaatattgtccacacatatggaggaagcggcggatcagcttcaacttcatcaacagcggcaaacgatggcggcggcaattcgtcggcatttcttggtgatcacctaacaggaccggaaacatgatcagaaactaaaaaagccttttcggcctcccttattttctgtaaaatatgttgtcctgctgatccatagaattttaactcaaatccttttatattactgattagcaaataatccccatcacctctttcattgaaatgttcgaattttggttaggcaaccttgagaaaaaattgtcaaaaaccccaagataattttgggattgaatttttggagaaacaccaatatgttacacataaaattaaaattttgcacgttgaggcctaaagagcgagtttttacaaccatatatatataccatgaaaatttttataatttttttaccgtattcaggcaaattggtgacgcgcacccattcacttctgcttaacggcacttttgatgggatggccaacgaatttgagcgccaaatcaagcagttgatcaccggctacaaggcgtggatgtttgatcagctgttccagcagcaggaggacaacgaggaggacgaggacggcactgatcaaacgctggtaggattttctacgggggacaacaacggcactgccgccgacggcaccgggttggcaagcagtagcagcaacacaacgacggcaccagcggcgggtgcaattaggacaaccaatttgagggctaataggccatcatcatcatcattagtagctggtgccaatgccaaacgtgcccggatgatgttccagtgatacagcaattgtttttgaattggagcctttttaatatttaatttaaatacacaaaataattgtaactgaataattgttttgttttaaatatgtcggaaagaattaaatttaccataaaaatgcaaattaaaaatatcgaaaagggccaatttgataaatattcaaaacttacgttaacactaagtattttttaaagaacataaataattttcgatttttaaaatttatttatgcaaattttgtatattttggagtttataaaatctgccagatgcaatatattggcataattttttataaaaatccttccatccaattcaatttttcaaacttcaaaaaaaacccgatacttagggggctgtaattttcgttttattaactttttcttataaaaaattcacattcacgcattgcatatttttttgtttttatattttaattcatattttaaaatttatttgtttaaaacaatcattttaaatatttttagtatcat

SEQ ID NO: 1096 - DNA, 1254 bp, Heterodera glycines
ctgtagtgcgggctctctcaaagtgcctgggaggcagagagtttctcattgcactgatgaaaaagtgcaatagaagggtgtaaagggcgccctgtgtagctcagtggttagagcattccacggaaaggaagggacgtgggttcgaatcccaccgcaggctgatcttttacacctccgccatccaccaaattcctacatatcaattttttagtcaaatttaaatgtgttcacctttataccaagatggaaaatgaaaaagtgacagcactcaatttgtccaaacaaaatgtgcccccagggcatggaattattatttttttgatttggcataatcttacataaaagtaacaaaattttacattctggcatcgttcggatatcccagattttctgtattagtttgcaaaatttttaaataatcaaattcatcttaagttatggcagaaataatattattttcatacaactttttcgaaagttgacccaatttttcagaaatcggaattcagatccaaaaaatgttacaaaaagggatcagtgccatctatattttacattattggtttcaccagcttataagggcaaaaagcccaaaaaatgctttggcacaaattaatataataacgaacaaaaaaacattaaatgaaaaataatttgttttaaataatttgtttaaatattggtgaaactcaataaaatttttgcctaagaaaattaaacttcaaaaaataaccaaggccatttcggcgccgacttttcggcgccaagtaaaaaataaaaatttccacgaattttcattttttacatttttaattttcaaaaaaagaccaagttaaaaaaaggttcgcctcaattttaagtagagatcggaattctcaaaaatgccggaccggaccggactggtattttcaaaaacaaccggattccggatccaatctctcataatccggtcaatccggtaatctggtcaatcagattttcaaattgccggatccggaaccggattccggattggtaaaatttaaattgttaatttgggaaaaaaacccttaaaatttcatctattatatgtagaaaattggtgcaccagaaaatgtcgccatagaaaagacaatgcgccgaaaaaaatatataaaatttcaatttttcaaaaaaaatttaaaaaataattttaaagtttttttatttttgaaaacctatgcctaaatggaaaaataataaaaaaaatttttgcggcgccccttttttccaaaa

SEQ ID NO: 1097 - DNA, 4693 bp, Heterodera glycines
  misc_feature (17)..(17): n is a, c, g, or t
gccggaccggaccggantgccatttcaaaaatgaccggattccggatcggtctctcataatccgatcaatccggtaatccggtcaatccagattttttccaaaatgcgctggggctttttatgccatttcatgatggcaccccttctcttgagaatctcgcatacatttcagacgagcaaaaccaaaaattaactatacgaaaaaaatgacgcgctcgctgattaaatgattcatgtcatataattagctgcccactaattgatcaattagggtcgctaatttgtttttgctcattcattcgtttcgtttctttgcgcccgcccccttttggccgtataaatttgtcgcgcatgtgctcacaattcattcattcattcattatcgcaccacacgttcattttccattcccatcaattcatcatttctcttcccatctttaattacctttaattacccccccccccttctgccgatttttctgatgggccgtttcaaaaatatggcccgaccaaatcttttcattattacactaaaaatattttggaaatttaacaatgaaaaagaagtgaattttgttttagggtttaggaaatttaaatgtcgtgggtacgggaatggtaactcggatttggggtaggggatatttggaaagctggaagaagtcagggcttgggatatttggaaaagccgggtttcaaggcaatggatattttgaaggattttgaggctggggatatttggaaaagcgtttttggggcggaaaacattcaaaaacgggctagtttcgagaatcgggatccctaacatttgttcacttttagctctataacacataaatttcataaacattcatcattgaaaatgggcgagaaatttgttggcaaatggaatttggagtcgtccgaaaactttgacgacttccttaaagaggtgagcgtgtacttgcgcgcgggcggggcaaggacggcccaggattatgacttggttgggagcggatatattccttcatccacgtttttctcgaaccaagaccgagactcttgagcatgggacaatcattttgggccaacgtcccgcagtccgcggaggactttccctacttgtggccaaatcgggtttagtccatgatcaaagggctaaattttgcacttttttgaaattttctgaagaggggctctgaacttataaccatcgtccatgattagagtgccaaattgccaaaaaaaaacaatttgccatacatttgccggcaatttttcttctttgcccacagattggtgtcagttatttgacgcgaaaggctggcgcatgcatcaagccggtgctcgagtttgaagtgaacgggaacaagtggaagatgacgtccacttccacattcatcaccatctcatgggagttcgagttgggccaggagaaggaggtgaagacggccgacggacgcattgtaaaggtgagggggagagagagaaagagagagagagagagaaggggggggggggagagagaaagtgaggcgcaacacaacgccaagcaaacggagatgcgcaattgggcaccaaggattgtcaaaattccgattcccgattgacatacagtagccacgggtaggctcgagattgggtggcttaattctcgatagccatcggcaacgaaagcaaatcgaggggagagactgaagctctcgagattggatttagttcaaaaattcggtctcgagcattttgaagctcttgcatttggagtaattccttgaaaaatgacaaatatcgcttaaatatgtgccaagttcgaaaaagtgataaaattcttgagttcggtgtcaagactttatggggggaggcatgtttgtcattcattgataagttttggggctctgtgccattaatttggaaaagtttgccgaagtctccatttttgtgcttttcagacaaccttcacctttgtggacggcaaactcattgagaaccagaagaagaccaaggtgaaaaattggaaaattgaaaacaaaattttgtcattttaattgggataattaggcccaaatgtaaaagtatgtctcgcacggaatttttaacggccagaaatttttaaatttcttaccctttttttggttgaagtaattttaattgtttatcattcgagagctcttcacagattgttttttggtttcaaaaatttaaaaatttttttttccaattaaaaggttgaagataaaatttcctaaaattttatggcctttttttaatgttttctgcttgaaatttttaaatttttcaatcgctcaaaacggcttttaattttaaatatgcaaagctttccggtggtaatgctatttacctaattttataattttccaaacaaatttaaaagaaaacattttgataatttctttaattaatcatcaacccaaaaaattgtaaacgaaaaactctggggacaaatttatgacccaaaatttattttgttcaaaaatcaacgaccacttttttaaaacttccttctcccattaaaaccataattggacattgattttgggtttttgatcactttttaaatttccctttcgcgcacgtcaattaaattttgaaatgcaattttgccccttccaaaaaataaaaatggacaaatttgtgcgattttttcgataaaaaaaatttcctcgttaattttttgctctaaattttttttcaggcggaggaaaaggacagttactatgagcgttatgtggacgcggatggaaagctcatgatcgtacgatgaatttaattttttaattgaatttttggccccgataattacccccaaaattattacaatttttaaagaccatggactgcgacggagtgaaggccaaacgagtgtacatcaaggcatgattaaaaactaattgatgaggaggaagaatggacgaaaacggagggactgagagggacacaatgccaaacaaattgcgccaaaaataaatttaaaaaataattgttgtttgtttttgagaccaaatttgatagaccaaagaatgcctagatacaagttggatgattttgaattgttgtagttttttggagtgaaaaataaaacaatttaaaataatttcttttttttaaatcaaagattgactaatttttttggaatcaaaaaatccaaaaaaaattataataatttttttcatttttaaattaaaaaaaattttaaaatttaatgtctttaaaattgacattttccatttcatattgcaaatactttttgaacttcggaaatcaaataaaatttagggatttaatttttaaatgctaatcacattgaaacccattaaaaaattattgtaattattattacgggcaaggcaagtcataactcgctttatctccaattaaagtgcataattttggtatcattcgaaagctttgaaattggagaatatttttgtaagcaaatgaaaggcaattcgattcagttttgtatcctataaaccaaaattattagcttttgcagatttcgtgttttttcattggttagagataacgaaaatagtgcgccaaaagaagagaaaaaagaaatgcgaaattttcatcaatccctaatcattaaagacgactaaaaaggcaccaaaaatcgcgaaaaaggcactttaatagtcaccaaaaaattgaaaaaaaaagcatgaaaaggcacgaaaaatccgtaaaaggcatgaaaaaaagcttttaatgtttttattaaggatttttagggagcaaaacacgtaaacttataaaaacttaattttggtcatttaatgatttaattaaatattttagaatttttttcgaataaaagaaattataaccaaaaaaatttttatcaagaaaacaaattcagtttggtgattaattttgagtacatttttcaattcttaggggtgtattttctgaaattttttcgggtcatttcataggggtgtagttttccaattatattgcattttaatggatcttttcggaaaaaaatgccaaaaaaggcatttaaggcacgaaaatcccaaaaaaaagcataataaaagtcaacgtaaaagcctcaaaccaagcgcaaaatgtgttctttatgcttaatatatcggaactaatgcgcagaaaaaaggcatatgccccaaaagtcgggctctattcatcacaaaactcggcaaatgccaaaatattgatgtaaaatatggacaaaaataggaagaggcgaatggagggcacttaaaaatggtttacgacattgcactgaactaacttacatgttacttatctttatcaatatatgttccgtgggttccatggaaatagagctcgacattttgaaaaaagcctgggcctggattccatgttggacctaaaaaaaatccaggaaaactaagtccaggaaaaatccaagctcctcgagacctggatccagggcctctggacccggatttttaaaaatttgttttaaaaagcaaacaaaagtttgaaaaaatcaaataattgcttgggaacatctaaaaatatctaatttataataataatctgttttaaaatctatcgaatcattttttgataacttgaaaaaaacatcggtcacttgaaataataaattctaaaattttgtccaggaaatccatgttttttcgtgttttgcctggacctggatatttttttcacatttgacctggacaaaacccaggtccacgaa

SEQ ID NO: 1098 - DNA, 1176 bp, Heterodera glycines
tttgaccaaaacaatgtattttgataataatctgataaacaatatttaattgtgaacaaaaaaattaaattaaaatcgtgggattcgaactttttggggaaaaagtaaagccacaggcataaccactggccaccactgctcaccttgctttacctttctttgcaaaatataaaggaaaggaaaaaaggaaaagccgcataactcggcgcacacgtccattcagcaaaaacggtaaaaattcacataacaaaccggggtcaatctacccacccaccaagtttcatcccgaaactccacattcacttgggggcccctcctttgtgaggaaaaatcttgacttttaatgaaatttattaagaaaatttgttaattgtttcataaattttggaaatctttttgatgaaatagttatgaaaatgttactcaattatgtatgggtttggggtctttttaacagttgaaattgccccaaattttcaaaaatacaaagttctattttgaaaatttgaattaaagacatttcgccaaaaataataattatttatcaaattttgggcagtttcgctggtgaaatttaagcccgttttagcccggtcaaaatgaccgggcccgggctcgggcttcgacaattggccgggcccgggccgcccggtcaaaaaagcccgttttaccgggcgtcccgagcccgtttaaaaactataaaataaattttcaaaaaatcaatgccaatcccgcagaatcctgcacaaaaagtaaaatttgctgatcacgctgggggatttgaactccatcagttaatcggtcactgaataaaccaagtgcattgttaagcaatccgtcctttgtgcctttgtttgtgctaattctttttatttatttttttaccgcgtgggagaagaaatcagcaaattcaatttaatttttctacctaattctttaaaattcttttcttttttccaccaaaaaatggtgtttttcatttgcgaccaatgcggcgagaccatgaagaagaagcaggtgctgcagcacatccaccggtgccgaaacgcgcactattcgtgcatggactgccaagtggtgttcgacaaaaacagttaccaagggcacaccaaatgcatcacggaggaccaaaagtacggaggcgcgagacatgtgccaaaagggacaaggttaact

SEQ ID NO: 1099 - DNA, 1447 bp, Heterodera glycines
aattttgaaaaaatggagcgaaatttccgtttttttttttggctttcaaattacgttgatgccttaactaagttggcatatttttatttttttttggttcactggctttcccatttcttgaaaatctgactttctttttttaagatttgttactgacaatgagcccgattttcaaaaaaaaaaaatacaaacaaagttggaccggatcatttgtcttgtgctcattgtcagagaccctaaaaaggactacatataaaaaaataaaatactttgtaagccaaggaggtcacttcccgctttatttgtttaaatctcggtcaactgctctgatttatgtcgacccttttactctataaaagtgccgagatttttgttgcctgactttcatatggaataaaaacctttttaaaaaaatcctttttaaccacgccatcatactaattgtaaccgttcttcgctccctaaaacatatttttttcagtgtattgtttcgaaatttggcgacgcttttattttcgttttgtttttccatttctaactgatttttggtcccaaatttccaacgctttctctttttttgcagggtgaacaaaagcaggacgcctgggtgtcgcaagtgcgtgccgccatccgtcaggtggacgagccgcggctgaagaatttgttgcgctccgtccaatgccacaccaacataccgcgcaaggaggccaaatttgtcaactttttgcaaaattcgttgcgcattcgggaccgcgcgttgtgtgtggacgcgtggaatgcaatcaaacgggcggcggacgcggaggcggcaaaagcgaaacggacaacggcggaagacgccgttgtaacaacggcgacggaggagaaggagacggcggaacacaacggcgacgacgcggacaaaatcgcaaccggacgaacggacaatgcatcggcgactacagaaaacatggagggacaagcggaggaggaaaacatggaggatgagacagcgaaaaggtgtggttttattgaaaattttgtcaattttattggactggacatttcaaacctggacttagacccgtatttttttcaaatttcatatggacctgggtttcctggacaaaaatccaggcccaggaaaaatttaggtgaaattttgaaggatttcctagagaccggacggaacagagccatgccgaggtttaccgggatttccgttcctgattttttggtaatagttgcggtcagggacggtcccaggatttcggttttgatgggataccatccccggaggcgacagcttttttttaaattttcgcggaacaagaggggttccccaaaaatttgggcaccatcatcaaccattttttttaatttactcaaattttaagggcaaataaaatgcatcaagaactgtcacaagttgtgccaatgaagcggaagaaaggcacacacatcaaat

SEQ ID NO: 1100 - DNA, 1825 bp, Heterodera glycines
ctcatcattttctctaaattcttttcatctcgaggaactttttttctttattgaacaaattgactgaaaatttgttgggaaaatttatcaaatttagggcggacgggggcccttttagttcgcaaaatccaataaattttgcctgtttaaagcgggaaaaaaggacaaaaatcccctcggggcaaaaatttatttatttatttatttgccctcgggggccaattaaaagttgggcgggggcggaggctaatcaattgaattgcttcactccacttttcttctcgggaatggtggtttgccaatttgttttcattgccaaaccttctcaagtgggctgatgtcagctcctcaaaggctgtgaaatttttgaacattttgccaaaaaaaaatcgaaaatagcaattaaattatttttttgttttcggcaaattcttaaaattcgtccattttttaaatttaaatttatgctgctgttttctcaagtaaataaataaaaatttaagggagttaaaaaaatttgggcaccgggaaacttggccactgacattaatttaaaaattgaaaaactaaaaaaatacaaatataaattccactgaaatttcatccttaaatggcccaaactgtgctaaattttattttattttaaaagaaacattaaacaatcgagaaacatttaatttttattatttatttaattcttccagatgtttaaatgcaagttgaatttatgccagggggccctatccttgtttagaccagaataccaggtttatgtggcccggatatatcgaaacccgtaaaaattctatttaaaaacataaaattttgagtctccattcagcaaaataagtatggttaattgggttgacaattcttgaaaaaaaacttgcgatcccgagcttgattaaaagttagtatcttttaaaaattattacattttttacacatttaaatattttttaaattatatttttttgattttttaaattattatttttttattttttaaattattatcgtgcccaaatttctcacaatcagtaatttttctcgtctcgcaaaaatcccagaaattttttttctcttccgccccaattttattgccccgccgccgccggcgccggaagaatagctggcggacggctcttctctgctgctgcctcataattccctttgatgatgaagatgataatgatgatggcacattaaacactttttggccgctcctccggcggcggcgattccttcgccaatttttatttatttatttggcaccaccgccccttcgcctaccggtcgcgatgccgccaatgtatagtgccagctaaggatgctcgggagtctcgaatcgagaaaagtctcgggtttttgggtctcgaatcgaaaaattcccaggttttttgagtatctgtctcggatcgaaaaaagtcccgtcgcagttttttgggtttctgtctcgggtttcgggaccaagtctcggtttcgagaaatttttggtctcgagcatcactaattccagccctataaccaacaccatatgggatgtccaattttccgatacaaaatttcctatacccagtttcatgtgctcaattttcgggtgccaaattttcccaatttcccgagcacattttcctgtgcctaattcccgggggactctccctcccccctaaagccaatagtcacccaacccccaactaggcccaatcgatccgcacattcaccgccacaaagtgtcgatggattttgcttgccttgctgttgtcccacctcccctctccacccaccgccggagggcgtgtgtgtgtgtgactcatctttttta

SEQ ID NO: 1101 - DNA, 1404 bp, Heterodera glycines
accacccgtccccggaggccaaaatattactgcaccgccgccacaccgcagctacttaaatatataatattttttgagccgccgccatcggtcggtcctcaagagtctcgacagcacagaggacagagaccacactctagtcagtcggggtgtcggaatcgtcaaccgatgctgctgctgcttcatcctaaacccccaaacggggtccctctccgccgggtaaagcaatgggtgaatgtgtcccctgggaggaagcttcttcacacccctcccctccctgcccctcccctccccaatgcccacactttgttgcccccctcctccccgggggcggttttgtcattacatattattattagtcatagcagcaaagagagtggtggcacacagatacacaggtgccgaattttggggacacacttttgaaaagcagcaacaacagttgaagagcacagatgagagagatgtgctgcttctcgtcgtctcccccctggggggatgtaagccatgggagtgtgaggagcatagggaatagaggaagaatgagtaggagaagaatcaacttctgtcccctttaatgggggaagaccgcattccggtggcactaaagaaaccatttcttctccccgcccctcgaagaagaagccaccttaccttctcccacccctcatccttgaggggagaaggggagaagaagccgcttttctccactcccgtccccccgggggtgagggaggggaggaagaagccaccctctgataaagagagagagaaaaagccacatcacacatcgccacacccttttcaaattgacacaatgggtgcctaaactaaggctcaggaagggggggggggggtactgatatgctattgttataaatatgtatataccatggatggcacggaattccgatttccgaaattttggacgttggaattccgatttccgaaaatttttggggcctcggaatgccatccctggtacgtacacaatgttgacaaattgcgaaccctgtcggagaaaggcatttttagattgggtcgaaaatcgcgtttttcgttggctcccatgaggtaccctgaaattttttggcagaaatcatgtttttgggagccccgacatttgcggcctgacttttacggtcccgacatttgcgcctatgtttaaaatcggactcaaaattgaattttttcaaaccctgatagcctaaacagcattaaaattaagaaaacactgttttatagtttattagcaatattcattctgttgttcgaaaattttattattttttcaaaaattcattgacgatcaaatgatcggacacaagcaatttgaaacgcctatttaaagctgtttaggcgatcagcgatggaaaaaaacttaatttttaacccgattttgga

SEQ ID NO: 1102 - DNA, 3584 bp, Heterodera glycines
gtcacaataatgtgcgtcatgtttttgataaaacattagtgtttgttctgtgattagctaaatttaattatttaagcagagaagtgtgcaatgggtttattatttgatcgctcaaaagaatgaagaattttgttattgattaactgatcgtaaatcgtaaaatttaaataaaaaatcaatattattttatgaattattcatctgattttcatttcaataccttcaattttttgttttattttaaattaattaattttcagattttattattatggcttcaataaatgatttagattatgttcgagattatgactatgtttatgatttagattttgttcaagttgaagaatatgttgagatcatagaccaagagattgaaagagacattagaaactatgatgtgtttgaggagcataattatgctaagcggccaagatttgtggatgatggtcccagtcagggatcactgaatttagatgttgaggttgcggggccatcccgtatgagtgatagtcagtttgaagaacggagaattgagtatatgagaaaaagagagcgagagagaatgagaatgagacgagctaatgaatctcaaagccaaaaagctttgcgtttagaacagaatagaaatagaattatgagtcaaagatctgaagaaaatgcatttgagcgacagttacgtctagaacagcaaagaataagacagagagtgataagacaaggtgcggttaatgtttatgcagcaggatctcatgtgaatgctcatgaacatagacttggacctatgaatgttagatgtgagttttgtgatgctttgcattttgttgaagagaaaatgagtggccgaggcaattctttcaaggattgctgccactatggtaaagtttttgttcccgagattcctgagcaggaatttcctgaggaattaagggatttgttcatgaaatttgatgcgagacatgtgaatttttttgataatattagacatttgaatagtagtgtgtcgtttgcttctatgaatccgcttagatatagatatccaaataacagaggtccgtattgcttccgcatttacggtcaagtttatcatagaatgaatttggctttgaatccagaagatggcgatgatcctgcttatgggcagattttcatcgtagatactgagcatgcaatgagagcgccaatgtcgatattgaccctcaattgctgagaactgcttatgaagtgattagaaatgtgaatccgtttgctgaagcatatatgatgatgaaagaagaagaagatgaagaagttgaaagagcaagaaatgagaacagagagccagccgagatcaagcttttgtttgagaccggaaggcaattggacagacgcttggggtacaatgtacctcgagcgaatgaagttgctgcagtttatgtacctggggctgacggtgaagtacctaatgccaagattgtggtgagagaacgtggaaaggaattgaagattttgaagagtacagattcaatggtgactccaatgacttacccactgttttatccgcgtggtacgcttggttggcaccctgaaatgaagcatagaaatagtaatagaagagtaacgagattacaatatgtttcctatacagtcgcaattagagaaagagagtttaacccaattttgtacggtggaaagctctttcaacagtattgtgttgatgaatatgttaagattgaaggagacagaatgaattggataaagtgtaatcagaaaaagattttggctgatgcatataagaatgttgataatatgttaatgagaagagcagaagaaagaggtttgccactgggtaggaaggtcattcttcctccgagtatgacaaacagtccgagatatgttgagaagcattttcaagatgcgatggctgttgttagacggtttggtaaaccagatatgtttttgactatgacatgtaacccgcaatgggaagagatttcagagaatttgtttcatgaacaaaagtcaagtgatagaccagatttggttgtcagagtttttaatttaaaagttaaagctattatgaatgagatagtcaagaaaaaggtttttggagaagtgattgcatggatgtatccggtagagaaccaaggacggggactaccgcacatccatttgcttttgacattggcggagcaagacaaattgattaatggtgaagatgttgaaaagaaaggaattagtgcgagaataccggacaaggaattagaagcagaactgtttgatttggtgaaaaggtttatgatccatggcccatgtggtaatttgaacccaaattgcccatgcatggaagagtttgttgacaaaaatggtatgaaaggaaggaaatgctctaagggataccctaaagcatttcaagaagagacagttgttcttgaaaatggattggctttgtatgcaagaccaaatgatggaagaacagttcaaatatttgcaaatggaagaagacatgaattagacaacagatgggttgtcccgcacaacctgtacctgttgaaaatgttcaagtgccacattaatcttgaaaaggttaatagtgttagttcagtaaagtatttgcataagtatgtgcataagccaccagacagggcaagactggaactagaagagagaaatgatcatgatgaagttaaagagttcattgatgcgcggtatgtttgcccgcaagaagcagtgtggagaatttttgaattgcctatgtatgatagaagccattgtataatgtccttgcctgtacacctacaaggtgaacatatttgttattttgacgagaatatggaagaagaagagattcgtgaaagaattgcgaatggttctgagttgatggcatattttgaattgaataagacaaatgttttggcaaaaactatgttttatcaccagatacctgaaaagttttgttttaagaaaggaaaatggacagagagaaagacatattttaacacaattggccgaatggtgaaggtgtcaccggctgagccggaacgataccacctgaggctgttgttgttaaatgtgaagggagcatgctcctatgatgatttgaaatcagtttttgatactaatggcaatgcaaaagtttgtgaaactttttcagccgcatgtttagaaagaggtttgattagaaatgatgaagagtggaaaagagcattagaagaagcagagagttttgagatgccatggaaattgagagcgttttttgcattgattttagtccattgcaatccggccaaaccggaagagctttggaatatgtttaaagactcattgtctgaagattttagaaggaattttagaaaagaagtagcttatgctaaagcttatagagaaattgcacttagcattattaaggctggaaaaacgcttgccgattttccaaccatggaacagataaatgttgatgatgatgttgaacaaatgtttgacctagccgaagaattggatttgggacaaagaaatttatgcttgatgtatgacgaaacaaggaaaattagtgatgaaattttgcatagaatatggaatcctataaatgaaccctgcgtctactt

SEQ ID NO: 1103 - DNA, 4015 bp, Heterodera glycines
atattttaacaaattggtcgaatggtgaaagtgtcaccggctgagccggagcgataccacctgaggctgttgctgctgaatgtgaagggagcatgctcctatgatgatttgaaaacagttattgatatgaatggcattgtaaaagtttgtgaaactttttcagccgcgtcgtttagaaagaggtttgatcagaaatgatgaagagtggaaaagagctttagaagaagctgagagttttgagatgccatggaaattgcgagagttttttgcattgattttagtccattgcaacccggccaaaccggaggagctttggaatatgtttaaagactctttgtctgaagatttttgtaggagttttagaaaagaattggcttatgctaaagcatataaagagattgcacttagcattatgaaggctggaaaaacgcttgccgattttccaaccatggaacagataaatgttgatgatgatgttgagcaagtatttgatttagccgaagaattggatttgggacagagaaattatgctttgatgtatgatgaacagaggaaaattagtgatgaaattttgcatagaatatggaattctgtaaatgaacctgcgttctactttcttagtggaccgggtggaacaggaaaaacacatgtgaataagacaattgtacatatgctgagaggtcagaagaagaaagtttgtacaatggcttttactggcatcgcagcaactttgctgcctgctgggagaacattgcacaatagatttggactgactttggatatgagtaattcgagtattagtccgagatcaagagtttggcaagaattgaaggaaacagatttgtttatttgtgatgaggcgcctatgataaataagcgcgcaatgagaactttggatgagaaattgaaagagataatgaataatggaattgcatttggtggcaaggttttgctctggacgggagactttcgtcaaacccttccgattcagaaacatgccacgagagctgagatggttagttcaaccataaagagaagcgagtactggaggttggctaaaagatataaattgacgaagaatatgagagctcttgcaacagagcaagaatttacgagagatttgttagagattggcagtggaaaatggaataatgaaaacgatgagataattttgcccgacaattgtattagcaatggtgatttagcagaagagatttttggtcaatgcattgtcttagaaaattggaatgaaatggccaaaagtgccattttagcaccgaagaatgttgatgttagtgaaatgaataataaagttttagaaatgttgtctggagaagaagttgtgtataccagtatagacttagctcaagatgagaatagacaaagagccgatgattatttggatgagtatttgaatgctttaaacccttcagggtttccgcggcataagttgagactgaagaaaaatgcaattgttttgttaatgcgtaatttgaatatagaaatgggcctttgtaatggtgcgagaatgaaagttgagcaaatgcaaccgaatttgattgtgtgtaagattttgactggagacaaggcaggtcagactgtgtacattcctcggatcacgctttgctgttctgaagattacccttttgacctgcataggcaccaattcccgttggtgttggcttttgcaatgacaattaacaaagcccaaggtcaaacccttgagcaagttggaattgatctgaggaaagatgtgtttagccatggacaattgtatgtggctctttcgagagcaagagcttggaataagttgagaattagattagatgatggcaacttagagagaaaggtgaagaatgtcgtgtacagagagttattagataacagtgattagataatgtgttagactagcattggatttagatttagtatagtattagaattgattttgtatagacaaatctgttgttctttgggttgctcaagacagtacgaacacaattcaaagtaagtcattctttttaatttcatactttatcctttctccaaaaataattgttcataacacattcgtactacctagcgggggatgcgccgaaggcgctgaccccgctagttttataaaatagccattgtcaaatagatccggcggccatacgaacagcaaaaatgccaacttttttttttaacaaatgctttgaaatccggaacaatttctgtttaacataattttcggtgctgctcaaaaaagccaaaaaaaaaaggtgggaaaaagaatgggattgcaggcttttctcgcgggaatcccgttatcaccacgttctaatacaaaccaaatggtgctcccttatttttcataacacttttccatttgtaagtcaaattttatcttggatacatacctagatttgattcgttaattaattaacctttatttcatagcaaaaacttgttaaatgcttgagacaccacgaacaattcccgggtttcattcggcggggccgcgtcgactcagtttggccacgtctcactacagacagtttggaattgtcagttctccgttggcgacttcgtctccttctccgatgcttttctcgtctgctgctgctgccactctcccggatcgcttgccgttacgccgtccaaaaaagccaccgcaaaagttgcctcttttaatgccgcaattgcacctgcagtttccttcgagtcgaacgaacacaattcgcagcaccgatttgtcttccatttacacggtgcagccggaggaggcagcgttggacgagcgaaatgcagtaagtaagaggtctcatccttcaaatcagaacaaaaagggttttcttagaaaattgaatgtcggattcttttgtagccgtaagatttgctttctttctatttagcatttgcttcaatgtatccaaatgcaacaagaactcatcaatcaggccaccgctgcaattgcgctttgtcataaaaagttcaggttcagtgggactcttcaagaggtttgtgtagatggtacgacatgtttcatctaattcaaacatcgacaatttagctcagcgcacagcgacttcttttggtttctcaggagcgccttgcgttgctcaaccgtcaaatggaccaattgaacgaacagcgaattttgaccaatttgtccgtccagcagttggacgatattccggaaagtgtggacttcgacaatgaggacgaactggagagtgtcactcctttggcgcgctgcactctctacattgacaagatagtgatcttttgactaattttcgaatcccggacgcgaattcgagcaaaaaactcgaaaactcaaaattcacttttatgttcatagctgtacaaaaatttgggtccgggattcgaaattaggtagtcaaaattgaatgtcggattcgggttacccgacacataaaacccccatgaacatgttttcacgactttatagaacaaaaaaatttttcctcaaaaaagggggcctaccatctatagtattaccgcaaaaattgtctttttttggtgaaaatctgttaacaaatcaacgaaatacaaaaaattttccggcgacgcctatcggcaccgccggacccccttcccccgcccgttcacctaaagttttttgaaaaaatgcgccgcaaaaaattgttaaaaatctgattttttgatactgacaaatcagtgcacagctattcattgtttctggaataaaatgttcaaatcaaggcctagctaaaacaaaaaaatctgttaatgctgaagacatatatttatttgccggttggaaatgcgattgaagtgtgcaatgggttcttgtcaatgtttttttcataccattttatgtttactttagtgggaggagtttttcagtacggtactaaacaaaacacttaataattaggttgcggactggctcagttcggccccagcggctttttggctataacttttttcactgtcaaccaaattcaacattcttggtatcattcggaagcttttaacatgctct

SEQ ID NO: 1104 - DNA, 455 bp, Heterodera glycines
ctgaccccgctagttttatataaaaatgctaccaacccccttttttcaaatttttcccggcggcgcctatcgatacagccggccccaaaaacatttttttctttaaaaattgtcccaaaatcaagaaaattggtaatttttggtgaaaatctcttaacaaaatggactcaaattttcaaaattttttccaactcctgttcccaaaaaagttttttggaaaaagcctcaaaaaaacatttccattgcttatttttatttggaacaaaattttccaaaaagctgatttttgaccccaaatgaagatttttatcggccaaatgctgaatttgaaaattttcacgttggcagcttctgattttacttgaagaggggaattattttgtattatttttaaatatttctgacaatataattttaaaaaaaactaaataatttattgaatccatccataataa

SEQ ID NO: 1105 - DNA, 5412 bp, Heterodera glycines
  misc_feature (10)..(10): n is a, c, g, or t
ttgtgacacnctttttcgaatttaacgaactctcccagtcgtcaagaaaacaaaataaaggaaaagccaaaagcatggaaaaaacggtcaaaggcgttaaggacgacggggaagaggccaattatatggaacggattaagtaatgaataaatatcagagaagtacttggccaaccccaatttcagagagcatcggtcactccaagaattggccaaattgaagggcgacacttttgacgaccccaatgacttccaaacactgtccaatgactgccgcatttcaaattccgtttggaacagactttacaggtcataaaaggaatgaaagtcgtcaataattgtctcttttgcttaaaagcgatgataaatatttttaagataccaaaaaaggggcgtccgatggctctacgaattgcattttcaatatgtcggagggtaatggatgagcaattgcgtttgcctttcccattggcacttttcagcattttggccgatgaaatgggactcggaaagaccatccaactttgcgtcttccttcgctctctctcggagagtcaaacaatttccaacattttcaggtgtgctttttgcatgcgttttcaatccctgtttttcctgtaggtataaaggccttggtccttctctgatcgtttgtcccgctacacttctccaccaatgggtcaaagagttgaatgcctggtttccgttatgcaaagtcgccgttttgcactcaagcggtgccttttccgggcccaaggccacgcttataaagcgaattggcgaacatcgggggttggtttttgtttgttttacattcgatgcgagcattttttattttggttttaggaatggatcaattctggtcacttcgtattcaacttttatgctgagctacgaacagatttctgcagtcaattggcactattttattctcgacgaaggccataaaattcgcaatcccgaggcaaaggtgttgtctttgtttctgctgcacttttcgatagcgtttctggcactttccagatcactttggcgttgaaagagcttcggacgccgcaccgtctgattttgagtgggtcgccgatgcaaaacaatttccgggagctttggtcgctcatcgacttcatttacccaggccgtctcggctcgctcaaagaattcatggagaagttttctgtgcccatcactcagggagggtacgcaaatgcgagcgctgtccaagtcagaaccgcgttcaaaaccgcgtgtgtgctgcgggacgcgatcagtccgtatttgttgcgacggatgaagaaggatgttcaaatggtgcttcagctgccagacaagtcggagcaggtcagttactcttaaactttttaatgttgttgctcgttttttccggggagagagggtattttaacacgagaaaacaaatgttgtggattaatcaaacattaccttcaattactttccattatggtaaaattcgtctgtgtttcgggtaatttcttttttctcctcccactaaaaaaagtctaccattttggctcctttcgcgatttttcttacaatatttcttgtacagattcttttctgtgacatcacaagtgaacagcgtcaactttatcttcagtacatcgagtccaaggcctgtgatgacattgtcaccggcaagcaaatgccattcgcgggtttaatgtttctgcgcaaattgtgtaaccatcccgacttggtgtccggaggacccaaccgatttggtaccaataataatttaaaaatattagcgattttaaatcgtcatttattcgttttgctttatttagccgactttaatgtcgaagatcggcaggacatggaatttggattttaccagcgcagtggcaaaatggttgttctccgtgagcttttgcgtctatggcgagaacagaatcacaaagtgttactgttttcacagagtcggcaaatgctttcgatcattgaaagttttgttatcattgaagggttggtaaatataacgcccaaaaaacctttaatttatttatattaccgtattattacagttattccttccttcgaatggacggcacaactccaattggcagtcgacaaactcttgtcgaacagttcaacaaagttagttattgctgcttttcctacaatcctcactttaattctaaggatcccgatctttttgtgtttttattgacgacaaaagtcggtggacttggcataaatttgaccggagcgaatcgcgttttgatttttgaccccgattggaacccgtccacagatgctcaggtcgatttggtccatatttttataaattaatttttccttttttttttgttttaggcccgtgagaggtcctggcgaattggacagcatagggcggtcacaatttacagattgtgcgtggcaaaactatcgcctaattaaacagtaattaaggttgacaagcggaacaattgaagagaaaatttaccaacggtgttgtttttcatcggttttcgttaattaatataaatttattcgtttaattattacctttaaggcaaatattcaaacactttttggccaatcgcattttggacaacccaaaacagcaacggttcttcaaaaccaacgaattgcacgaattgtttactttgggctcgtcaaaaagcgaccggaagtatggcacaggtaaaacaatctgtaaaaatctcatcaatttcactcccaaattttagaaacggcggttatttttgccgccaacggaagcgaagtgagcagaaaaaagttgaagaataacatggataaaagaagggatgaaaaggaggcggagaacaaagcgaaagcggcggaacggacggacgacggcggaaaaatgccctcggctgattttaatgacagtgcactttcggacgaggcccgggaaaggcttaaaatggtcgccaaacgattagcggcgtaaaataaataacaaaaaatgcttaaattaacaataatttttagaaattttggaaaaacggagacggacaaagcggaaaatgggcggcggaagagggacaaagtgttgtttgagggcaaatacaaagttccattgctgcggaaacaagtggaagtgatggaaaagaaagaggaagacaacgaagagacggcgccggaggggcattcgttgagcaacaaagaacaggtgaaggaggagcacacccagtggaagggaaaggcccaagcaaatgcccaatttttgttattttgttggaaaatacccaattggacgaggtactggaggtactttcccaatgttccgcctcccctggaacagtccatgccatggtttttaaaggggaaaatattacgacccaaaacaaacaaacaaaaataagcattgcgaatggatttggccaacaaattaattttatgagtgaattgtgttgatgattttatccctgtttcaggatgattatgtgttgagcaagttgctcagcaaaaaggtcggtgttcactctgcgcttcagcatgaccaaatcatcaaagagagttccgccgccgacattcagctgatcgaagacgaagcgaacgcagtggcaaaaagggcagccgatgtgttgaaacgatcgcgacggttggccaatttcttgtggaactttcattgtttcattcttctcaaggcgacacctcgaattcctgtcgaatgcgtccgaatttggcccaatacaaacaaaaaagtcattgttcggtcgcaaaagagtggccgggttcacaataataagcaatggaattgaaaagactgatggaaatgggggcagagacggagcgccaaaagaacggacagaaaaggaagaggacgacgaggaggaggaaggtgaaataagggaagaaacacgagtgggaaagggagttgtttgttcagggtgttcaaagcctttcgatgggagcgaaatgttagggcggaaaaagcgcggaaaatgcgatgcgagcggcgccgaattgctcaagtcgataagacagcgaaaggagcgccaattggacattgacggggagggcgaacttgcggaaggggaagaggacgaagttggtggacaaattcaaatatttctaaatttttgctttccatcgttgcaataagtaatttagagcaattacccatccatttctgcacaattgcggccacattcgcttccctttggtgacaaatacgaaaaacttgcggatgaaattcgaaatttcttggcggtaaataacggaagagcgaccaccagcgaaattctgtcgcgctttaaggtccattccgtcgcttgccggaataatccaattcaatttccactcctcagaaccgagtccatccctccgagtcgttcgtgttccgctccattctcaagcatttgtgcaaattccttccaaattcgcagtgggttttgcgcgacgaatttatttgaaacttttgagccgagtgaaatctcaactttttattttattgtattttacattcgcactcacatttcttgattaattttgaccaaaacgttttgttattttgatattctggtcagtgcaataaatgacatttatctgttagtttgtttttttccatttttatgtttttttggcccatttttatcgcaaatgtttaattgttctgtgatttacactgtgaataaaccaattcagcagttgttttgctttgttctgcgatggtcgcccaacattttcgcattcgcgcgaaaggctccgcgcgcgtcacaaaaggaaattggtgtgtatttttgttgttttgcaaaaaaggaaaggcatttttgcaagttctgccgcttccatcaaccccaaacgttctcggcatcgcgacgcggcgcgggcgcaacgaattgccgcggcgtgtccaatggttgcggtggacgatcgacagacaaaggccgaaaagacacttttggacaatgtgccaatggttgtttggtattcgttttctgcaacgcctaaactaatcgactttcagggaaacatttcgctcgaaacaaattgcaaaatattaggcactgccggcggaaaaggtgccaaaaatgccaccaaaaagagggatcccgttgcccctgccattccgaccattctcgaccaattgccaattgtttgtgccctccctccaatcaaaatgaaatgggatcagatctattttagggcactttgtcgttgttggaggacgaaaggccgacaattgaccacacagtcgccgtggatttgtttgaacagcttgagcggtcactgaacgtgcaaaatgccaaatcatggccaatgataattgaaaagctcaccacactaatggccaaggcggggcctacggttgcgagcggaacgccggcatttggacgagtgatgggcaccgtcgcgcagtttcgtgaccgcgacaattgtcctgtagcggaaagcatcgatcgagtacaattgcaaatccgaa

SEQ ID NO: 1106 - DNA, 2757 bp, Heterodera glycines
ttctcgacccctcccctttttatgtacaaataaactgcccataagctttcaattattatggaataattccccctttttagtgtctgattgccgatttgttggccgctctttcccgcaaggctgtgccccgcgatttggagtgcattttcgattttgttgagccatggctttgcggtcgatcgtctggaagagcccagaaaaaggcttacaggcaaagaaatgaatattttggtttacaattagttatttttaaccaatctcagaattttggccgaaatttaccgtcgaattggcgagcccgagcttgaaaccttatttgaagcaaaacgaacatttttacacgcgctcattggaaacggaacgaggggattgaatgggacggtgttccaatggcgaattgcaattttccgaagtgtgagtgccacacgtaaactcactttgtttaccatattttgcaggtgctttcttccttcactgaatttgaccaactcgctgaattctccgcttcgattagtgccgaaattgtcgccttcttaagccgtttgaacaatcgctccactcgccatcagtcggcactttgcctcagtgaaatgagttcggcactcatccgactcggactcaccggggacgaacagtgagtttttaatgcttttctctacgatgcctttgggcttcatagttccaataagccccgaacgatttgttgccaaacttgccatttttagagtctcggcctcttccgcgctccatccgctgctctccaatttgttcagcgagctcaaagccagcaaaaatggtgccgagccgtcctttcaatgttcgctgatcgctctgaacattttggcacaaaagcactgtcggctgatggacgcttctctcctcgcccaattcgtcgcctattcctcgtccgcccttcgcatttcgcccgccgctgtccgcccgttgcccatcagaattttgcgaattctttctgccaaaatggaacaatttatgttcgaccaatttaaggtcagaatgattattcgtacgtctgattgaactttttccaaatattttaatgtttaatcccgaaatttgacaataattccgctttgtttgaaccctccaggatttaatcatcgaatccgttttctcgcaagacactcgcacttcaacttctcggatgcggaaagccaacgcgcttctcctcgcccaattgcttgaacggctcgaattggaaactttgttgaaattcgctggcgacagattggtgtggcaaaaacagctgaaaaatattgagaaacgacgacgaaggcatcggagagacaaagcggagaaaggagaggaggaagacgacgatagtgggatgagagagcgagtgtcgcagagaagcggcagtggcgtcgaaacagaatccgcaatttcgtggacgaccgccggaggtcgtacggcgaaggccgactcaatcttcgatatattgagggacagcagtgacgaagaggaggagggagaaacgggcagtgacagcggagtgagagggagaagggtgagtcgagagaaaggcagagaaagagggaggcaaacgaaatagcgaaagagttacagaaaaagagtggacagcgcgaagtgaacgaaaaacgacggagaggcgcaagtgggggcggcatgtccactcatctttcggtggtcattgaggaggacgaaaacgaaatggtaaaaaaaaagtgaaaaagcattaacacaaaacccccactctcgggtaagctggatttgttggaccaacagtcaatgctacaaaaagtgacgttggttgggaatgagaaaagtgcgaacaaatcggagagaaagaaacccggaaaacgacagaaagggaaacgaggcgaaacggaaaagggagggaattcggaggacgaggagacggggccgttcaagacaaacaaggagggcaaactgctgattgccgacttggacaagaagcagcgaaaaagagggaacaccaaaagggacgccattcctaagaaaggggcgaaacggagaaagggaggagaggaggcaaagcatgacgaagacggagggggaaggaacagcgatggtgagtcatccgccggtggaagccaatgaacgaacaaacgaaccatcattgcgcttttgttgttgttatgtttattaaggaacaaataaatttataaacaatgttttagttttttaaatttgagtcttaccaactttccaaaattttgtggaatttgaatttaaataatataaaatgaagcatattagagttgcatttatttcgaatcatttaatgatcaaaatcacagtgacacatgaaaatgaaagaattcaaatcgatggaaattgacaaaaaaacaaacaaatgaatgaggtgtgaagtgtgggggaaagagcattcaattggtgaaacgcaaaacaaacataagaccatgtacatatacattttgtaattgactaggaaaagatgggattttgtcgcaattgaaaatcgggcaaaaaaatgcccaagcggtgacaattttaccatttaaatggtaattgatgcggcgaatcatcagaaaaacgatgggtcggacgattgctggaaggaattgttcataccgtaggcgagaaaactctgaaaaaataatgggggatttttaatagtgccattgtttaatgaatttattatttttaatatgggacaaattctttaaattaacaattaaatgcaaaagcgaattaaaactaacaaaacaaataaaataaaaatatatccatgga

SEQ ID NO: 1107 - DNA, 8977 bp, Heterodera glycines
  misc_feature (31)..(31): n is a, c, g, or t
  misc_feature (84)..(84): n is a, c, g, or t
  misc_feature (8958)..(8958): n is a, c, g, or t
  misc_feature (8967)..(8967): n is a, c, g, or t
gtaaaaacgtgaattacaagttactagaaanaatttaaataaaatatacaccgtagataaataaatttattatttttttaactnttataaaaaatatgatggcatttttgttctgtaatggatcaacagtgtgaagaaaactcttttttgtgtggttatcaaaaaattcgtcgttatggcagcctcagtgactcaacattctctcgaccgaaataccaacggataattgtacataaagttatgccatcagatactcttcatggccttgaattacggttttaattaactatttaattacaagctgaaccaatatttagtttcaaaagttcaatgtatgaaatcaaacgcctgaacaaactttggtcagatcaaagtctttactgcaagccagaaattcttatcccaatttttgatgatctaaatgtgtccactcaaccaccgaatgaaaatattcgaaacgatggtagactttttattattaactttttaaattattgttcttgttagttcacaaatacaatggagaagaccttaatgaggaaagcattgatcagttgttccgaaggatcgatttgggtgtaaaacaaacgaaaaaaatggttaaaaaacgagtacaaatcaatgagatcggagattgattgctgtccagtcttttgttttatgcagaatcattaagaagacactctttattatatttcgaaagatataaataggggccctttggattctggcaatttttaccagaaagggtcatccttttggcaatcaaagggtgtctctaaggtgctgagtcgttatataaaaactatcaaatggaaattttcaacaaaaaactgcccataacttttgtcaaagtcaaccaaattaaacattcaatgttattattggatagccccaacatttctctacaagttcatctaaattacaaaaaatttggtcaagcttgagcaaagttatggccaaaagtacgcaaggtactaagatttcacacatttttggccataactttttttaactcaataaaattttttgaaatttttttcaggtcaaaatgggagggctaaacttgatttgtaaaaaaaagttcttctaaaaatgagtcaaagtaataataaattgttttttaccaatgttatcaaggaaaagagactcagtgatttgtttatgctttcttcgtttaaatgtgtaacaattaaagggataataatcgaacattataacttgaaaaggcagcaacaaacgtacaatatttacaaacaaaaaaaaaattcttaaatattaacacttattgctcatttaatcgcttttacgccgtctcttcgttccaatagcctctgaaaatggcaaaaataaacaaatgtaaaaaaaaatctttcagttccttaaaattacgaaaaatgttgccgaaaagattaaaattaaaaaagtcaacaatatgaactgtttagagttcaaatgttttggcaatcatctcttttcctggtcccgaacaaaatttcttagttttctgaaaatctaataacatatttctaggggtgttttgacgagctgagttcgaatccggcctcctttttggcgaatcgaacccttaacccggcttcgaacaattttcgaaaagtttttttggaatttaagtttttaattcaaagaatggtttaaatgatctatttattgaagcattgatggatgacattaatattttcaatattttaaccttttttaaattaaaaaaatgaaattcgaatgtactaattgcctcaattttacacggcgagtcaattttgggttcccagtgcaaataagtttattatttatttagtaatcagaatgccaaaactttgcaaaacttgaattttttttggattttcccttgtaaaaatagaagagccgatctcgagttcgagttaaaaacataacttccaaaaaataaaatagggattcgatagagtggcataaaatatggccctatgcaaaatttcaagaatagggaaaattttttttcaaggacaaacatttcaatacttttaattcttttttagccaagtgcgcaatttaagccaaaatcaaataaaacctacaatattctcctgaattttcccttcaaaatgagcacaaaatagttttatttggtctagtattgaccaagttataagctaaaaaaatttcataaaatctgtactattagttgatgctgtacgcagccaacgctttttgaatatgatttttatttttgacacgaaaacttttagtaataaaaaatgattcttcctttttctttaaacagaagaaattgaaattaacacacaacataagggggatttgaacctgagaccccctttttggtgactaactcacagaccacaccgacgaaaaatccaacttaattgcacttggagcccaaaattgactcgccgtgtttagtaaaaaaaagagtgaaagtttgtcagcggtgctgtaaaattttaaactaagcatattttacccaatttttaaattgggcctaccccctctaatttagattttttgcttcaaccgttctctttttatggaaaatgtaccacctcctaaccaaatccaaaaccaaatacatgcgcttaatgcgcaaatttttcgtctcagggagcgccgtgacaatgggtgaacatcaaattgcagattggaacgaacgcgagacgaactttttgagcaattgcacggaggacaagcggtaacggtatcaatagaaggaaagtgaaataaaaacttgcttttaaggcgccccctgctgggggtcgtcgtgctcacagtgagccgccaaggcgtcagtacggagacgatgacgacggagcaccatcgtttcttcaccgatcagcggaatgaggtttaacggggagacataaaaaaggaaaagtgggttgggttttaagtcacatggaagttattaaaaccaaaagactattatttgcagtcatgaatataacaccaatttcatcgtctctccctcatcattggttttttataagtttcgaaagagtccgcttttgacttttccttttttgcttcccttttggtctttttggcgtttcgttgcgttctttcgttcgcttgtgtgaagtgaccctttcatttgttcccctctctgcaggaatgggagcgtattgagcgtgaacgtcgccaatacgaggagacggagttggagaagcggcgcgaattggaactcgagcgggcggaggcactgagacgcgagcagcagtggttggagcagggacgggccgaacgggagcgactggaggttggccaagcgaactccatgccgaaaacagaccgccttttatacagattgaacgcattaagcgggagcagcgagaaaaggaggaacgcgccagagagcgtgcaaagcaagaagtggaacggttgccacgcgaccgggacgagttggaacggttggagcgcgagcgaatcgaactggagcgacaggccatggaactgctggtatccgttcaggcgacaaataaaatttaaaaaaatctgaatttcagccctcacaggtacaaaaggacgaaaatcggtacatgatcggcacagtgtcgcgagcttatccccgaattgtattcgtaagttcagagtaatttttagtgaattccaagggcgtagccaaacccttggcttcaggggggggaggggcctacgccctttctgtattcctttttccttttattaattttaattaactaaatccaattttgctcctttccttctccctttagccgtggctgccatggcacgtcgactcggagctgtacccgcacaagtgctatcccccatttgtgcaggtcaccttagcaaaatctgttcaataaccattttaatattcccaatttttcagggctccagtttcgtaatttcgcgtgcgctgctgcggaagtgcttcggcacgtgtgcgcctttcacggctttgccattcatctcgacgacattctgatgggactactcaccaactgtttgggcatttcgaacattcaccgagacgggtacacacaaaatgccaaataaaaattgcaaattttatttaaggttcgacgttgggcatagcctcgactccttcacagtgcttaattatcaggtgcttttggcatttgcccataatcactttttgccataattttgctagatttttaaatttcagttctctcgctattcctccttcgctttgtcggaaatgtttggcagggtccttcacatctgatgacagatccgtcaatttaccaatgaactcagacacaatgaaacaatcaattattgtcttaattaattaaatgcaatgttacaaagaaaaatgttttgaatgtgaccaaaagaaatttgataaagtttgaaaagtaatttgttttttcattattttaaatatttatttttactcgcgtacgatactccacggcataaacagccgactgaacgacattgacatggcaagggctttttgttgttgcatttgctgttgatcccttccgatggcattttaatcctcctctctttttaatttccccttttttaccgttcgtttccctctcagaaagtgtctcttttgttggaaatgttcacttcctccgctccctccaatcgcagcagtgccaacaatggtggcaactccgtccctcctccgccggtgccttcgtcctccgcccttttgctctctccgccgcccctttcgtccgccggctcttccgactccgtcgcctccgcaatggcaacggccgcgcaactcgcagcgatgctcagcggaataaaccccacggcacgtccaatgtttcctttattttaccgcaaatttttagggttttaatttcgcctaaatgggcgatgaattttatcattttaccatttcgcgttttaaggtttttgcttggcaaattctgcgcgagtcaatcaacgacgaagagctgaaaaacattcaaatttcgctacggacttttcacggtgaaaccgccgccaatttattggcccgccaattgccaaaggtaccgtaggaggaggagactgtagtaaatggcataataaaatacagtaaaacggcatgaaaaatctacgggcgctttcagatccgaattgtggtggaacaaacgatgagttacttcaaatgggacgaaatgccaaacgaagtgcaactgaccaaggccaaactgattctttcccacctgaagaacaatgccaaagtgcgcaattggaccctgagggagggaaggccgagcaggtgggaaaacggggcggagggggcgttaattagccaaccaattaattagtggggacattttgtacgaaaagggtttcagtttaatttgaccatttgagtgccactcctccatccattttttgacttcaaatgcccaaacaacttccatttcagttcttttgcttgtgataaattttgtcaccatctcttctctctccccccatcctttggtttaccgtattatttccccctcccccgccgcctaacactttaatggttacattttgcgtttgcgcaattcaccgatggctgagaggggtggggtgggggggagtgtttgcggcgtccgtctgttgtgcatgtttagtgcgcgaaagggaacagagaaagataggggggggggaagggattcggttgcatgattatcggggggggggggaacgattggtcgcgttttgttgtggcggagtgagtgaatttgggggaggtaataaccgctgttgtaacagcagtgttcattgtcattatgtgggcttttattgtgaatgctctctctctctctctctctctctctttcttttcttctctcctctcctattctctctctctctctatttctttctttctctctctccctcactttcgctgcgtttgttttgccttttcttttgttcattttttcaaagttatgtgtggtgtgatatgtttcttttcctttctgctgagtctgttgcggcgtttggaatttaatgcaaaacgctttttcaattttttccagaatttttttgaatctatgaataatttgatgatttaattttatgtacaatatgtacctgtatatgggtttcatttgcctataatcgttttgtgaagaatcaacaaaatttagtgaagagagagagagaggcgagaaaccggttgtacgcattttcattcgtccggtaataaatgcgcaaaaagaagaagaagagacccatcccttcaattttttatcacattttgttggaacgagcaaaatatgagcagggcaaaaattgaaatatttttaaatttagttttggcagatgaggggaccaataaacaaaaaccattacgcttaattgattaattagtgttttgttgctcagattggctaacatcagcatggcttcgaatggcaaggcaacggaagcgtcgtcagaagaagtgcgttgttcgtcgggtgctgccgccgcgtccaccgcttcgtttgtgccgtcgtcggattcgccgcacaatcagccggggtcgcatgccatcgactggaagacgtacgccgctttgttatcctcgccatcgggcgccgatttgatggcagcgatgttttcttccgctgctgcgcttggaccgacgaaagcacacggagaggaggaggaggaagaaagcgaaagaggggagggacaagagaatgttggagaggaagagacgacgaggaagggacggacgacgaaacgaactgtgaaagacgaagagacggaagaagcggagggagaagagcgggagggaaagcggatggaactctaattgaactgtcattaactgaggagagggataatagatgattatttgtgaggagtgaccatgaccagccagtagaacacacttttgctttatttcctcagatatttttgtttaacaattctacttcattctctttattttctcggcattttaatttatgtgctctctttgaagcgggagattaagcgggcactgtccgctttcactattaatgacttgctctgatgattattttaattgtaagtaggcaaagaattgaccgtttcgtcgtccgttaattgcccgcggctgttgcattttcactttgtctacccaattgaaaaactaattatatgtataaattcttttctttactttgtgattctccttttacatattcctgttttcctaaatttacccattacattttatatttcgacatgaaaagattttgatggaatacgaacaccaacaaaaaatttgtcgcctttttagaaagttagctaattaaactttagtatcttagaaaatcgaatatcaaaatgtctttttttattaagtgtatgatgctcatattcacaatgctaaggataaaaatccgcatatacctagctgtagctatggtagctgcagatcgattaatctacggcttgaaacccgtattctcaactctgaatacgactggggatagttcgatccccagctacctatccaaaagatacggataagccactacttttccctttgttagtgtattctatgtctagtggtttgtgctttggacgaaaaagcgtctgtgggttcgaatcctttaggggctaatgtagtttgttagttttctaacaatatctatgcacctctaagaattgaaaaattttctcaaaaatgaattccctaaaatacattttttttcttgataaacttttgttaaaattttcttattcataaaaaattttaataattgcatttacaattgaaataaaccaaaattaagttttttacgtattttgcttcctaaaaagtgttataagaaattttatttgcctatttttcgatttatctgcagctagcgaattatctgcggatagttagcattgtgaatatgagcatctgttgtttgtttaacatttcactctgaaatctgcaaaagaaatgtttccaaaattaaacaaattttgactcaaatttcttgggcaacgtttcttctctcaacgtgtccccatacatttgtgcctatgtcagaaatcgggttttaattgaatttttttaatcctagaggttaatcataaacatcattaaagtgatagaagtgattgggttcgaaatttggtcgtcagtaattccattttattttattttactttacatttcatattgttgtattttttgacattatttattttgattttttttttatgcgccacataagagcactaatgtgcctgtggtttgctcaataaatataattataataatgttcctaatcaaccggaagacaatttttctcatttttttcaaacagtctaagaaaaaatgcattttaattgtctaaatgaacggctaaattaaactaagaaagtttcttttccttttaattggttgcaaattttccgaaaatttttttggcactctttgttccgttgtcctccccctcagggcatttttttaaataatttaaatgtaatttaattgttttcatttttaattgtcattgtgctgctttgcgtgatcattgtccgaatgtttaaaaacacacaatgttacgacaaagacaacgacaaaccgaccgcggcgacagttgcgcacattgaaatttaattttggaaaaatgtttataattaaaaagcattgcaccaaaccgggaccgaaagcactcaaaaagttgcgggaaaataaacccagcggtgtaaaagccaaaaaaatttcatcgttaattatggtttttttttctcgactctcggctgcggagtcaattgcccgtggcaacttgttttagcaatgaatgacccgccgcgggcaattaaattgcaaatgactcgccgcaggcattttcaactaaagaatgaataaatggtaaaatgtttgcatggactaaaaacgataattgagtttaaaaaatttaattaaaaaacatccaagtatggattaatgcggattacaataatagggttgtggtttttttgattggttgcatttttggcaccggggggagacaaaatatgcacaaaaantgtgcaaantatgattttt

SEQ ID NO: 1108 - DNA, 3424 bp, Heterodera glycines
  misc_feature (30)..(30): n is a, c, g, or t
gcgaaaaaactgaaaagaccgagcggatgnagataaaaaaatgaatgctaaagatttttggatatacgataaaatgagattttaattagtttttttttgtacaataagaaaatacgaactaaaaagttgtctagcaaaagcgccaaaaaattaaaaaaccaacaatatgaatgattttttttttattcctttaaatatagcacttaattttttaagttagttttaaaaaccaaatatttttaaaataaaaatttttcttatttttggatgtttcttttaaaaaattcaaaagttttattctcaagttcattttttggcaatctttgtcatttgcgcaactgtaatttgtccctctaatgatctgccccagggcaaaaattctttaatgaattcattataatttatttacgaatttgttctgattttttatcagcatagctcattttctttttgaatctctttctcgattctcaacaaaattatgttcaattgccaaatgcattttttctattaataatccgcctgaggctattttttgataatgacttgcctcaggccatttttttactaattgcccgcttttatgtattacttgcaattttctgttccatatattttgtattaatttaacgctattttttggagttatctcattctcgactcattaaattcggtgattgccgaaggcattttatttactaatgaacctctccccggggcaaatattatattactaattgctaccggtgcttttctttcattcgtttcttatttattttctcaactacattttttaaattcccctttttcagttttgtttttctcggtgattaatattatttcgcccaattatgcctttttctcccactaatcacttcctaatttgtcacttttttgctccgttcgcattcccgacgatccgacgacgcccaattttttgcaaattgtttttttgtttattgcgcatttttttcagctttactaattgtatctcgagattcccgactacaatttcccctcaaatttgtcgtcatcattttttcatccattcattcgtcctccgcaaattatttgtccttcatcgtcgccactttcgccccacacctttctccaattacttgtgcgtcattgcaatttgggtaattaaaatgaatggtgtgcggcaagcggcgaaaaatcggcaaaaaagtcaattgaggaaggaatgtgtgcccttcggcgagtcaaatgcaaatgatgaatttgttggtaaataaatcggaaaaacgatcagaatcaatcaataagctggggtggacaagaaatttaaacaaaaactgatcagtgggggagcacacaaagtgaccaaaatgagtcaatgatattgatcacaaaggcgaggaaatcaacaaagatcaagcgaactgatcagtaaatggcccaaagtgatcaatcaatatgagtgatttaaaataaatcaaattgaactattgatgaaatgaacaaccagatcaataatgaaactgatcagagataaagcactcaatggaaaatgatcagagctttcctcatgacgatgaccaacccaaacaaatacagaaatcatataaaattttcatctgttgattcaaatgaattttatctgactgttttccaatcattttgatcaatccatttttgggtttagtcggctaattgatttgttatgcaatttgtgataagcttcacccgaaaacaaaacaaaaagcaccaccaaaagcagcagcagtggcttctcaccagcagcccatcaaccaaattgatcagaagcagtgaaagtgtcgtaaaaggaaacgggtgaagaaagaaaagcacaggggagccgaggagaggtggagtttgatctaaattttaaccgaaaatcttttcgttaaaagcttttattttcccgtgccgttaaaatgtgacttttcgggtcattggacgcccaaataattgttgctattgcttttcagatggttgtaaagtctcaactacttctctgatcattaactaattacaccaaaatgccctcttggttgttaaaacaataattatgtcaaattaacattttccgatcatttaaatctttctgatcatatccaaagtgtacgttaatccaacacaaataatttccgatcacaaaatgccccaaaaaatgatataatttaattttgattattgcaaaaattggtcaccaatttttttgatcataaacacccaaaaatgattctcttacttcctaaacattgtctttttataatcaacctgatcagtcaccaaatgtccaggttaagaaggttttctgatcactcattgtcaaaaattgaacaatttaattccaattagtgctaattggcaattctttctttactcacattatcaaaactttcttctctgatcacacccaaatgtcccgttaaaaatgactttctgttgatcatttaatttgtcttcccctcctccaaatccgttcttccttccccacttttcttctcgtccattctcgccctaatcaattgcacttttttcgcttgaaggcgcgggagaattaaaatgcttgaataaataaatgtatgaataatgtgtgcccatcaattccttttgactttttccatttgccgaccacagaaaaatggacattttctttaaatttacaacattcatttattttattttttgcaatttcaatttaatttttactccgatccaaaaataattaaattccccgaaattataataattgttaagccctttatttttgaatttacgttgattaaaataatcggttgaattactcctccttctgagatgggtaaatttcttttttgggtttcctcatatatacaaaaacatttaattttaaattttcgtcttactaattactttttaatttctacattaaaccaataaagcatttctgatcagcaaaaccagcttactgctaaatgaacctcctgctaataaaagtcattattatttttttatttcgctcattaaagtgacccattataatatcaattgatgataatgtgatgatgatgataagcatttggtaaaaattgcttttgtttgtattggactcagctggggacaaaagcgggggccagcagcgatcagatggccggccactttcccaccaccaccacccgcttcttcgtccaatgctttccccctccttaattagacaaacaaaaccgaataaaaaataaataatattattattgcacgggttggggtgacgatgggacggatggacggacacatgagaagcacaggaagaagcctcacagctgctgcggctaatgaagcctggggctgttatggctctgatcatcagcagaagcagcaaaagtagagacggctaaaaacattgatcgatgcattcgcggatcgccccggggcaaaatggggcgcgcgcgcaaag

SEQ ID NO: 1109 - DNA, 1530 bp, Heterodera glycines
ttggggaccaaattttaacaattaaaacttgaaaaaatttcgtaaaaaaacccctcggtttgtcatgttatttctgtcgaggagggctaaaagttcgggtgaatccgaagggaaaaatggcaccaaaacacaaagtggactaagcttaagaaaccaggatgaaagcttgaattgtaaaatctaatgttgcaaaaataaaattaaaaatttcgattttttcaatttaaatttataattcaaagaattttttcacttacgttgctcaattacgggtgctcaatttgctcattaggctgtcgttctactgaagacaaaatcaaagacaatgagtgcgcttgtttcaaatatattttcttaatagtgtaataaatcttgaaatatataatataattattaataatataatttcggatgggacggctgaaaataggagggaagcccccgggggaagcctgatttaagttgaccctccgcagggaagagaagaaagtggcaaataaaattataaaattaaaaagtcacacgcaaaaaatgggtgcggcaacgcgtcatggggcgatcgccgggcggaggtgggacaaaaagcaatcggcgtcggcgacacgcaatttgcaacttccgccgtcgctaccaccgccccacccggccggccgcccgtcgcgcaaaagtttggcgaccaagcggaactcgccgttgcagacagacaatgcccacatccacacatagaacacagtgtcccagcaggacgattgataaggtggtgattgtggcgttgctgtcaccaccaactccatcaccgtgatcactgatcagtcagaggtatgatggtcagtaatcgccccacccccgccggtgatcactcaatcactgtgcacagaaaaatgaccgagaattttgcggcggtgcaatgcatcgccactgatcaccgccaatatcacttttctatattatcaaagctgcgatctgagtaatttattatataatcaatgttttatggctattttagtgggcatttttatacgctgatcacttcgtacgctaatcccttcgtttgctgatcagaattaggaccacaattcgggtatcttaattttaatttttaatttggtaacaatgatgacaatagcactccgattcgagttatacgaatcataaatcacgccaactgaaatttttgtttctgatcacattcttgctgaattaacctttatacaaaaattcagctgggtaaaaaaaaaatgggtcgttctttattaatgaagtcatcataagaccgtcatattctaatatggtccctcaaattcatatgataacaattcctctacggaataacattcttcatttggcgatgtttgatcattatagcttgatcatgttcactaaatgatcatgctgcttgacgaatggctttttgctctgatcagcagccgcattttgcacattctcccggcacccgcatgaccatttttgcagagatgctaatgcattttggcggtgttcatggtcagcagatcagcatcatgatcattt

SEQ ID NO: 1110 - DNA, 1428 bp, Heterodera glycines
ttatggcgaaatgtctttaattcaaaatttcaagataaaactttggatttttgaaaaattatataatttaattcaacagagatttagaaaacctcgaaaatcctttatggcctcggaccaatgattcctagaatttataaaatttaatccataaaaatttttagaaatgaatgcatcagtctggaaaataggtctttttgaaaaattaaaagatggcaaaatggcggagtgccgcgaatgcaaagcaaatggaagagccaaatatgaatttggcctgccagacttcagcaccaaatcgctcaaaaatcatcttttttcaacaatccatgcaaattcggaattgatatttttgaacaaggccatcccaatgttggactacaaatactgatttaattttgttggatgataaaaagttcataaaattttccataaaattttggtttagaacaaagaaaagaaattacgcaattttttttatatttataaatgcatttttaaaatttgaaaaaagcccggtcccgtacgggcgcccggtcaaaattttggaccgggcccgggacgcccggtaaaacgggctttttttgaacgggcggcccgccccggtcaattttcgaagcccggtcccggtcccggtactttcaaaattccggtctctagtaaataacattggatagagagagaaataacgcattaataagagggtgctgaaattcagtaccggtcatacaaaagcatttttgatgaagaagaatagagaaaaaaagcaaattcaacagagagtgttataggaaaagatttaaggacatcgagagaataaaatggtggcgaagcgtacgttaataattaaataaatatcatcagggattctttttttatgtaagaaaaatcgcgaaatatgtaaataaaatatgtataaaaatgctaaaatatgtatgaaatatgtacaaaaactcccaaatatgtacgaaaatatgtaaataaaaattttctaacggttatttttttttggaaaaattcttcgtaaagggtgaaataggcataaaatgcaataaaaatgacccaaataggcctagaatcacattttagtactttaaaaattaatttttgttatctgtttttgaaaaaaaattgattttttagaggtatatttctcaaaaaaagaaatttctataaattctcaaaatatgaaaaaaaatgaaaatatgtacgaaaaattgctaaattttggattttttggggcatttaaaaatcctcaaaaattgcaaaatatgttggaaaaaatgacgaaaagtccaaaatatgtaaaaatatgtaaataaaagtcccgatttttgttcgcaaacacaaaaagaaagtgtttttcctactaattaggctatggagaatccaggaaaaaaacatgtatttacataaaaaaagaatccctga

SEQ ID NO: 1111 - DNA, 2027 bp, Heterodera glycines
cattaaagttttaaagttgggtaaattctcgatttcagcgtcataaatgagatggaattggattggaacttttggggaaaacaaatggtgggggggggcaatcaatcttcaaaaagattgcctaatttgtaaaagaaataatttctaaaaaatatttttagtggtaagttttttgttgttgaaaaagtttgaaaaatatcaaccaaaattttaattaaaatttcaaaaatcttttttggacaaaatctattaacaaatcctacctccgtgttagtctgtacaccttaagattattttttatatttcattttttcgtagcatatatttaactattattatcagggcccggatttttatgtgctaaaatcccgaaataggtacctaaatagttgctaaaaattggaagataattatttcatcaaaaatgcgaaaatttctcaaaaatatcataatggtgaacttttggggaaacatgggttcggcggtgccaataggcgccgccagggaaaaaaattgtttatttttttaaaaacattttttaaaacaagtcaaaaaagttgtttaaaagtttcataagcgaaaagttgaaaatagtttctaaaaatttgcgctaaatcgaaaattgatcgaaaaaatgtttttttttttgcttttgtctcaccatatgctttctgcaaaaaataggtgaaaacctaaaaatccgggccctgattattatgtctgtattattctatatcacaaaggggtattcacttatgttaacctaccaaatttcaaaaaagagggtttataaacattaagttgagcatcgaaatcaaaaaatttacaagcccaagaatttaattaatacaattaaaaaacagatcactgtattaatgctatatcactttcatccgtatcttcatcgcccttgttaattcgtcgtatcaatgtgcccaattttttgctgagctttttcttttcttcagtatagccactttctaccatttcgcatacatttagatacagtatgttaagcgtaccatcgacggcataaatttgccgaacaattttttgggacacatattgcttctcatattgtatttcaattctaaacaaatggatatttcacatacccattaatttaatgagcatgattaaagcaaaattttgaatcgcaattctaacggtttaaacattctaaatgcttatttttaggttcgtcaatttttgcgattattcatactttattctggcattttgaggcttatttcaactgcttatattaacattttcgtttatttattttttcttttttcttataaatggtccataaatctctgtcaggaaattttgtcctcaaattttgcaccgcctgttcactcccatgcgaaaccttgtcgaaatcccctttctggtccgtaatcctttaataatttttttatagggtgcaatcatgtccatcaggtttaggtttttctcaaaaatcccgattccgaaattttctcaaattaaatttttaggttttcgagtcaaccatcatggaattagtttaattaattttaaaatgtgatgcctctgctgttccgtttgttcttcagaattgttttgataagttaaagcggcaaatttggcctccatttttctcaattggtcaatttttttgtcgtataaaatcaaattttgttttgcttcttctaccgttctggcgtgtgctgccaaatcgtattttttggtcacataaacttttttgccagcctgtttttctaatttttcgagcatttcgggagaataaattgctgcgtcaacgtaagggccttcgtccaattgttttttcttattattacctgaaaaaatagaaaaaaaatgtttttctaaagaaaacattaagctttttgataatttcaccttttgttaaagctcgagcaatttttagattgcattgattttttggtggacgacggatctttttccggtctattacaattgctttgttttgtacgggtctcatcattttcaaatatttcaaaaaatttttttgtcttttt

SEQ ID NO: 1112 - DNA, 3159 bp, Heterodera glycines
  misc_feature (3137)..(3137): n is a, c, g, or t
atgatggaggtgtgccgcggaatgtgttgttcattgtgtcaaggcgtctccttcgcgtttcgtcccattcgctttttgttggcgacaccgatcgagaataatccgggctcaattctcgcgcattgattttgatctgcttcttcttcttcacctcggcatcccattggtccaatcggcttctgatcgttgtgatggcattttgtatgcccaactcgcattctttgtatcttcgccatcccccataatcttcttcagtcaactgcttttcgctgtcgccggaggacttgcgtccaaacaatttattgaatgaaaggcctagaaaggtttatttaatttgtaattaattaataaaagtcaagaatccttggccgaggtatgaaaatatattaaaatgtattttaataggtaccaatttttgtaattaatcactgtagcccttttcccaattagtttttaaagttcattttaaaaagcccactaattcacttttctttgtttttcgcatctttgtattcggagaactgcttggacttgttgccgacgattttggcattgttggtgatgacggcgccgagctagcagcggaattggaccctcgcccatcattatacactggcggaccttgccaggaggaccttcttggtgaaattggtgaactgtttgaagtgcttggcatgaagtgcgtaattggcgaagatggtgccgttcttgcttctgatttaaatacacgagggttgttaggggaaggactttgccaggctcgtccaaagtcaaatgaaaaatcatcttggtcataatttgacgagctcggctctaatgggtcgtggtgatcagcagaattgaatatttgtttcatacgattttgtcctgatggctccgataaatttttgccacgcgcttaatgaaaattggttttatttgttttagatgtgtttttagtagagatcggaacgggctcgcttttgccaagcaatgttaaaatgagaggtatttttgagaatttttttttaaatatttcattgagaatttgttgagtttgagaaaaaagcctatctcaataccaacgaacccgtcccggcctctggtttttaggtgtagaattgaaatattccaagtaaaaataatcaaaaagcttaaaaatatttggcttacggaaaaaagatttggcgaaaaaaatttacttttataaaaaaaataaaaaattccattaaacctctttttcttttgtcttgcaaattttccaattcttttgagtttggtgaaggcttaaaattttgttcaatgattcgttcttcgtttcttggaatgcttaatctaaatgtgggtataatttaataaaattgttttatgaatttcaaaaattgaccttgaatttcggtcataatcagacaatatttcatgaatttcatcatcgcttatttctaaattaaattcgcaaaatcaaaatgttatttttttagtttttttaccagcgccaatttctctataaatttcttcgtcataaaatgaatgatgcgcttcgtcgcctcttattcttcaaaattaaaatttttaataggtatttttattttatcttttatcattttatttaaaaattttggaaattgataataaaaatgtattttttaaaaacgaattcctatcgcattttagttggcccaaaatgaatgaaagattataaaaaaaattaaaaaaattaattaagcaaagattttgaggcttcccttgtctaaataaagtcaattttttttatgaacaatttgggtatttttggatttgtcttgataaacggcttaatcaaaattaaaattttttttaaatttacctgatatttgcaagctttttgagtttgcccaagtcttcatcacttatccgagctgtgaaattaaaaatttatttttcttatcattttgtttgttaccttgattctcaattttataatcaattagttctcttgacttttcctttttcacaattagcctaaattttcgagagtttctcattatagaaataaatattattttttataattaaattaatcccattaattaccgtgggggtgtgtccttttttatcgttccaattaattcgtcaatttcttcatttgacaaatctaaataacttttagatgttttattattctgtatttatatttttaactttgagttgatgaatcacttttgcacattttgcctttcatcttcttgtcctcattttctctctgacttgattcttaaaaatattttatcatttatttctaaacttttttataaatttttcattgttttttatttatttttcgaatttttttatatttttaccattttcttctcgaaataattgtgccaatgtccttcgggggcttttcgacggcgacgacacatttgatgttctgcatgagttaatttcgccactttcagcgattaaattgatcagcgtttgatacacaaaaataattaaaggaaaaaattttacatttgcgatcattctgataaaaatactgaaaaaattattttcattaactatattaatgaattaattttttaataaaaatagtcaggaccataattgtggaaaagcctgacatgaacttatttttaggtacaaataacacgcaatataggcaaatgaacaggaacaaaaaatctcaaaaagacattaaatggacaatcaaactaggcttgaaaaaatttaaaagaggtaaataagtttttttaagtttatgagattttgaaaatcataaatttaggctgggaatttaaattgacaatttggtaattaggcaaaaaaaaaaaagaaaaaatagcaaaataggcattataatagttatcctataaaccccataccaagctaaaattgcgttttttatatttatttcaatgtattaagtaatcgcagcaaagaattaagacatttgcccaaatctcgttattgatgatttaataaaacaaatatgaaaattttttttaagatggttaattgcataagcaaaaacgcgattaatgttggtggaaataatattaaatgcttttgttaatcacatgtatttaatttgataaaataataataatattttttaattttacgagcgattaatttattaattaaaaataaattgtcattatatttgttcacanaaattacagaccataaataaag

SEQ ID NO: 1113 - DNA, 8008 bp, Heterodera glycines
  misc_feature (32)..(32): n is a, c, g, or t
aattagaaaattatttttgttttgcaatattnaattcgttgtcagcgacgctaagaacggcgccaccttctaatttttgtgaagagtcggaagcttaaaaaatatttatttattttttaattttcatatttttacgtggctttgcttccacatttgcatcccattcaattcctgctccagccaaattatcataatcttgctcatgttctgctggagtttcggttgttgtagaagtcttcaaaaataatttaataaatctcattaattgctcgagaatgcctaattcgtggaaaaaaattccaaattatgcgcgcactcacagttttcatcgtaatcctcgtcgtttttggcatcgtttttgttgtcaattttttggcagttgtccgtcgtgttgatgccgcaatctgtgcaacagttggcacttgctcatacaaatcccgtggatcaaatgcggctgaacgttgcaacacttgcacattgttctccaaaatagtgcgcacattttctttgaaatcaacctttagaaaaaaataataattaaaaatataaaattataaatggcataatattgaaaatattataaaatataggaatcttgttaacataaaaaatataaagtatatttaatcaaaaatatattttttattattaaattttttttttttgatttgtttaaagaaatttaatttagtgagattaaaataattttttttgtagtttatattggataaaagcaatataaataaagcatttttaataaatagggtttaccttttttaattgacctccgttatgtggaaaatatgccattctcttaagaacatttgagcacccgataacccatttttcactcgaatttgtccgatatcgcgcaatttgccaatccaaatattcaacggctttttctgggttttttattgtgtcagatatcggcacaaactcaaatctaaaaaaagatttattataataatttatgatatcttttaaatattaacatgggcttttgataaaacttaagggtttttttcaaaattggaaaaaatacaaatatttgcaataaattttatattatgaataggcagctaatgtaaaaacataatttacaaagcaaaaaatttattaaaatacttgacatagcaatattatcgaatatatttttcttgtccatgattcttagcgaaaatttaatatactctttttcacaacaaaacagacaaaaaggattttggcattatctataaaaaatttaaaaccaaaagtaaaaattaatgaatttcacaaaataaaaagtattaagaatattggaatattttcaaattaaagtaaaagacgttatttgaatagctaaaaaagcaattttgttatatttgatttgtaaacgaagttattttaattatcaaaaaatattagaataaggacaattttaaatgaaactttctgtcatcaattttttaaaaagttttcagtttttagggtgtttttctgaatttttagggtcgattcttggggttttacttctttttttaaggaattttccgaaaatcccataaataggcacccaaaatagcgaaatgtgcaaaaaaaaaatgcgacaggtaaaaacttcgtttttgtctttttctgagcgtatcaagggcataaaaatagaatgttagatatttgcctagaaatataattcctaataattgtaaacatattttctatcattacggatttaacgtggcattccgtttgttggataaaacccggaaactgccacaaatttttacacttttattttgataagcatccgcaaatgtgccacagtattgtgtgccacgctcatcaaccccatccgaatacacactgccatacgcttcatgataatttttctcggagcttatcctaaaatgaaaaaaaggttaatttattattcaattaatttccatattttcattttttgaattatgaatattattatcataaataatatgctttggatttattataattttttttttttcaaaaaatttgtttgattgaggaattttcattagcatgttctcgaattttcctgatatagtaatttttttttgatttttggaatttttattaaataaaaattcagagataatttaaaaaataaataaataaaaatttaaaatatattttatttagaatttatttcaaaatatttctcctaccaatatccaatgtacatatgtttggaatttggaaaggtaataaattgctcattggatcttccaggctcaatgtgcccattccgataaattgttgtccaataatcagggattaactttaaataaaatagaattaatttgaaaaattaagaaacaaacccaaaatcctgttactgggcaaaagttaattatacaaattattattataaataaaatcataatattgctaaatcaataatttttattattaaattggttatgcaattaaatttaaaggataaaatatttttttcatttccctaaaatttatttaatgaagaaaatgctctttctaaccatcattgtaaaagacaaatagtaaacggcagaaaattgtgcaaatggctaattgtttgctttattaaattagtcgacggacttgattcatcatcgtcaatttatggacctcactaaccgtttttacgattttttatgtcctgataaaatatttttgtgtcgaaaacaatttatagcaaaaattgtttattattggaaaccatctgtttaatcaacaaatgtttttgtaatcaaaaattgtatgattaatttaattttattgtttgaagatttttaaggttatccataccaagaatctatgccttggaccaaaacttaaaaataccattttgaaaatcattattttataattaaaatatttatgtgacgtagaggagactcgaaccttaaccattaatataaaaagaaccgtaaaagaaatatttttcgaagcttttgcaaagcaattggacgcatttgaaaaaatgtcatagattgtaaaaatccaagaaaggatctttctttgtctaccgccggatggaatctgaaaccaatgttagacaaaaatgatagtgttaaaatttcaaaaaccaggtatactgtggtccggaaatatgataagaaaacttgcaaaattttcaaaaatactgaaaaaggcatgaaaaaaggcaccaaaaagttaaaaaaaaattctttttttctcgaaggaaatttaaaataaaccaattaaaggaaacattaatttttattactaataagaatatacaaatatacggcttaaaaatgtttaataaatattcggtcaatatattctaaagtttgtttgactggttcaaattttgcccagaaaacaatttgtaatttcttgccgataatattcggtaagctgttccgcatttaaaaacaccgattcggtcagatggactaattcggcatgacgaaatgcccccgccatgttgccgcagttggtgcacaaatggtgcatcaacagattggagtaatgttcggacaaatgttgcaaagtgcgacgaccagcagcagagagaccagcagtaactgctgaacaattagaacattgtcacgatttattgtaaaaataacccaaaatttgtcaaaaaaaactaatttttattttgtaattcgttttcaattatttaattgttgcctgaatttgacgatgtcaatgcgcagaccaaaaaaaattcttcctccgaaagttgtaatctgaatttaaaaataaaatatgaaaaaatgatttagagagaattatttttaaatttaacaaaatcatacataaaaaaattataaaaataaggaaaattataaaaattgtttacgttttaacagtggccgcatggaataatgggttaaatttgttgttatttgtgataatttctgagttcgtttttaatggattaaaacgggcattcattgcaatcaaaggaattgtaacaaaactcaaaagaatcacctaaaaggtaaaaaataaattttaaatttaattaaattattaaatgttaaagcataattggaattttacttgatcagttggctctaacatttcgaagtgtggcattgtacgcaacagctgaatcactgatccaatttctgaaaacaatgggtttttagtttttaccagatgattaatggatgtaccagagaatccatcagccttaaactcctagaataaaagtaaatttccaaattttttctaatttaacaaataatttctgcgtgaaaggaagttaaattcatgttttttcttaaaagtaggttaaataattgttatattaaatttactattcgattaaaaaatagtgataatgctaaagtgccaaccctaatcatttcaaaaacatattccgttactttttttaataaaaaattgaccgaaatgccaaataatttagccactgtctatgaactgaccttgttttatcttttcaaattggccattttcattttcatcttcatcatttacatttgcgccgctttcctaaaatgatttaaaaattgaagaagttactgtatttgtgtaagaaattaccgtttccatgtgacaatttttttcttctttctccttcagctgctgttgaagaaattcacggctttgtaaagcgattggatgaattggcttagttcctcactttgttcagcttccaccagagttgggtccatgccttccaacaaacacttgtcaagacggcacgagcgacaggtctttatttcttatttcgaattttaatttttattaaactttttatttttaattaaaattatatttacatatgtgaaaaagctacctttatttatggggcataaatttgatttcggacaaatgaatgttctctgagcaacgattgtacgacgaaaaaattgcttacaagctaaaaaaataataatttaatttctctaattaattgctttaaaaataattatgtaatttgttctattagggcaataaacttttcattttgtttatgtttttggcttaccatcacagctctgtattttgtaatacttgaaaagtgtagccctttcacaaattttgcattcttgcgcagtttttggactctttttgtatttcttttttacttgtttaattttcccattttccatttcattgctttcggaagaattcattttaattttatgaattaaaaaataataaatgtcaattttttatgttattaatggtttgtatctctctatcgtctttaatgtttgtaatggttttggtctttttctgcttttaattttggtatggatcatttatacaaaaattgaataactaaaaacataaaatcaggacatttatttttcaattagaaagactcgggcaattaagaacgtaaagaaaaaagagatccagaccatattatggtaaaaaattcatttatgttttaagttttaatttataaattatttattattttatctatttttatttgatattttgctttatttttagtcattttatgaagtttttcggatccaagttggaatgaatgaccaatttgtccaaattccgtctttcaggcatcttggacatgtcgtagtgagtaaggttgttgatcggtctgcagcaacccctttgctttggtgaatgctttttcaatttgtatttaaatattttggcatttttgataaatatctttccgttccttactaatcatatggtcaggtcattcgaaaactttaaatgtttagaagttatttctaaactattgactgccattagacaatgacaattattaaagagttgtaatcgaaaattgcaaaaagtcaaaatttttgaaatttttcttaataattttttttacagctcagaaaatctttttgatttttgtaaggcgaatagagcatgtgaagtttcgaatgataccaagaatgttagatttgagcgagaaagaaaaaagttagaacccaaaaactcgggctggcgcaaaaacgattgcgcgaaaatctggtccaaatttttgcatggttttaggtcagctttgaaatcttagggagaattttgtgggccggcatcgctgacatgaacaatttttcggatttttaatgaattttgttaagaaaaaggcttttgctggagaaaaaaaaaatttaaaaaatagcatccgtcaagctttgctttggcaattatgatcgcatcatgccttttcattctgttttgattggactgctcagaaattgtgttgaagtgatttgagaaagattgcaaaggcgttttttggaaatgataaaacttttttcatcttggcttttttgtttatttttgtataattagtttaaaataatatttttgccggtttttcactattaaaaacattagcgtcggtaagagcaatgaaagtgacgcaacaaaaaattttaaaaaaagtattttaatataaaaaggatccggaaagaataatagtctaacttaaataatcaatcttataaattaatatttaaccagaattattattttttattcaaaaataccatatttttgataattctaaaaacagctaagaaaaattgtaaaactaaaactatttagtgaaactccgtttttggttgtgccattgaaaactaattgtttgactttgatttgcttcacttgtacattctgtttcaaaattacagacccagggaaattttgtgtttcatctggcttggaatagggaaatttttttacaaacttttagaggtctggacggagtatggagtatatgtctaagatgcttccccgaagatcaaaaaaactatatgccatatttgaatttcaaattttataatattatccacttttgaagctcggcgccaatatttgggttttgaaatagcatcttattttataactttgaccaaatttaatattttgggattttaaatgaaaaaataaatgtataatgaaatttgaccctttaaattgaagttaacattcaaaaattacacaactgattgaaaaatattcaattagaattttatccaaaaaaattcttcaaaatatctgtttttttctgaaatttccggcgaccatttaaaaacgacgatgattttctccttaattgaaaaaattctgtctatcattcaataatttagtgtaataacttacgcagtttcaattgccttttccaatcataaatttccttccgtttcatgccaaaacctctagcaacattttcttcaatttgagttaatgtttcgctatttttatgtttcgatttatcgttttttatatgttgatattttttcttttttaaagcattgaaacgatttattatatcgcgcttccgtttataatctttgtcatcatcatcatcatcatcatctaattgttctgtttttcatataaaaagtgttaaaaaaaattccaaaatcatttattgtcaaaatttttttcttatttatcactcattttaatctttttagtatattgtagtgctgttcgagactctcggtctcgagtctcgactcgagaaaagtctcgggtttttttggtctcggtctcgagtctcggtctcgggtttttaagtctcggtctcgattttcgagactcgagaccgagacttttttacacccctaatgattggctttttgcaaatttaaaattaatatatttttggtaattttttgcttcattttgtttgctcgtaggtgtggtccggtgggttgttctcctggttatgttcttcattttagcgttggatcagttcccctccaagtaaatgttttttcttctaatttttcaaaattattcctttttcgataggaattcaatcaaaattttaacatttaaaatcataaaatattgtcatttttggactaaatctattaacaaagtgcactaaaatttcaagattttccccagcggcgcctatcggtaccgccggcacccaaaacggtattttttttaaaaaattggctaaaaaccgcaaaggtttggacattttttggacagaatcttaaaaattgcactcaaattttaaaatttttccccggcggcgactatcggcaccgcc

SEQ ID NO: 1114 - DNA, 1177 bp, Heterodera glycines
  misc_feature (1110)..(1110): n is a, c, g, or t
  misc_feature (1121)..(1121): n is a, c, g, or t
  misc_feature (1165)..(1165): n is a, c, g, or t
tggatttggcaaattaatgctggcaaatgggccatttatattagcaacaattgcacgaaatcattttcatgtgctatttcaatgccttacttcaaatatttatttaaaattaaattttcaattcctttttttttacaaaaattacattcaaaaaataattctgctcggtgttaatttgtataatgaaaaaagaggcgttaattcattgaatggcatccaaatattttgctaattttttctggtttttttagatgtttttgcttaaattatcaatactttttgcacattatttcattaatgtgcaattagccgaggaacaaaaatgtggggaatattcaatcggagaacttgtaaaaagaactaaatacagatcatataaaaacaggaagcagccaaaggaggttaaaacaagcggaaatgatgactttagcggctcttttggagaggtaaatttgcgacaatgcccaagccccgaaatgatcaattagtcctaattagtacagaatccaatgtttcacattaaccgtcattagggatggttaaatttcactaattgccatgattggccaaatattgtccaatcagctttttcccttctctctgttcactttgtttgactttggttttcctaagatttcggttggatttatcgtctatgagaaccaaaagcaatgtgtggcggttaaattctttaaaaacgaaaaggacgaaaaggaaacggacgaaagcggcaatttgaaattgcacacgaaggcaatcgaagtggccaaacgcattacgaaatgcctggaggaaaaggaacgacggcatctgatcgaaatgatcgacgcgtaagcgaagagattgccacaaacttggacaaatgcttgatttttgcaaaacgaaaacaaattgaaaatggtgccatgccaactcggacaaaaggcaactcgtacaattttttaggttaagcctatgctttaggtttaggcttaggcttgctcgggcctaggcttaggcataggctttattttgtaaaatttgagttgctttttatacgagttgcctttgtacaacagtgtacgagttgccttttgtactagttgccatcgacccttgaaaatgatgtanaaattcttttnaaatgtgctttttcagtggctctgtgacggatggcacggacaanctgataataata

SEQ ID NO: 1115 - DNA, 2204 bp, Heterodera glycines
gactcgcagaataaaaatggcacaatatttgtcgatgacgcggtgttcacggagcaatactgtgccccggaatttgatggtgacaaccatttggtaaagaaataaaatggttacggtaatcaagttgaaattttattagatttctcgaaaatttgacatttggtcactcggaatgataattcatgaagcatttgttgacaagctccgccaggaaaacggcaaagaaacgttggaattggtaaagcatattttgggttttaataaaaaatatttcctttattcttatatcaattataaattggctcattttttaggaagatcgggagcgatttatgacagaaatgagaaatttgtacgactatgaaagcttcagcaaaagttacattatgaaaatgctgaacaagtcgtcaaatattacgtcaatcgaccaatttgacgccaaaacgtgggagaggaacaacaatttggtcgaaattgtgctcgaattttggcaacgatacccaaagacggcacttttggtgacggtaaaaattatcaaaaatgaatgtttttaagaaaatctttttacgtggttggccattcacaaaaagtgcaaatttggtcctttacaaaaaagtgcaaaaatcaaaaatctgttttttcctataattttttaatcgattttttaaattagataaataatattcttctaaaagtttttttgtatctcgtataaaaataaaaaaaattactaaatattaaataattgattactaaaattttaaagcttaaatggcgcctttaaattttacaaaataaagcctaagcataggcctaggcccaagcaatttagcttgagttgaagtggatacatttcaacataaatatttccatttttatatattttatttaagttcatttttacttttatcccatttgtaattacacttctatgtatataaaaaattcaaagtaatctggctaatgattttatttaattaggtaaattaaattatttttattcgagatccaagaaaaacttttagaagaatatgtattaagcatcaatttaattaaattttaacattaaaaaatcataggaaaaatcagacttttgattttgattttgtgaagcgtccaaattgcatttttgtgaaatgacctagaaccatcttttcagaatatgctgcacccgacttggcaacagcgactgacggccaaaggcattttggactttgtcgccggaaagtgttacctgcgcgagttcaaatgggcacgaaaggcaaaaaacttgcgcctttttaattactttaaatttggcgaattgaaacaaatgatagtgcgaaaacagcgaatggttcgagttcaattttggaagaaaaatcgaaagcaaatgcaagagaaatttgggaatttgaaaagaaaagtggccgaaataatggagcagcagcagaaggaaatggccgagataagcaaaatgagcacgaactgtgaaaacgaatgagtgagaagcaatattgggatcgcatttttaaacgcatttaaatttgcatttattgtaaaattgaactttttattttatttaaaaaggaactatttaaacgaatattaggtacaatagccaaatgataattagttggccatgttaaaatgcaaagtgccaaatacaacaacaaaatggattaaactacttagcatttctcaatttatggaatgtatctcaacaattagttgtaagcgaataaaagaaaagattaattctaggctaataaaaattatttgcaattaatttaatgagttaaaatgaaaagtgccgaattaaataaaaagttgaccaatgcgatttcggcattttcaaaaatgcaaaaaacagcaattagtgaatgccctttattcgtgtgggaaatgcgctggtgaacacaaattccgacaacaacttccacccaattatgatcatcttcagcttcgctttcgcgtcggtcctttgtctttcggttctcttctccctgcgcttgtcgcttatgctttcttggctgccgccatcttctttttgactgccaacacggaagagcggggcgggcacggacagtagccgctgtccttgccgggatgtcccggtgctccgggctgtccaggctggccagaggttccaggctggccgggctgaccgggcgcgccaagaggtccgggcggtccttggcctcctggctgtcctggatgacctt

SEQ ID NO: 1116 - DNA, 7018 bp, Heterodera glycines
aaaaaggagattttttttacaaaatatgtaaaagcagcaggagtctccttttgtcggcagtcctctatgttgtatttgataagaaataatggttttaatgacaattttcgttaagttttttcaaaataatcatgaaatttatgaaaaattttggcaccctcccatagcctgctagccttgcatttcatcatcagcatgctccccagaaaattctcttctccttcattagtgttatagaattgatgagcgtaaatatgttatacacatgtacatagtagccacattattactataattgcaataattaattaagtaataattatcaaaacgtggaaaggcggggaaaggcccgctgagcacgcccaaccgcagttgtaatgcgcctggttttcattttcgggacacgtttgtgcaatttgtttcaattaagggacgtttcaggaaaaaacaacaaccaaaaaacgaagttcgttccactgggccctctctttttttctccgctgccgacgccccaaaaatctgggcgggacaaatttttcgatggtttcgcgcaaagaaattaattaataaaaaataaaaatgaaaggcaaaatcaaacaagacaaaacggaaaattgaaatgacttacgaaggtgaaaaagaagggaaaaaggcaaaggaggagagaaatgggggaggggggacacgtcccccaggggggacaaacagcgcaaaggcacaaaagtgtacgaaaatgcccgagggcaaaatgggccatgcgacttaaggaaaatggggtgatagaagaaaaaagtggcaaaatattcacatataaaagggggcagcaattctcgactccaccaactcagcagcattcattctctcatctgctgaaaattaaacagcttttcttcagtctttccaaaatgtgccttttatttatcaaaaactgaaattaattaactaaaaaactttcaattttttcggcattttaaattcattagttccaatgaaatcccttccctatccccctcaaaaaattggttttgtcttttggaatttcaaatttttagcgctaaaatgcaagagactcacattgttctcgggattgcctcggtgtgctctctgttggctatcatcgccacagtcgtcactctgccatctctgtactcggagatgagccaaatgaacagcaaagtgcgcgacggagttgaggtactcagccggccgcactcagacaaaaaacacaccgaaatttgccaatttttccaggccttccgcgtcaacaccgactcggcctggactgacttgatggacgtgcaagtggtcgtgacgccgccgtcgaagccccgtgataaccccttcaactccatcttccgtgccaaacgtcaactgcccggacactgccagtgcgctggcctccaacagccaagctgtccccctggtccgcccggcccgtccggaccgcctggacagcccggacagcctggaggcgcaggacagcccggacagcctggacagcctggccaacccggtgggcattttttgactaaccctatgctaatcagccccttccattgcagctcctccttgcccgccccagaacatcccctgcccacgctgccctgctggcccgcccggccgccccggaggacagggaccgcccggacagcaaggagcccctggacaacctggtacgcccgctcaaggtggaggacctggaacgcctggcgcgcccggaccccaaggacagcctggacagcccggacgccccggagccgctggccaacccggacagcctggagcgaacggagttgtctcgtaagcactttaatcatggcttttaagttaaaacccggttccactcgttcagacgcccaattcctggcccgaagggaccgcctggagcgcctggccagaacggaaaccccggaggccaaggtcagccaggacagccaggaggccaaggaccgcccggacctcctggcgcgcccggtcagcccggccagcctggaaactctggccagcctggacagcccggagcaccgggacagcccggcaaggacagcggctactgtccgtgcccgccccgctcttccgtgttggcagtcaaaaagaagatggcggcagccaagaaagcataagcgacaagcgcagggagaagagaaccgaaagacaaaggaccgacgcgaaagcgaagctgaagatgatcataattgggtggaagttgttgtcggaatttgtgttcaccagcgcatttcccacacgaataaagggcattcactaattgctgttttttgcatttttgaaaatgccgaaatcgcattgtcaactttttatttaattcggcacttttcattttaactcgttaaattaattgcaaataatttttattagcctagaattaatcttttcttttattcgcttacaactaattgttgagataacattccataaattgagaaaatgctaagtagtttaatccattttgttgttgtatttggcactttgcattttaacatggtcaactaattatcatttggctattgtacctaatattcgttaaatagttcctttttaaataaaataaaaagttcaattttaaatgcaaatttaaaatgcgatttaattctttcttctctctcatcgttctgtaacatttggattcaattcataaattttaaaacctaaaagatttgggtactcattcggtttgggtcctatattttggtcaaattttttcaattttttttattattattatcagaattgcttcagaattgcttttaaatgacaaataaaagtgattatgtgtttattgggtacaattcagcgatttgtgaccacaaattaaaaaaaatatccggtcccccaaatcaaaaagaaaacagcaaacatccggaaaatacaaatgtaaaagaaacacaaattcctggaaagtacaaatggaaaacacataaaccgtgaaatacaaatgcaatcggaaaatagaaacacaaaagtaccacgaaatgcagtagaaaatagaaacgggatacacaaaaatgtagaaacggaaaaattgaaaaaaaaatcacgttgaaaatacaaaacacaaaacacccaggaaaaacacaaatgtaaaaaaacacaaaaaacatcaccaaggggcggacaaaattacgaactttccggaggaaaagcgaaagattccggattgtaacctgaaaagtaaaaattaaagaaaatcgaggtaaatactgtgctttttacagttctaaacgtattaatttctaatggatagttatcgaatttgttattcctttttttaaactgtaaaatgataataaaatttttaattaatcagtagttctaccaagaactgtttgaaaggtctgtttccataaaagataaattttgaaattaacaccaagatcattttatccagagatttgtctgttttgtcgaatttgcttttatctaattagcagcaataaaatatcatttcggcttacaaattagcacttttctttaattccactactcatttttggcaaaggcatttcattaaaaaaacaacaaaatgaaaaaaagtcatttgcgtgtgggtgcacgtgggtgtgtttacaaattagcaatattctgagagccacagagatccttttctcatcctccctttgcttttgcttgtccaaaccagcgatttccccgcgagggtttcggaaggaataattaatttttgtgtggttccgccgcgtcccacgtcccacccgtcgctgaagcaaactcaaagttcacgaagcgtccgtcacaatttgtcgctgtgttctcaagcgtaccattccgccgtcctatcactttccctccggcgcaatttgccccattcatctgctgctgctgctgctgctgctgatgttcccattccttttcattgtccgtccgtctgtctcccgctaatgatcggccaatgattgatcgggccaaaagaggttccgcttctccccccgcccccccaccgcttttccctcgcttcttcgcctccctttttaccttccttttcttctttccttctgcttactgatgctgtcaaaaagggtgtccaacgtggaaaatgggaacgactcgacccgacccgacaccccaacccaattcaattccatttccaatttttcttttcttttcgctttgccccccccccccccgctcccctcgcgcgacttccgttgtccattatttttatttattgtctttttggccacagaaacaataaaaatttctaacaacttttttgcgccatttattgtgaccccgtgggggccaaacaatgggaataatacgtggacggagcgggcgcagcagagtcgagcagcacaatcgggaacaaaaacaacagcagcagcagaagcaacgcccaccgccccccagcggaagacagaaaccgcaactgatcagcagcagaagaagtgcggccgttgacccgcaaaccccattattctcatcattctcctccgcctgtcccattccctccacaaattggccccatttttgttgcttttggtgtccaacaattggccaatatgttcagcctttgctgttggctccgcttctcacttctcccgccgctgattttgccgcttgtttttggcccggcattggccagcggtggtggcccaaattcttcgcagagacatccatcgcatcatcaacagcagcagctgcacagtgaaccgcttcaactccttcactcatcagctgaaacggtggtgaacatgagcagcactaacggacaacgggcggcagacgccgccacacttggcaaaagtgggccggaagggccgccccctggcaaatggttgggctgcgaagacgcgccggacgaatggcgaagacgaacctgcattaaagtaggacgaagcaagcacacatagaggagtgactcattcataaaaatcctattcaattctggcacaaaacgaaaattcagttgcgacagattgaccgcaaggcacggcaagcgttgacccgtcgcgtcaagcagatggtctcgccaccgtcgatgcccggctcgccggcgtggttgaagccactcccggtcccagtgaaccatcggggccaaatcgcgtcgcatccctttgagtgcatgacccttcgctgcctttgccccttcttcaaagtgattggattaaaacaaaaataggtaaatttaattcccaattcctccaagggcaaaatgcgtcgtgatggcctttgttatttgcccagcggaaagccgctttcgatggcctaccgtaaggagtaccgtatgctcagtgatgaggaacggcgccgtttccatgtcgcaatgaatgagctgaaacgccaaggcatttatcgctttttcggcactcagcaccgccgggtggccaccggtggggcccactcgggacccgcttttttgccgtggcaccgcgaatttgtgaagcgcttagagattgccctgcgtttgctcgacccgtcgctggcggtgccctattgggactcgggtggaaagcacaatttcaaaaattaaattaacaaaaaaaaaattgtttatttcccggcattaagtgatggacaattatttgccggacccgcgcgactcaatttttttctcgccaatgtttgccggcgacacggacccgaacggatatgtggtcaacggaccgtttgccttttggcgaacattggagggacgggcagccattctgaggtttaaaattggggcattaaaaaaacatttttaattggcaccatttaaaaacaaattaattaattttacaccgtttttagggatttgggaaaggacgcgcagcttttcaccgaaagacagctcttagcggtggcaaacgagcgcaacatttggaacgttctctcctacaccgtccccttccgcggctgtcccattccgacaaattttgacgcgttggaatattcgcacacaaacgttgtatgattttttaaaattatttttaaattattaaatgcaactttttttttagcatttttgggttggtggcgatttggccacgcccgaactgtcggcaaatgacccaatcttttacatggtaattaatcattttttgacaaaattttcacccaatttatttagcaccattcttttgtcgaccttatttttgaaatttggcgtcagatgcaacaatcgcggcaagaacaaaaaacaaaaatatttttaagtgtaattaatttattaattagtttttcatttttagttctgaaagagaaaacatttacaccgcaagtaattctattgtaatttttgaaaattagcttaagaaaaacagatttgaaaagctgtgccaatgaatttcatttctcccattcgctgatggcaccgttcaacacactgacaaacattgacggtcagtggaagcgaaattaatgagagagtccagcagaatttggggggaggaagggtcgtaggaattagcttggaaatgattcgaaaaatcgaaaatttaaaaaaaaaattattttcattaattacagaatattcgagttttattttatttattttttatcttgtaaattaaaaactctctgtttccaattaaaggtctttcaaatgcgtacactgatcagctgtaccgttatgccctgcggccggtgtgcactcgcaaaaggcccacctgcgactcgaggcatattagcccccctcacccattaatcaagactaattgccatctcaatttatttattttgggtatttattctgcgatctcgaccacggcgtgccccattgtgtgtcaaaggtcaaattgggcggcaattgccgcgggtttgagggcaaagatgcctgtttcaatgggctgtgtctgtttgggctgtgccaaccgggcccaaccccaccggcaagacaaattgcttaatttatttttaaatttcaatttgccgtttaacgaacctccgatttgctgcttccgtttagccatggagtccgccgtctcccacggcgccgccgcgtctccagccaatgtcttcgctgccgtcttcagctccctcccccagaagccttagacttttc

SEQ ID NO: 1117 - DNA, 2145 bp, Heterodera glycines
ggggaattgttggcccaaatttttaaaaaaagtaaactttttattagttttccaagcttaaaactttaaaaaatcccccaaagttttatcaatgtccactgtgaatattggttcctgtttaaaaggtcaatatttgcgattttgggctgcattttcaagaaaattaaaaaatgttggggcttcttagtacaaagttgaaaagcaattgctatgagacacaaactttcttcatgagggtaaatgagcgggccatttcccattaaaaggtcaatcggcgtgccatttctgcgaagcggcgtataaccgatcggatgagtgtcaggacagacatctcagctgcgagcaatgggcttcggacggcgagtgcggaggacaatcacagtgagagcagtcaattataattaataggataattaactttttatcttttttagtctctttttggaggaaaattgccgcgaaagttgcggactttgcgcactcaataaatttgacggttcttgctcaatgtttttgaacgcagctgcaaattttacgcacaacagatgagaacctttccatatttattgttatattgatttcaattttaattagcaataataaaatagactttattatccggatattaaaactaaaagcactaaaataatgttgcagaattaatggtaaataacaaacacaaaattgacataatttggcgacttttttttttttgcttttcataaccggttttttttgcgacgcgctttttcaaaaaaacttttgggaaatagaaaaggatgggcggtggtgccgttagacgccgctagaaaaatttttgaaaattgtgaaatttgttaacagaatttgcccaaaaaataaaatttttgcgcgagacaattttttagagaaattaggagtttttgggggccgacggtgccgatagaagccgccggaaagtttatgggattaactggtcaatatttcacataacacatgtaaaaagcataaaataattgtatttgtttttacgaattttttttatcatctcttcaacgcaaaatgcgttttttgagaaacatctccataaatgtatttttaaaaataatgctttttggccttttccatatatttggttcccactcagtggaagaaatagtaagaaatagtgtgtgtttggtgagagacactctctgctgctcgcttttcccattcgcttatagtcaattaattcctcacccgagggtcgtggcgggcccttgtggcccagcgagtagggggcgaaggcggacgaggggcgggcgtgcgccgagtggccgcaagggagcaggcaaaatctcccgcgcggtcacagtggctccgaccgcacacgagagcatcgccatccaaacgcccaccgccaagctttttgccgcgctaaaaatgtgggcagtgaaaacaatcagatgaatttatcaattggcattctcaattcatttcctcaatgtgaccgccttttccgtttcatcatctaaccccggctgttactgttcaaaaactgtttgatttcgctttctgtccaatgcttttatctgcttctaaaataaaaattttaattccgtccaactacttatttattggctttttttttaccaatttgtcttccaacattttcgtcacacgttcttcacattcggccattttttgtggaataagtcaaatttattttgattttctggttcgggcgtgaaaaacagatggaaagtgaaaacgcaattaaacttgggtgcagggatgcgcgacttttttgactgagcgactttatttaaattatttaaatttatttaaatttaattttaaattattttaaacgtcttaaaggtcaaagatgttgaatttaaaatcatttaaaattcatcaaaaattccccgcaccgagcggatccgagaactccagagggggcggccagactgacgcactaaccactcggccacattggcaacggatgacaaacattaatttgctctcataaagggaaaaaatgacgtcaccggcagggaaaggggggcgagagcaggcagcagcgagtggcagtgggggcgagagtaggcagcagcgagtggcaggggggcgagagtctggcgagagtgcaatgcaacgagaaaaatggcgagaaattgctcggca

SEQ ID NO: 1118 - DNA, 2181 bp, Heterodera glycines
  misc_feature (44)..(44): n is a, c, g, or t
  misc_feature (46)..(46): n is a, c, g, or t
aagctaaaattaaaaaatgcatataaattaaaaaaatatctggntntattaaagggtgaaccgtgccagagtcgaacagctatgccgacccttttaaacgaatactgtttaccaaactaaaagtgcaatgctgctatccgattcggttttaccgattaattgcaaattttctaaaaatggcctcgaatttaaaaaaaattatctcgttaatgggtaaatcgtgccagagtcgaacagagctatgccgatccttttaaatgaatattgtattaccaaactataagagcaatgcagaaattcgattcaatttttacccagttattttaaaattaaaattaattatttttttgtcatttaatttgtgtaaatctttaagatgtaaccaatttaacccaattctttaatccatatttgttttgaacattataatggtaaatttttaagctaaaattaaaaatggctaagaatttaaaaaaaattatttcgtttattaaacggtaaatgtgccagagtcgtaccaagcaatgccgacccttttaaatgaatactgtattaccaaactataagagcaatgcagaaattcgattcaatttttaccgagttattttaaaattaaaattaattatttttttgtcatttaatttgtgtaaatctttaagatgtaaccaatttaacccaattctttaatccatatttgttttgaacattataatggtaaatttttaagctaaaattaaaaatggctaagaatttaaaaaaaattatttcgtttattaaacggtaaatgtgccagagtcgtaccaagcaatgccgacccttttaaatgaatactgtattaccaaattaaaagaccaatgcagctatctaatttggtttttaccgattaattgcgaattttcaagttaaaatttttttacatttaacttatgtaaatttttcaaatgtaaccaatcctagccgaattctttagtcaatatcttttttgggtacattgttaagctaaaattaaaaaatgcatataaattaaaaaaataatctggtttattaaagggtaaatcgtgccagagtcgaacagagctatgccgacccttttaaacgaatactgttttaccaaactaaaagtgcaatgctgctatccgattcggtttttaccgattaattgcaaattttctaaaaatggcctcgaatttaaaaaaaattatctcgttaatgggtaaatcgtgccagagtcgaacagagctatgccgatccttttaaatgaatattgtattaccaaactataagagcaatgcagaaattcgattcaatttttaccgagttattttaaaattaaaattaattatttttttgttatttaatttgtgtaaatctttaagatgtaaccaatttaacccaattctttaatccatatttgttttgaacattataatggtaaatttttaagctaaaattaaaaatggcttagaatttaaaaaaaattatttcgtttattaaacggtaaatgtgccagagtcgtaccaagcaatgccgacccttttaaatgaatactgtattaccaaattaaaagaccaatgcagctatctaatttggtttttaccgattaattgcgaattttcaagttaaaatttttttacatttaacttatgtaaatttttcaaatgtaaccaatcctagccgaattctttagtcaatatcttttttgggtacattgttaagctaaaattaaaaaatgcatataaattaaaaaaataatctggtttattaaagggtgaaccgtgccagagtcgaacagctatgccgacccttttaaacgaatactgttttaccaaactaaaagtgcaatgctgctatccgattcggtttttaccgattaattgcaaattttctaaaaatggcctcgaatttaaaaaaaattatctcgttaatgggtaaatcgtgccagagtcgaacagagctatgccgatccttttaaatgaatattgtattaccaaactataagagcaatgcagaaattcgattcaatttttaccgagttattttaaaattaaaattaattatttttttgtcatttaatttgtgtaaatctttaagatgtaaccaatttaacccaattctttaatccatatttgttttgaacattataatggtaaatttttaagctaaaattaaaaatggcttaga

SEQ ID NO: 1119 - DNA, 8955 bp, Heterodera glycines
caatcagttccttgtgtacaccttgtgaacgaagagtacgaaaatcagcctgttgttgtagaaggaacacttgatctgataggcgatctgttcttttcaacatgttatcccaagaagagacaggggatcgattggtaaaaattttaattattatttaaatgttgatttaattctttttatttattcaggagcgaacctctgtatgcggaattgaaggatctgatggtttgtccgggcgatttgcggaaatgtctgtcacacttcggacatcggaaggatcagcgcaacttggtcgtcgacgagctggattggcacgacgacgacgacgacgacgacgacataacagaaggagcttggtgaaagagctatgcttgtttaataaatgtcgaccggaatatctcgcgatgatgcttcgaagaaggaagaaggaaaatatcaaatttataggcgatcggaaaatcgaaactgtacatcttcgacagaatttacaaatttatccggaatcatttactctttttggtgctaatcgtatgtacgcctatcgtggtatgcttggtgtcacggtagagcaacatttatacgctaagcatcgtgtccgtctaaaatttcccaacctcccatgtgttgtacaagatggcggcaacggccatcaaagttatttcccacttgaacttttgaaaatatcttcgttagctatgcaagatgaaactgcttaattatttgttgtattttttaatggctgcaattataaagaaattaaatagtaaactgaaaattttatacattcaaaaagatcattcatatccaaacggtaaaacctcaagggtttgattaataatgcctttctgacagacaggtaaatattttttattttgtttcctagttataattcgattatcttttgtcggctgtattttattataattgaagactactgcattctcctgctcatcctctttcccgtagttgatcactttgcgtacaaaatgctcaaactgaagctcctgagaattgttgacgtcgaatgtaatgcctcgaatcttttgcacaaatttaactgcttttgtctgtttatgcaccattttcattgcatattgtttcgctccgccacatgcaaaagttaaaatgtcgtaatcggcgtattcttcgctcatttgacccaaatactcgcccgtgtgaactggaacaaggtctcgcttatgccgaacaattacactgtctgtgtcagtgtatagtaactcggtgcccggtgtattataacattgcagcatatagtcaagcagtttcagcctagctcgactcgttgtccaaaggcttaggacaatattgcttgatgtatgttctacgatgaagtttttcttcggcttatacagcactcgaatagctgcatcggatatggggattattgacgatatttccttaatttttaaaaataactcaatatatgtagaaaaaacctaaccattctatggtttagcactagatcataaaactcctgcggtctcgttatcactttgttcgagccaagctgatttctcatgctgaattttcccctaaaaaatataaactaaaatgccaaacaaaaattttttaaactgaccatagactattaagcattaattttgcgatgaatcgtagtcctggattctttttaatactcccaaattctaaatcaactccgtatatgcgccggtactcgcggatatattgatgcttttcttctaacgtttccacgccatctggaaatccgcttgattccacctgtgaaaataattttgaataaaatatttgttgaatgacggaccttaagcctgatgaattggcgaacatatcctttgaacacctgatcactccattcatcataatgccatgctctccaaaatcgatcgatgacgtagcccatttccaacgctttttccaattcaatatgagtgaaatttccagtgaaggctctctgctgttccgaatgttcgcatttgtgtgcacagcgtgtcacacttttacgaaacaaagccgcacatcgatggcaacagctgaacagcagtctctcatcaattttcatcggtagaactggtattcgtagaccacgaggagggatgacacgaactcgataaagaccctggtaacttagatgttcaggtttggtccagttgactatcatctcctccgcgctaggacgaataattgtaggaacaccaattggataagccgtgtcgtagttgacccatgggtatagtgagacaatgtcgaatacggaaattttttcatccgcggacgcttcagcaaaaagtcgtaatggacccgttcgtccaccgcaatatgcaagtctagggtctaaagggccacgttcgtttgccaagtcatcgaaaaacactttcatctcgtggtttttcttcagctggtcgtttatttcgcattcccatatttcttcaacctgtagactgcgcccatccgtgtcaggctcgcgaagttgacgaagtcggtcttgcgtcatttcattcagctcttgacacgtcttttcgtcaacgagctgctcgtcaggtttgaaacatcgatcacacccgtgccaatagcagccgatcacttcaatgcatcgttgctgactttcaatccacccgtcaagtttaaattttttccattgtttttcccgtccgttgcccgcatgttgtatatcaatcccttcgctttttgctctccaatccaaatatttgatcgcaattacgctggctctatcgttacgttcatatccaagttcggggaccattgctagctgatcctcttgcataaattgtgccttgaagatgttcatacaggcactgtaaattaacggaatataaatacaaatgttgtgtatgattgattaacctggctattgtacaacttatcggtagaacatcaaacccttgggtgattttattaattaaaatatggcgaaatttcaccaaggctttgagcaaaatttcggtgtcgttatgacaataggttcggagttgttcaggcaagaaaaaaggagtgtcttcattttcgctgtaccattttttaaacttttcatatttgtccgccttcattgagccgggttcatacattttctgatcaggaagtttctccagtcgtatacaataattctccctcctgttgaacgcgtacgggaagaacggtttgtcttcgcagtcaaggttgaaagtcgtctttaaatcagcgagcggaatcggcataatcagacatgagtcacgccatattaacattgaatgctttggactatgtcgaacacgaaactcgtatatcttgagtccattcataacgacatcaggtcgcctaacggttttgcagatataatttagcgcaaaatggccatcaaatcttgaggcgttatgagcctaataatttataaaattttaaaaataattttttttcaccctaacccatatgtaggttttgtattgattgttccacgcccttaaaatccattcgacaaaagcggcaacaggttgctcatcgccatcagcttcactcctatttgaattttggtaatgaaaaataaatttactcaatttactcaaccattctttggttcgttcaaacgtcccattggtctggcaacaaatttcacaatctgtttctaactctgatgcgtcacagcaatcggtacaagtaatgcgtgctgaaagaaagttgaccacgtgtatacactgcccttcgtcctcaagtttttcaagtctcgtttcagtgtcccatacgatgatacgataggtctgttcttcttcaggcattttgatctttttaatgaaacagctcgcctttttgtcatgataaacctgaatatattatacacatttcctccgatttcagtcatttaaactttgcatcgtttgcagtagcttgtgtcacatttatgtctctgatctttatccgagcgataaatcctattacagagcgaacaccgtttatagagtttacatgataggccaagatgaccattatagcaaggcgacgaaaaaaagtaacggttacattctgaacagaaaatacgaacaccgtcctgtttcgggcacggatgtagaggcccaactaaaatatcggtcatttcaaaatgttcatgaaaaagcaaacctttagaacattgatgacatctactcctacaacttattgtatgtttagcatccacagtgtacgtacactcgcaatcaacacagtatttccggccaagtttgaagaaacagtgaatcttttttatcacatcatagtgattgttagagagaaaaagcgtgacgttaaaacgatgtccccctgctcctttccataagggacggggtaactcttctggccggtcttcaaataacactatacggtacattccaggaaaaacgctatcctgaagcacattcattaaattttcagcacaaaatattaaaattgtagacaaaaattacccagtattgctgaacaggtagcagatggtcaattccataagaatcttggccaataatgatgcctgagttcttcatcagatcttcaactacagattccattcgcccggtgtttgataatagacggttatacgcttcataatccttgcaaaagtctgttctattctttatagctgcaaaaagtggagcttggttatctggtggactgcgactggagcgaaaaatttcataatcatgataagctcggcctgcagcaagagcataaaacaaacaatagttgtctttgttgaatatacggatcatttgcgtttgattgtagccccaattctgatgcggaaaaaatcgtggtgctgatcctgccggaatagttaaacatgtaacgacgatctccactggctcgctgagtagcaaagtttttttgttaactcctccttcatctccctcgctttggcccagtttgtccatctcggccattacaacgtcaatattgttttgtgctggaggcctcaaaggcagcactaccggatcagttaatccttttccagccaccattattcctaattttgaaacagtgcgtccgttttgcttttccgcattttgtacagctctattgacgagttggtgtaacgcatgacggagcgcttcatccggctgttcatgttgagcattaagcacaaattcagtgacatggcgttgcacagagaaacgctccatattgtgtatatgattggtgatttctacgtataacggattctgttcctgtcctacatcggcatttgttgataaactgtgttggcccgtgcctgtttgacggttgccaactgttgaatgttgtgttggcacattttcttccatttgggactcggtcggatattgttcaaaataggccattgatcggaaattccatttcggctgattgggatgcggctgactctgtccgcagctgttttccgtaattttcgctttttttctttcagaagccatgtcgctgaatatattagttacagaacatcggatttggtttaattctttgatgtattaacagggtaataataccctaaatagttgaagattgaagataacatttgttatatttatccggaatcatgatcgttagcattacatatgatcatttctacactaagattagacatcagcaggtcttctttgctttccaagcttaaacttgttattttccgacaggcttcatgacgatgctccttcggttttctgtttttcaccgtcatcatcagcgtatgcatcagtagttggtacaaatacggatgaaatgacccaatcatattgtggcaagctgctggcttcacctccccaattggcgtctttttccttaatataatttatatgttgtaagtaagcgacaagataaatttagtcgtttataatatagagtataagtaataccttaataatagagcataattaattctttaataatagaacataattaataccttaataactattttggctacaatcttcttgcccacgaaggaatctaaaagcttagcaaacccttccccgtctccgtccagttccatcatccgcatttcgcttgctttgcggccgattagcttttgagaagtattggtgaacatcgttgtgttttggcggcactctttatccataatatcttgaagttcgagtcgcaaaagtatagcatccgttggatttttaacaacaagagcacagctcgaacatagtctctgatcggacagcttacggttgcataatagcccatttttagctacggttgggcaagcctaaggggtgacaatacagactgttgcccgttgcattacagagatgaactcacttcatacagtttatactgtaagttgagtatgtgagcttgtacaataaatgtaccagcccccgccgaattgtttaacgtctgtgacgtttttcggggtaaacaattgcccatcagcatcgcgtttgtatgtagattttatttggaagcgggaaagcatttttaatatgagtatatctatgattttacataaaaagttagaaattgtttagtttagcagggcgcagcgttgggcaaattcatgaaaaagacatacaacgcaaaataaaacacacaaaaaaagtgaaaaaatgtgaaccgaaaatgcaaaattggcccaatgtaaatttgccagagtgggttatatacggatatacataatgggcggaagcatagcttaagcctcggctttgtcctaagcgaaagtcggaaaaaatagctaaaccaaagctgggctaggcttatgcaaacgtctgggatatggtaaatatttgcgtgacattacgacatttaataattttttaatgtataagacttttcatgctttcatttaccaatgctaatttagcaaagttatgtatttattaccagtgaacggatttttaggttttcacctattttttacggatagcatatgctgagataagcgcaaaaatcccatttacttcgatcacttttcaattttgagcgactttttagcaactattgtcaactattttcgcttaataaattttttaacaactatttttggcttgtgaaatttttaaaaaactattttttcaactatttctgcttttcaacaaaaaattattatgaaaaatgcaattaaaaaaaacaaaaaatgcacctctgagaattgacgttaatttttttcaaaatacatccttttttttcaaaaaggcactcttaagaatcgacttttttccaattttggcaacttttttagcaactattttagccttttttgtttttggcaactattttggcagttttttatcaaatatttaggtacctatttcgcgatttttagcatctaaaaatccgtccctgtttattactgatcaaaacaaaacgacatactgggcactactgtattatcccatcgtccttatatttgttataataaatagagacgggaaaaaatacgcaaaaatagttttataaaaaagctgattttctaattcggggcagtgacataacgtataggttcgaaattttgaagaaaaaatacttttgcacaaggcctactcttctgcaaaatttcaaattttcgactggtattaaaattctgcatataaaatcgcatagccagaaaaatcccgcctgaaatacgtcatttttgtaaaatggtcttaaggctacagccaaaaattttcaaatttacccgaaaataaattttaaaaataagaattataaaaactaaatactacagagactttttttttgtttatgaatttatttgtattttatcaaacttgaaaccataaacaaaagattaacccaaaatttttaggaagctatttgatatataaatgaaaataatttcagcgtcaaaaagaggccaaatattctttcttgttatttaattgtatttatccaaataattaatctcaatcgttcagtgtacctgtcattgttgtgccaaattacattgatatgtgaaaacaacaatatttaagcgttctccttaagcaaaaccaaaaatgaattaagaatttttaataaattgcaatattatttcattgtaaatcatttaaattaacagaaaaatatagaaaaatggaatgaggtcaaaaatagatcaggaataaaaaagaccaattgttatttgatctcaatgtaaaaaaactgccgaaatataacataaaaggcaaaaaaaacccaatgattaatttatttttaaacaacagcaacaaattttcaatcacaaaatttttgctggaaaatatttgaaaaataattaataattttaatccatttttttggcaaaaaaaaacttgttatgaatttgtacagaatgccaaaaaaagactaatatgtcaattgatcttaatgtataaactgccgaaaatataaccgaaaatgcaaaaaaacccatgattaatttgttttttaagcaacagtaaattttttattttaaattattcacaaaatttttcaggaaaatagtgaaaaaataataattttattttaatatattttttgccaaaaaaaaacttgttatgaatttgtacaaaatgtcaaaaaaaagactaatatgtcaattgatcttgatgtataaactgccgaaaatataaccgaaaatgcaaaaaaacccatgattaatttggttttttaagcagcagtaaattttttattttaaattattcacaaaatttttcaggaaaatattgaaaaaataataattttattttaatatattttttgccaaaaaaaacttgttatgaattttaaagttatttaaaaactgattctttatgaattttaaagttatttaaaaactgattctttggatgtatttttcatgaatatacccaaatagaacataaaaatgtacaaaaatgtcaaaatatatgcaaccatttaaattatattatttaaatgtggaaagatccaatgaaaattagaaataattataaaatgaagagcagttgtacatgcactcccttttatatgggaaaagaagtgcaacacgataaatatttggactttgcgaaa

SEQ ID NO: 1120 - DNA, 3767 bp, Heterodera glycines
ggtcttgaataatccctaaaacttgtaataaatagaccaaattaatactgccaaatatttgaggctttattgaaaataatttataattggggttatgcatgcaattttgatggcacaatgtttaagaaatgctgagaaatgcaaaagaactgtatgttctacttataaaaaggttggcatctgtccatttacttttgaaattataattataattttaaaaataaattaaaatgtgaaattattttaagaaattcttattttctttccttttttttgattggaaaacaaatatgttaatcctaaattgtgtatctttttacggatgaaatgcgtgttttttgggcaattaaatgctagaattgcgaatgatcatttttttagggtaagctgacaattaatccgccatttcatctctcgtcaccaaaaagcgtgagttttttttgctgaaaaacagacatataatccgtcaaattgcgattttacttaaaaaaaatattttaaaaataaattaaaagtgaaagcattttaagatattcttattttctttacactcataaaaaactaaacttttttggctggaaaacaaatatcttaatcctaaattgtgtatcttttagcggaagaaatgtggtttttttttgggggcaatcaaatgttagaattgcgaatgatcattttttagggtaagctgacaattaatccaccatttcatcgctccccacaaaaaaagcgggagttttttttgctgaaaaaacagacatataatccgtcaaattgcgattttccttaaattcaactgaaaaaacgtctggcttttttgggcagatttggcgaccaggcacataaatggggctatttaaaggtatccaattcaagttgaaatcatttaacaaatgagggctaatcgacctgaaaaaaaagcggaaattcgtcgctgcgcctcctcaccccaaattggcgcagcaattcctgaaagggctgaacgtctttttaacagaatgttcgatgcccttggtggacaaggaagtcgccggaagcgaaaagcctcaactccccacccaaatctttttgatcacgcaccatataaccctttgggtgtgtttgtgttttttttgttgccagtatgccacacatttccggttttttttgggtgtggaattccgattatattatatcctagaaaattatttggtttcggaagtccgatttccgaatagttttcaccatcagtgttcctattttttaaatcagaaatcagtggcatgaaaacaaagatctccgatctttggaagggatataaaaatgatcgtcagaaaataaaaaataaatatactacggaaataggtaattggtgaaaaataataaaatatattaaatttttgatttgaaaaaatattttaattaatttgtatttgagttttttcgtttttaattattatgattttttctccaaatttaactcatacatttaatttaaaaattttttaagaagttttgcaaaacggattggtgccatcgactagcgccgccgcttgggttgggcacgaggaaattggtgataatttggatgattttccatcaaaaattaattttaaaaatataaaaatttaaaaaagataatttgaaaaaattttaaaactttttaaaaactgcctagttggacatcaaccgtcaagtggcgcgcgttattcgccaatatcacccaattattttgaaaaagaataacaacaatttgcggcaatattggcgtcgatgtgatcaatttaatatgtaatgtttcccaatttaatgtgataattagtattttaatatgtgattttttcaatttagtatggtattttagataacttaatgtttaataaacatggtaatggtgtcggtgattgattatatgcataggtaaatgatgtaaataaaattttgtttttacggcttctttaataatagggatacggttattaggcttaaaaattgttaaaatggcgtcagtaaaaatggagaataaccattaaaaccatcaaatttagagggcgtaaaacggtaaattcgaaaagtaaaaaataagccaattctttttgacatatataatttttaaaatcgaaaatataagagaaaagtagctcaacaaacatcaaattaaaaaaacttgtttttcgtatgtttctatttaattgactcattatataaatcggactttttatttatttttattatagccaaaaattataaaatatttgattgattgagaaatgataaaaaaaaatttttaaatatcatttcactggctcgaaaaaacatgggagagctcgaacggtgccgtgattgtcggaggcgcgggtctcggggcggccatttttttgaaaactgaaaattttataaaaatttttattttgttttttttttaattttgttaccgaaaacgatgaaaatggtcaacccgatcaaccagaaaaaaaaaatggcaaggacggaccagttgatcagcaataaactatggaaaatatttttttattattcattttattaaaattttttattttttacatacatttttttatcggaccaatggtggtcctcggctatgtccggccactgatctgttaagttgagatcgtaatcggccttgagacagatcagtggccggacataaccgatcggtttccaacatttggaaccggccgcggtacaattggcgcggcgagcatttgtgaccacttcccacttgtcctccgcgccaatagtagggaggaatagaagaaaagcgacggcgaaaaacaaataaaaaagagtgttgcacattttaggagtaaagattaggggcagaatgtggtgaaataagcggaaaaagggaaaaagtgcgaattaaaaaaagaaaaagccatttacaaagttattttataaatgaaaaaaaactttgaaatgcttcaaattttattaattgcttctaccggtcggccgatcaatgttagacgtgggaataatccgaacggaggaaaaatggcgcggcagaagggggattgaagtgattaaaacgatgatgaagaagagggggcaggggtccgggagagggggaggggtttccggggagaggggcaggggtccgatcatcgccgccgccttggggcaggatcgggaggaaaattatcggcacatatccaacatttgctccgatcatttcaaccgcctccgtggccgagtggttagagctcccgtttccaagggttcgagtcccccaccccgcggcgaatttaatttttattaaaattctcccgcatttaaataatttaaaaaactgcgcgagattcctgaggaggatggctaattggattaggtttgtggtaaagccctggacccctgcccctgtaacccattactactcttgtagcttaaaggttattgactcattaaataatttttggctgtcattattaaatatttcaaatttacataattgatcattcgtttgagtaaaaaatgaatgaattatatgaaaatattttaaaaagccattctttaatgtttaatgtgtcgcaatttggaacaatttctgtaaaaaattcttctgcaaatttttccatccgttgaagcaaattgtagccaaaattgctaatgatgcattccaatcggttgggcttttcagaaagatgctttaaggtcaaattttctttaatttcttttgtctcatatttgaacagatataaaatgatttgtcgccagactcgactatgataatcggatcagtgtccaaattagtaatggtcagccca

SEQ ID NO: 1121 - DNA, 1977 bp, Heterodera glycines
ctaaaaactaccaaaataattagtttttagtttctaaaatacccccccaaaatagttgctaaaaatgggtaaatagttgctaaaaactttcaatttagtgatgtaaaatgacaaaatttattcaaaaaagtaaaaaaattaggccaaatcattattgagctaaataatttttaaaatcacaattttttgtcaagaaataaatatttaaattttggagattgatttttgaaaaatttcatttattagggatgcatttttgaaaattttcgcgtcgattcttaagggtgtatattaaaaccgccacctctattacagcgcccttttgaccaataatgactgaaaaattttcaaaaaatttcagttttttaggtattttctcgattaataaaaatgaaactttttaaaaaattggaaatttatgccaaaaataatttcaacaatggaaaatttttgatattttactccaaaatcaatttttattttgtattttttcttcaaaatgcttttttaaaccatatttaactattttcgaaagcataaattgctaaaaataaaaaactttaagcccacaatgtctgccgctgcttccggctcattgttcaactcaagtgcttcatgggttgcttcatgcatgtccgatggacgatatttgcttaatgatccgatttgtatgaacaaatgcgtcaaaattgaatataatggaaaaaggtaagatttgtgtggcttatcgtcccagggctttctcgataatccgccaaaattgaggatttttctaaaatgaatgaaatttcccagactaatcgggagaatagaacgttatcgaattattctattaatttattttcgaaattttaaaaagtttatagatatataccgtattctttggcctctgcccgacttggttacatttttttcatttctaagtttgactgtgccaatcaacaatcaatgcccggaatgtgaagtgaaccatgtggatttgtcaaccgaagcatttttatggttggaaccagccggtggaacggttggagtggcgactggtaataacaattttaatatttcaattgcaatattcatttcaggtgccaccattacatatttggaatgtgcctaaagaaattgggttagaggaagaaatgcacaggcgatggaacagatgaaaaccgagcaaaaaatattaaaatgttaatactccttaaatttatttaaatgatacggaatattgggctgcactttaagttttatgcatataaatttgctaattcggttcagctttttcagttttgtttgaatttgtacattttgtttcacgtttataaagattaaggcaattaaattgacaagaccaagctcttttcgtaaccaattccaaaaaagtttaaccagtaataaaccttatataatttgcagttaaataattgctaaattaagaactcttttgcatgttcaacgcaattttttgtgttggattatcggtgcagtgccccgttaattttctaaaagatgtaaaatgatcagattcaattagccaagtcaccaaataactaatggtttcattcaaacaaaaagttaaatatgtaaaatatcaacttaaaattgagaaaaaaatttagtaaaaaaattgagagttcgcccagggaaaatttataaaaggaaaaatgaatctggatttttcaaaataacaagaataacaaaagtataaaaatctttataaaaattttgtatcaaaaacggaaacatgtcaaatcatcagctggcaatcattttcttttagttttcctccaatctttcaagcttatttaggcttgaatgtaaagtgccaacaatttttgttcacttgatggttttttcttgtgtgaatcggagaaaaccaaacggacctcaatttttgacaagtgaaaaaattataaaaaaaaattatttaaaaaactaaattttctaaatttataaaaaaaattaacttctagaattaaagga

SEQ ID NO: 1122 - DNA, 3728 bp, Heterodera glycines
agattttaatctagttgagggtattactacccttcaagaaaatgaaaaacaaaaaaggaatgccaaagtagacttctctccacttgagacagatagcctcgagcaagactacttatattaacttcacttcattttttcaatttaaaaaaatatatctattcaatttatccgcaaacgaaatttcggtccgtaaaagtcggtccgcaaatgtcgcactacgatagatccacaccagattttatatttactggtaatctttctatgaattcgttttacccaaagatatattgggcacaaaaaaaaaaacaaaatgtcatggctaatgtggactaattaaggaaattgtggaccgctgaatgccagggacgcggcgtctcacatctcggtacctcaatgagttcctcgaaaaagttgtaccctttgttagcgttcaggtccggataattgacacttttgcccattttgatttttgtgcaaaaagcggcaccctcgctgatgaaatggatgaaagcgcctgaatagagcgggttggaaagctccaatttgtcgctgtccacttgcagctcacacgcctcgttcagtgacaaagaggctcgcttatacaccataatttgactatcaatcctgaaaaatatgcaattccaaaagaacaaaactttagtataaatttagtaggcggagaattaagagggaagaattgggtagcacgtgaccgggaccaagctaggaattcccggtcttcagtaggttcaggcgtgactgaaaattggaagtggacaatccacattgaggacaatccgcagaggtggacgatcggacagggacaacccaacagtaaaatacacaaaaagataaattccgtccccaaatgggtgccttatcaagaaaaaacaaaaataggaaataaaaaaatggtgaatacagtctaaaacattgtttcgttgcaaattattttgaatttgccattttgtaagcgacggttgcacatttgttgaaaccatcaatttatttacctattttcagtctccttcggcaacgccattttcttatcgtttggtccagatcccggtatttaaaaatcccaggtaccgatcccgatagggtgaccggaaacgggaaaataaaactattatgattgaaagtttttagtggaaatcagtagaaaatccatccgaaaaattataattttgtgcaagatcataaaatttgcgaaattttcgctttaattgcaaggtttataaatttatgtctacggataccgtcgaatttcttgcgagattgcctctttgtctttggtcaaatgttcattttccgcatgatagtttggactcttctcagtcgatttgtcattgatcagatcactgattgcctttatatgctcgattttttcaataattttaatgtaaaaattttcaatggtaatttgaattcgtgtttgacatattttcagcgattttttctccttgctaaaaaacattaaaataggaataacatcaacaattaaattattcaacattttaaatttaaaaacttaaggaaagccgaaaataattttgcattaaaatgaaaatttcataaataatgaaaaaattttaaatttagctaaaggtgcatttaattaagaaaaaataaaggctaaatgtatatgtaaaaagtggtatgaactgcgcgaattccctaatttgtaagattacttgccaaatgcctcactgcttaaattatttaaaaattaaataaggacattattttgagatttgcaaggacagcctctgctgaattatgcatgcaaattattattacttacctcaacaaattttccaaactggcaattttcatctggtgcttgcccataaatggattggttgcactggcaacattttggccattttgttggagaaatattatatttaaggaccaaaatattgcgaaaatattcatcattttatatatttttattatatttttgagtgaatttgtatgaataccttggcaaaaggtaataaaataatttcttttcgcgattttacacgtataaatcaatatgtaattctaagcatttttacaaagaaaaataaatgcaaaaaaaaaaaaaaaaatttaatccggattttctttattgttaaatacaagtagtataaggctccaaaagattgcgggtagcaaagggaccccaccagctcggtggtgtgcgaaaaccaaaaaaataattttaaagcgggtgtggctttaggatgttaattttttttaaagtcttaaaataaaagttgcaatagacaccgccggaatattttcgctattgaatttttaccaaaaaattccaaaatgtttgctaaaaattccaaagtagtcaaaatacgaaataaaaattgttcggagaaaatgttatttttgggcttcctcgccataactaagccgcagaaaaatatgtaaaaacataaaaatccgaactctagtaaatatgaaacttaattttgatcttggacgacaaccaaatttgctcttgaataattaggaggtcatttgtagtgtctaccgtaacagtgataatttttcattattgcctcatcttacatacaatctgaatatgcaattgaatatttttttttgcaacttttaattactttgattataaaactctgcaagaattatgtattgatctattatatgtaaaaatcagcgcaaataaattaaattattacatttttgctttatagatatgtagcgtaaaacatgttttagtccctccattttgctaattgatttcatttaacgaatattaagcctttcctatttaatgctgatatccgtaataattaataaaataattaatgaaaattgtttaataatatttgaacttataattatgtattaattaatatttaataccagttttttctgtaatttaggcattaattaatattaaatgtattttaatttattaacaacaatatttaccatttctttttaaattttcattttgtcaaaatgcgatgcccggaaatattaattaaaaaatgctaaaatcatatgaatgttttcatcgattttgattcatttttcttttttttctcatataaaataataattaattaggcttaatattattttattattatttcataggttttgcaatttttcagtttgcaaaatttgtcgcaatgaatgttctgctaacattatttgttcttcatcaattttattcaactgcttattctattccgtttttgaaaagtaataaaaaggaataaaaaatattttttaataaacaaaagcattaaatcttatggaataagtataaagttgctttatgtgatccatcaacagggaggggcatttgggactttttgagtgtccgtaattaattaatcatcccgcccattaaaaaggcacttttatttggtgacaaaaaatattatcacttaattcaaatctcgagtcctcaactgtcgggattatccgcaaatttcggggaggcggttttaggcaaaagcggatttaccttcactgatggattcatccctccgaatttagaactctgttcatggtacaatgtgtgccgcttttctaataacccaattggcggggcacagcacattttgctggacaatgtgtacatggattattttctggcccattcatcagctgaacaatgtgcaaatgagtcaaaaattgcaattttcaccatatattgtatatgctaacatggaaagttgaacaaaaccaaaaag

SEQ ID NO: 1123 - DNA, 1916 bp, Heterodera glycines
agccagaactttacggtcttcagttgatggagccgaagtatttggcaaaaattcctgcaatggaattgatcggtttgctgcttttgccgctttctggtgttttccagttttttgatgatgagaaatggcagctttcccaatggaaaggaggttaatatcatcgttgcaaacgacacaaagggcaaattcttcgccttttcgactcttctttatgtgccggaattctttttcgtagctctccaaatagatatttttacgttttgggggcattttgggcatttaaaattaacgaatttacactaaagaaaaataaaaatgaaattttttacaaaaacgaattaattcaaatattcgcttcaataaaaaacaatatgtaattaaaaaaatattaaatttttgcatttttattttcaaatccatgaataagcacaaagcaaggaggtcgtgccaaaataaggacaaatcttacaaataaggacatttttaatttctaagatttggcacctccaaataaggacaaatcttacaaataaggacacttggccgccctgattaaaaccgataattttctttttactccataaattaatcattaaactatgatttattttcattcaatgggaacggagaagaagaaattttatatttaactgaagaaaaaaaaattttttttttgaacttgcgcaattttatttattatttttagttcgaaaaaatattatcggcgggccggggaaatttttatagattttgatgtgatttgttaacagattttgaccgaaaagctgcctttagcagaattttaaaagataaatttcttaaatccataaaaatttgtcttcatcttttttaataagtctgtcttattcccaaaaaattaagttacgatgttttacaataaggaaaaatgctaaaaacaagcaaagaatatatttttgtttcggtgatttttataattttttattcattgttgtctaccagactatctttagggtgtattttctcctgcggagatgggctgcggggatccccgttttcagtaataggaaaaacgaggaaaggggaccggcgggatgaaaatcacggggatccccggccccgccccccccccccccccggcttggaccttaatatataaattatatttttaaataggaacctccatctgttttctttgaaaatgggcccgaagatgcgcaactctttcgcgcattaacaatttgtacaaaagaaacgtttgaagaggaggaacaaaaaactaacaaaataaccagtggggaaaaaattggcgatgatttatttcacattgttaaaactcaaacgagttttttgcaatgcctttggaaaaatgtgcaaaaaaacgcccgaagggatgaaattttgccaaaattgcatttggaaaagattatggaccttttggagcaagaagaatgtgataacgccaaattgttatgcggtattagaaaaatgtttacagaacatagtaattgtttatttgtaaaattaaattaaaaaaatcaaatatatgataatatatttttgaaatcaatattaaaatcatttaaaatttattttgaatttattatgtattcaacaattttaattagattaatttattaccatttgaatatttaaatatttttctttatttttcatccaaaccttcttttatatgaatttttaatttaattaagacatttaaacattaaatttatttttttaagaggattcgctaaaaacaatattggatcccgaaggaattataaaaatggacgaaattttaaataaggttaacatttttagaaaattattgaactaatttataaatttaacattttagaattttgagtatttttccagcgtcgaaaattttacatcagaatcatccgatgatgaatattgtttttcggacgcaa

SEQ ID NO: 1124 - DNA, 2569 bp, Heterodera glycines
  misc_feature (1971)..(1971): n is a, c, g, or t
tcaaacgatgaagatttaaatttaaataccgatcagcaatattcactcaaaatgtgcaagcaatgaaaattgtggtggagcagcaaaaaattggtaaaataatccactatttgaaaatcatttataaaattaattgtttcttgctaagaaaaaaaattggcatttaaatttattttttacagagacttctttaatttctgctgaatatgctcaatacaatttgataagaacaaatccaacaaatcgtgagctcgattttaagcagtcggaagaagtaaaaataattatcttttctccttactctatttctctaatatgtataatttccgttttcaatttctttctttctctctttgccgtccttctcttattcacttctctctctctctctccctctctctttctctgaccttctttctctctctctctctctaacgttctttctttctcactcactcctctctcattcaaacactcactgtttctttctctctctctctctactcctctaacaactctctcactctctctttttcattttcattttttagattagcaatttaataaaaccattctgtgccaacgaaaacaaaataactctgatcaataaaatcaaaaagcaaatatattcaaatttaaagcaatgggtgaaaatagcgactaattttgaacgtacatttatttgtttaaacatataattaatattaatattttttattgacaataaaaattaaaaatttgaaaatgttacagatcccttgctgttaacaaacggttcccatatgatgaatgctgaattggacagctccgatttggatttgctgtgcattgtgcccgcacaaatcaatttgaacaattttttataccaacttaacattagtttcttttcaatgcttaaaaaagtaaattttttaattaaaattagagcttgggctttaggatttttagctcgtttcttttgtatatgggtcagggtaatttcgtttttactgcattttataaagaaatttttggaaaaatcaaaatttacttcgaaattattacttttgcaaaattttatcttaaaattatcatacaaaaaatcacttaagacccccgaaaatagcataacaacagaacttaaaagcaattctttcgtatattttagaccaagaagtcctaatgcgaaaatattagtgaaataaaaagaaaaacatcttgaataaattctatttaagtaattattttccattttataaattaaagttttatgaaattattgaatgttgcccaatttactgttcagaatttaacgaaagcaaaagttagcagtgtgtccggcagagtgccattgatacgaattgagcaaaaccaaattgaatttgatgttttgttcgttcctgtcccattacaatatttggtagaaggtgttaatttggaaagtgatcaactgatcagagaattgggcactgctgaggcgctttattcattggcaggtaaacacgctggaaaatattgtaaattttaatattcaaaccaattttaattaaaaatagttttagttaatttaaaatatgaatctttcctaagcttttatttttcatttcggttttgataattgcaaatgctccttttaataccaatgttttcggactttaattgaagattgcatttcgtaattttaatgaatcatttttataacttttaaggctacagatccggcaaatttcaattgtcacttgtcaaggacagagaaaccttttcacaatttttgagagccattaaactttgggctaaaagtgagcaaattttattgaaaaaattcataataataatttaagattaacattaatttttagatcgtttaatttattctggattatttggctattttaatggagcaactttgtcagttatggccactaaaatttgcgctttgtttccatttgcacccttggcttatttattgtaccaattcttcagcatttactncaattggtaattatagaaaaacattaataattatgcatataaagatttttacgaagttttaattaaaaattgcattacgaatcacttaacaaagtatattctaatatttttctgtatgtttaataaaaaaaattttccaaaattccctcttcttaataaaataattgtaatcattaaatatcaaggaattgggcatctgaacctgtaatgattgaaaaactgagtgaatttccgccacaaagcactctgaagccgccaaaaattgctgaaaattcaatgacagtgatcacgccaaggtttccagaacaaaatgcctcattcaatgtcaacaaatttaccattcggacaattgttgaagaaattggcatcggtaaaatttttattatttaaataattgtttaagaatttataatccttaaaattaaaaaaaaattggaataaaataagtaaataggtagcctctaaacgatattatttttttatatttagcgaataaaattttaactgaaaacccatcaaaatgggcacaaatatttgaagaaattaatttcatgaataaatttgcccattttgcgctgatttgggtgctcgacatcaa

SEQ ID NO: 1125 - DNA, 3017 bp, Heterodera glycines
  misc_feature (84)..(84): n is a, c, g, or t
atattttaggctctaaaactgccaaaataggtaggctttcggctctaaaaaacacctaaaataggcaataaaaagcctcaaatntagggggtagaaaatggcaaattttattaaacaaagcaacaaaattaagccaaatcagtactgagataaaataattcttaaaatgacatttattttcaccaatctgaattctgaacccaaatttaagaaaaaatcaaattcggaattaggcaatagtcaaaattggtttcagattcgttgtcagcgaccctgaaaacaccgagcaacttttcacaatcagacatcgtcttacaaaaaatttgtgtaaacaatagggcccccacttacagctttaaaaaaataacaggtgatttatcacttttgttatgaataggcggactcattctttcgtcggtttgtattagatacagataagaaggcttattttctttccgtttttttgttttcatgatttttttccaaatcctagtggaagttttttaaaccttacccattaattttcgataatttttcagtcgtgcttccttgtcttttggcgtttcgtacccccagccggtgtatgagggcgacaaagaattgccattgtttggatgtgtgacataatggtgtgtttgaaggcggatataattcacagtgccaactttgtcaccatgttccttggcaatggttgcactaatgacagtgaaaaaggcacagaataccatcaaaaaaagaatgccatggggacaatttcgattgtatttcatttttaaaattctaaaaattttaatatttttttctcatttaatgaaatttattttttgaaagtggtaaaaaatattaattcttatgacgtctaaacaatattaatactttatagctcgtccgtcaattgaattgattttaatgtctacaatatttaatgctgcgtcgtctcatctcgagaaattgaaataataaaaaacaaatttaccttaaccaagagtagatcagataaggagttccggtcggttttttcgataaaaaatagaaaaaggtcaaaatcgaaaaagaatgataatttttcttcgatttttcaatcgttttccttaaaagaaataattttatattatttgaaagtccagggagcacaattttaattgggaattttttaatgaaattaaaaaattaagtaaaattttcaaatggaaatgtattaaatcatttgcaataaaagtaaaaaagcggattttggggtgctgacatataaaggcggggtcagagtaatattacctggggcctattcaaattagcatcgtatcaacgatgcgatgatacgatgtgatggctcatcatagccccgatgcccgttcaaattaaaatcgtctcccgcatacgatttatcacaccaagtcatcacatgtacgttcaaattcatcgtatcatcgcatctacgatgcgatcgtcacatcgcacgtaaaatcgtctgcggcagacgattatttgtacgatatgtcgtatgtgcgttcaaattaaaacatttctacatacgacgagcccatcatacgatgagcctccctctatgaaaatcgtatgtagacatacatggaaggaaccagcgattttcctacatcgtatgtaggaaaaaaattcgtaaaaaattcgggagacttttaaataaataatatttgtatatttcttatagattaaagtctcagctattttttcatataaattttaaatttttagtaccaataaaagccagtcaaattattaaaaacataaaacattcaaaagaacgcatttttcctttaatttgaaaactaattaactgctgcttcttgtagtgactggttgttaatgccgctgatttacaaatcaaatattattaacagttttaaataattgaaaaactctccgaatcatttcatttcgaagcattggattttcaataattgggtgtaaatgggcaaaagatagtttatttgcattgcccgctgtcgatagaaaaaatttggaatatttctgctgctgagaatggtactaactgctgctgactatggcgttgaataaaaatatttgtttcatttccatcacatcatcacatttgagtatttcgtctcatattaacacttctttttaaacaaaaaacaaaacacaaaaagaaggatcagcagctaccttattaggtttgtataaattatttggagaaaataacagcgaatattaaaagtaagaaaataacagcgaatattaaaagtaattatttttattaaattttgtcgaatttaaaattattttaaaattgccaatggaaatatttttaagacataaaatgatttgtggtaaacatcgtattcattcatcgtatcatatcatcacatcttatccataaaattaatttgaacagccatacgatcgtatgatgagaacgtacgattggatcatcgtacgatctcatcgtatgatgagctgcaaacgacagctcatcatatgacgaaagtctttaatttgaacacgcatatgatcatcgtatcatcgcatcgttgatacgatgctaatttgaataggcccctgaaatccgggaaattttcgaaaaaaattcttaaggggcggagaaaatttttcatcgaagacgattatgattgacagaaagagcactaaattggtgtaccgacatttcgccaacttgacatctcgccaactgacatctcgccaactgacatttagccaactcagccaaaaacattcatttcgcctactaagccaaaatctgacatttcgccaactgacatttcgccaaatagttaaaaaaattaaagaaaaaaaactaaaaagagtaaaaaaaaatgctgtgttaatatcaaatacagccctattccagtttacacgtccaatcagagtgaccatcatcatttcttatgtcctaacttttttcatatttgttcgttccaaccatttttggatcaatcaaagcttaagaattcctttcacttttttataatttcgtttctagcgtaattcagattctagca

SEQ ID NO: 1126 - DNA, 3295 bp, Heterodera glycines
tagcttctcaatttggacccagtacatctcatctagtacacggtagcgcatgatcagaggatcggattcgtgatcagcgaccctaaaagcgccttaaacatgttttcgttaatttcaaaaacacatttacagtcatcgggaagtgtatgtgaaaaatagcctgtaaactcttagaaaagtaccatattgccttaagaatgtgagcatcgataaaagtataaaaaatcaaagcaaaagaaatattacaatttaaaatatttaaatcaaatgcaaaataccaaaaaccaaacgtcattttcaaggattcttatttatttaattttaaataatttttattatagcctttttcattattttttctatctttataataaccaggactcccagctaacttttaaaagcctcatttggctggcaaaaatagttagtcgactaacatctaaggacagccgcaactgtatgaaaaacaatttcaaaaatctcaaaaatcttcctaaatatcttaaaaactaaataaataccttttctgatgattgctcgcaaaataaatttaaaaataattaatatatagaagagaaaacatcatttttcaaatagttttttatacggactgtcaaaaatccttcaccgtttcctttcgctgtcgaaaaaagatgattagcgctagcattaagaatttggatttttctgcagctacaccaatccgtatatccttagaactatccttagctcatgaataccaactctttttttttgctcttctatcataaaattcgagaaaatttatgattatgccttttattaataagagatttgtccaaaaattacaaattttaatttttatcacaaaatgaataatgaatataaaaatccgttctctacttactttatctcttttattttattcatttttattctttcctctcttttttgattgcatttttatttaatcgatttcttcaattttgctgaataattaaatatatttaaaaaatattttatgtatacatataaaaatatattaacgggttgggaaagcttttgagttaaaaaaaggtcacgtaggaccctgtatttgcgaaaaaatggttgtttactgaaacccaatttaaaaaccaaaattcatgaaaccatttttcaataaatatttaaattttaaaataaatttgtaagcagcagatacatacaatgaaaaattgtgctcctttttgcttaatcgacgcatcaatcttctttgctcaatttgggctgacctattgatcagatcaatgtgtgaagaggaggccgatggtatgccaccaaaaatgctgccatcgtcgacctcaatttcccccgaagtgccatctccattggcattttcagtccacattccctttgatttgccgccatttccgccctcattttccatccaagttttaatagacaaatcattttcactgtcactttcactttcatcacttttgtgtgacagttcaacttttgtactgtcattgtcagtgtcatattcttcattcaaatttgaatgcgtttgtttgcatagcattttatgtgccattgagttgcataggtcgggcatagatggaattttggatagtttcggaatgggcggcattttgcatgggctgggaagagaaagcattttgtatggcttggttaattttggcatttccattattggtttcccctctaaaaaggtgtataaaaattagcggataaataagctgtaattttttgctgctaaattattttactgctaaatatctttatgattcgtcattgttttaccaaaaaaaaattagttttagtttatattctaaacatttttctaaattgattttaccgtggaaattaaataaattttataaaaaaagagatttttttgatctgaatattgtgtggaagaagctggctgggcgattaaaatgcatttgcccaaatttattaacaaaatgaatgaaaaaaacgaaaaatacacccctaagaatcgaccgacccttaactaactttctttgaaagaataaaattatttgttatttttcatttttacccaatagttttttgtagtatttttgtcttgccgctttgtctttcttcgtttcgtattcccaacccgtcacatatgatgacgatgctgatgggtttgatgatgtcaattttggtggcactgttgaagcattggcattttcttcctcgttgccagaatcggcttttttcataatgtcgctgataatgttgcctgcattagtgcgcgtaaaaattgtcgaaaatgccattgaaatgatgccgaaaatgttaaaagttttattgaatttcattttacaaattaattctaagaaaaattaccaatttaattttttttattactgaaaaaattatatatatatcaaaagaaaagcattcatttttatatttttgagtgtcatataaaatccggaaggaagacacatgaataaattatgatttaattaatacttaagtgcactaattaattggattttgtggcatttattgatttaataggcattctcggatacatttaaatattttttatacatattatttacaaagaagtagttattttttagagaaaataataaatgtaaaatgttttcgctgtaagctttcaaagggcctaaactatcgccaaaactcccataattttggcttgaatttttataaattaatgtttttttcgcgtcccaacatttgcggacatttaaagaaatggagtaaatttcgttgctagtcaatttcttggaacaactttggtatgttttttttgacaaaaactctgccttcctttggtcttaaaaacaatcaaattagacattcagggtattattctaaatttttaagccaaacaaaaatttagttcaaaattcgcagacagtttgtaatatcgaatgatataaaaatttgattgcttataaatgagaaagtttatgctgactttttaatttgaaaatttttttgaaattttcacttcggcgcctgctagaaccgcggactcacctctctccagaaaattttggaaactaactcggcaaatatttttttcctactatcaaactttatgcatctttttgacactattttgaaaatttttgccatcattttaagcactgtaccgctgcaaccttttgggctttcggttgcatctcataccattgggttatccgcaagttccgtccacaaattccgttatataatcaggttataaaattaaaataagatttggaaatcattttacgctaggggggacaatcccattaaaaatgttttgttttttaaataa

SEQ ID NO: 1127 - DNA, 1858 bp, Heterodera glycines
  misc_feature (95)..(95): n is a, c, g, or t
  misc_feature (103)..(103): n is a, c, g, or t
  misc_feature (112)..(113): n is a, c, g, or t
  misc_feature (190)..(190): n is a, c, g, or t
  misc_feature (205)..(205): n is a, c, g, or t
aagtttttgtgatcaattgaaacaaaacaaagtgagtcattatcaaataaaatgaaaaagttccctaaaactatcaagaaatgttgcaataaatntattatcncatgctatnnttgtcagttaatccaattcggtaggtgcttggttaatttttgcatttgatttcgccttcttctcctgctttatcgtnttagttgctgctttnttctctttttttcttatatgtttttctaaaaagggagcaaacaatatatagaaaaaataatatttaaaataaataccaattaattacttaaattcaaaaattctaagtcgtgagagcttatttttcttggatccaggtccaattcaggtccaagcaattttttggcaacctgtgtttttcctgcgattgaatttcggggatttttacccagaaagtattggttcagcaaagataataggaaaccaggcttaatttttcaaaatacgaattatttattcatctcaaaaatgtatgcatggatatgacatgccctgttcccgttcaaagacgcgtcgccgctcttccatacaatccgtgccggccaatccaaaagcatttggtgaacaaccaatgccgtcttctcccatcgcagtgaagttcaagcaaatggcagaaaatgtcataaaaaatatcaaaaaagcggaacaaagttatatcgcatttttaattaaaaaaaaaataagattttgcttcagctagaatttttgcaactccaataatcattcatttttatatctatccacttaattccacttaattcacatgaaaaacatttgaatcacatattttttcaatcattacttttaaattggagtatggtggcatttattgaacattgcacaatttttgtttgtaattttttcagtagccacgttggcaaacaatgccaaaataacttatgaggtgtataattcattaaaataatgtaattatttgtcaaaataatgaagaaaatatagatccgaagattatgttcaggaaggttggaaccggttccgttactagcgcaccttttgatgaaactcttagaataaatcaggaattttacttgtcaataaattgtattttttataagaatttttattcctgattaatcagaaatcagcacaaccagcccctaaggtcacttttaattatacaaaatttttctttatttttacattaataatagatttttcaacaatataaaataaaaataattataattttggacaaatttgttaacaaatttgacctaaattgcttatttgtagtcttctattttagcttgggattaagataagcaatgcaacaccttttttgtttgttttcaaagcacttttttacgggtctgtttagcttcggcgcaaacgtttcggtgccagcccgagtttttggattgtaactttttcattttcaaaatttccaaaaaaaatttcacaacccctaggaatttttttcgaaaattttcccgattttcactgtattttggggtgtcccgatcactatgaaggagtgatctgataaagttgctgtaaaagacttttttgatcaacatcaaaagttagcttagcacgaatttttttcagaattttggccacaaaatatttagtttaagagaaataaaatttttgtccataaacatatgaccacctaaaatgggcactatgcctattcactcacgagtcattttgttaataattattatttcagaaattgatttataggtttagaaagcccatgaaaaagctacaaaaaatgacaaaacattagttcgtttcagatttattcaaagcaaagggcaactattttcctcgatttatcatttgtccataaacatatgaccatgactgt

SEQ ID NO: 1128 - DNA, 3183 bp, Heterodera glycines
ccttcctcttttcttctcctgttcctctttccctttctcttcctctttgccttctattcctcttcgtcttctgtcttcctctttcccttcctcttcgcctccctttatcttatcttctcctcctgttcctctttcccttctattcctcttcgtcttctgtcttctcctcctgttcctctccccctttctcttccccttcctcttttccccttctatccccctcatgttctttttctctttgcttttgttccacttctgcttctcttcctcttttgggattgatcttttggataattgaataatcattttcataatgcataaaaaacattaattcctaagttaaaaaaatttttaattcatgcggtatttacttcaaaagttaatgcatttaaacaatccatcatgttacatcgacggcattattgccggttgcacacaaaattggtttggccatcatcatcatcgtcctcatcctctgctgccgtgggcggtaaaattccgtaatgagccgtgtcaacgattgccgccgccgccgccgccgtccattgtgacgttcatccttctgtttgcccaaaaatacaatttcatcatccccgtcggtgcctgaaaataggggaaaatgtaaatttaaaaaaaaaaatttatttacaaaaataaatcttcccctcttctcttcaccgaaattcttgtttaaaaacagagcgaaaaaatggtgaaggcgcagtggttaaagcaaaaaaaaaaaaagtttgtcagtaccccctacccacagccgaaatagtgactatcattgccgaacagtcagataattacagtatactaatatagtacttttaatttaaaagaaaaaaaaggaacaaaatatttacaaatttttcaaatttctaacaagggaacatatcgaacctgctctattcaatggtatattatcatttatatgcattttccgactcaaagtgccaaaaatatttgttggaacatttttgaaaagtaattcaaacaaaaaattttggaaaatttttgtattggaatttcttacaaaaaaaactatgatttttgttcttgaaatttttttttttagtaaaaacaaattttcccaagcgaggaagggttggcgggtcgaccccccccctttttcatatatatgatgcagcaaccaaaaaattgtccaaaaaagcatcccaaatgtttaccatcattagcgggctgttgcgcctcactgttgctgcatgccgccgcctcctgctgctgctcaacattgtcgtcctcccgccgttgggcattgccaccgccgtcgcattcctttggcaaattcatttcagccaaaaagataacgtcatcgtcttcatcatcgccattgcctggagggatttaaaaattttaacggaacaggacaaaacacagccgcccaaaacacagccgggaataaattttcaaaaaaaaatcgccgaagatttcttgaaattttttttttctcatagaattttcaaagaaaactttttctaagatttttttcttgaaaaatttctatttgaaaatttttttaaaagtttattcccggctgtgttatgtctcggctgtgttttcggcggctgtgttttggggtgtaccgaaattttaatgtggaatatttttgaaaaaattgagacgatacctcgagaaatttgtgcaaaataattttttaaatttgtttaaaaaattaagattaaaaaaaaactttttctttgacaattcgaaaaaaagaacatttaaacaagaaaaaagatttaaaaatttattaaaaaaaccccataaatttaaaaaattaaaagtttttaattttttcagatgcgaaaaaccaaatcagtttttaattatttatttcgggtgggaggggggtgggggaactgttgaaagcgttcattttattatgattaggtatttattatttgtttttaattgtactaattttgccaaaaccaacctgaacattgttgttggccatcacattcaacacccaaggcttttttgtggaagaattcggtgatgcgtctggtgggcagccggcgatcaacaagttcaaaacgactcgcggacatgtaaatgcaactgacatgcggatacctgacgaatttgttgttgttttttcaattattgcaatcaaaaaaaaattgcccaaaattttgctaggggtgccagagaccccataaatttttttcgagtgggccaaaaagcaaaaaaataaataaataaataatttaatattcgcggatttccagtccagaaatttttttctgttcttacgaagcctggtacgtgttcgtaggactgcccttgtcgtcttcaccccgccccctcctcctgttgttcgacctgtacccgtaccacgaatggccgtccttctcacgattgaatgggcgcatgaagttccagcatgcctgttggatgcccgccgttgtgtagttgggcaagtgcattgtgcggacattgtgatcgcttagcccggcggagaagccgaccaccaatgtttgagcaatgcgaccatactgcaaaacaaaaatggggtagaaaaatcaaaaaaaaaaaaaaataattccaatcaatttaaaattcaagagacaaaaaaaaattgagggtggaaattttaaaaaatgataattattattccaatgaaaatttatgtaaaacactcaaaaaattaattctcgaaatttcaagacatatagatttaaaattaaaatatttttgtttgttaattatttgattaaaatttaaaatattttattttttgaaaaaaatcttgtactgtaaattatagtacaagattttttttcaaaaaatgaaaaaacaaaaaaaaaattcgcttcgcctgccttatcatcgtcggccaccaaacgctttgacagttcgttggacagcgcgtggacccattttttgacctccgcgaccgttgcaagcattgagacaccagcaaattgcttggatgtgccgagcgattttggctgcaaatttgagcagaccggctcatcattatgccctgaaattaaaaaaaaaatttggtagacggagtggttttcaatggtgacggcaaaataactaataactaatttcaaatgtcgcgtcgctcggaaaagaaaaaatatttttaaaaataattttggctaaattagggcggtgcaccccaaaactcagccgagacataat

SEQ ID NO: 1129 - DNA, 3402 bp, Heterodera glycines
aaaaaatttcgcttcgcttgccttatcatcgtcggccaccaaacgctttgacagttcgttggacagcgcgtggacccattttttgacctccgcgaccgttgcaagcattgaggcaccagcaaattgcttggatgtgccgagcgattttggctgcaaatttgagcagaccggctcatcattatgccctgagatttaaaaaaaaatttggtagacggagtggttttcaatggtgacggcaaaataactaataactaatttcaaatgtcgcgtcgctcggaaaagaataaatatttttaaaaatgattttggctaaattagggcggtgcaccccaaaactcagccgagacataattcagccgtgaataaatttttaaaaaattttcaaacttagaaatttttcaagaaaaaaatcttagaaaattctatgagaaaaattttttttaaagaattttcagcgatttttttgaaaattttttgaaatttcttagaattattcattaaattttgaaaaaatcgcctgaaaaattttttaaatttttttttccatagaattttctaagaaaaatttttctaagatttttttcttggaaaatttctaggtttgaaaattttttaaaaatttattcacggctgaattatgtctcggctgagtttcggcggctgttttgtcctactccgaaattagggtacctaaccacttaaaaatacatatttattttctaataattatttggtaaaatgagagggctaccaattataaaatttcaaatcgctccgaaatttttttttattgtcccgtgacatttcgtcgctggcgagacatttcgggtggcaactttttgggatggatcgcccaataattttttttaatttcccagaaggatgggatgacacaatattaccttcaagcaaccgtgtcaaccagtcaacatttttagggtgaaaatgttgcagcaaaacgccgcgtggaatgccccgaagttcggccatcatctacaaaaaaaaaattgataatttttaatgaattttcgattggacgggcacccatcacccgttccacaattttttttttttgaaaaaacgcgcaacaaaaaagcggcggcttgaaaaggaagaaagcatcaatttgcagtgcacacccccccccctgcccccttccgtcacctccgcattgaattggcgcttcagtcgcttgccaaattttccgcccaaattccacaccgaattgattggcgtctgtccgtacagttttgcaatgtgttttggcacaatcacactctgacaattcggtttatgccttgaaagaaagaaaaaaaattttataaccaaataattttaagaaaattaaaaaaatttcagcaatttttgtcaaaaaaagaaggaaagtttctattttttacgccccataactgtttaatttcgtgctatgggtggggggggggtaaaatgaaaaaagtcacaataaatgtaaaaactccttaattttccgttaaaattcacccaaaaaggtggaaaatttggtaattatgttatattatgactgaaaccagaaaccacacaacaaaccttgcacaaacaagcttggcaagaatctaaaaaaattaatacaaaaaaaaaattatgaaaaaattagaaaaatttggcactttgttgtgtgaaatgccggccgaacatcggaattgggtgacctccttgacgcgtttgcgaatccgttcaacaaccgtcgcaccgatggcaatggccaactgttaaaaaaatacaacaaaatgaaataattttttttttttttgaaaatttatcagcaaaaaccaaaaattttcacagggtccccaaccacaattcagaaaaaaatttttttttttaaatttattgttaacaaatttaaaaatttgtttcgtcaattggagcctggccctaaaattaaaattttccggacaaatgacaatacgggtcccgtcatgttacccaatctttttttttcttttgcaaaaaaacgcacccacccatttttcatgttatgcacccgccctacctgttgcctggagacgcgacagtcgttgctcaaccactccttcaagctgttcaaccgttcctccgcgatcactgtctgttgtttgtcgctttcgttgaccaaaaaagtgttcgggaacagctgcgcaatgtcatcgttcagctaaaatgatttttttttttttttgttggtaaaaattgtacaaaaaaatttccagtatttttggtgtaagaattgcgatttacgacattttttggggaacccattgggaccgtccctcgacacaatacccgtaaatctcaaaaagactacttttgaattttttggttcattttttgagtttttcggtcataaatttttgtcaaatccacttttttgcaaaaaacatagaaatttcagctaaaaaaagatattaacaatgagtaccttttgaaccaattcctccattggttggctgtttaattccatctcacagtgcgcagtcaaatccaaaaatgcctttaaaaaaataaaagaaaaatttttttgccaaaaatggtccgacctcgtcaactgacgccttttccaccacaatttgatccgaaaaatcgaccagcactttgaagatttcaccacttgcgtccctgtaaaattacataaattacagaatttgattatttttcgcgaatttttgataaattttcattaatttttgaaaaaattcttagaaaacgtccattttgggaatcaaatttgattgcaaaaattttttcccaactatttttgagtaatttagctcggatttgagagcggttgctttatctagtattttgcacttaaaaaataccaaattgattcgtaaatggcggaaatttacaagggaatgaaattttctacccccatcaaaaaaaaaattctcaccggtatttgctgatgtctcccttctccacgccttcaattgcaggcacacggcacaaatggatgatcggacaaagatggcgcatcgaaaaaatgaaatttaataaacaaaaatttattgaaaaatggggttcattttttattcaaaagaccccccgtatttgtccgaattagatgaatttgatgtcattccatagcccaatggtttctctatttaattacaaaatttacacttaatgctatcgaatggtacctaatgggtccggtttgtaaaactatgaacggagttatatataatccgctccgagtaaaatagtgaaattaatgcgcaaaatttcatccgtttttttacaccaccggcactttttcggtaccattaaaggcaatcctgcagtttactggtcccgtttttttttagggtactgagcacgaatccgaccttatttttgacaaattctgaaccccgaacccggaatcgatcatttttcatatta

SEQ ID NO: 1130 - DNA, 2022 bp, Heterodera glycines
acagcaatcggcacagctgtgatcagcacaagctgttatttttgttatcaacataggcgagtgcgtcggtgatcagattggcttttcgtgtacggtaggagaatcttatgatgataaatgggaatgaattggtcttatggtcattgaaaatgggatgagtgatttgtttgacatattaatttggagacagaatgttttgtgtattttaacataaagatggtgtttctatgatatttggttatgatgcttagcgacagttgtttgccctatatatgcttctatgctcggttgtgaacaacataatcaagtaatgtataaaatttcataatttatgagttttagttttattaagggggaaaaattcagtttatcagttattgtgtaagacgaacgagaaatattggtatttttgcatatttaaacgaaatagggcaatcatgtaataatatgatagtttcgcgattactagagaattggtgattcaggagtgacattgagattagagcatggagcggaccattcatataaatcacttttgttggctgcgttaatgcaaaaaaaaagtttttgttgtgaaaaatgttcgattccgggttcggggttcagaatttgtcaaaaataaggtcggattcgtgctcagtacaataaaatagccctagaaaagttttcccagaattttacaaaaaaaaaaaaacgggaccagtaaactgcaggattgccaccattaaattgaatttggtgattgttgaaactcaaacctcgttgctgtccattccccgtttgattccgaaggctcgggctggatagttgacggcaatggccctgaaaaacaatggaggcttaaattttaaaaaaaaaatcaaaaaattcgagagacgatgttgtgagcgctaggtgcaaaaggacggatttagaaaaacaaaataataattcaaaaactagaaatatttgcttactgtcccgtgatggttgtaccgcgactgaacggaacgacggccaacgctcggccgcggagatggggctgttcacgctcctccacttgggtgtaaaaggcatctacaaagtttggcaaaaaatttcctcaaattcggcaggggtatgtatgcctatgaaatgaaaaatcaaaaaaaaaaatggtttaatttcattaaaattagcaaaatttctcaaacgtggaaaccccgccctttttaaaaaaaaaaaattcttggtgtcaatcgaaggcttaaagtctatagatttttttttctatataattaaattctttgttaaatgcaattgacaaaaaaaattattcaatgaatataccggaaaaacaccaaattttgtgtttgttttttagacattgattgaccaagcaggaatattatggccaaaaggaaattgaggacgcgtaaacagtgattgaatgcataaattggaaaaaagccaaaaaaatgctttcccttccttacccatatcaatcaaagcgatcacccgaattgactcccccatttcaagggttatgtgtagaagaattgttaatatgtaatacaacagaagagaaaaaaaaatgtgcaatatgtaaaattggattaagccttgttaaattatatttttagaaaaacaaaggcaagaatgacgccgatggtaaaccacccttaaatttttagaaattataaaagatgtggaaattttttttaagggttttagggatcgctgatcacgaatacagtaccaatttcatccgccaattcaatcccaggtccgaatttgaacaaaaaaaatagaaactttaatttttcaaataacacatttttggttcaaacggcttatgtaaatacatggaaaaaattgaaagtcaccaatgaaatttgaagtctcaattttttggagggtccgggaacagaaatggtcgaaattttcttagcatcggaatggaatagcatgtacaaaacaaatcgataccaaattgaccaaaacgagtgaatgatttacggctctctcatagggcagagacgtatgtgaccagtgaacattcac

SEQ ID NO: 1131 - DNA, 4315 bp, Heterodera glycines
tttgtattttttattttgatctaccataactcgcttccttttcaactaaactgaacaaatttggtatctaaaaaaagattttgaaaaggggaatctttttctaagcgaatgttaagtaatttgtcatctcagaaaaaagttgtcggaatttcaaacttttatcatgttataactcaagtcctaggccgccgtttctaacaaaaatggtaaaattaatcattttttattgattctaaatgtccatagtgtttttgtacctttacaatcaagattattataatttgtgaatttctatttttcatgtgttagagacatgaaaatagtacgccaaaaagagagaaaaagaaattcacaaaatttttcaccaaataacttttgagtgagccttatttttgtattaaatttctattaatcgatgtagattttttttctctatcgatatgcaaaatttggctggccgtgattgaatttccaatcacggaaatccgtgagccgtgatcacggggctttaaaaaaaatccgtgacccgtgaaccgtgatcacggcaccccaaaatccccgtgatttccgtgatccgtgattataaaaaaaatttctaatgattttttatttaaatttatttaaaaaacggaatttaatcgcgggaaaaattcccaaaaaatgttttaaagaaaccaaaacatataaaccgctttttttgcggcgaccttttccaaaaatgactaagtttacgatttttggcaatttttttaggaaaattagagctttttgtagaaatctccaaggaaaagtttttatttttaactaatttattaagaaaatttttcaaatttttcttaaatttaaccaaaaatctatttatgtagagaaaaaatttcttctactttgtaagctaacttttgatgctgaaaaaatcttttggaccaacatgctcagtccttcatgacgatctgaacaccccaaaagatactgaaagtcgggaaaattttagaaaaaattcttagagggttgggaaaattttctgaaaattttgattaggcctgtcgttttaaatttaagcgacggagagaaaaaatagggtttttagcagtttatatgccaaaaatggtaatttttctgccattttggggttacaatttcaaaaatacggtaaaatggggaaccggaaaattttgaaattttgagtgaatttgttgacagattttgtccaaaatatgtccaatcattggttaatttattggtctatggtcgttttaaaaaataaagaaaaataattttcaatgttatgaaatttcttgttaattaaatttcaattaaaattatcaaaacaaaatatataaattgtcctttcccaatggggaattgaacccaagggacagacaacgaaagacagaaggcttaaccaccagactacatatatatgtctactttctaatttgtaaacggaaaagaatttatttatttttctcaaaaaattcttcacaccactttcctattttcgtctcaataaaaattccctatataaaatgccaatcacggatcaaaatcacggaaaatttgaaaaaatccgtgacccgtgatccgagatcacggcaccccaaaaaccccgtgatttccgtgatccgtgatcacggccagccctggtccgaaccctaaatcaaaccaattaaaaatgaaattaaaatattttccaatttcttaaataaataaagaaatattgctttattatcattttataaaatttaattctgaaaaatcgttattattttagattaaacaaataaatatgcaaatataataattgaaagaaattaagaatgtttgttaaaaatatattaaaattgaagcataaaaaaaaataaaaccaaagaatttaaataataataaatcaaaataaatggtgagcagaaaactggcaaaaggaggcctttacttttacgagtaaagcgccacacggccaaaactcaaaacaattttttccataggatagtaaaaaatggaacaatcttccggtggtagcgatgcaaattaataaggcaaagaaattcgggggtttctgagtaggttccacgtgacaaatttatattcaatatttaatacctgtgatttttatatttttgattttgtattattctttgattaattttatttgtttgttttctttttggcgccatgtaagagcactaatgttcctttggtttgctcgataaattaaatcaaattaaaaaatttttaaatagaaattaatgtgtttacatattattttcttttaaaataataaaatattttttatatggttttattaaaattctagggcttcaataaatgtaaatttactctctcatcaatttcataattagtattcactcagtgagctagtgattattaaaatattttaatttattcaaataaatcaatataaaaggaatcttgcgtaaaaaaaaggagtataaaaatattgtttctaatcaacctttaaatatgaaaaaaatgttatcttatataagataaacaatttaatgaagaaagctaaaaataccacctgaaacaaaaaattgcattaaaaataataattgttggataaatttctccattaaaatttattatttgatcactattagtaggcttataagttgtatgcactaaaaagtgccaaatatgcgcataaaatatgactaaaattcccacaaatatgccctaaaaacccgaaaaaacataaatatgcactaaaatatgcattaataaaactgcaaaaaattggctttgaaccttcaaaaatgcaaaaaattgtgtaaaaattcagaattgactttaaactccaaaactatggctaagtgttttttagacaattacaaaaagttttaattttcaaactttatatatgcaatttcgaatttttaatttttattttatgctaaaatcaaaattgcttttttatatttacaaatttttttcaaaaattctcagaaaaaaaaatttaaaatctttagttttaggggagcaaaaaagtcaattcttaggggtgtgttttacgaaaggacaacggtggaaaacatattataattttagtcattgaacaaaatgcatataaagattatcataacaagtgtttaagagaattattactaaattctaagaaataaaaaaaactattaatttacttattgttaaaacaatatattgatttttaatttctttataaattcattacatattctgttaattcactgaattaaatcaacgagataaattagtatcaaaaattatggctattaacaatgcattcagatggccgctcacgagaaattaagtcaaatgcaaaaccttaaaaaataaaaacaaacctattcatatatttaataaagtacatttaaattttaaaatttttaattttcattactatcaaatttaagaattctttatgaataaaaaataagtgttcagattttggaaaatataataaaagaaattatttttggatgtatcttagattaatcattatttaaattatttaacaaaaaaaaaattttttcgtaatttactttaagacagaataaataaaaatatataacataagaaaaagatcaaacagattaatggaattcaaacaatattttaaaaatgagtcaaacaatttataagataatctttcggtataaaaaaaaatcaaaaatattcaaaaaaatacatgagaaccgaaatatttaaaaaataataatatttaagtcaagaagatattatagatatttaactcaagtcgaaacaacaattaataaaactaatgattataatagagaaattgacttatgaatcagcaaacgcataaacaaacaatgaaattatcaatatttaatatctttatgggcagttgccaataaatgtattatttttacagatgagagcatatgatttcatcaccgaggctcgacataaagttgtggtacaagcgctacggcaagcagtaattaatatttagttattcacaaaaataatgataacataattaagaaataaaataaacgattcaaaaattaaatttaaagatttaaaattaaattgaaatttgtcttggattattaatgcaacaatttccaaaagaaataaaagtgagcgccatggcactcctaaaaaactataaaaatttatatccatgagtgatggtagggttcggaatatgcatatctttttttctgaactgtgggaggcctgaaacgtacgaaaaacatgtttttagattttttgaagcttctagctatatttccatatgcatattttgcatatttgtgcatatttcgcgattttatatgcatatttg

SEQ ID NO: 1132 - DNA, 1515 bp, Heterodera glycines
  misc_feature (80)..(80): n is a, c, g, or t
  misc_feature (123)..(123): n is a, c, g, or t
  misc_feature (195)..(195): n is a, c, g, or t
ttccacacgtgaacgaagctgctctccattcgtcctgcgggactgtggttctctgtcactttgctcctttggccttatgntgggttctattgatgtttgaccatcgttgagggaggattttgncagtggggcatgtatgcttacatctccgtgtattgtagaaagacggtctttaaacacatctgcgtgcgtttncgattggtccttagcatcactgaactgagtctgagcttccaatgattcgtttactggtgatttttgttgagattgaacttcattttcagtttttcttaatcgcttccccagctgttcgccacgtgtaagagcttgggctcgaggttcatcgtgttgttgttgttgtcgttgtgctgaggggtttgatgggggtgttatttctgaatttttcaatgttgtatcagatgctgatgtttttgtatctatgactgcttctccatctttgccatcatttttattatcgttttccgtaacaatcggctttatgcgcttacacttggtcagccttcctatcttacggcactctaccgcattattgtcttgctgcactctttcaccttcatcattagatgaatcgtcatctttaggtaggtccttactgctactctcttgattctgttcttcctcaggtgcaattggtgtaatccgcttgcatttggtcagcttcccaatctttatacactctactccacggttatcttgtggtactctttcgccttcatcatttatctccatagtaccagttttgctttctttttccgtctcttcccgtgattgctgttgtccttgatccacgcttcttttggaccgtttaatggaaggagtttgaccatcttcagtgcttttgcggcttagagcggtcgttagtgtaccgttcaaatggcgctgtagtccttctgtgttctgttgtgatgattttggtagatgaacacgtagcaatcttccatcaatgtaatgaatgtcaatccattgatcctccacagttccgattgtagaagcccatgagtgagggtactgtattgagtacagtccacagacccatgagccacggaattgaactggtttcggtaggtgcacacgatattttgacgtggagttgtccacgtaatcagtaacattgctaggcaatacaacaaagaagtagttgttgttagagtcatcagccatttttaatatgcagtttattgttccgtgaaaagtaaaactgataatatacaaatttgtgaaaaggtggtctatttatacaaattctgtctcatcaatccaacggggtttttctgggtcaccgaggtattttacataatatctcttcgtcccatccttctgtctcttagtgcgtaacacgtgtacgcgatatgtcgtttttgcgtctttgcgcacgcgtgccaaatccggttcatagaaccatcccctcaacatctcaccgtgctcgtctttcaccttatagcgaacaggcgttgtgttgggtttcacctctgcattttgtagaatttcgtccga

SEQ ID NO: 1133 - DNA, 5666 bp, Heterodera glycines
tgctcgtctttaccttatagcgaacaggcgttgtgcttacaaaacctctgcaatttgtagaatttcgtccgaccatctttggaaggtacccgcgtgcgaacgtccctttgtttttgctcatcctcacaaaatctccctcacgaaagcgtggtgctctacgtccctcgtcatccgcatatagttccgggtgtatgaatcgttctcttggtccatacaatcggtcccacacctgctgagcattatgaaatccaatatccataggacgcattccgtgtgttcggcttctggactcgttaattcctttgacaatttggggcaacacctcggtccatgagagagtgtgatgctcagaaaagtaccgatacatccgctgtttcagtgtccttattgcacgctcacatatgctagctttcacggtggatgaggcaggacgatgcttctccacttcctcctctgcgaaaaaatcccgcacttcacgtgcctcaaattcctttcccttgtcggagaacacacgatgggggtgcatctccatttgagagaacagacgtctcagcgattcgatcatgtcgcgcgcggacttagaacgtgtgcgcgttgcaaacattctcttgctgagcacatcaatagcaactagcgcatattttgcacccgcgttatggcgcgctaacttttgaaagtcggccaaatccatttgcacatcggtcatgtagcctgctggtatggttcgtgagcgacggaagtgcacccttcgcgggcggtgcagggtgtaggtgcgatgatgctcaagccattcacggacctgatctcgcgtgattcccggcatggccttacgtgcctcactgaacagcacatcaacccctgcaaaggcagccgatgatttagcagggtcattatacagctcgctcagtctttgtccgtatatttccataatttagggtcaaattttgctacttcttcctttcctattagcggtcgtgatgacgatcccttttgtttttgttggtgcccttgttgttgttgaggttgtggtaaataggcacggagaagacgttctctctcgaatatttgctcaatctgtgaagtgcctgggggccttttggtggtcgctcgagttccaacattgaagatccattcaagcgaacgacgaatattactgtttgcaattcgagcaccctgttgatttcgaattccaccatctgccgaaacgccatacttgcccggatttgccatgaacagcacaccgaattcatttatccatttcgatcgttgctcaggcgttgcggtctttgttgcagaagaaacttctgattcggctcgtagagtaccggttgtttcggcacttttagcactcgtccatgaagaatccgcggtgtcaattttactacccgaatctgtttctgcgcctccattttcctcaatgtccgtagagaaagagacctctccgttactggtgctactacgccgtgatgtcgctggtgttgatgaggataatttgttccttccacgtcggtctactatagaacgtttggcgcgtttcttttgtgagggtgttacaacgggtatttcagactgttgaacgggtgcggaagcattgtcaattgagactttaacaggtcgttcgtcatatgctttcttcaagtgaaggtagcgacgcagttcttgattgtaatgagcgttttttgttgtaggatcagcgtgctctctcttaacttcatcaagagcacgtcgtgtaaagtccaaattagggtccccggaggtggctgttgcggtcagacccttgtaaatttcctctggtacaagaacaaagcgatttgcatacatacgtatttattctttagtacggcttaggatacgtgacaactcgagaatgataggggtcaataatgcgggaaataaatgcatgctgaatccagaccccttttgtactatcaattgacgggctcctctctctgttcgcgcacgactgagacgacgaataaagtccgcatatggcatcattcttttcttttgacgcgtggtgagcgcgaaacggccccgcacaatgtttaaagatatctctgcgagagcaagcagttgctcggagcttatagacctcagaatgcgtcgtcgttttctgacggatttggtttttgatagtctacagagaaaaggaaactgctgacacactgtttgattgatttgcactcctttttgtaacgattctctgtgcatcctgttcaaatgcctgctttaggaagaaaaatcgtctgttgaatagcggtgtcggaattgtcttctttaaatatgttggtccgtagacgtagcaatgggtccgacgatgggtgcagatcgatgagtagatatgagtatttttgacgtgttgcttgtcgataagcatccaagaaaaagtccaattgtcgagggaacagttggacgcccaaattccggatggccaatgcggagtttggagcacgtagtaggacgatgtacatcgaattttgacgaaccactttaagcttacgatcgaacaggtcttgactgatgaacacgaccccgaaattttggtggtgtgcttttttggtaaatagttctgctaggtagcgttcatctatagagtacaaaaggtcgtcgagaatgatcatcgcgggctttgtcaaagaactaatcatttctgcatccggaactccggcatgaagttgcacgttggttatacgatgctgaagatctgttaatgatggactatactccccataacagaacaaaatcgatttgggtgcagggtcgattatatgttccgcttgttcgataagtttgcaaatgaaggtgcttttgccgctcgaactaggcccggacacgagacatccgaatgggagacaaaattttagctctttactctcaaaccgctgcgcgtcaatcataacgagtttattgaacaataatgatataattagggtttttatacaaataaaacatgcgtatcgctttaaacatctttttcttccttgatggtgtctagattagaaataaatttatttgttctgaatttaggtgtattttccattgtgtttgcttcgtccattagttgtacttgcgacagatccattttgtctgtccgtatcatcccatctgttgctttctctcccacatttaattcatccgtccgattggtaagttctggtttctcatcttcgccatttttcgtagtaatgtcgcgcgagtctgagtcaaatctcgcttttttccgctcaacattgtcgatgagagggttttcagtcgttgatgtaacagttgacgacattgccttttctagtggagaatccgagaaaatatagggtactttaaatattcggcgcgaccgtacgcgaaacgcacaaaaacgcggcaggtcatacactcggtcgaatggtacaaatttttcggtcccttttagtcggctcgaatgaatgtagactccatccttactgatcagatagtccaaatccatattatatcggcattgtctgcaaatggtaccatcatcattgaaaaacactacacgcggagtgtccaatcggtcactgtgaacagtcactccctgagttgtgaccaaaaaattgactgtaggaagtagttgacttgtgagagatttgttatccattttttgggtcaatattttagaaatgattcattaaaatgacgagaatctaacattatactgtccctaataatgggcggggcttaaatacataatttacacactcgtagtgtcatcattatttaaatttagtgcactcatatacatccgatgcacacggacgaggatctgtctgacgacggcactgaatcatatacatttcgctctctgatttactacgaaaagaaacaatgctccaaatgtaagaagcttcgtaagtggtacatcgtggaatttcacatgccaaatccgatcattacaaattggggactgtgtcgctatttaatagacgaagcctgtttagacaatgtatgaaacatttaaaaagtaaaataaattctcatattacagtccggattcgctcttggaattttatgggaaaaaatcacccaattggcgtcgagcggtcttgacattctgtcattgtccaaccgcatgttttatgactcttaataagctttattaaatacattttttcatgcagttgtgctcaaatggagggccccgatgaagacgaatttactattgtagggtgggacccggaaaagaaagtcgtaatggacctcgtttgtttaaaaaacttaaagtgtaatttttcgataaattttaggaagccgccattcactctgctcaaacaatggaacgttcattcacacttaggacaaaaaacggaatggtggaacacaatggacacactgttgacactgaaattggcgcaatggaaaccgttcaaacatcatcaatcgatacatccccattgttcaacacacaacccgtccgtcaatctttgcccccaatttctctccttctgtccaacatcccccaaccagtgaaaagcgttttaaataatataaataataattctaaatgtgaaataccgttttatgaataacataataatacgaaaatgattttcacagagcgcctttcaaccctgctttcctcgcctcacctgcgataccaagcacgtaagacagttgcacactgcccttcaccaatcaaatgctgacggtgaaagcagcagcaacaacaatcggtgttcaagtgctatgtcaatggcgtcctcctcatcatcctcgtcaaattccgggcgaaagcgtccacccacaacagaaacggatttcagaaaaatagcaaaaattcaaaaacacaattaccgttgtgacgacggaaatgggtgccctgagtgtgaccgaattcatacacagaaattacccataaattttaacaccttttaaattcataacacatcatcaaattttccattttttatttgttaaaattcataaaattttccattttgtcatttgttatacattcataaaatttccacaccgccaaattttccgtcttttcatttgttagacattctgacctcccaaaatcgctcaataggcacgagacaataaacgaaatagccctataggcagagaaaaaagcaagcccaaatttgaattcgaatttttgaattcaaatttagcgccacgaccggcgccgcaactcggtcgctggcctggtttaaaacataaattattcaattttcaacatcatcaattcccgtagaaaaaaaatttctcattccgatacaaaagccgaaaacaattaaaaaatttcctgtttctaggagaataaaaaattttgttatttacaaaaataatagtacaatattttaaaacataaattattcaattttcaacactttcaggaattttgaatttaaatttggcgccaaagcgcctcatttccactgacatcaccccaaaaccattcaataggtgtacgacgaaaaacgaaacagtctttctgacagagaaaaaaagaaaattttaaattctaaacttggcgccaaacacgtcccacaccttctgacctcccaaaaccgctcaataggcacgagccaataaacgaaatagccctataggcagagaaaaaaagcaagcccaaatttgaattcaaatttttgaattcaaatttagcgccaaaagtgggaccctggcccccttgtaactactaa

SEQ ID NO: 1134 - DNA, 1596 bp, Heterodera glycines
  misc_feature (43)..(43): n is a, c, g, or t
  misc_feature (53)..(53): n is a, c, g, or t
  misc_feature (162)..(162): n is a, c, g, or t
cctgagtgtgaccgaattcatacacagaaattacccataaatnttacaccttntaaattcatgacacatcatcaaattttccattttttatttgttaaaattcataaaattttccattttgtcatttgttatacattcataaaatttccacaccgccaaatntttccgtcttttcatttgttagacattctgacctcccaaaatcgctcaataggcacgagacaataaacgaaatagccctataagaagagaaaaaagcaagcccaaatttgaattcgaatttatgaattcaaatttagcgccacgaccggcgccgcaactcggtcgctggcctggtttaaaacataaattattcaattttcaacactttcaggaattttgaatttaaatttggcgccaaagcgcctcatttccactgacatcacccaaaaccattcaataggtgtacgaagaaaacgaaacagtctttctgacagagaaaaaaagaaaattttaaattctaaacttggcgccaaacacgtcccacaccttctgacctcccaaaacccctcaataggcacgagccaataaacgaaatagccctataggcagagaaaaaaagcaagcccaaatttgaattcaaatttagcgccaaaagtgggaccctggcccccttgtaactactcacgtgcactacaaatcaataattttcactctctcctaaattttcttatataccttcctaacaaataagttgttttctttctctctctctctctttctcatttcgctgtttctcttgctttctcttttcgctctcgcttattctcctttctttcgctcatactttctctctgtctctctgtctcacctttctcgtgtttctcttctcttacctttttacttctcttccgtcgcacgtccttttcctaaacaatttaacaaaacaaataaacaaaagttgaacaattcccagttccccatacatacattccaacacttaaataataatgcgccgtcccccttcttgggcttcctcctcaaaaacactttattcatccgacgacaccgatgaacttcgccgttcctccccgctctgatcacttcccatccattcagacgctggcagcgtgtccaatactttataattttgtttttattttagagaaaaggctttttcttattttgtttgtcactgtttacataattacctttttttgattagttaagttttttgtgccgcgaattttgaggccaacaaataaatataatcaagaagacgggctgttaaattttacattttattaataaaaaaaaatctaaatttggtgtttaaagggcaattaagttttgtttttctaaaaaggatcaaattaaaaggacccgatttcgataatcactttaaattcttttggtaattctttttaaatttatagtattatgtaacgtgaccggacatttggacagtggacatctggacagtggacattacgacagtggacatttggacagtgaagtcatttggacagaaccggacaattggacagtggacattacgacagaaagtgaatttttttactattaaaaatggctttagcagcaataaaaaatatattt

SEQ ID NO: 1135 - DNA, 1133 bp, Heterodera glycines
  misc_feature (111)..(111): n is a, c, g, or t
ttgtggaaagtcaatcaaatttatgcactgccgctcaattgcccgtttggccaagtgaatgatcgaaaaagcctaccatccttttgtggctgttggcattgatcaatcccncaattttgcacaaatttccattcagaagaggggatttggatgccaccattgtgcaaggcgaacaagcaattgccgcggcagtcacagcatgtttggacaagctggaggaggacatcctgcggtttaccatcactgccgaacctcaagtggaatatggagcggaagccgacactgccataatcaccattcgacatcgcttagacaacaagcaggaaatggttgacatgtcgaaaattctggactgaagaccagccaatccatgtgcgtgtggcagccaaaggggccaaaccatgtgccaccggcttcatcatgaatgttgaacgacaggaatcggaaacgggactcagcattgtcgccaaactcttcctagcgtaccaagaagccaagaactacgattgtgaggaggcatgggaccgaataatggatggggaattgaccgaaattgagcctttgcattctaggaaaatcctaatgcaaagggccgaaaaattttcagttaatttattcactgaaatggcgaaaaacacaacgacaggactcggcacaattatgtccattctaatggcacgccaaggggaacgaacgcctccacaaaattcatgggatgagctattcgtagctaaacaaccagcattaaatgatttgattggatgacagcgagagacggctaggctaatgcttgattcagtcccccgcgtcgtgttcatgcaggcaccacccggcacaggcaaaacaaaagtgtctgttgacataatcgccgcccatctgcgcaccaatccggacgcacatgtgctttttgtggctccgctgaacgttgccgttgtgaaagcagtcgaagagatggccaaaacgatggaacgaatgggatggcgagaggacatgttggccttattttcaggatccggcaaaaagaaatacatgctggagctgaacaaaattggccctcatttgttggctgcagcgttgcgcgcaccccaattgtttgaagagctgaaggatgataagaaacgcacagtgctccg

SEQ ID NO: 1136 - DNA, 3480 bp, Heterodera glycines
accaaattccaactcctcttcggtattcatctccgatctgccctaagtggtcctctattagcacgtaaaatttcgaaaaatttcactaagattcaaaaaagttattatcaatatcgttcagaaatctggttttttgaataccaaatctaataatcttgctaatagaggacacttagagctatcgatcatatcaagattgttggttgatttggttgacaatgaaaaaagaaaacgaccccgactcattgtcagaatttttaatgtcaaatttcagcatttatgccgcaaagcattgacgcgctgaaattcgccgatgagatggaccaggaggaggagcagctgatcagttcgtccgtcaacgcccttctgaagaattggcgccgtcagctgcgctcgggccaacagaacactttcattccgttgcttccgttcggcgtttgatgagaaggaaaaaaccaatttaaaacaatgatttttgatttttcaaatatttcatttattcagtgcattttttcaaaaattttacaaagattttaatgcccacaggacagccaaaatcagtgttaattgttccgacagaaggggtacgctattaaaaaacaccaaaaagagccatttccaccagtccatgattttttggggcggcatttgtgccatcggtaagattcccctggtgttaatcaaaaaaaacaccaagataaactcggcagtcgatcagaacaccatcctaagggacgtagtgtatcctggggcataagggcactttagaaaaaaataattcgtccttcaacaggattggacaccggcgcacgagccgaaaacatcaattcagctgagtgaaatctgtttcatggattttgggggccagacatttggccctcaatttgcaaatttgaatccacttgacatttccttttggtcgtttatggaccagagtctgaacaagcgattgcaccaaattaggcgctgaaggaggcttttcaccgtacctgggacgaaattgccgaaaaaataggtgcggacattttggttaattttcggaagcgtttggacgcatgtatctcagcccatagtggctactttggacttttgatgtaattttctaataactaagaccctattaaataaaattgccaaattatatgattttctttttaatttgaaatggaattttccatggaaaggcaggttgcagaacttatgccgcaccctgtaaacccagaaaatccacctatgtgtaaaacttggtaaaatccgcctatttgtaaagcttaacacagtaaaaaataatacaaaaattcgcttgtttgtgaaacttgacgcacggattataaaattaaaataaaaacccgcctgtttgtaaaacttgacacactaaaaaatttgtaaaacttgacgcaataaaaaaaatacaaaaatttgcctatttgtaaaacttgacacactaaaaaaataatacaaaatccatctgtttgtgaaacttgacgcacgcattatcaatggcgtaaccaaaatttgcggccccatataaacccagaattatgtagcactttttcacccggcgacgctccaatttttctcttaaaaataggctcaaaagcgcaaaattttgccattttttgactaaatctgttaaaaattataaactgccctgagcataaatggtgtaatttcatctgattttacataaaaaatcaatttgattcacgggataataatgggcaattaattgaatttaaatattaattaaacatattatcatttcatttttgctttaacttttggatttaaaaaggaaaatttaatttaaaacagtccggcggatgtttcgacgcggtaatatccgcaacgcgtaaaagcagtgccaaatggaaatgccggcgcagcagggggaggtgagagacaggcggagtaaaattttcaattaatctttttaattgggatggatacattttgggttttaaatatattttaattggtaaattcgtttttcccgtgccattctcagagacggtgttttactacgtctcctcctcctcctcttccaccgccaatttccatcggcgccctttgccccgccttttttctccccacccgcgccgtctcagtttcacttcgatggcaattttcacagtgattgccatcatcatcatgttcttctccttcaaaatgcactccaaattcaatcaacagtttcaacaaaggcacaatgcccaccaaaattcattggcattgccaaaaaatggggagaagcaatgagagaaaaagcggttgctaattgagttccactttcgagactcaaatgctgcccggaaaccgagtcccgtcaaaacaaagcaaacaattggggaatggaacttgagagattgtcactgggatttgcttcaattttatcaacatctcacccaattaaatctcaaattttgacacttctaacattcaatttgtgccacttattacatttattggttttatcagagagtgtaaattaattttatttttttcttttttttttgcttaaattattccttttgattgtattccttttgacatcttttccgtctaaactggttcttatttacttaaaaatgaaattatttttttaaatactttaagacaaattcttctctcatttttgttttgtctgttctttccaattaatttatggattgaatttatccttttttaactcttgtcatttcattttgattgttttgttaattttactatttttaaatgtaaataaaaaaaacattttgaacaataaaaattcgttttccagtctcttttctcttctctgtgtttgcttttttctttcatcatttctgctattttgtgctcaatctccgccattgttctgtttttggtttcgggcagtgcgccgtacaaataaattccaatcgctgccaatggcggcacggtgatgtgacatttgcgccgcagacacttgcgccgcccagccaaaatgacacttgcgccgccgacatttgcgccgcccccccccccccccctattttgatataagcgaaacaaacatatactaatttttaacaacgcaacaaaattaatattttcaacaatattctaatcccatccttcgaatcccttcatccccacacggtattgcaatgcatgaatatgtcggatcaaatcatcgtcatttttttcttctttcgcgtcataagcaattaccaattgcctaatagctgagtcattttcgatgtattttttaagacgtggtcgatcggcaatgccccttgtctgatcaatttcgaaaggccgaacacgattgttttgatattcctcttcatctttcattgcctttatgaatctgacataataattttaagtgggattttccgaaaatttatctaattaaatttaatataaaattcgatagttaataacctattccgaattgatcagaccattcaaaattgatttaaaagccggaaaaattgaaattgagttcattaaaaa

SEQ ID NO: 1137 - DNA, 3529 bp, Heterodera glycines
tctcgttgctcaacttttggagcccgaacagttcgccaattccgaggttttcttcaccaatttggccaatgccaaacggaggagcaagtgcaaaagttgcaggagatactcaaaccgatgatgctccgacggttgaaggaggacgtggagaaggaactgcagcccaaggaggaaacaatcattgaggcatgtgccagcggtgccaatgccaatgtagttacaaccgcattccggcacttttcgctttagacgggatcaggatcccatgggagtttctcgggatccttcccgatcctttttttccttctacggcattaatcgggaccggatttcatcgggatccctctcgatctttttcaaaaactatgtatatataccggcattctggcatttttaggctatgttaggggtgtatccatccgaattaaggcacgttgttggtgtgccaagggtatatccacctgaattaaggcactttttgggtgtgtcaagggtgtacccacccacatttcgacagtttttaaaaaatttttggcaaaatgcgcaacttcggtaccacatttgatgtgtgggtgccacaaagacaatggcactactctgcaattttttgtgatgaaatcccctctaattttaaggtccaactctccaacatccagaaaaaatattaccgcgcagttttggagcgcaatttcacccatctgatgaagggctcaaccccgtcactgatcagcctgaacaacacgatgatgcaactgcgtaaatgctgcaagtgtgtgatcgttttttgtctctttttgtatagtcctatggactgtttggcgtcggaaatttttggcgccagtaaattttgcgccgggttaacatagatttgctaactgtgcgccaatgcactaacatcatgccaattaggcaccattacatacaattctgtctaagtaccctttggcgccaaaaattgtgcacccgcacggagaatctaggcgccatcacaatggcgaactggtgatgtgacatttgcgccgcagacacttgcgccgcccagccaaagtgacacttgcgccgccgacacttgcgccgctgccatttgcgccgcagacacttgcgccgccgacacttgcgccgcagacatttgcgccgccccccccccccctattttgacataagcgaaacaaacatatactaatttttaacaacgcaacaaaattaatattttcaacaatattctaatcccatccttcgaatcccttcatccccacacggtattgcaatgcatgaatatgtcggatcaaatcatcgtcatttttttcttctttcgcgtcataagcaattaccaattgcctaatagctgagtcattttcgatgtattttttaagacgtggtcgatcggcaatgccccttgtctgatcaatttcgaaaggccgaacacgattgttttgatattcctcttcatctttcattgcctttatgaatctgacataatattttaagtgggattttccgaaaatttatctaattgagtttaatataaaattcgatagttaataacctattccgaattgatcagaccattcaaaattgtgtttaaaagccggaaaaattgaaattgagttcattaaaaaaataatcaaaaatgaaaatatttcttttttatttcttgctactctcggcagtgaagaagaaaaaaacttgtcattgctcttactgtatgcgttgaccaaagacaaaaaattaagtgtttacctttgtgattagtgatttattgttgtgtttttttaattagttgtcattttgcgtttaatttatagttttagtaaaatttgttgataattacctaatgttgaattttatttaaaatgtaattggaatggaagttttaattccgaatgctacattaactttaaacattaaaattgattgagaaaattatctttaaataatcaaaatgggggggggggcggcgcaaatgtcggcgggcaagtgtcattttggctggtcggcgcaagtgtctgcggcgcaaacttgtcgcggcgcaagtgtcggcggcgcaaatggcagcggcgcaaatgtcggcggcgcaagtgtcattttggctgggcggcgcaagtgtctgcggcgcaactgtcgcggcgcaaatgtctgcggcgcaaatgtcggccaatcggcggcacaaaaaacagtgcgtaagccttcggagcaatcaatggatttaattaatgacttttaatgtctatcgaaaagagctctacaaagaatcccggcaaatctttgcgatttcacaaagcggaggaatggagcacaacaaccaaaaccaaaggggaaataaacgccacaggcgtttctggctcccaaaattccactaacattgctaaatttgacccaaaatcaacaacatgtccactaaaattactatttatttaaaaagtaaattgaaagaagcttatggagattttggtgccgaggtgatagccgacgaaaattttaaagaccacgattatgacaaatagaaaatgtttatttataaaataaatatttttcatgaatatatttaatatttttgatgtatatgtagctattatttcatgaaaaaaattatttgagaaaaaatgaaaattttttgaattttttcaggacccgttactcggactcggtttaaaaacttggacccggacccggcttttctggacccggcaataccccggacccaatttttgcccaaatacccggacccggccaaccctagttaagattggatcttacaaaatataatcacattatacaaaatagtgaatttttttaaattattttttaatttatatttaaaaatttaatcgtattattaaattcattaacataaattaatttatttatttttttaaatcaattgagttccatattccaatatcattaaaaaagtatgcataaaatacatatgtattataggaacttttgtttacgcttaagcattccaatcaatagaaaatgaatgatgatttttggggtcaaagattaaatgcatttggagggagggaaagggcaatggttggagagattggtcgatattttgccttcattttgtgagttgatgttttttgttgccattttatgtagcagattaacctttctaaaaaggcgtatccaaaatgactgaagcagaggaggaggagaagggggtaattaagaggagggaacaattcaaagagagccaattttgagagggcatttcatgttgaattgttaaattaccctcttgaatttgtcaaatttcaccagcagatgtgccgaattgcgctgccccatatttgtctgtatgtgcttctctgtttgtatttgttggccggcgcgtgggccttcgcgtgcattgaacacaacgcggaacgcgcggaacaggccaaaaaattggaacgcattggttggtgacgggttacgatatttactgatttaccacacttgctcgattataacccccggggactctattgttcaacccccctcaaaaggcgggctttattcgagaggagggggttctaat

SEQ ID NO: 1138 - DNA, 6160 bp, Heterodera glycines
atttcacacgagaaatgttcgaagtgaagtcctgacgatcgggcgtcgccaattgagccggttaattgctcaaacaattatttgtggaagtcgaacaccaaataaatttattaacacaaatggaaaataaataacaaataaatatttgtcggagggacggagcaaattggggagcaccaaaaataggaaggaaaataacacaatgaatgaggatggacgaagggaagggcatgaatgaatggggaaaaaatcaataaggggtcaaagagcccaagagagggaattacaaatatttgaattatttgcctctctaacacctccccttttaagtccaactgatcagtgccatgatcagtcacacataggacgatcggctggggtcgatttgaaggcggtcaacaggccggcgatttcgaatcggataacggcggactggcggtgattgattggctggcgggacttctgccaaattttggtcccttaatggaattgggaggccaaaagtgccattgatcacatcgagcgggtcttcgatgtcctcatccggaatttgacgtgcgcggatttggttggcatgaaatcggccgcgagaattgtttggcaattcgacggtgtaaattacaccctttttgtcgatgattttgccgtgtcgccattccgctgaattgtgccgacgtgtgaaaaccaattgtccgatttcaaatgatcggaattttgcgccgtgtttgcgattgaattggtcctccattttattgtccttgacaattggaattgacagcggaggccggaggaggtcgaggcctattcgaggctttcggccaagaaataattcggccgggcattttccatccagagtttctgatggcgtggtgcgataggtgagtagaaaagtgtcgagcacattaccgtcaactccctccccttttattttcgcgaatgccctcttaaaagtgtcgaccatccgctcagcttgaccatttgactgtggcatgtacggcgctgtaaaaatgtgttcaattccgttcgatttaacgaaattttggaattggtggctttggaattgagtgccgttgtcggaaacaattgtttccgggatgccgtagtgcgcgatcaatgagcgcatttttgaaattgtggccatggcatttgtagaattcatttcaaaaatctccggatattttgaaaatgagtctacgacgatcaaatacatttttccatgaaatggtccggcgtaatcgatgtgaatgcgcttccatgggccatcagattttggccatgactgcagtgtcgtcttgattggatttttggcgacagctgcgcatgaagtgcatttttggacgaacgtttcgatttctgcgtccatcattggccagtagacatgcattcgggccaaagatttcattcgcttgactcccggatgtccttgatgaagcatcttgagaatttgcttctgcagtgatttggggatgactgtccggtcgccgaacatcaggcagtccttgacgattgaaatttcgtcgcggcgccgataaaattgaatgaatttggcttcgtccagcccttcaattggctgaaaatttttaggttctggccaaatatttttgacaaattgacgaatttgttgaagtgcctgatcatttgccgtttcttgggccaaatttttgaaggtgatcggcaattggttgacattgttgatcaaatttctgtccaatgccgattccacttcgaatgaggcaataatgacttcgtcgtcgtcggattttgacttttggacggaaattaggcgagataatgcatctgcctgtccaaatttgtctgttttgacgtattgtatttcaaagtcgtaagccgtcaaaatgagtgaccaacggacgagacggttgtgggagtgctttgggacaccatctttattgccaaaaattttcttgagtggctggtgatccgtcagcaatgtgaatttcctgccgaagatcattttatgaaagcgtttgacggcttccaccaatgccagggcttctttttctatttgcccgtaattttgctcagccggtgtgagtgatcgtgagaaatgcgacacggcttttattgagccattggcaaatttgtgtgatatgacgccgccgatgccatgttgtgaagcgtcggctgcgacgatgatcggcagatttggatcaaaatgcgtcaatgccagctcagattgtagcattgaaataattttggtgaacgcattttgacatttgggtgaccaatcccatttggcatccttcttcagcagttcgtcaaggggctgtcgaataaaccggaaatttcgcacaaattcctggtaataattgaccatgcccaaatatgatcgcaattcgctgacattcgaagggatgcgcatttccgcaattgctgtgattttgcttgggtccggccgacgtccactttgatcaatgatcacgcccaaatatttgatttcatttttgaaaaatgaacatttgtccattcggactttgaacccccattctgaaattcgggtgaaaatttggttcaaatgttggcagtgttgatcaaatgtcgcgctgacgatgatgacgtcgtccaaataagccaatgcgaatgggaaatcggagaacatattgtccatcaccgattgaaaaatcccgggggcggatttcactccaaatggcagccgctcatattggtagtgtccccggtgtgtagcaattgtacacaatttctttgaagtgccgtccagttcgatttgcagatatgcatccgacaaatccaattttgtgaagaattttccgccattcagtgtggcgaaaatgtcggctggcaatggcagaggatgctggtttaattggagagagtcgttgagcccggtggagaaatcagcgcacagacgagcagttccgttcgctttcttgaccaccaaaattggggctgaccagttagtgtgttcgactggtgtgacgacgttcattttctccaaccgatccaattctgcattgattattggcagcgtagaatatggcactggacgggcgcgcttgaacgttggatttgcgccttccttgagcaccagattggctttcattttggagcagtagccaaggccatctgagaatatttgctcatatttttgcggcaatatttcgacgaattgttggattttgtccgcatcatttgacgaaatttgattgatttgggcgggattgatcattcgccgtatttcttccagaaatccaaacgcttccattgccggtgtgcccaaaagattcaatgatcccgatttggcaacataaaacggctgaattgtctgaattccgttgaattggaaggtggcggtcccgcgtccgatgaatttgcaccgctttccgtcgaaaaagcgtgcttcctctgaacatatttgaattggtggtcggcccattgcgttgtaatcatcttcattgatgatgatgatttccgcaccgctgtccaggatgaaaccaattgttgtgccgttcacattgatcggtgctttaagcagatttgatgaatggacggaattgatgtaagccgcggggagcatcaccgtatttgtgttgaaatttctgcccttattttggtgaaatgctcgaattttgtcgcattgccgattgatgtggcctctgcgattgcatttgctgcatatattttccttctttgggcaatcctgtgcccaatgcaattctccgcaacgatagcagttgctcggcggtattttggcctttgatttgcccgtgaatttttgatttgggcgaccgtttccgcgattttggtgcttatttggcgatgatttgccatgctgaattgcgtttattttgggctttggctgctccaaaatttttgcttccgcctccgtttttagctgtgtatttaagtcctcgatgactttgtcgaataatttggacgtttttgtcgtctttgtgccctctgctgtgagacgcgcgaggatatgttggcgtaattttgcgtcgcttggtgacttaagcgacgtaagaagaaccaggcatttgaattcctcttcgtttaattccgaaaaacggaatttgcggagggctgccttaattcggttcacaaaaatttcaaattgttcgccgtcctctctgcacactcgcaggcatttgtagcgatcgattgctaacgaaggaggatgagaaaataatttgatcagacgagttttggtgtccgtaaagtcaaatttggtgatttcctccggcaggcagtagcgcttgtattcgccgaaggcggacgggttgagcttagtcatcagcaatttgagtttggcttcgtccgccatatttgccaccgcgcaatcaaatgcaaattggaagcgctccaaccactcctcaaattcttcggcattatctgttgaaaatgggtgaatgtccggcaaagtgatgttttgtgccggctgagttgcggtggatgtcgacgcgctctgctgcttgatcgcttgcgtcaatttttccaaaatttcggcgagcgttttgtccatggttgatttggaggatggacttagaagaagaaactgcacatagcagaaccgcacacaaaattagtgattggttttttgaagaattctgcgaaatccaaaaatcaacacgagatttttgaatttccactttcgaacaatttcaacacgagaaaatgttcgaattgttgaggttctgtagaacaggcgtcgccaatgttgagccggttaattgctcaaacaattatttgtgatgtcgaacaccaaaatatttatttaacacaaatggaaaaataatacaaaaaatatttgtcggagggacggagcaaattggggagcaccaaaaataggaaggaaaataacagaatgactgtgggatggacgaagggaagggcatgaataaatggggaaaaccaatatttgaggtcaaagttcacaagagagaaaattacaaacatttgaatgttcgcctctctaacacctccccttttaagtccaactgatcagtgccatgatcagtcacacataggacgatcggcttgggtcgatttgaaggcgatcaacgggccggcgatttcgtgtcggatatcggcgggctggcggtggatcattggctggtgggatttcttccaaattattttcccttaatggaataggaaggccaaaagtgccattgatcacgtcaatcggatcttcgatgtcctcgtcaggaatttgacgtgcgcggatctgatttacatgaaatcgaccgcgagaactgttcggcaattcgacggtgtaaattacaccctttttgtcgatgattttgccgggtcgccaatccgctgtattgtgccggcgtgtgaagaccaattgtctaatgtcaaatgatcggaatttggcgccgtgtttcctgttgaattggtcctccattttaccgtcctttatgattggaattgacggcggaggccggagaaggtcgaggccaattcgaggctttcggccaagaaataattcggccgggcattttccgtcaagagtttctgatggcgtggtgcgataggtgagtagaaaagtgtcgagcacattgccatcgactccctccccttttattttcgcgaatgccctcttaaaagtgtcgaccatccgctcggcttgaccatttgactgtggcatacggcgctgtgaaaatgtgttcaattccgttcgatttgacgaaatctttggattggtgactttgaaattgagtgccgttgtcggaaacaattttttccgggatgccgtaatgcgcgatcaatgaatgcatttgtatttttttcaaaaaatataaaatgttttttaattatattttttcttatcgatagcaaaagcctgttttaacagcaaacataataaattcggtgctattgacgaaatacgacaaaatgcaaatgattaaaatgcaatggaattaaaataaataagaaaataaaatataattaattcataattattaataaacaaatattttaatgggttcattaatctcagcgttcatcagattcttcacttatttcaaatgcaccgtctccgacggttaaattttcccgcgcttttgaaatgccacaatttgaattgcgtaacatattacagcctccttcgtagcgcgaatttgcacaaagaaggtcgcaataattcaaaatattcgtgtaaacttctgaa

SEQ ID NO: 1139 - DNA, 1557 bp, Heterodera glycines
  misc_feature (1541)..(1541): n is a, c, g, or t
aaaaaactatgaggaatcatattttctttataggaaacccataagaatacaaaaaaaaattgaaaataatatgatttctgtcctttggattgaaccaggggaaagaagaagggacagtcaaggagactagccattaggccatttgcacacttgggcattgttacttttaaagaatatattaattattattttttatttttccctttgactccaattttcttcactaatttttcactcagaccccattcttaccagtgcttgtttttcccggttcccggttgccctaccgggacctgagcttttcaaaacccgggaccgggaaccgggacctcggatgaccgggaattcccggcccggtcccgtggcactctagataggagtaataaatattttacgaaggtgatgacaataaatattgtaaataaactgttacaaacaacagtccctccccccccccccccaggggctgccctctcattgttaattaatttattaatgagggtgaaggggagggggcggaggttgggggttaattaattgttgacggattgggggtgcttacctaatgagtcttctgataaaaattgtttgcagtgtatgtcgagaggagagagagagcctatcattttcttccgtcctccaactctcgacaattctgtcaaaaaacaccactgataacagagtggttaattaattgataaaatgataagagtgattagggcggggaagggaggagttcccccgggaatggtcgttccggcgccgacgtttcggcgccagctcagtttttgggctataactcctttcatagttgtcttaattgaatgaatttggtaccattagatagccctacgtattgtctacttgcctatgaaatctcgaaaaatttggctaagttttgaaaaagttagtaccagaaaacttcaaaaaactggttttccaacctttttggtcctaacttttttgaaacttaaaccaaattttttgaaatttcgtagtaaaatagtgaataggtaaggctattgaatgacatcaaattcattcaattaggacaattattgaaggagttataccctaaaaactaagctggcgctcatttggtcggcgcccatttgagccccacaaattccatccccccccccggcgaacacaaaaatatgctgacacaacgggtcaacaacaacaagaggaaaataatgggcataatggccagttttgtcaatgacagcaaataaaatgattgtgctgttttgttcagaagaatttaaaaaaaaaaaaatttttttttgactcgaaaaaatccgggaaaaattaacgctcgagaaaaatttgatatcttttttttagaaattttggcgctaatttaaaagtggttggtgttaatttgggaaatctaattcgaattcgaatttattgtccaaatggatggggcagattcgtgccaattgtaagcgtattccacaaaaatgcagcatgaaaaaacggtttcatgatcagatatcatcatcatcattatcttcacacttttatgaagcgccganaatttttgaaattttt

SEQ ID NO: 1140 - DNA, 2414 bp, Heterodera glycines
aaaagcctcattttgtgtcaaaaagcctcattttgtgtcaaaaagcctcatttttataaagtttattaaataaaacacgcttaaaattttcaaatgattttttttgattgtccatgatcaatttgagcaattttttgttcgaaataaacattttgtgaaattctaagcatgaaaaacgaagttgatttttttgcggcgcttttttcaaaaaacttttggggcggaaggggggccggcggtgccgataggcgccgggaaaaattttgtgatttttaatacgatttgttaacagatttgtcgacaaatatggccaaaaacattatgccaatttatcaaaattaatcaaaatttaaaaaaatctgacgaattttccccaaaaatcttcaaaatttctcaaaaaaccacaaaaagcctcaaagcctcattttgaaaatttagcctcattgacctatcaaaaaaccacaaaatgaggctaaagcctcagatctgggaaccctggtatttaggtatacatgagggaaatgaagtgtttgctggggccatattgttaagaatggccaaacaaaaagcaaaaaaatttaggtcaaaagctcccgccccgccaatcttgtgggcgctataattaacgaaatttaaaatagtgccaaaaaatgaaattccgaaaaatttaattggtggcaccaaaaaaaaagattaattattttttcattttgtttgtttttaaataaaaacaataattcattcgttcggttttttcatcaaaaacgcaaaatgactaataatttgttggagtcggcggaagggggagggagaaggaaggaagagacggcacagaaaagaatgattagaaagaaaaattaaacaaaaaaagggggggagggaatggaaaaagtgtaagaaaaagagagagaaagagaaatagaggaagagaaagaaagaagggaggaagagattgagtgaaaagagagaaaaagcggcttttgctcaacgggagaaaaggtggaaaagaaaggaaatagagagggaggaacacacagagagagagagagagaaacagagagagagagcgaggagaaaatgaaagggagggagagaagtgaggtgacggattaaagcagacaacaacaaaaaaatcggatgcgattaagccaacaaagaaaagggaacaagaagagagagtgataaaaaaaagaaatggagacaaagagagagaaaaagagagagagcaggagagagaaaaaagaggaaaagagagagaggagagggagagggagagagagaaaaaaaggaaaggcggctttttctttgaccacagaaaaagagacggaaagtaaggttgtttgtgtacaacgcctattactggggatgaagcagcagaacatcaaatgtgtaaaaagcggggggggggggggggagaaaagcgttcacattccaaagtcaacattaataaacacatatccatcccccatccggattaagagcaaaagtggatggatggatatattacactcacatttcattattattgcaaaaaggggacgacgcaattagtgccctcaaataaatacataattattaataattaaaaatgaaaccccggcggaattccgtgcaattttaaatttaaaaaacaaacaaaaaaagtcacttccgtttgtgttttcagccccctcatgaatttaatttaggcgcctgaacactcgaaaatttacttgaattttcaagtgcaaaaataaatattttttttcgaaacaaaataaattaaaaattgaaaaatttttatttaagaagaatgagagggcgttgcttttgtattataactttttgtccattgaaaaataaatacacacttaatctgtaactgtgacgtgacatctgtgatgttaaaaaatgaaaaaatgtgcatttattcaattgggggtcaattttttttgaaattcccatttttactttcatccaataaatctcaaaattgcgcttacaacgaacgctctaacacttagaaaaatttgttgaaaaagggtgaaaaaatagtaaaaggacagccaaaaaacagttttaaatcgggcgagggggggggggggtaaaaaggtgaatattgtaatattgttgatgaccacagcagtttagagaagaaattgcaggggatgagagaatgcgcgtgtcaagagagagagtcgggcaaaaaaagctcgaaagaaaccccgagaaattcatacgcctcacacgagagagagaggccaaccaacaaagatcagcaagtggccgagaggaggtcgagactgaaattctcgtgcacaaaatggcggggggggggacggaacggaaaaggatgaatgaataatgatgatgggtattttgtgttgcatttgcaacgatcggcggagtaaatggggggcaaggggaaattcagg

SEQ ID NO: 1141 - DNA, 4966 bp, Heterodera glycines
  misc_feature (36)..(36): n is a, c, g, or t
  misc_feature (65)..(65): n is a, c, g, or t
cgggcttcctgaaaattaaaaatgtgtattaaatanagcttattaaaacagatttgtattttttntagaatatgtatcattgtgtatcgtattttctttttgattgaataattttcttccctatcattgacatactgtagcggatatcaaataatcttcggctgatccccttattttttattatgccatcatttttcttgtccaattttaaaaattccccggtggatatatatatggcggacatcgcaagttttggcaaaaattataataggaccctcaaaattttagttttagctgtgcgccatcatccaccgccgtcggttgtttgtctcacacccgcaccaggagtcttaaacatattccccccccccattaattgccttaattggcaaaaattttcacccccccccctttaaataagtgttgtgccaatgccaacccgataagtgatggtcatcactggtgcccccattgctgctgctgtgctccccgccatgctcatcgaacattgtgaagtgccgttgctacagtttcgggtgccaggtgttgccgatgacatcgccataaaacttgttgcgcttgttgctggcgtagtcggtgtgttgtcgcaatgccgttgctggtgaggcgggtgttgttgttgttggactgcttgaagttttgccgcgggctgtgaagcaatgctaaaaatagttaaaatatattccccagttcaaaatgagaaagagactagatttctatttttttattgttgatttggtacaagtaaatcaatcatttttcgtaaaatgcagtatcaaaccaggtcataatttttttaattttccaaaatttctggggcggtgcctgccggcaccactatacactaattgtcctctaatttttaaaaaatgtgctcaaaaaccgtatcctaccagtccacactaaattttattatatgaaatttgtttgaaatgtcgacaaatgaataaatttttgggtacaaattaattgttggattttttaaataaaaaaatgcttttcatatgaataaaccattttttgttcgtagaatataaatcttttatgcatttttatttgccttagggtatggtccttaattaattccttaatttttgtttgggtttttgtgggttttttaaagcagtgaatcaacaaagctgtatttattaacccgataatgattgatcagaattgagatgagtttcctttgcatctctcatttctttgctttctttctctcatggtctcttccctctttttgccatcctgtgcatcataatctctaactgctgctgttgttctttctaaggaaaagaaaaagacagcgtgcaaaagagtgcataatattttatccaagtgacagacgagcatgggaaggaaaaagcacacgtatcattgtgaaaagagacgagtagtcattgggagagagtacccattcatccctttttctatccatctctccccatctttccaccccgtctccccttcccctcttttacggcctgtcctttggacttgctgctgctctttaaacttacctggctggggagttcctgcgatcaccaaggcagggctcctgtggcgaggctccaccattgcactttcggtcggggctgacccgcagggcggtcccgaactgggataggcccacagctaaatttttgagtgcgggggacggcgttcgcgcctcccctttaactttgcttcatctatttgctgttttaaacattgccgtttatcctttccaatatctccgagtgccgtgccgtgttgatgaattgtcgccaaaagcttcgtttatttgctgtttttgcagcgtatgacaatatttcatactaatgaattgaagcgcttctctaattttggatgacaaaaagtcgccgaaaaatttgtaaaatgaaaaggcgaaatgccaatttttgggacgggggcattttttgtcccttaaatttgttcattggcactgttatttgaattttcgacagtgttgacatatgtatttggatgccatttacgtactttgaaccgtgctgagtcgaacaaaaaactcagtgatcgataaaataattaaatttaattattcgattctctaaattcatataattattatattcatcaattattgaagattttttaattttaaaatttaaaaaaatgaataatttatttacttcgaggttattcttggacaagcaaaatcttaattaggttggacttattaatattttttcagaatcattaaaataataaatttattaaaatggcaaatttttatattattccttttttaatttataattaaattataatcgtatacttaaattcattgacaccgatcaatcactgagttttttttggatcgacctagcactttttgaaataggccctaatgcttagaaattttcaaatttgatttatttccaagattgtacttggaatcagcaattttctgaaaaaggacaaaaattataattaaaagtcattgtaacagtaaattataaaactcggagaccgaaatgatttgaatacgttgtaatgtttatttaatttattatttatttttagcacattttttgttttttttttaatttcattatgacttcaaacaaaagaaaaaattttccaatccgaattgggaaaataaataaaccagcgcctgaaggcacataaaaactttcccctctatacctcgagatgttcaagagtcttcttggtcttagtcttgaattattagggattgtttttttctcagtctcagctttgagtcacctttggcgccgaaatggctgtggtgctgaaaattgtctacaccgaatgtgtgattgattctcagccgatgattcatcaaatttcataaaactgatttttccgtaaaataacagaaaaacaaatcgaaaaattccacaaaaatgaatcattttgtaaataaccattaaataaatatttctgttcacttcaaaagatcaaattaatttccaatggctctctcaccgccaaatttgcctattgaactgctccgtcttctgctcctcctcctctttgtcttcacttcaactgtctgtggtaaaaataatttcgacggaaaattattgtggggcataagttagctgggaaattcttaaaaactgtcacattttggcattgttcggtcggtagccatgagtttcctctattaaacaaattttgaaataatttataatttaccaatgctaattgagaaaaataacaaaatttgcatgctcttcagcaagttttgtaaattttttttgcagaaaaacgatcaaattggctttttttgttgttaaccaaatccagcagtcttggtatcaatcgaaagcttaacatgtttagaagatatttctaagctattgcttcgcgattagacaattaccaaaaaagttataacatgaaattccaaaaaagtcgaaatttttgagtttttttcttaataacttttttagaagctaaaatttttgtttgttttttgtaaggctaatagagcttctgaagggctttcgaatgataccaagattgttagatttggtcaacaagaaaaaaagttataataaaaaaactgaggctggcgccaaaacgtcggcgccaaaacgacccagtaattttaggcacaaattttgtccccaaatgacctggacggacttgagcgatcaattgacgatttcaaagtgtttttggcagagcaggaccggatgagtgcctttctctcaaagaaacccaaggcccatcttctactcttccactttgtgccatttgcacgacaacatcaattcattggccttttggatgagcagggtgaaaaataaattgcttaattagcacaaacttttaatattttcaaggtgatgaagcgcttcattcggtgtggcgaagactcgaacaatggtggaaatgtatgcctgacgcggaacaaattttgcaacaattggagcaccatttcgtcaacaattggctgctggacaccggaaggattgacgaattgaagcgggtttgttttttcaaaaggtttcccttttctgaattctcatctttagaattatgaagaaaggaagggcgaggatgacacggatgaagaagcggcggaagaaattgattacgaatgccaaattgatgtaatttaacaaatttggattaaaggatgattttcaaaaaaaaagtgaagaaacaaaatgttttatcatttttgtttatttttcagaatatttatttgccattttacaagtcttcttttgcttaaaatcaccaaaaacgtccgttaacatgcatcggattcgaacctggaaccccccttttggtgactagcacatataccactgagacaaaaattcaaatctttttggaactgggaggcaaaaactgaaacggtgtgtgtagcagaatccgcaaattgcaaacccttctacaaatgtatatgagcctgtgcttatcatttaaattttcaaaatttaacgagacttatacagagttttaccctttgtccttatttgtaagaattgtccttattttgaggtagagagaaacttagattttaaatgatatttttgaaagaaatgtttttgaagcgaattaatagccaaagtcttactttttgcctcatttatttactcatatgcgtggtccagtgggttgtgatcttggttatgctcttcattttatcgttggatcagttcccctccaagcaatactttttcttctaatttttcaaaattattccttttttatgggaattcaatcataattttaacatttaaaatcataaaatattgtcatttgtggactaaatctattaacaaagtgcactaaaatttcaaaattttccccggcggcgcctatcggcaccgccggcacccaaaaccctattccttaaaaaattggctaaaaaccgcaaaaatttggacatttttttgacaaaatctgttaaaaattgcacttaaatttgaaaagtttt

SEQ ID NO: 1142 - DNA, 1097 bp, Heterodera glycines
ccccccccccccccccaaatcccttaaaccccccaatttataataaaaatgtgcccaatagtggctttttccgagcagttttaaagcgtcttcccctgtcccaagcgcagaagcactttagaaggagtgagggggagaagcccaaaaaagaggcaaaccaaaaaatgggacgtcgcgcgggggaggaggagaagccgacgaaaagccacccgctttttggagggggaatgatatgctttacgactttcccctcctcttcgttactagcaattagtcttccataaaacttaatgaccacaagcgccaattttagaaaaaagaaataaattaagtgaaattcaaaatgggagagcggcggggggatggggtggaagaagccgacgaaaagccgccggttttcagagggggatggtatgattaacaattcttcaacccaccaataaccatcctccataatcccccccccagcgtaaaatttagtaacaaaaagtaaaaatgaaatttaaaatgggaaagagaaggagagggagaggggagaagccgacgaaaagccgtcgcttttcggagggcaaagatatgcttaacatttcctcctgctcttgtctaacaccaattatcatcctccataatccccccagcgtcaaatttagtaacaaaaagtaaaaattaaatttgggggggggggagagtggtggaagaagccgacgaaaagcagcggccgcttttcggatggggaaggaaaagatacactttacatttcttcctctgctcttccttaacaccaacaatcatcatccacataatcgtcacaatttagtaacaaaaaattcataaaaataaaattgaataatactctgagaagagggtagtggggagaagcggacgaaaagcagtcgcagtgcttttcgtagggataaaatgggattgataaacgttctctttacgctgcttcctccttccctcctcctctttatcatcaattaggctattatccccttatcccccatataatcgccataagcgtcaaatttagtaacaaaaagcaaaaaaagtcagcgacccgtcacttctcctcactctctgatcactttcaaatg

SEQ ID NO: 1143 - DNA, 4558 bp, Heterodera glycines
tttcagttttttgttcaaagagcaccgctttgacgagccgttggacggcgcgcactttcaatggacagccatttacgacgacgacagcccattttttggccatgggtttggtgactgtgtatggtttaggtgttaggaccttgagaaggagaacatgttcaaatcggactacgtgcgaccagcgggaattaagcccaggggccgacccaaacaacaaatgccaaatttattgctgtaacaatgccaattctgtagtaacagtacaccaccgtctgctcgtacttttccgttttggggatctgctgatcggcgcccttattcggacaaattcatttttacggtggccatttttgtcggtaattaattaattaattaatcagtggtaattaactcattagccattcattattcattgctaattttaagcactcgttgccagttggcactgaatgattgacagaaaagaagcaattgttgtgatgataattttggttgaagtttcgaaaataaatttgtgtggaatcattatgtttttttaaatgtcataacattatcactggcatattaaatcttttaataaggaccagagctttatttttcaataaattacaccgtaaatttgaatctggggtcggattttccgacttctatgtaactaccgaaaaattttggggcctcggaatttggcgtttgctgctggaggatttttgcattaaaatttgctccccactgtaattgtctgcgcagaaaacggaagagcacgaccattctgagcatgagaagcatggagaagaagcagttgcagaacagcagatatgtgccaaaacccacaaaatatgctaaaaacccaaaaaggcctaaatatgggtcaaaattgatacaaaactgcttaaaaaatcttattctccagccattttgatagcataattgcaaatcaaaatcatttcaatcatcatgaacttttgaaattggtttagttactggcgccgaaatccacaaaatgacaattttggtaaaataaaataacaaacgaatattttcaaagtttcctgacttcgataaattaaggaattttaaacaacttgaaaaaagaataaatttaaacttcacatttttatgaatcgagaaaaacttgggaatttgaaaattccttttgaactttcgaatttctttgtgcttcagagttataaaataaatacaaaagaacaagcaaataaaagaagcaaagcttttaaaggggaggcgcgaacgccgtcccccgcactcaaaaatttagctgtgggcctatcccagttcgggaccgccctgcgggtcagccccgcccgaaagtgcaatggtggagcctcgccacaggagccctgccttggtgatcgcaggaactccccagccaggtaagtttaaagaacagcagccagtccgaggaaaggaacgatggaaggatgagggggagatggggtggaaaaagggggagagatggacagaaaaagagcgatgagaaggcactctttccacaggcacactcttttctttacccaatgatgctacgctatttcctttccatgctcgtctgtctcttttggatgaaatgttcttcactcttttcacgccgactttttccttccctccacaaaagcagcagttagacaaatacactactcttctgtgaaaaagagggaagagacaaaggagagtgaagaaggcaaagaaataggagaggagattcaaagagagagtgtatggaaaagaaaaagagtaaacgaaaagagcgcagcagagggccgttgtgcctttcctcttttagaacccatcaaaaattttactcaaaattttcttccatcatatataagaaatgtccctcacgccgctttcgttcattccaaatggacatatactaaaattggaacaatacagagaagattagcatggcccctgcgcaaggatgacacgcaaattcgtgaagcgttccaaattttttgcctttttttaatgcaatgtcaaaatgaaatgttttaattaatgttttttttgacagagaagaatggatccagaatagatttcaattataatcttttgatttttatataataattctccaaaaatgtagtaaaggcatttttagcctgaaattctcattttatttcgcctactagacatctcgcctactgacacttcgcctactggacatttcgcctactaagccaaaatcggacgtttcgcctactaagccaacatttgacatttcgcctacgaatttttttacctactgaaaaaatgctaaagaaaagaaaaaaagagagtgaaagagtagaaatgctttatttttcgatcaaataagttcgtgaaatacttacgagtcttaaaaagccaataaaaagccccgcattcattgaaatgaagacagtgtactgaatctgagagtgcagccaaagaagcaaatggaaaatgtttcagacaacaacgatttgaacttagccaaaatgcggatcagggatggcacggaattccgattttcgacatttttgaccaccggtattccgattttcgaaaatttttggggcctcggaatgccatccctggtgcgggtccttgacgagaccgattttgaattggacgaaggattagcaaacaccttgcacctgatcggactcgttttcagacctttatggaggggcttcagatccatggaacgtccgcacacccctgacacatgccaacgaattggccggttggcaacaattttggcagtttgcgtttggattgaccacttgtttaacaaagctcgttttgtgcttaagactgacacaaaaaaacgcatcaaaattaactcgagactcgagattaaaaaccaagactcttgaacaaccaaattcccaatgagcaaatggattactcattggcacgttacggcccacaaaaacggcggcgccggtcgaggacggcacaaacactcaatttttcgttttgttttccggtcggttttgagcaatttttcggccaatcactgattgattgccagggatggaaaattcctaaactttaagttggttttcttatcagttcatagaatccgcttttttctaaacctgaaaaaagtggtaaagttttcaatcatttccaaaatttttcaaatatttccaaaatatttgttgggccaaaatttaaaaaagtgttggccccatatgacacatgccaacgagttggccaagttggcatgtaacacctctgggaggccatggcacactttcacatcagacaggtggaccaaatgccatcatttgcatgcgcagcaaaaggaccgtttatagatgtgttggggagggggaattgaacccggacgagcaaagcgaaaagagacaaacgcacagaccaatcggccatggagcagtgaaaagaatagagatataagaattgaaattggaaaacatttgcatccatttgcttcagttaaaaattttttttaaattaatttgagttatttgtgtattgttaccccttaaccttaacatataattattgtattaattacaaattattaactacattctaattatttagttactacaaaaaatttttcaaattaattttattgaccaaacaatgaaaaaaactctcacgaaaaattcattggttttaaacaaaaaatccttcattacgtcatattcattttctattttatagagattttgtcaattttcttttaatttaatgtcaattgaatttctccaagagacaacaaatcaaattaaatcattagcaatggaaaaaatcataaaaatattttaaatcgaaaaataaaacaaaaaatcacaaaaattgtgagaaaaaaccatttgataaattcaatatgattgatcaattcagtccgattctgataaagtccggcactcggccacaatttggccaaaaaatatgggcaatgggctgtcgtcgtcgtaaatggctgtccattgaaagtgcgcgccgtccaacggctcgtcaaagcggtgttctttgaacaaaaaactgaaaataaaactaatttgtttcaattaaagattaattaacagattaacatcagtgaaaaagagtgaaacggcgagagagtatggggaaataagagggtagacaattaatgaagtaacgagagatggttggcccccgcctcgttaattaggaataattgggcgattagtgtccagcaatagaaaagaatagcaaaaatcgtataatttctcaaaaacaaaaagaaataataaattcctaaaaatttattgttcgaaatttgtgtttgttgctgactgggtgagaaaggggtgggggagagcgagacaggtgctggaaaacaacaaattgctgctttctgatcaggcctggtcctgctcaaaaattcgttcgaatgatttggctttaaatttgcccaaatcattcgaataaaaattcatgaaaggatgatcaaaatgagacctaattgacttattgctgagcttccgatcagttgatccgagaaaaaatgataaattattacataatcatgacaaccgtaaaatgggggaagcaatcgccacggaacgccccgaaa

SEQ ID NO: 1144 - DNA, 1242 bp, Heterodera glycines
  misc_feature (1233)..(1233): n is a, c, g, or t
tgggaaaattctgatcaggattcggactcctacattttaatgctgatcactgatcagcttaatacctactcaaaagtgggccaaaattgacgcttctgttggcactcacaaactgttttattgtcatattaaattaatgaatgataaacggcctttctaatcagtcaatttgtacaaacgcttatagtggaattctgaattttggacaaggattttttaaactttgtcacaattggccaacgatcactcagaggccggagtatcttggctacactgatcagcaattagtcctcccagtcttgatcactgtgatttgtttatgatcgaacccactgctaaaagcagatcatttttggatcattctgatcaaaatgtctgagcgcaaaaaatcgatggaaacaattaattaattggccaattaaggcactgatgactgaccggtgagcccgctgtaggcacttgcgaattgcatccacgcgcacatgcgttcgggcgtcaccgacgcttccgcgcccgcggcgtcgcacgcgtcctcgtcacattctgccgcttcagttgtctgcccctccgccgttttgtatgccaatgcgtccaatttgtgcaccaattggagcgcaaacgcgcggcactctgcttctttgccgccgccgcactctccctcttgtccgctctctcgctgctggtgctgctctgccatctgtcgttgtacgctatctcctccgtgccgcttctctgcccccctcgcggcgccgcgcatcatcgcgtattgcatgtgctcatgcgtcagacatgcccacgcgtgcggtgcgcacgcgtcgaagaagttttcacacatcggctcgcgctgtagacgctccgtgcgctcggcgcgcaaggcaggcggaagaaattcgcagcagccactgtggggactgaaatggggcggtggtgaaaaatgcaaaacaaggcaatggtatacggtagcgcaaaatcacagagtttggctcaagtgaatacggtaatgtcggatgggcaaaaaaaaatttgtgacctattttagaatttttaatagaaaaagtgttgtaaaagacagattaaattttaaaaacattcacaaaaataaattgagaaattgaaaatttaattaattaaatatatttatctttaaaaaatcaggaaaaataaacccaaaaagataaatacgtctttaatctagaatttgccaaactttgtaaaggttttttaagaaaaaanttatgaaaa

SEQ ID NO: 1145 - DNA, 1831 bp, Heterodera glycines
tctcgagcatgatagagagagcgctgcgcaatgtataatatattgcacagagaatttgtgtcatctgaggaattccagaaaaatggatatctatttttctgaaaaattttataccgcacaaatgctctcaagcatgatagggagagcggtgcgcaatggttattatattgcccagagaatttttggcttctaagaggaattccagaaaaatggctatctatttttctgaaaaattttataccgcacaaatgctctcaagcatgatagggagagcggtgcgcaatggatattatattgcccagagaattttaggcttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatggctatctatttttctgaaaaattttataacgcacaaatgctctcaagcatgatagggagagcggtgcgcaatggatattatattgcccagagaatttttggcttctaatatctatttttctgaaaaattttataccgcacaaatgctctcaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgcgcaatggatattatattgccccagagaatttttggcttctaagaggaat

SEQ ID NO: 1146 - DNA, 1267 bp, Heterodera glycines
tattatattgccagagatttttggcttctatgacgttttcggaaaaatggctatctttttctgaaaaattttataccgcacaaatgatctcaagcatgatagggagagcggtgcgcaatggatattatattgcccagagaatttttggcttctatgaggaatttcagaaaaatggctatctttttctgaaaaattttataccgcacaaatgatctcaagcatgatagggagagcggtgcgcaatggatattatatttcccagagaatttttggcttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatggctatcatttttctgaaaaattttataccgcacaaatgatctcaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgtgcaatggatattatattgcccagagaatttttggcttctgaggaattccagaaaaatggctatctatttttctgaaaaattttataccgcacaaatgcatgggcaagccatgatagggagagcggtgcgcaatggatatt

SEQ ID NO: 1147 - DNA, 5521 bp, Heterodera glycines
gattgatctcaaaaacgacgattgaagacgacgaaagtgatcgtggcccaatttgatgaatgtggaaacggaacttttgaatgctgttgtaaagcaatttccgttgaattccgatcaattaattgttgagattggaaaagatgaagtgctaaaaaaggtcatgaagtaccttcgcactcaatggcccacttcaaagaatatgtctttagaaatcattccatttcaccgcaggcgagaagccttatcaattgagaatggatgtattatttatgctgaccgggtggtgatccccgcatcacttcagaaggaagtcttgcagcaattgcaccagggacacccgggaatgaaacgcatgaaaaatctggccaggcaatatgtttattggcctggaatggaccagcaaatcgaagactccgttcgatcttgccaagcttgcgctgaagaagcaaaagcacctgttaaaactcttcttcactcttggccaaaagaagacggcccatggaaacgagtgcatattgactatgcagggcctttctttggaaaaatgtatttaatttgtgtggacgcattttccaaatggccagaagtctttgagatgagttccaccggatcagcagcgacgattgacaaaattcgttatctgtgctctcggcatggacttcccgaaacacttgttaccgacaatgggacacaattcacttcaaatgaatttaaggaattcacgaggaagaatggaatttcccatctgttttcggcaccgtactgcccgatgtcgaatggacaggcagagcggtttgtcgacactttcaaacggacgtttcgaaagttgaaaaaggagggggtagcgaataggttggatacgtttttgacaacctatcgtaccactcctaatgagtcgctggctggaaacaagagccctgcagaaatgtttatgcagcgcaaaatccgaacgactttggatcttctgcggccgaaacggcgcccaatcatcgaacgtgacgaaacgatggaaaggagtttcaatcgccgtcacggggcacaaccaagagaattcatggtcaatggcaaagtttttgcccgacatcgaatttctcaaccatggaaagccggacgtgtcactcaaaagaaaggagtaatttatgacgtgtcattttccgacggatcgtctagtaggttccatgcgaaccaaatgttggttcgtcacacgccggactatgaggaagaccccttggatatgcttaatgatgcatttgggcttcctctggccccatcggtggtagaaaaccctgatggacaggctgaagttcaacttcccatgcgtgccgacacaccggagccactgaacgatggaccactcgacgaagatgtaccaagtatccccgaaggacggccgaaaagaaacagacgccctcctcagcgcttttcgccgggatgatggacaaaccgattctttttgatggaggaggtgttaggacgggtcatatttaaattgtatttggcattctgtcccctttgccacgtcatcattttgaccccattccaattgtccttaaatatcctcccatttctctcccctcgttgttcatcaccactcattcattttttttgtcatttcccttcacttgaccccaatcaatattatttgtgtgccttgtcctatttaatttggaataaatatttattatttattctctcggactcatcggcataacattggcgacgcccgtcgacgactttacaattgttttgtcttcaaattgtgcggcttttccgctgtttttgttgtgtgattgttcaacaacattcgccactcaatcattttgttgtttgatttttttttttcaacaacaaattttcgtcgactcaatttgaattttgtttgtgaacaaaatttcttcaacttcaattttgttttctcaaacaaatggcactgaccgtagaacagcttttgcaggcaatcgcacagcaaaatcaaaacccgtcactttcaggcattgacttgtttgaattgggcgatgaaagcaccaacattgaggattggttgcagcaattctgcttcgcgttggactgctcagcgccaaatatcaaagatgagcagaaggtcaaacttctgatgacgaaattgagcaaggcggcattcagcgagtacaagaagtcgtgcctaccgaaggatgtgactgactacaatttcgccaaaacggaggagcaactcaaggcattgtttgccaaaccacagtcggtgtggatcgacaggtatgagtgcctccgggctttcaagagcgaggatgagaacttccgctcattcatcaatcggcacaagcgccttctccgggattttgagttcaaaaaactcaatgaagagcaattttattgcttaatgctgttaacagctttgaaatccccgaaggatggcgaacttcgaaagagaattttgggcaaattggcggctgatggcgacagggcaaaatacgataaggtcgtggaggacctacaaatgtatttgtccacaattgctgaagctaaatgcatcgagcagcagccagccccgccaaagcagattttggctgtaaagcaaaattgtgcagtgagaaccaaaggctttgaagcacgtggtcaagtgcaacagcagctgaaggtgtgctggcgctgtgggcgaagctcacattttccaagtgtatgtccgcacattaaagttgcgtgccggaagtgcagcaaagtgggacatttggaagcgcagtgcaaccaacaccaagcatggctgataaggcaagggaaaatgcaaagccgtaagcaaggcaacctcaagcttggaggtgtgctgatcaattcgatgaaccaaccgaaacggctgattgaatgccctattaaaatgaatggaaattttgtggaattcgcgctggactcaggtgctgaggttgtagtggtcaatgaagagacacatgaagcgatcggaaaaccgaagctaagtccatgcaatgttgaagcgaaataccacgacggaacaaaatgcacccttattggaaaaggggaagctgagttcgaattcggagggataatccgaaaagggcaattttacgttgaggcaatccgaaggatgcccattccaaccaatgtgtccactctccgatcatttttgggaatggttaaccactaccaacaattcgtaaagaatttgcggtttattcgccaaccgttggacgaccttttgaagcaggacacggtctggaattggtccagcgaatgtcagaaagcctttgatcaggtcattggcacgcttcagtcggaccaactgctcacacattatgacccatcacaagaaataattgtgtccgctgatgcctctgagcatggtatcggagcagttatttcccatcgttatgcggatggaagcatcaaggccatcgcgcatgcatcgcattcgttggctccggcagaaaggaattatgcccaaattgagaaggaaggcttagccttaatttatgccgtgcaaaaattccacaaatacctttatggaaggcattttatcctgcaaacggatcataaacctttgctgtcaatttttggcaacaaaaaaggaattaaatcctgcaccgccaatcgattgcaacgttgggcattgattttgctcgcttatgattttgatattgagtatcaaaacacatcggagttcggacaagcagacgctttgtctcgattgatctcaaaaacgacgattgaagacgacgaagtgatcgtggccaatttgatgaatgtggaaacggaacttttgaatgctgttgtaaagcaatttccgttgaattccgatcaaataattgttgagattggaaaagatgaagtgctaaaaaaggtcatgaagtaccttcgcactcaatggcccacttcaaagaatatgtctttagaaatcattccatttcaccgcaggcgagaagccttatcaattgagaatggatgtattatttatgctgaccgggtggtgatccccgcatcacttcagaaggaagtcttgcagcaattgcaccagggacacccgggaatgaaacgcatgaaaaatctggccaggcaatatgtttattggcctggaatggaccagcaaatcgaagactccgttcgatcttgccaagcttgcgctgaagaagcaaaagcaccagttaaaactcttcttcactcttggccaaaagaagacggcccatggaaacgagtgcatatggactatgcagggcctttctttggaaaaatgtatttgatttgtgtagacgcattttccaagtggccagaagtctttgagatgagttccaccggatcagcagcgacgattgacaaaattcgttatctgtgctctcggcatggacttcccgaaacacttgttaccgataatgggacacaattcacttcaaatgaatttaaggaattcacgaggaagaatggaatttcccatctgttttcggcaccgtactgcccgatgtcgaatggacaggcagagcggtttgtcgacactttcaaacggacgtttcgaaagttgaaaaaggagggggtagcgaataggttggatacgtttttgacaacctatcgtaccactcctaatgagtcgctggctggaaacaagagccctgcagaaatgtttatgcagcgcaaaatccgaacgactttggatcttctgcggccgaaacgacgcccaatcatcgaacgtgacgaagcgatggaaaggagtttcaatcgccgtcacggggcacaaccaagagaattcatggtcaatggtaaagtttttgcccgacatcgaatttctcaaccatggaaagccggacgtgtcactcaaaagaaaggagtaatttatgacgtgtcattttccgacggatcgtctggtaggttccatgcgaaccaaatgttggttcatcacacgccggactatgaggaagaccccttggatatgcttaatgatgcatttgggcttcctctggccccatcggtggtagaagaccctgacggacaggctgaagttcaacttcccatgcgcgccgacacaccggagccactgaacgatcgaccactcgacgaagatgtgccaagaatccccgaaggacggcccaaaagaaacagacgccctcctcagcgcttttcgccgggatgatggacaaaccgattctttttgatgggggaggtgttaggacgggtcatatttaaattgtagttggcattctgtcccctttgccacgtcatcattttgaccccactccatttgtccttaaatatcctcccatttctctcccctcgttgttcatcaccattcattcatttatttgtcatttcccttcgcttgaccccaatcaatattatttgtgtgccttgtcctttttaatttggaataaatatttattatttattctctcggactcatcggcataacattggcgacgcccgtcgacgactttacaattgttttgtcttcaaattgtgcggcttttccgctgtttttgttgtgtgattgttcaacaacattcgccactcaatcattttgttgtttgat

SEQ ID NO: 1148 - DNA, 5399 bp, Heterodera glycines
  misc_feature (5)..(5): n is a, c, g, or t
tacgncggcgggattttggtcggttctgacgaaatggaaagtggtgtgctgcccttgtcggatctcgacgagtcttctctgttcaaattgggccttgggttcgtcggacttcacccatgagagcgcaatttgggagtcagaccataagtgtcgcccgttgatcgggcgccggagctctttctcggcgaaacgcatggcgcgaattccgacgaggatggcgaggagttcgagtcgagggatggtgaagcgctggttcgcggttcgtggccggaggcggtttttggcgaagattaggttcgcttcggagctatcggcagtctcgcttcggatgtagacggcagcggcaaatgtgtgttcagaggcgtcacaaaacacgtggagttgtaggcgactttgcttgccgagaatggagtgccaagggatgactattgtttggttttgccaaagagaaagggtttggctccacgtcgccgcctcggtgtcggggaggggggcatcccaggcggttccttctccccatagccgttggaagagccgtttggcgggcagaagacatggcccgactagaccaagagggtcgaacgtgctggcgatgatgctcaggactgaacgccgtgtagcagtggcgtctgtgtctttcggcagactgaaagtgacgcagtcgcttggggtgtcccaggtcaggcccaaaactttggccggcgttttgtcgagtcggtcgtcctcgggaatttgcttcatgacgtttggggagtggctgaggaactccctgaggttcatgtcggcgtctttgaggatttgtttggcgattgatgacttgtcgattgcttcctcctccgtctcgcactcgatgaggagattgtcgacgtacatattcgcggccaacgcttgggcgaatgggtgctcgtgcttgtcgaagtgttggaggagaacagcggcgaggataaagggagaacatgtcgcgccgaaaactagccgtttgtagcggtagatcaagagattgtcgcctgagacaggacgggcagggtttttcagccaatgcattttgcaaaagcgcctgtcctcgggttcgacttcgatggcatgaaaggcgccctgaacgtcggccaacacaggaattgtcgctgaacggaagcggaggagaatcccgcaaaggtcggggagcaacactggcccgcggtgaagacagtcgttgaggcttggggtgcccttggcatgagcactggcgtcaatgacgatcctcagtttctttgggttgatgacggcgtggtgaggcaaaaaatgctcgtcgttgtttcgcccggtcagctcaataatgtcggcgtccatttgccgtgtcagttcggcggagtaacggtcgagaagctcaggagagcattgcagacgcttggtcgttgagaggagccggcgatatgcgatggcccaattcgaggggaggggaggccgaggttcccgccaagtgaggcgaacggagtaacggccagacggcaattggcggacggtattgctaaattgctgcatggcaacctggtcgtcgttctgattggggtcgtcggtgattccaatcgcctcgagactccaaaagtcattgaccgtgcggaacgaggggaatgactcgacgttactggggtgagacgtcagcatggcaattgtcggggtgtgccgtggggtctcgggaaactccgcttcaccaccaaccattgggccgaaaattgtttggatgaggtgaagcccggagtgaagcgttgaacggccaataaagaattgccaaaattcccggatgccgatcaaaatgtccggcgccttttcgacgaccttgaggacggcatttggggggaggggtccatcggtggtgtctcactggagggccttgattttggtcgtgatctcgtcgattacgttgagctcgagggtctcccagcctccgtccaggcgctgcagttgaatggcgaattttgctgatcggacggtcttagggcgggagtctccgaaggtgtgaattcggaggaggtgctctgagagtcgagggggtcggagcttctctgtcattgcccggcttatgtagccggactggctgccagggtcgtggaagacaaaagcaggaattccgtcgggtgggcccccttggcatgacgccttaagggtctgagtcatcaaatgagctactctcgtcgatttggggacgggaaaactgccgctgtcgacggggagggggtcaaaggcggcggcgcataccgcctcgggaatgctttcgccctcgtcgcacacgagcagtgcggttgtggtgggagtcgctctcggtcggaccggttcggcgttggctcccgtggcacgactgacgttgcgggacgcatttccattccgctcttgattctcttgtcgatggtttgttcgccccggggggtcgattgacgggcagaggaggaagtgatggtcgttcgcctgacatttcgaacatcgatcttgacgagagcaatcgcgagtgatgtggtcttgacggagaacgcaggcagcgcccctgttcctcaagtcgtcgccggcgttgaatgacggtggtgtatcgctggcacgcactcggacggtgtccctcctgctcacaaagggagcaactgatgccattggcagagacgggttgggcgagagcaggaaaggcccgagtgttctccaaataacgtcgctccggcgctggtggtggtggtcgaaaagaacgaccacccggacgagagggagcccgttcgggaggacgttcgcggggctggatgtccatgtcctggaatgtgcggacgcacaagtccacctgctctttgtcggtgacgattgtcgcaaatccctcacgccaatttcgagccgtccaggaagtgtagctctcgcgctccattcggatcaggtcaagcagtaccggtggtggaagtttgcttttgatgagattggtgaccagcgagctgttggcgattggcgagagctccccctcgggctcgagactgcaaagttgggtgcagatccgctcgatctcttgctggagttggcgcaactccttgaggttgttccgggcgggtttgaggtggagaagctgggcattgagttggtcccgtcggttgccgacatcgccgtagcggtctcgtagaatgctcacgactgtgctgtaattggcgtctgacggtgggtaaccttcaatcatccgtcggggtggcgatcccttctcaaggtactgtaggaggaggaggtgcttttggaaggcggggtattggcgcgagtggacggcaaagtcgaaggcggcccaaaatgtgacccattcttctgccgatccgctgaacctcgggatttcgattcggctgacccggagtgcgtcgtcgtcattggtcgactgtcggaagtggccatggtgaggttccgatcgatgggtggggcgattcgatgctcggggaaatgtgaggttaagcgggaatgccggggttcgctggttgaatagggtttgatcggctctagccgaattggacggctgatgtgcattcgctggctgtgcctgagtcggtgggtcggtggattgccgttggcggtggatccggttttcgtcgtcggccccgtgatcagaaacacgactgctgctgcgagaagagatggcgtccgtcgtgtcgaatcgagcctcgatgtagacttggaggccgtcgaggatgagctgggctttagagagaagagtgatgactggccattcttcgacatttgggtcggcttgctcgtcgtcgaaggtcgggagtacggccagaaggtcctcctccgcctgcttcagaaacgggtcgcctagcagctgaatatggtcaaaacattctcgtagcatgccattgacgcggtcgatgcttctctgtagcaattgtcggtcagttcgtacgcccttggcgagtttggtctcctcggcgagcgggatttcctctggcgccatcctggtgaattcagtgagcctcccgaccctttgtcggaggcgcttgacgaggtccgaaagggttcggacttcggcggtgagacgttgacgaatgagttccgacatttccgaaagtctaggattggcggctggacgcaagagtcgggcttggttggtcgagagcctagagaaggcggctgtcggttggtgggttgagtggagattagccgagagcccgagagggacggctgacgataagagttgagtggtgaaagccgggagcctaaagggtcggtttaagaggacggctgacgactcaattgagggcttgtcggaagcctaaaggggggctggcggcaaagagttgagtgatgaaagccgggagcctgaaagggcggctggcggctgggagaagagtgatgaatggtcgaaagcctgaaatgggcggctgacgactcggtgagggtttgtcgggagcctaaaagggcggctggcgacttgatttgagtgatgagtgccggaggcctaagatggtcggcggacagcgaagggttgagttgccgggagcctaaagggtcggctggcggcagagagaagagtgatggatggtcgaaagtgaattgaagggcgaagggttcgtggtcccgggtcgtggcaccaaaaagtttgtcgaggaaggggggacaaactgggggagggattgggtcaattgaagaggacgacaagactcgccacactgggcggcgacgctgaaggcgagagagtggcgaggcgagaggagaggggggggggcagacggaatgccgttctcgcggtgtgagtgacgagaggggggtgtgttcctcccgtctctaccgtccctgatcccaccaacacatcgaccaacaacaatttatttgacacgagaggaaagggccgagggggttaatgcaatcggcattgaagatggaaaaattggggagaagaggagcagtgattatataaagtgtgtgtatgtgggggggggggagccccaggcttaagtaaacagacacagagggggcgggcgacagaagtaccatagaaaaatgggaaaaaaacgatttgcagatgtgaacaaaaattggccaaagggagacaaagaagaaagaagaagggggaggaaaaaggctgagaaaagcgacggcacatttgaataaaaggagagaggcgaaaaaacgcaggagaaggacggggagagacaaagagaaaaagtgttaaaaagggggtgtttggacaacttgcccccgggggggggggggttacaagtccaattacaaaaacatgaggcagagtgaaaagtgacaaatgaaaaaaggaaaaaagggggaacaaaggatcggtcaacaaaatgtggaaggagaaggagaaaaggagagaaataagaaacaaaaagggggggggaaagcaaaaggaaaatgcccaatttgatctctttcgaatttgatcattcccctcgtcgcat

SEQ ID NO: 1149 - DNA, 9959 bp, Heterodera glycines
aattgattggaattgaattgctaaaataattaaacttaagtattttataaataaattttgaaatggtgcggccaacgaaaggcactattcaaaaacgcaatgccgcggcggcgggacgcgccgttatagaggcgcaaaaggcaaggatggccgctttgaacgaaatgctagctaggaatgtgccggcgaagaatggtgatccggcattcttcgagatttgccagcaaatctgggcaattctcggccaattcttgggtaagtttgtcttatttggtatggggaaggcggaagatggggaaagaaaaacggccaaatgcaaaaatgaatgattgtaaggatggaaaagggaaaaaatgggaaagaaaaattgcgagatgactatcagtggatcggtgtaatggccgagaaagccattaggggaggggcataaatgtatgcaattaatgtgtttttatttaaaatgattaaaaatgattttaaatatatatatttatttatttgaggaaaagtttcgaaattataatcaaattaaattaattgtttgggtttaaattgtacttgaaatgtccttaaataattggctaaaggaaaagttgaaaaaaatggaggttactgtaggttattttaccggtccggctttaaggggaattgtggccagtgactttcggctatttgaccaagccagaggaactcgcaacggcatgggcaagcagtctgccggcgcaagtcggcctgcacccgctgcaccattcgctgccaatgaggcgactcgtgtcgtctttggcgcacgagggcctgcacatcctggaattccaacagggaaggcagtggccgagggctggcaccagcacgaagcacgatcatgggccattttttcgtgccaaatgtgccgaattgattgagatttccggtggactgatccagccggaatgcaaagagtttgaccatttgtgaattttggttatttttattattataaatttgttaactttgattttattatttataagaatataattaaaaatatttaaactcataatttaatagaaaattggaaaatatacaaaaattaattattattatttattttttttttaaatttttggtcaaaagtttaagacataataatttttcaaaaccaaaaaattttaaaattctggtcgtgtaggattgttcatgggactctctgctatcgaatgaactataaaagaaatctgtatgataagtctgagtaaagttattacgacttttatgtcacgggttttattccactaatggatttcctacattctttaaattaaattaacacattttcaatctgagaagcgtttcggtcgttgtattgtcgttctatctcttaaacgccttgatttctctgctgtttcatcatttctgttgttgtccaatgtttcttggttagtgtcttccacgtctgattgggctttttcgttgttttctttttgttgttcggacgtattttcctgaggccgatgagaatacccgggcatgttggtgagctcttcagcttccgctttgtcaagggcttgatgttcatcttctgtaagagttggcttggtacaggcaggtcctggtaattcaaaacaaagttttaattggttaatgtggacttttcgtgggtttgcctgaggggaaagacaggaaacgattatggcatgaatgccatccaaacttacgacacggaaaatgcctttccatggcaaatgcagcttttttgaagtgccaggctttccggcataattacgcaaaaggactctatcgcctaccgtaatttttgacgggcgaacagatctgtcgtactgtagtttcatccgcaattgtgcttcttcatttgcttctgcagcacatttccaagcagttcttaaagtggtgaccaatttttgcttaaattccattgaatcatccaacgctaccgggtctctaattgtcggaaatagaatttggtcaacactaaatattgggtccctcccaaaaatgaggaaaaatggagattcttttgttgatgtgtgaacggatgtgttataacaaaaatttgccatttcaataaattcatcaaaatcggggtcatttttgttgatatattttgccaaaatattgtgaaaagttctgaaagttcgctcagttatggcatttccttgggaccaatgaggtgttgcgtatttttgtccaatgtaaagcaggctgcatagttctcgaaagaactcactcgtaaatgaggttgcttggtccgttaccaattcggtacaccctccaaattttaaataacaattagtcagaaatgcgcgagcaatagtccttgctttggcatccggtaatgggactgatatcacgtatttcgtgaaccaacatacaatatttaataaatatttattacctctaatcgttaatggaaagggtccagctaaatctaacccaactttagcaaagagtgtattaaccggggtgatggacatttcagctctataagcaggtgttggattgtttctgagctgacaagtaacacatgcttttgtccaaattgctatgtcctggtgcatttttggccaaaagtaccgtgtccggcattttttaacagttttgttggtgctcatgtgaccgcctcccagtggcgaattatgaaaagattcaaatactaacaatcgaagagaaattgggatgtaaattcggggtttaagtccatgaggtttaaagtacagtataccagaatttaaacataaattaattgcgaaaatggtcatttgctctttttcattctcatcaaaacctcccggaaattcacctgattccaaaaatttaatataagcggacgcttccgggtctttgtgttgttcctgtaacaaatcaacttggtaagaggtaccatcatcatgtcgtaaggtcagtgagccaatgaaagggtccaatacaattcgtgagttcattgaaagtgagaggcaaattgggaattcaacaatgtcgtccatttctggtagttgtgccacctcctgaattggcacatcttcagcagaacgagaaagcgcatcggcgagggtattttgtttccctgaaatatgtacaattttaatttggtaattttgtaattcgatcagccaacgggctaaatgaggatgtgtatcagacttttttaacaaaaatgctaacggtttatggtcagtatgtaattcgatatcacttaaaaaaataaatggtttaaattgccgtaaagcataaataattgcgcataattcaatttgtaccggaggccaacggcgttctgatgcagagagggtccggctacagtaagaaatggccgaaaatgtgcctgattcatttttttgcattaagactgcaccaagcccgaccattgaagcatctgaaaatatgtgaaatgtttttgaataatcaggaaagaccaaatttggtgcttgggacagtaattcttttatatggttaaatgtcttatcatgttcagcactccattcaaacgggacgtctcgtctcgagagacgtaataatggttcaactaccgtagcaaaattaggaatatgccttctgtaaaatcctatttttccgagtactcttttaacatctttaagatttttaggagttgacatttcttgaattatttcaattcgactcatgctcggcttgtacccttgggtgtttaatgtgaaacccaaaaacatcatttcttgggtggcaaatacacactttttaggactcagtttcaaattgtaaagcctaaatttttcaaaaactcgtctgagggagcttaggtggtcccaaaaagtaccgtccttggtgtagactaaaacatcatcaacatatgacagagagcagtcttctaaaccacttaataccactgccatggctctcgaaaatgccgcagtcgcattttttaaaccaaaaggcatgtatcgcatttgatacacattgtcctccgttaagacgccacatttccatgatgtgtcatcactgagtttgatttgcatacatcctgaggataagtccaagctactgtagaatttgcaacttccgactttttccataattgaggctaatctcgggagtgggtatctgtcgggtatcattacctcgtttaattttcgaaaatctaaacatggtctaattccaccatcctttttctgtatgtctcagattcaaccattactcctttattaagcaattgttcaatatgcttctttaattcatctctgtatttatatggcattcgtcttggcggcgaagaaattggagcttcggttgtcgtgtcaaaatgatgttcgccacctgaaaatgagcctaaatcatattgactttttgaaaatatgtccttaaattcttctaaaagatttttaagtgcttctctttctctttcattaatgtcagattttgagaggtcaattttgaatgatggatcagttaatccatttgggtcaggattcccgcttttaattttctcctggtctgattcgtagaaaattccatcattttcgactatttcgtttaaataggctaaatgcatgcctttgaataaaatcttaggatcatttgatggattaattattgtcaacgggatatcctccacaaatggagccgacacacttggtacaatcccaaggtcattgtttagcaaatttaaatcgggcttatccacaactaagctgtgttttggctgtaaggcagttttaatgtttgctctgatcattacttggcttgaaggtggaattgtgtaattttcggcagcaaaggctcgaatattgttcattaattcataatttttggagcctaagcttatccattgtgttccaatttgaattttgtttttgtctatatttacggtaaaagggccaaaatgtcggagtgagtcacatccgagaattaattgataatctcggttgcagacggatttttgttcatttacaaaataaatagtaattgggacacaaatgtctgccacttttagcattacctttgctttttcacgaaatgaaattatgtgaccacttgcgctgattgcgtcctcatgtgatggtaccgttttgcagcccaagatgtcaatcagtgcccttgacgccaccgtgacacttgaaccggtgtccacaagacatctgacaatttgtgaattaattatggttgaaattacagcagtgttagataatgacatcattgacagcaattcagaattagctcctatctgagttaaagcatttacattaccaatgattgttcgatttgttgccgtttcggtttttcttcttaatttaaatgaaactcttcgggttttgttccttaggggtgctttctcaatttctgataacggcctgatcggggtgtattctggtctctcatttacaaaaccggatcgttcgaatgattgggatgacccaggcctatcatcaatgtgtgtgttattgttccgcttctctgtgttactacgtcccaaatttatgtactggtttctcaaaataaaataaaaacgaaggattaaatcagctgtgttgataaaaactaaaattgttaaaattttccagaaaatcccatcccagtcaccaataagaaaatgtttgaattccttgcctgttttagtccattgttcgtcgggcacaattgaagttcctttattctgaaaatgaattcgaaaagcaatttgtgactctttgatcatgttacttgtataagaatgggtaagaatatcagttacatttgttaggaccaattggtgaaatgaaaatggctggagaattggggtggtcaattgattgaaactcaaatttccaatttctttaattttaattctggaaactgaagctgatttttgatcaacttccaaaatttcattatcaattacaatcatttgtttctgattgcttgagcacggtgcctttttcgatgatggatttatgatcattgttgttggatcgacaaacgccatttggtggattcctctcatctcgattttgattggaagaaattcaaaacattcatttgtcacaggatttgattcctcgagaggataaaatgagtactgattcggctccaatggcacacatggccaaattttaataattcccggggccaaatttttagcaaccaaatttgggttcttgaaagttatacgggcaaaagtaattggttcagaaatcgaggcggaaataacccatcgccttgtttgttccatgtattcacaaattgagtgagtggtatgttgaaatgaaaatgacatggtatttgaaatgttccagttaaggaaggataattctgaggctaattgggaggaggttattaacccatccgtggtgcgtgtaactcgggttctcttccttcccctaagacttactgtgtctgctgcaaaaccttgttgtgaaattgtgagattcctgtcgcagtctaaaattgttttggcattatgagaaaattccaacattaggggctcattggacgaaatccaatgctgacccatcatttcgcctttccaatttccaatgctttggaattcacagtttgtttcgttttctggggtccaaacaattaatgaattgtcctgagttaaacaagtgcctttttcgtatggacaatttagctcttcaaaattttgaatggatactgtatttcctccaaaatgggatgtgatatttgttgggattaaataacaattatcaataaaaactgtttcccatttccatgagccaattaaccaatggcgaggtgagttgtcaattttcaaatcagtatgccataagcccgagtcttcaatcagtacccccaatttacacttacggtggcgaatcatttgccagcattcatctgaactaatttcgagcggaattggttcaagcatctctgaaatgggaacatttgtaagacttgtatatttcttgattgattttcttatttttctgcatgaccaagccggggtttgatgttcgaaaacatttggagtgtacaatcgaagtgacttaattttgggattttccaaataatccaatgagaactttgggcagcttgacaaattaggaatttgccaaagtactccatcttttatcatttggcataccatggggtgtttgggaatagtattagcggtagtggtgttaatgagaccggtaatgagtaacatgaatgctgtaagaaccatgaaatacttggacaattttggtccaatcccttcccactgtgagattttctgctggtcacttggttcacatggattaacctgagttttacctgttccttggtaagcaacttcagcaactcttgggtgatctgcaggcattgtgctaatggcattcattgatgcagattcatttccacctcttgaagacgggccttgagtgttcataacactgaatgctctaagcaattcattgatgtccaatgtgacatttgatgattgacgatttgcatcctggtgaaattcgggagagtcgtgaatggcatttaggtttggtcctgaatttggggtgaattgtctttgagaaaattggtttttcctctgaaagcaattgtatgccatatgacctgtcctcttacaaaaagtacagtacggtcgttgattccagctgcggtcggccatgttgtttggtcctcgccaatttcctcggcctctttgtctttggttgaaagtgccgccaccacgtccttgtccatatcttccacgatttgggctgtttgaaaaattgcggtatgaatttgatggtcccgcttcatttgaattgtagttctgtcgtcggtcccgttcacggcttggcgtccatggattttgttggacggcatgaactgtttggagaattgggtcgggaatttgtcctttatgagttttaagaagcagttcaagctcttcagcttgggctttgactatgtctaactcttttccttttgagagccctgtgagtctaattaaaaatgctaagtcaggtctcaaacggtcaattaattcctcactcaagcgctctttaagctgatccgggtccaggtttgaataagcaacttccactaatggggccaaacgccttaaaaatattcccaccggttcatcatcccgttgtttgcacagtgccaaatttcttttggccaattctttgcgttgtggtgagtcgagtttttctcttaaaaatttgagagctcgcaatactgtcgttgtttctgccggggtgagtgtgtcgtacaagtcgcgtggtacgtcgtctaaggcgaggcgaaggcggtccaatttttcagcttcatccaaatttttgcctactacttgaatgtaatccctaaatcgtctcgaccatttgtcaaatgccgttactgattcttgagagaaaatttctagacccgttactccggttaatgtattcacttcattgttattgtcaggattctgttccacgaatggatctactcgaattaatgaggtattttgttggccatttcctcctgtaaaattcacagaattccccccttgagagtctgttccatctttgtgttccaatttgaaaaggtccattctatctgagagtgatataatttgggcctcacatgtctgtagatttgtgttcacttcagcagcggcgcgattgatggcatcataatttgctttgacaagtctattaatgtgcctaagtgagcggttcactccgtcttggaaagagacgaggtcattgttggccttttccatgtctgctactgtaacttttgtttttcccgcccaaaattgtcggtctatggctacgacttccacccgcgcatcatcattattttgtccgaattccatgtttatttgcgggttaatagactctaaagtctctgacgagttgaagatttgtggccgtaaaggtgaaagaaacgtaaatttataaaagttcggggattgagggcgagagtgattgattttgaatagaaatgataattttgttttgtctaaatttgtttaatgactaatgattattttgaattgaaaaaatttgactgctttaacttgtgttttttttttaatttaatgagttattgtcagtcataataataattattagcattttattccaaagtgattaatgcgaaaggtcggttctccgattgtgctttggcggaagtcatatcatgtttattaatcgcaataaagaatgagcgctgtgaattttcattaaattgaaatttgttcgccgtatcgtgagaaaaacggaataagtaatctctttttttaaatctgattatgaatcggcttttaatcgtgagaaaaattttgcaattttgcgtttttaattgttaaaaagatattgaatttgaattttgaatatcgaaaataattaaattttatgtttgtgaaatgattgaaattttggagaattggtctatttttaaatttggcaatttggcaggagtttggttaaattgatttgcataattttgaattgttgctttatctttttttttgagttaattatttaaatgtttttctattaataattcgtaatactgtcaggattttaatactcgaaagcatcttgcgcagtgtagacattggaccagtacagtttgaataacagttgaattgagttgtttgtgagttataacgtttttttttttttgtgtttgaatgatttttgaatgtgtgatttctttctctctctttttttttttgactgattttgacaattttgtttttgactattttttgaatgaataatttcttttactgattttttttttttttttttgaatgttttgatttttttttttaactaaatttaacggccgggttataatgctcgaaagcatattgcgcaatgtagaattaaagctgcagcttgagccagtcggatttcatcccctcgctggatcgtctttccttcgactcgaaagtcgaaccatccggtgctaccagtaagacgtgaggatccatgccagagcgggatgggaggagacggattgtcccaggactgaagggtcttaatcttaggaatcgggccctgatcccc

SEQ ID NO: 1150 - DNA, 4760 bp, Heterodera glycines
tgcaaggagaggggcgactggtgtggtcgacttggcccgtctcaaccaatgccaatcgtgtcgctttcgcaaatgtttggccgttcaaatgaatcgcaacggtcagtcagtccattgattggtcaaccgacaaatcagtgagcagaaacatttgctgctgcagatctaccaaccaattgtttggcataagccaatatttaaatgcaaaattaattggtcataattagtccattttcgattgatccgtcggctgatcggacaaatcgaaagattttttccgtcgtttgcccattcattcatttttttgttttttttcagctgtccaaaatgaacgttctgcattgcccaaagttgcgcagtccgtcctttgctgcgacgcttcgcaaaaggcgagggaatttccgccgccgatcattcggtcggtttttgtccactaattaattaatcgtttattgttttttgcgctttctttgatcaacacaaaattaagtcgcagctccatcccttgctcaatggtggtggccccttctccgttcttcagcgcagtctctgctgacaatgagaacgaacattcgcaaaactttgcactttcgaaagagggtaatgggaacacaacagaatgatcagttggggaataatcagatctgagcaggaaaaattaaagagactgatcagcagaacagaccattttagggagggaaacagaggtagaaaaggatttatggatcaacggaggcaagaaatcatccggcccaccccatagtttttcgtaaaagctcagctcgctcatatattcaaaaaagagtctgatcaggtccattttgggaacttggtcagaactgatcacttttgtggagagtttcacttctgatcgagaagggactgtcacttctgtgattagagagagtcttgccatggctgtgatcagtgtggtcactccccccccccctcccacaggtggtctccccactttaaccactcaaatgaactgtgccacacgtcagtcgagtgtggtgagtgccaacaaccagatgatccaaccgggcccttctgcgcttcgttttgatcagtccaatggcttttccatcgcccgccttttgccctcttcgccgccttttcattttccctcttcccaccgatcgttcgctttcctttccgttctgatcacttcgctgcatgccttcccgccctttcgcgacctcatttctaagcagtgcatggattctctgttcagcgacggatggcatcgctttttcctcgcccatttgcctcaacttttcgcacaaagttcgttcatttttttgatttttgctgttccgcagtgacttttccacgacagttcccctccaaaatgtgtgccacaataattcgtcgcccttcaccaatttgtgccaacaattggcccaacttcggctcaatgcctttgagcaatggcttttcggctgtgccgcccttttccatcaaataaacaaaagtcggtcggctgtaacaaaaaccgattcatttatacatacaaagctcaaaactttcttcagccgtacttcagcaggatgagttggaacttcgtgccgttgccacacttatcgactgttgcctcggtgtgcaaatgccgtcgccaacactttttggcacggcacagtttcgcttggccagactttttacactgctggcacatattttcacgactgaagcggacaccgttctcaaccattttttcccgcgacattctgtcgaacaaatccgcagattgtgggagcaaaataaatgagcaaaaaacgcagaaaagaacggctctttaaattaccttcaaatcaatcatataaaatcagagtccgattgctatatttttattttgacaaagttgaatttttatgtgtgaaaggttttgtaaaaattaaacaaaaaaagcaaaatatacataatgaaaaataataatttaatttaaacattttgtgattttatctagaaatgtttgaaattaggcccgaaattttcggcaatcgaatcccccggcgtttccagaacgagaaacggaaacaactctccttgcataaattcaccagtgatcgtatggacgttactttctgttgtaaatgaatgggttaatgattcgttttttcgcacaaaccgaaaattatttttccatttttaaagatcaataatttctgcattcggaaatcaacacaacagcccatgagatcgccacttcccaaagtcgagtttccggggtgcccttctgtatttttcaaaaaggttccgttgctgctgtacgtgcatccaattgtaactgattttttacgcacaaaaccaaatgagaaatagctaaatatataaattatgaaaaattgaacaatacaaattataagtattgtaagtaccctgacaacacattgatttgtatttcatattgaaaacaatccacgtcgttaggcactgcgtgttgtgcgtaaacaaatcgtttatctttaaaaaagtatattggttattaattaaagctcatttgcagttaattagtgctggattatcaatggccgttaattaggtcatttggtcctcctcccgccccaaaagccaaggttcacccttttatgtgcacacatttctcacatttctttcctatgttaacagacaaattgtcgccatcaaataataaatctttgtgacagccaatgaaactgtttctgctcgaattgggcgtcgtcttctgctgggaaaacaatttaataataacactaaactcaactgatttccatactttcgtgacggaattttgcgccgtaacccctaaaaatgggggttatcaatagggatgaaatttatataaatgtccatttttttctcaaaccgtttgattttcttatccgaatcatatttatttgttacataagtaatttaaaattgcttgccaatttttcccaatggcgtgactttcgatttggtcatcctttgctgctgttccaagtcgaaaattcttttgtccattcggtcgacctccgtccccattcctgcaatggtcgtccccatcctcgccaattctccagcgacttttgcttcgaattcgtccgatcgtttctcaaacttcgcttccaattcgtccgatcgtttctcaaacttcgcttccaattcgtccgatcgtttctcaaacttcgcttccaattggtcagatcgcgtgtcaatggtcgtcctcagcgatgccaattcagcacagagcatccccattatctcgtgctgtgaaaactgggtaatggtggagatcattggtcccataataaaagggaaaaaagcccgattttaatgattttgcacttcattcgggggttatcgagggtgctgagcaagaatatgccatcagatttgtcatctgacgacgtcaaatctttgatttttcgccatgtctatgatttttcgtcaagtatttttttccacttttaactcaattatttagctcaaaaatgagctcagcttgtttattgcacgaaaaatgcacgatatttaagcattgacaacataaaactgaccaatatggtcaaaaatattttcgaacgccaaaagcgtttttttcccataaaaggtctttaggggtgtatttttcgttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccctaataatgatgaaactccaataaattctgtcgaaatcaatatttcgaaaaattttgccgcaactattgaaaattgcaaaaatgtttttgctgttccaaatacaagccatattatgaccaaaaatttaatgatcgattgggttcacaatgttttggtcccagttttacgccctggagaacaatcattattgttggtggatagttggaatggttggaatgattttcgactcccggataatgttaaattaaaagtgaagcaaatcccaaaacatgcaactggaatatgccaaccattagatgtttacatttttcggtagttttgtattcatcgtcccgatgtcgtatatacgatcatcgtaacatcatggaaaaaacgtccgatgtcgtatattttgtttcaattaacaaccgaccatcgtatatccgacatcatatatacgatgaaactaagggaagaaatcgtaaattcatccgtggtgcaacccatgtatttggttcatgatgtcggatacgcgatttttgacatcacatcatgcaaattgaattgaaacagaattacatcatattcacgatttttcgtcgtatttacgatttttctcccatcttataaaagatgatcctaaatacgatgagacgtcgtgaaatgatgggaattgaaacaaaattttacacgatatgacataatatcggagatacgacgggaattgaaatagacaccgcaagtgtttttcttttccgctgtttaagaaattccccccccccctcagggacggtcccaggggggggggggggtacgtaccctcccaaggcccctccacactcgaaatttttaaggaaaaagttgtattttttggtgaaaaatttcgattttccttactgataccccctccaagaactacctcacaaaagaatttttaagtaaataaaaggatatttt

SEQ ID NO: 1151 - DNA, 6252 bp, Heterodera glycines
  misc_feature (5026)..(5026): n is a, c, g, or t
cgtccctgccccccccccctaccattccctccctccctactgtctgtccacttcatgccatttctcatctcctaccgtttcctctccgttccgcagcactcaaagcaaacaccgagtgatgatgctgtgtctgaattgtagacattcttagatagcacagattctgctgctgctgattgacactcatttgtctcttagctactctctcaacgaaaaaggcaattaataaaaagaaaattcagttattaaaataggtatttcggtatggaatgacatgtaatgaaggaacacagtaaacaacaacaacaaagaaacacagttttacggaatacggtgcgctgggcaatcctttctttttgtttgcgaaaatgatttcttctctcaaactctgttagttaaatggtgggctttttttgctccgagcaaacatatgaccgcaattgagaagggagtgagtgaccaatccaaaaaggacagcggcaaatggacgccgaacggacgaacgaatgccctcgaaattattgttttaatctccattaatttatttattgaaagccttttataggctaaatcctcaaggtgaataaaaatgggtgaataaaaacggctggaatcactcaaaaagccgaccctttgtgttcgagcgttggggcggcgattaaagggacaaacgctgttcgactttaaatcggggttttatgaaagtcgtcaattgcacttcaaataatggaaatgtccttaaatgagtttttaagacttttttgttcaggaactttttcttttatcttttttcgactttttatgaaaatttcgccccctgacaaagctgtctgcccccgacatttttaaatttcttcagccaccccagacaaatttagtcggggaattttcaccccgaaccccgacttttccaaccccgacgtcggggtcacaaccctaatttttacatttggtatttgcatgttgcacttcagcagcagcagcaatttttgtaattggagagattggtcggtcgttcggtctttgatcagaatctcttttccattttattcggtctttgatcttttccattttaatcacaggagataattatccgtgccttacgatattccgattattgattccgcaattctttggctgattgtgaaagagaatggacggaatatttgagaaagcgatcaaatttcaaatagagagaaatggaaggcacaatggtaaagcggagagtggacagacagacaaaggaaaaagaataggtatttgggagagagcagcgagacaatgagtggaaagtgccgaggccaatggaatcatttgcattgtctctttctgtgcggtcattgcttcatcatccgtcggttgcgcggcagtggcggcacccgcggcccctctttgtccttccgcgttttgggcggcaccggagggggcggaaagggcggcgaaatgtgtaaagggtgagaagcattggacgagcggagcggaccgacacgcggcgcagcggtagggaaaacggtagcggaggaacagtcgccggaggcgacgtttttcggcggggcaaacatttggggagaacaatcgtcctgagaaaacatttgattgataggaatgggaaagataaggtgattaatgacttgatccgttctaatgacaatggcacttataatcagttgatcgaagtcccaaccaaaattgggttgaccgatcactctgatcacctctcccccccccccccctctctctctttcctcatttcctctcactttctgtcagattatctctctctctctctcacacacacactctgtcactttgttgtctctgtctccctatctccgctctctctctctctctatatctctctctctctctctatatcctccttcccccatgtcactcatttcacaccccctcgttgctgctgctcgcgcacattccgctgtcccatccgccggcgccgttctgtccattggccatgctattggttgtgggcaggccaaaagagacggaggcgatgtcgggcgacggcacggaaggcggcaaaggcgggtggccaagtcggagagtggtgggacggcactgttcggagacggacatcgaaaaatctgacgagagagaaaggaagtctgaaaatattcgaaattcctcgcccaccgaccattgaatgcccccggcaatccctccgctgccatttccgctcggttcagtaccggcgcctgcgaagttgggcagcgcaatgaaatgtcttccgtccctccgccgtttttcttcgcactttccgcccgtggcattgccattggcctttttgtccgttcttcttgctgttgtgctgcaaattgaggtgctggcgaagcggccaaatgagtgacttttgcggtcgggatcagcttaatgaaatttgttaattgactgtcaaaaatgagaaatgccaatacaaatttgatgctttggttttcctgcattggcacataggaaggattagtgatggacccatcgacggggacggggtgacggcgcaaaaggtcagccaaatcgttgggggacagcggcttcctgcattttaatacaactgtaacatgccgtactccttcaattggaggagtaaaaaaccgctaaatcgttacccagcggggctgtctgatgagcgcgacctttggtgccaatggggaaaagcggcatgctcaggggacaacagaaaaggcgaaacattggcattgttggcatggagaggaatggttgcattaagcagggacgacgaaccgcgaggcgattgcgcggaacgggcgggagacaaagctgcgcaacggaacactgatcagtgtggcatttgattattgttaattagcgagcgatctatggtcactgcgcattgatcgacccgatcaataagaatgtcatttcgtgatcagtaaccctgcagaaacccgggaaggtgttttgacgaaatcaacccactcacaacacataaagaattagtttattcatttttaataaatatatgtaggaaatgtacaatagtgagtcgcaataacatacaaaatacacagagaggcaactcagggccaagtgatatatgcatatacaattatacatggaggcaacttgggccaaatgatttacaaacatcctcttttaatacatcaggcagcatcggaggtgtgcacgaatcgccatcacattcattcctgcgcgtcgcggtatctccaggcgtcggtcggcgtaccagtcccaacgcgttgaaaatggcgcggcctccactggggtctccgttgttctttgcgtcgcctgtcctcgtcccgctggtgttgctcgatgaagcgcttgactgaaaacaaggggaaaactaattaattcttaatccaaattcctccctcccctcccaccttggttcgccatttttgtgtcgttgaagtacagagcagcggtgagatgacgccacaattttcggctttcgttgttcttctggtccagcaccctgacacattcctgtggaaattagaaatgggtgcattaaagttcatttttatttgggcattttctaacctttgtcacgtcgcacttcgcccgcacatttgtaaagggttcgaaggctctgcgggcacttcgcttcaggacaatttcgcctcgccagtcgcctttcagttgcatcaccgccacctccctgtggtagacttggccatgaatttggtgcgcacttccgaagaacatgggccgcgcctggaactcgattttggcactgtatccggtttgcaagcagctgagttcaacctgtgtggaaaaattttgtttgctgaaaaagcaaaatcgagcgaaatggacccacttttccagcgagttcaaaccacggccttccgaagacgttgcgcgcgaaggcatctgggaaggtggccatgtacgtctcattgtgctgaaaatggggaacaaacgattaaaaccataaaacaaatggcacaaaaaattacaaaactcacgttttggagtcgaacagtcgcccggccgatgttgcggacgcccagtgatgtaagcccagcgaagtgtgactcggtgtaaatgtgcgatgtgcaggtcacgccggattccggatgttcgacgtaaaaggcggagatgggcggatgatggctgacttgctcgccgatgaacgtcatctgaaatgtgggaacagatttaggtttctcaatgagtgacgaggctatcactcaaactggacctggttggttgctgagcccgggaacggtccaccggcggttcggcttgcggacaacggcacgccaggcagggtccaacggcaacggaacacttcgcccaggatcggattgtacggcttcttcgcggcgtcggttttgcgtgcaggatagaaggagttcaagtagtatttgaggacggcaaggaatctgaaaaattgttgattcaaaagcgttgtcgtcaaccaatcgggaccgtttctcagccgtattctcgtaggcgccggcgatcagttcatcaggatgagctgaaatgagataagattgaacttggaaaaattttaaaaagcaatgtattcaccgaagaagtcggcgtacatttcgaggagagagcgtcgttccagcacgaaggtgggcagcgccaaattctgcagagtctgagtggtgccgagctgaaaagagaatttctattaaaacaattcatcgaacaacgcgtcgtctacctgggtcactaaatgtctgaacacgccggcctgctcgctgttccagttgtcccgttcgtccgagttgttgtagatgtagtcgtagtcggttccgttggtgtcgtagttgccccaatctggcgcttgcattttgaaatccgctgccgctaaaattgaaggggaaaggaaatcatagattgaggaaacatatatgaacaaaaacaactaaaaaaagaaaaaaattttacgaagaggaattgtggaggtggagagaagaaatcaacacttttatacagaaaatccgactgaactcacaaaggaaggtccccaggtgtcccgtgggatttccaaatgaaatttggtggngtgtatagagcacccatgggttcttaagaaaagtgtttttattttctgcgaaatgagtctgagtgccgagttatgacgtgccaaacttttttttattgcaataaattaaatatacatttgcatgttttgtgttgttcggtggtgcggaggttgtgctcctgacttttgtttttgcccccataggttcgaatccctcttatgtaattttattttcctcattttatatttgccttttatgcaaattaatcgccattgaaatcaattccatcgggtcaaaaatttttattcctcctccaagtgattcctaaatatgtccgtaaatccccaaaatattattgtccttttaaaaaaatatttttccaaatataatgattagggttgtaaattatatggactaaaaaacgcgaaatatggacattaaatatggtctaaaaaagcccgaaatatggactaaaaaggccaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaaccccaaaatatggatttatatggactaaaaaccttcaccaaatcaaaaaattttaacgcagaaatgctatttttaagcccctttcttcatagcatatgcgcagaaaaaatatgttaatccatataatttacaaccctaataatgatgaaactccaataaattctgtcgaaatcaatatttcgaaaaattttgccgcaactattgaaaaagggaaaaatgtttttgctgttccggatgcggagccatattaaagggaaaaatttaatgatcgattgggttcacagatgttttgg

SEQ ID NO: 1152 - DNA, 748 bp, Heterodera glycines
tcagtctcttggatcaccgtttattccacggttcacctccctagctgattgttgcctctgatcaaacaacccacaattgttatactgttgaattaattgcattacacagtgtttttttaattaattattttttgtgtcccattgcccgtgatgtgtgtgtacttttttttcttcgttttaaacaacaacaccatcattttggagcagtacaacaacaacaaaaagaacaaccgcctcattaaactactcaaaaatccattcattgttctttaattatcgtccgttccacaattatgtgttgtcatcccccgtttaccgtacactcccgaaaaattattgttgtttttttttacaaatttttagccctttttggatttaattatgaataatgaatgatgttcaaagcttattgttagaatttcatgccgttccgttgttattgtcgctgttctttttttttaatacatttattaaatccacagcaataaatgtgtgtgggtgaataaaaaagttgtgcctctggtaggggtcagttgcgtctgagccaagcataaagcaccataacttttttctttgtttgtcaaattttataaatttggcatcattcgaaagctctacattttgaagcttttgataagatattgctaagcgattgaacaacttataaaaaagttgcaacatgaacactaccaaaaagtcagaatttttgcatattttaatttataacttttttatatgtggtatgtct

SEQ ID NO: 1153 - DNA, 9660 bp, Heterodera glycines
atactgtttgctctttcgttttgaaatgaatttgtgggatttgtttttccaaaatttttcaacggatttttttttgtaaacgctttttttatgaaaaacatttaaattgtcaaacaatttgcagagcagcataagttaataagtttttgagaaaaaatgtcttccgcacttaaacagaaacaacaaaatccgtgcgcacaatttttgttgtccggcggcgacgcggtgcccatcccggacagtctgttcatctacagtgcctttctgcgtgactacaaaaaggcgatgctgcgcggcgacatggacaacctgtgaggagcaggctgaatttgtgtggcacttggagggattaggatttagaattcccgaatcttggcagtcgggcaacagtatgccaaaaaccccggttttatgggatttggaattttataaatttgtttaaaattatcgggttttgttcatttttggcgagcccttataataaggtagatatttttgggtaaatttttcatattttccgcccggtgggactcgaactcatggcctttccacactttggaatttcatacaacaagtttctagtccttagccacaattggcacttttgtccccctcccccccattaatttttgtgctccgtttcagtgaaaatatgactattccgttgccggttgtctccggcaaacagccgttcaccaagcagcatttgaccgtcatgactcagtttttcgacctgtgcgtatagtgcttcttaaattttacaaaacctatctcttcccagcctaattacagtaccccttttcccagttacacgcgtcacaattacggtgcgggcagttccagtgccaaaaaagtgccctccacggtggacttgcagggcaaatgcggccccggcgcggcggcacacaccaaagcgacgccacggggcgtaaacaaaacggcggcgccaccggcggggggaaacagcgtcgtcggcaacggacgcgtaagagcgggggcgaatttgaacgatcagaaatttttagaatgatcagaaaatttttatcaattttcacccccccccttccctaatcgaattcgacacttttaaaggacatggtcgagtcggtcagcagcgagacgaacattgtcgaaatggaggccaaatcggacgccaaagtgagacggaaaatttaaaaaaaattgcgaaaattaacgaattcgttgaatttgcattcccataccgtacccctttgcgttagcgtacatctaccgtatctatctcacttttttacagactcccggcctgcccgactgggcgcacggcttcttctcggcgctggacaagaatttgctgattcagaccgccaatgtggccaactttttgtccgccacccaatttgtggagcacttggccaatttcatcgcgttgaaggtgggcacagcaccagcagcacaccatcgggaattcaaactcccgattggtccgtccatatatccgggcttatttgcctattttttggactttggtctcgagccttgaccattttgaataacgttttcgtgaaaattcactcgaacgcattatatttttttgagtctcattctcgagatttcgattctctaataccccctattgttatattatttttggcattttttgaacgaaaatataattttgcgttccatcatgcgcagtgccgtgagatggactcgtcggctgagatcatggagttcctcaatgtcggcaccgacgacttggaaggcgaggagttgcgcaaggagttgtacaaccactgatcgaccatccgtctcggtcaattgatcgggaggaaagagacccagctaattgatttattgtggcaaaatttctgatcaccccccaaaatcttgtgccctttggctttgtgtattgtatatcaaaaataaattgtgtattttttggcacatttcctctcttttataaatttaaataatttattttaaaatttcctgaatcttttaataaaatggtaggaaacgtgagaaaagaaagggaaaggaacaaaataaaagtggaggaaaaatcactgttaaaaaaggaataaacaaattgaatcattttaagtcgaaacattgccgaagatacacaaaatcatttaatatgtgtagcaaaaaatgtcatcccgacaaaatttaaactaaaataaaaaaaagtttcattaaaaaagaatttctaaaaattccatttaaaaaaaaaaaaaattaaattttgtcggttcgcccgaggctttttgtccatgcgccaaattgcatacgattggttgtacagcagtaggggagagatcggagcggaaagtgaaaaggaaccccaatttaagagtgccgacccttggggcagtagtgcaactcgagagtttccggtctcgactcaagaaaagtctcgggtttttgtttagaggtttagaatcctaagaccgaatctcgagtcatgagttcaagactttgaatcgaggccacacctcgagaccgaatcgtggagtcgaacctcggatattgcagtcgaacaattgttagtattgagtcttggcgccgagtcttgaaaacgaatccctagtttcgatactgagtcttagaaataagtttttcgattctcgaggagggggtcgtatctcgatcccgagtcttgacccaacatcataattctcggcctgcctcgaacattatcacaacccgcagtgatcaaaaaagtgttgtgggggggcaccggcagggtcggacgttgcaaggacaataaaaaaaaatagcgatgcccccgggccatggattaattaattagttaattgctcttttcttgcgccacaaattacgtttgttcttccttcacacatccgccgacacactggcaccaccagcgccggcaaaactgctgttcaacgaatcggcgacgacggccgtgccgccggcgacgggcgaacggcgcaactgttgctgctgggggccaaggtggggcaacggttggaagcgcggggggctcagtgcttctgtgggaggaaaattgtgaattttcaaattttttttttaaatttcagtccgccaagaatgtaatcagagcccttgtctttcctaggacggactctaatcggtttgatcagcagattggtgatcaactcgatggtttagagcactaattaattaaatgacctattccatatcacgaaaagctttctgttgtattttctgatcaagtgaagcaccagcagcttcatcaaactctgatcaatccctctttctgatcggtgcttttcctttcgcctctaatcagttgatttgatcaagatttgagtctggattagtcagtttcctgcttcctgatcactcctattcaaccaacccccctatctgggcaatcaatcactgtttgatcaacagcattcgatcactttcattctcccgcctcttacttgtcgccgccgttttggcgctgccgccgatcgccaacggtggcgggaaacgttgcctttcgcctcctcggccgccggcgctggcgccaagtacggacggcgtgtcgcgcccaccgctggcgctggtggtaccgctgcgcggcaacgggaacggactcgtccgcgacggcacatccggcagcgccacaggggcgacggcggcaccgctgcgctgatcagtgccaccgaacgtggcactcccatttgatcgcaagctgtagggggagggcagcaaattaatgttgctgatcacagacaggccattagccggtattttacgaaaaattcgcgggacaaaatgtcgccagagcaaaacgtcgcagggacaaaacaacgccggacaaaacatcgcgacgtttatgtccaggctgcgttttgactacaacattttcctgaacatttttggggccatgatccgggtgcatttttcaaaaataacccggaaatcggggttccggaccggacaaattctgacagggttcggtttcttgagaaaaacgtcgggaatggaaaacctaaagggactcgacgagacaaattaaaactcattagtcccatccattgtcatgactcatgaatcgagaatatcaaatatttgagatgtcggaatttcgcttttcgaaatgagggcgtcggcaaacatcctgatttgtatgccttgtggctttgcggtgctccgtactcacctgtacggcggtgggggcgctttagcgccgctggtgcccagcagggatggcacggaattccgacttccgacttccgacatttttggggtcggaattccgacttccgacttccgaaaatttttggggcctcggaattccgacttccgacttccgaaatttttgatgaaaagtcggaatttttcggaatttttttgagtttttttttcaaaaaattagcaatttttgtacaatttgttaataaattgcatagaaattttcaatttttttccgacggcacctatcggcaccgccggactcaaaaaaacttaattttcttgagaatttttaatttctgtttgtattttctattactggaagttgaaagaagaacatggaaaatggcctcttctttgtcgtgttgcccgaaaatttctgagcgcaccttgtggatcagttgaaagcgaaagattgttttctaaagccgggctcatttgcacggatttgcgaaaccggattaagggagacaatgttaggaaattgatttttttgcagtccaatttatcaattgttgaatttgattattaatttttaatattaattttttaatacataaatacatttatatttagtaattttgatttataactttaaagttaacttatgaaatattttaaaatttctgtaaaatttttcaaaaattccaagttccgaccttttttgggtcggagttccgacttccgaaaatttttggggcctcggaattacgagttccgacttccgaaaatttttggggcctcggaattccgagttccgacttccgaaaatttttggggatcggaactccatccctggtgcccaggcggaaggcggcgctgaagccgccgtcgtcggcatcgcactccgttggacgcatgccggctgtcagcaacacgcgttccgggtcgccgcgcgtgatcagcggggcagcggctgcggtactgttgccaccggtgccgttggccgcggcacggctggcgcccgctgctgccagctgctggtggcgccggaacgacgccggcgagtcgcgacgcgcgcgcacaactctgtgccgataagtataatttatttttttttaataaatttgagttttccagagttggaaacaacaagttcctgtatcgaaaattcggtcctggtcaaagatagagtctgatcccataagaggcatttcatagactgaaactattcggcactttatttcgagactctcgatccaggtcgctctatatgttgatggatcattgaacttgaagatattagacacagatcactttcaaagttatgatcggcacttcattctgagactctcgactcagatcactttatatgttgattggaacattcaacttcgagattgctgacccgggaccagagactcgggtcactttcaaggctcggatcgacaattcatttcgtgactctcgattctgatcagcagaaatgagactctgatcactcacgcacgcactttttgcatgtgatcagacaagcagccaccatgcacaacagcagcaacccgcacatgcaactgagcacgatgaaggcggtgtagtaggagctggacacaaccccctgttgggaaaatggaaatctctaaatttccaaaaatccaaaatcaccgcatgatttggctccaatacgccgccttctccgtccgcacaatacgcattctctttgatgccccatggacagtttttgcagtcggacacctgctgccgagaatggaaggaataatgaatgacaattaaatgatgcaattaggcttaagccccaacccttcggcgggtagagaaaagtcggggaatcgaggatgaaattcaccgacaaaatttgtcggggatttctggtggaaacttgcaaaaaagtcttcgaaactcattcacagcaaaaaaataaaataaaataattttttatttgtttttaaataatttttatttatttttaattgctatttggttatgatcaaaaataaaaatccatttattattcaacccctaaaagaaacaaaaaattcaataaggaaaaatgagggaagaagtggtgggcctgggccgagaggctgcgggaatggtatcattcgaaagcacaaagtctgaataatgtaataatacgagaaaacaagagaattctaacattccaagaaagtaacaaacgaaaataatcagcaattacttaattaatcaaatcttttttggtaattgcctgaacgctgcgagtttatatattttagcttcgttagattttgtgctttcgaatgataccaaaaagatagggtttgttcgaacatgaacaaagttattgtataaaaacccaggattgtcaattgattggactcataaaagtcgattggactcataaagtgcattagagcccgaaaacctatgtcccacctccccaaatccaattcctgactccgaactttatttgcttcgatgtggataaaggcataaaatggagaacggataaatgattggaaaaataagaaaaaaattcaaatcaaaaaaattagaaaaaaacaatataaatgtgtaagtgttgatcggagagagagaatataattgtcgataaatggagaatagagaaaaggaataattgcggtttaaatgtaaatgataaagaaataattgaagtaaattgaatatggcttaatagaaatgccaacaagccaaaaaaatcagtcctccatcttcctcccttcagtttcctagccttcattttcctcgccttcgtcctcgccttcgtcctcgctatcgtcttcctcgtcatttggcccgcgtttcaaaaattcaacgcaaaaacgttcgccattttttttgaaccacatttgcttggtttcgaagtcaaagcggcatttgtatttgcagaaatagtccatgcccaacctaaacacatttattaaggatgcaacttattaattctctgccgtacacctacgtcaaggcgtctttgtcttcaatcagcacggcgcatctgaacccattgtcctcaaaattaccaatttctaatttcaagccggacaacctagggttttgtttgtaaataattgtcactaattaaaaaacctactgtcctttggacgcctttctgcctttgtaaaggcccttaaaatgctttatattgctccgatccatttttcctccagaagtgaaagtcgcttcgttttggagaaacaatttgcctcccattattccactggtgcatcctgtgagtatgtaactcagatcttatgctggggtaaacttctgagcgcacctgtgtctaccaaaattttcgccacttcaattccgcacactcgtccacgcacatgcgcttggcggtcaatgaggtcgttgtctgcgtacgcttcatcgttcacatcggttgttgaagcggtccttttcaagctagctttgagtccatcatgaagaacagaaatggaaaacaaaattagtaaagaaaaaaacaaatgtatggaatattttaagggtagaatatgagggggggggggagcagaggggagaatatgataagcggaagtagtataaggcacattaaatggccccaaatttgccccccccttccccatcctttctttctcttttccaaaattccgccgcaaatttcataaaaagtcagaaaattagagtttcaatctaggacaaaaaatttcagtgaatttttggggggttcgtaggcccaaccctataattgttagatataattccgactatttgcatatgtataaaagcatggcgacaggcacaatgagggggggggagcagaggggagaatatgataagcggagaatatgagggggggagcagaggggagaatatgagaggggggcacaaatgagcagggaataatatgagcggagggagagagcagaggggagaatatgaggggggagggagcagaggggagaatatgaggggggagcagaggggagaatatgataagcggagaatatgagggggggaagcagaggggagaatatgaggtgggagggagcagaggggagaatatgataagcggagaatatgagggggggagcagaggggagaatatgataagcggagaatatgaggggggggcacaaaatgagcagggaataatatgagcggagggagggagcagaggggagaatatgagaggggggagcacaaaaaaagttggtgttggtggaaggaaaaagggccaaagggtggcaaaatgtaaattagctttgaataagagggggggggagcagaggggagaatatgtttattattcaacccctaaaagaaacaaaaaaattcaataaggaaaaatgagggaagaagtggtgggcctgggccgagaggctgcgggaatggtatcattcgaaaacacaaagtctgaataatgtaataatacgagaaaacaagagaattctaacattccaagaaagtaacaaacgaaaataatcagcaattacttaattaatcaaatcttttttggtaattgcctgaatgctgcgattttatatattttagcttcgttagattttgtgctttcgaatgataccaaaaagatagggtttgttcgaacatgaacaaagttattgtataaaaacccaggattgtcaattgattggactcataaaagtcgattggactcataaagtgcattagagtccgaaaacctatgtcccacccccaaatccaattcctgactccgaactttatttgcttcgatgtggataaaggcataaaatggagaacggataaatgattggaaaaataagaaaaaaattcaaatcaaaaaaattagaaaaaaacaatataaatgtgtaagtgttgatcggagagagagaatataattgtcgataaatggagaatagagaaaaggaataattgcggtttaaatgtaaatgataaagaaataattgaagtaaattgaatatggcttaatagaaatgccaacaagccaaaaaaatcagtcctccatcttcctcccttcagtttcctagccttcattttcctcgccttcgtcctcgccttcgtcctcgccttcgtcctcgctatcgtcttgctcgtcatttggcccgcgtttcaaaaattctacgcaaaaacgttcgccattttttttgaaccacatttgcttggtttcgaagtcaaagcggcatttgtatttgcagaaatagtccatgcccaacctaaacacatttattaaggatgcaacttattaattctctgccgtacacctacgtcaaggcgtctttgtctcaatcagcacggcgcatctgaacccattgtcctcaaaattaccaatttctaatttcaagccggacaacctaagggttttgtttgtaaataatttgtcactaattaaaaaacctactgtcctttggacgcctttctgcctttgtaaaggcccttaaaatgctttatattgctccgatccatttttcctccagaagtgaaagtccctttcgttttgaaaaaacaatttgcctcccattattccactggtgcatcctggggagcatgtaactc

SEQ ID NO: 1154 - DNA, 108 bp, Heterodera glycines
agaggggagaatatgaaagaggggggggcacaaaatgagcagggggaatgtgagattatgagacgggggggggagggtgtgtacgatttgaattaccccccttggatt

SEQ ID NO: 1155 - DNA, 3071 bp, Heterodera glycines
ttgtatctttcatctgaattgtcgttaattagtctctccccagttttcgatatatttaccatttatcttaaatctaaaaaataaaaatttcagaatggaataaaaatctaacctgtatttgtactatctaattctaaaacttttttttacctgatttgtttgttatatttaatgctaaacaacatttctttatatttttatttaaaaaatttcttcataaacgacatatcctaacgacaaatatatcgttaatagttttcaaaaagggccccagatcaagacatatctctactaatgatccatttcataatgaattaatttgctaattaattaattatccaattaaaccaaagttcagttccaactgatgtgttgacaacggaaaagtgatcagcatttatcagcattattcccatccaaatttaagtgatgtccctgggcttttcccattgaaatttcccacgcaacggcggtacaaaaaggagaaacaattgagatggaaattgaaaaagtgtccgaatttgcgctggagaaggtgggaagtgagcgattaagcaaagccatgaacatttggggattttcatggaaaataatggcagaaattagaacgaaagacgaaaacaatgagaaatggttgggctttttcctttacaactatggcactgaaaaaggtaaaaaaaaagccattttcataaatctgtcaggagaaaaaaataataatttcattaaaaatattaaattactctttttaagctgaattacatttaataaattcttttttttccagagatttttattttttactatcttatcatatttatttatgaaatttaatatttaattgaaaaatatgaaaaatacaaaaatatggaaatttaggtctaaatgatcacgattttggtatccatttcgatcgatagggatagacccgaattcgaatctaagagggcagagttggtagttgaagcttgttcctattttcaaatgcattttaaattcttttataattaaattgcccattgtcaaatttccacatcgaatcattgagaaaaatttaaaattaataaaataaccattaaaaatttgcgcgaaaaaggggattaatactgggctaatttatttcattaaattttgaaatggtaaattaaggaattaatggagctgagcaaatgcttgtacaacaaagatgaggacaaagtcaccttagccattgatttattgactgcttcgtgacttcagacgggcgctttggatacgctaacctcgctcaaatttcccctgcgaaaaaacaatatgttgttagccaaaaggatttttctgaaaaaaaaaatataaattttacgatttttacaaaaattcattttctacttattgctctaaatcgatttacgtaggcaattatctaaatgatcaaagtagcagattcttttcatgcatcttttttatgataggaaaaaattgcttttttttcatgagaggcacatttttatgaatttacaccgccaatatttttgtctttacttgtgaattttggattgaaaattctacttttatttttagacaatttacaaaaataaatacttgttttaaaagtagaaacaaagatgaacaaatgggtatttaagtggggtagttatcgtgaaaataatcaatttcctttttttacagctaataattgagaaaatacgggctaatgagtcccaaaatcccaataataataagagtgaaattatttttaaaaattatcttgtttaacttaattttaattattattttttcctctctgtttcctggtttgagaatcccagtttaggcgagtgattgcaaatccgcgctgttaccatgctcttgtcttacgggtgtatttttcaaaaatttcttgatatttttgtcagtttttaacaaatattttttaaagttttcgggtttttcagcaacgctataaaaacttttttatttaggttaataaaaaaaattttgaaaaaggcgaatctcggattcaaggctcggtctcgatgttgagctcgagtctcagataattggtaaactgtgcgctgattctccatacgaacgaagtacagcagggggggccgggtcggaaaagttatggccaacaaaaggaggaaacccagttttttcatttttttggtagtactataatttttaggggaacgggtcgttttggcgccgccgttttggcgccagccttagtttttttattataactttttttcttgttgaccaaatctaacaattttggtatcattcgaaagcccttcacaagctctattagccttacaaaaaaaaaaaaaaaaaaattagcttgtaaaaaagttattaggaaaaaacttccaaaattttggtttttttgttatttcatgttataacttttttggtaacctaatcgctaagcaatatattataaaaagcttctaaacatataaagctttcaaatgataccaagattattagatttggtcaacaatgaaaaaagttgtagtccaaaacttggactggcaccgaaacggcgggcaccgaaccgtcccctatcgcaattagtgcaataagaaatacaaaaactgacccgataactctctttgttgaaaaaattgtccatgacctaaacaacttttgaaactgacatatgtgtaatttcaatgttgagtttttaaagcactaacttctggcttatcattgatctagtttttccacggaccaatgaatgcattttctgtttcttattctatgtaagtatcaacaacatccttcctaaaatcaacaaaatgcaatttgtttttccacttgcaccgagcttcgaggcgttgctttcttctcccggctacgccatattcatcatcttcctttttttgattgcccgttttctgaaattgaccagtttcgatgaaaagccaaaaatcacgctgagaaagaacaaaaggagaaattcgtctcaaaaatgttcacatttaatggaggaaggaagtcaatgtgcgactggtccgtttgttgagttagctgaactttttgtgcaatgttcgattctgcaagaactgtcagtaatttatgcattc

SEQ ID NO: 1156 - DNA, 3191 bp, Heterodera glycines
  misc_feature (3183)..(3183): n is a, c, g, or t
gagtcccaaatcccaataataataagagtggaattatttttaaaaattatcttgtttaacttaaatttaattaatattttttcttctctgtttcctggtttgagaatcccagtttaggcgagtgattgcaaatccgcgctgttaccatgctcttgtcttacgggtgtatttttcaaaaatttcttgatatttttgtcagtttttaacaaatattttttaaagttttcgggtttttcagcaacgctataaaaacttttttatttaggttaataaaaaaaattttgaaaaaggcgaatctcggattcaaggctcggtctcgatgttgagctcgagtctcagataattggtaaactgtgcgctgattctccatacgaacgaagtacagcagggggggccgggtcggaaaagttatggccaacaaaaggaggaaacccagttttttcatttttttggtagtactataatttttagtcccgcatgtccgaatccaatacccattattttcgacatttgtttcgaattagggattaggaattggtcaaaatgaatgcagatattcataatctgcgctttccgaatattttcgcgacttttgaagaaacaaaaattgattaaaaactgaccaaaaattggaccaccaatacaattttgcattccattccagccaaattattcccccacccctttcctaattaatgcattccacatgatattatgtagtattgttatttattttttatcaaaaaaagtaaaaaataatcattttcgaaaatttttttgaacttttttccaaatcaaattggtcaatttactttcgaaacatttttaagcaatttttagaagtacatctaaaaaacaagttattgcgacacacaaaaattcttcggatttttttaaaagtaaaaacccaacatggtttttccgaaaacaaactttcaaatcgaaaaatttactttaaaagttcgcataaataaaaaaataaggttgatttcaatcaatagaaaatttcaaattgtttatgactcgtcctatgtttttgcttctttcactgtgacatcaatggccaatgtcactttgtcgtcttctctgttgtaaaatccattgttcaggtccatcagttccttaattgtccataattgtgtcaattaagggaaagtttaattgtcactcacatcaaatgaaattgaatgaaagattccagttcaatttattgtttaacaattagtcattgaattcatccttgaaatccggcacatctttcttttgcgagacaattcgaaaggttgccgaacattcgaagcaacaattcttggcttaatggcaattaattatgattttttatcaattagcttttaatttgcaccttcttttggagcatcgcacaaaaggtaaaagcccatccatttctcattgtcagtgccaagcaaattctttctaatttgtgccaatattttccacgaaaatcctttgatgtgcacagtttcgcttatacgttgactccaaaagatttcttgcgcaaattccgacactttttcaatttccgtaaaaaatggcctttcgatttgcattggtacaaaattaatttttccatttttgcttctttcatagtgacatcaatggccaatgtcactttgtcttcgcttttgttgtaaaaaccattgttcggctccatcaattccttaattttaattatttatccatttatgtatattttttcgctgtaccgactgctcttaatcccctctcgagcaaattccaacatttttttaatgtccatcaaaattctgcccttttttcgatcggaaattcgtccattagtcggaaatggcattgggaaaaatccatcagatatcccatgacaatttggaagggcatggaattgataaatgtcgatcacttcatcttctgataacacttcggatggaactgaaaaactggattttaaaacttataaaaaattataataaaataaattcgttttttataaaatcggcagctgctcatcggaaaaaattcaaacattttggcttggttatttttaccaattttcttcgaaaattcctcatttgggatcaatggaaagcgaattttgaacagtgccggaccgagaacggcacgacgattctttgccgagcgttcaatgcaattttgacggcacttcgcgtcggcccaacggagtgcctttattaatgagaaataacaaattaattagaaataatttcttatttatagtaaaattacagcgttccaaattgaaatttcttcacggattttcaattcgtcacgtccaaaaatttcacacaaaaatttttggtgaatttgcaaaaattccttcgatttgatcaaatcgtccgcattttcatcaatttcaatctgtccaacccacctccaattcataaagttcggcctgaacataagccacgaaaacattgcgcagtgatgaaacaggaacttgcaaagatgcgtcgaccaagccagggatattgtactttttggctaattaaaaaaaattaataaattaaatttaaaaaaataaaattcaccggcgtaaagtactgccattgcattgtctccgttcaattcagccaattcgcccgtataaatgaagctcaacatcactttgaacgctgctgcttcaacatcggggacctccacaggataatcagtggtggctaattgaaaattaattaaggtaataaaaagaggctaattttaacttgctgaaatatgattaaaatatctaaatatagaaaaaaatggtatgtttaaaactgaaaataaaatacattcctaaacgcttcaaactaagctaaaaaaattatttaaattaatttttaaactgaaataaatgtgaaaaaatggaaatacataaaaatccggtctctcattaatccctaattttaatagattaatattccaaatattttttaccattttctgattttgcattctttgaatcaaagcggaacattgcctcaaatacttcggacgcgtgcttcaaaatgagtttatgtgctggcacaagcttaaaggaactaatgtaggaaaaaaataaaatacataaaataaaattaattaaaattatttaaaataaaattattcattcttcaaaactcgcctctttttcgtctccgtccccaacaaaaaagtgcacatccgcgtactctcccgaagcagcaacancttcatcc

SEQ ID NO: 1157 - DNA, 4848 bp, Heterodera glycines
ttacacatttatcagtgttaaaggcacatttaattcttttgagggaatttacgcgtatgaatgtctataaagtattgtaaggatattatttagaatatgctggttgagaaatagttgaaaatagaaaacagtacaacaatgggcaaaaagatgaactgatcgccgttaatcacttccattcccttccaaattgtcatgggatatctgatggatttttcccaatgccatttccgactaatggacgaatttccgatcgaaaaaagggcagacttttgatggacattaaaaaaatgttggaatttgctcgagaggaaattaagagcagtcggtacagcgaaaaaatatacataaatggattttcgtggaaaatacaggcacaaattgaaaagaaaaatggaagcactgacaatatgaaatttcttcacggatttgcaattcttcacgtcccaaaatttcacacaaaattttttggtcaatttgcaaaaattcctccgatttgatcaaatcgtccgcattttcatcgatgtaaaacaaacaatggtaggcaaaattctaaaaatggtctttgattaactcataaatataagcgggcaaagccgcttaaaattcagtaaattcaccatttcactctgtccaacccacctccaattcataaagttcggcctgaacataagccacgaaaacattgcgcagtgatgaaacaggaacttgcaaagatgcgtcgaccaagccagggatattgtactttttggctaattaaaaaaaattaataaattaaatttaaaaaaataaaattcaccggcgtaaagtactgccatttcattgtctccattcaattcagccaattcgcccgtataaatgaagctcaacatcactttgaacgctgctgcttcaacatcggggacttccacaggataatcagtggtggctaattgaaaattaattaaggtaataaaaagaggctaattttaacttgctgaaatatgattaaaatatctaaatatagaaaaaatggtatgtgtaaaactgaaaataaaatacattcctaaacgcttcaaactaagctaaaaaaaattatttaaattaatttttaaactgaaataaatgtgaaaaaatggaaatacataaaaatccggtctctcattaatccctaattttaataattttaatagattaatattccaaatattttttaccattttctgattttgcattctttgaatcaaagcggaacattgcctcaaatacttcggacgcgtgtttcaaaatgagtttatgtgctggcacaagcttaaaggaactaatgtaggaaaaaaataaataaaatacataaaataaaattaattaaaattatttaaaataaaattattcattcttcaaaactcgcctttcggcgctacttgcaaagagcactattttgaaaattttttcaccttttttttcatattttttttttgtttattttgttacagaatttgcttttttaccatatggtacgcatttcacgttatttaataattgatcacgacaatctgccggttcggccaccttctttggacgaaatcaatttacgttggatttacaagcagaattctgaggaaattctacaatttctagcttatcatggacttatcaaaaatcaaatggagtgcaagaagtgttttaacaaaatgtcattgacaaaaaagaccaacacaaaggatggttttttggtaatgcatatagggatgtcaaaaatatgtacaaaaattgatcaaaatatgtacataaatatgtaaaaaaaatccccaaatacccgatttttgtttgcaaacataaaaaagaaagtgtttttcctactatttagagcatggagaagccaggaaaaaaaatatgtatttacataaaattgacatccctattaattattagccccggctcaaaaaattgatcccaaatcaatgcaaatgttgtaaaaaaacaaaacattgtttttcaccaaaataagagaaattgttgtgtacataagttgaataaattatatatatatatatatatatatatatatatattgtttaattttaaattaataaacagagaaataaatttgatttaaaaaaaacataattttttctccatttatttttcgtaataactaaatatgttaattcatatcttgctcacaaatcaacaatgttttgttgaaaaataatcatttgttttcccccaattattttgatcaatttgttgaccgtgggcaaagcgactaaaaatgagagaaatttggggggggggggtcataacgaaacattactttctcctgctgctgacctacataaattatcataaacaaattattggtttttgggtgtgtggcctattagccgattaattctttacgtttttttcgactcgaaaattcctttttcaaatttccttgagaaagttaaatttgcggcagaaaaaaaacaacttgcgaattggcacaattcggattatatgaattttattttatgcaagtccataatttggttttttatgaaacaaaattccaaaaaaaaataaaaataaataaaagcatcttaaatattttcattgccaaaaattgccattaataatcagattttgatttttaaaattgttttaatataaattttgcaatcttcaattaaattgttaaaaattaattttttattttaatttattcttttgaatttgttatttttaaatgtgagattgttttttattgctttgacaaaatatttttgcaaaaaccttttttctgtttcatttttgtgcatttcattacaaatttgttgtataaaattaaggaaaaaaactattttattataatgaaaagaatcggccaagaaagtgttaatggcgggcaaaagccaaggaaaagcaagaaaatgccaacaaaaacggacagcagcgacgatgagtcagatgaagaaaattcagcagcgggtgggtaaataactaaataatggttaaaaataaatttaaaaatgctatttttttagcattatttcccgccggtgcccccattaccgtcgtttgtgaaattttttaatatttaaaagatgcattacggaaattacggcactttttgacccccgtaatactaataacggatttcagtaatttaaattccagttacgcccacccctgctgatgttaagaaccattttgaaacatttatgattgtggatttctttaggacattcccaaaaaatatttttatttttttttgcctgatttttttaaatttacaaatatcatgattatcattttagcagaatcaccagggaataaatggatgaagctaatgttgagcacgggaaagtacgcggatgtgcactttttggtgggggacggagacgcaaaaatggtgagttttaaattgcctaattataatccttttaattgtgaaatcgcccccgacacttcggggaagagattagcgaagatcagggacggaagatgggtcaaaaatgggggttattgttagttaattaatttctttaaagttttaatccttttaagcgcgtgccagcccataagctcattttggaagaggcttccgacgtatttaaggcaatgttccgttttgatgccaaaaaggaaaaagcggagaatggtaaaaatatagtaactaaaataactaagatttaattgtcaattagactctgctaattgcccagctgatgtggagattcccgatgttgaagcagcagcattcaaagtgatgttgagcttcatttatgctggtgatttgagcgaattgaacggagacaatgcaatggcagtgctttacaccggtgaatttattttaaggaaattaaatatttataaattaaatgtttgaaattaaatttaatgagtaatatttttttattagccaaaaaatacatcatccctggcctggtcgaacgatctttgcaaattcccatctccgaattgcgcaatgttttctttgcgtatgcccaggctcgtcttttcgactttgaggtgggagataaataatttaatgataatgaatttaagatgatttaaatgcaataattatttatatatttatattttttataaattttaggactattgcaatgattgtttggattatattgatgggaatgcggacgctttgctcaaatcggatggatttttgcaaattgaccaaaaattgttatgcgaaattttgggacgccaattacaaatccatgaagaattttcaatttgggaagcagtaatttttttaatttaaaaaagttacaatttcattttaaataacttcctatttaattcgaatttattttcggcactccgttgggccgacgaaaagtgccgtgaaaatggcattgaatgttcagcagagaatcgccgtcaaatgcttggcccggcacttttcaaaattcgctttcctctcttctcacaagaggatttctcggagaaaattggtaaaaataagtcaaaatttcaaatgcattatttgatgactagggatgtcaaaaatatgtacaaaaattggtcaaaatatgcacataaatatgtaaaaaaaaaatcccgaaatatgtataaaaacccaaaatatgtaccaaatatttaaataaaattttttaatggtttttttttttgaaaaaatcttcgtaaagtgttatataaacacaaaattgcagaaaaatgacctaaatatgtttagaatcaccttataatatttaaaaaattatttttggtattttttatgggtacatttaaaaaaaagttttttttactttttcaaaagaaattctaaaaaaattttcaaaaattctcaaaatatgtataaaaaaatgaaaatatgtaaagaaaaatcccaaatatgta

SEQ ID NO: 1158 - DNA, 1724 bp, Heterodera glycines
tttatcagtttccatgcccttccaaaatggtcatggaaatatccgacggaattttttcccaatgcaaattttcgacaaagagaacgggtttatgaacacggggcacactttttgctggacattgaaaaagtgtcggaattttgggcaagagcctgaagatagtagtcggtgcagcaaaaaaatgtacataaatggactgtcatggaaaatattggcacaaattggaacgagaattgaatccgatgagagacgtatctacatttatctgttgtgcgatgctccaaatgaaggtgcaaattaagggctaattaatattaattaaccaattaatttgaattgagcagaaaattggagttgcaaatgttcggcaaccattcgaattatctcacaaaagtgtgatgtggcggatgtacgaaaagaatacgatgtcgattttggaaaaaataaaaaatatgatagctggggatgccgcgattttagaaggagatacctcgatttggttgaatttgctgtgggtggcatttaaatgtctttctctaattaaaatattaaaattaagaaactggttgatccgaaaaatggcttttacgacaaatgcatggacaaagtgacatttgccattgatgtcacagtgaaagaagcacaaacaggcaaagaatgctgatattcataatcagtgatcccgaaaacccctcgaaaacatatgtattttcatgtgtttgaataaaaaaaatatgataaaaaaactgaccaaaaaaggcgatccaaactaacactagtttagctaactttctttgaacaaaattcaaacaaaatttattattttaattattttttgagtaatatattagctttaacccactgtccaaaaattcctacgcatttgggttactttttcccacctcatttctgcaaattatccacatatttcaagttcaaatgcggaactgcttcctgcttgttgtctgctgctgttgacaacttcagttgcaattagaggggggggggggggggcttttcccccgggggatgcttttcctccacagccctcgccaaccccaaaattttattttattttgcattccattccagccaaattattcccccacccctttcctaatgcattttcgcccttttcttaaatggatggacgacggttaaaaaaaaatttccgtcttttctttgatcactgccctcaagcaaggaaaagagagagattgaaaattgatggaatagtacacaaacgggggataaattaagcggcagaatgcttgggaaaaaggaaatattacatgagaataaatctggagagggagtgaaagtggaggaaatagtgtgggaaagacaaagaagaggattgtgaaaatgtgtgagagaggcagacaagcagagcaagtgaaaatattatataaatctaagagaagagccccagactgggaaaggggaacaaaatagtgcggtggaaagacggcatacagcgaagaaatagtacggctaacagagagctttgatcaatgaaagaaattcagcaaaagctcggtggaccatgcggcgcattaacccaccgtccaaaaattcatacgcatttgggttactttttcccacctcatttctgcaaattatccacatatttcaagttcaaatgaggaactccttcctgctcctgcttgttgtctgctgctgttgacaacttcagttgcaattagaggggggggggggggggg

SEQ ID NO: 1159 - DNA, 1987 bp, Heterodera glycines
aaagttgatcgtaagacctcttggatgagccccccctccttgtacagttatgcttaaaaggaagagacaatgcaaattaaggtcattttctgaattataattttccgtgaaaaaaaattgtcactgtggcttcttccgcttaggatgaaaaggtgtcattaatttttcgattaacatttattatagtcaaccttgtttatgtgcaatatatttaaaatagtttttatatgttattccactatttcagatggagaatcagggactctagttcagtctgcacaatcagctcattcaaaataggtgtggtttgagataaaattccgtacaatatcatgctgtgattgggcatcattttttgcagcattagttcacgcgtgattactatcgtagaatactacgacggactctcgtcactcacagactataactaaggtaacatggggtgggtgattatggtttggcattggtagagagaacaatcgttacagttatgcgaggatttattgataggtcttaattcattggtctcacattaagggggggggggggggcttttcccccgggggatgcttttcctccacagccctcgccaaccccaaaattatggcttaaatcgcgtaattcttataactcatagtaattaaggatcaatggccaatgtcactttgtcctcgcttttattgtaaaatcctttgcttggatccatcagttccttaaacattgtaatatattaaaatttaaaaaaataattatcttaatggaaattcattataattagtattaattagcatttaatttgcaccttcttgttcacgcataaggtaaaagcccaaccatttctcattgtcagtgcttccatttttcttttcaatttatgccattattttccatggaagcccatttatgtaagtgacagattcgcttttacgttcacttctgtcgatttctctcgcaaattccgacactttttcaatttccatcgaaattattccattggatttgtcgggatcagaaatgcatttctcctttttatcatctttcactgtgacatcaatggccaatgtcactttgtcctcttctctgttataaaaaccattgctttggtccatcaattccttaattaataataattatgccaattaaggaattatgtacaattgacactcaacaccacgtttaaacagctgtaagaattgactaaataataaaattgtcacttttccatattttaatttttaattttgtagtaaatataaatttttaagcgcagcttggattattaaagaatgaaatcatagcgaaattagtaatagtttttcaatttttaatttaataagcccaaacttcccggttcccaaatttctggtcccaaaaaattctgcttaaataaaaggaaaaaatgatcagtcaattaggaatggtttcaatttaaaaaaaaaagtttaaaaaaatgtttacgtaaatcctaacaaaattaatgcaataaatccaagtccaaaaattgtaaacattgacctaaaatggtaaaatttgaattgggtttatgactaaaatgtttatcattgaaattcggtactcaaaaatgagagtctgctaaaacagctccgacaattaattaattcacatatcagcagttttgaaagtataatcaagaaaaattaataaataaaaaaacaggttcatcataggatggaggatattcaatggcatttttccccaaatcatattgggcatttatgtttcgtcctccgttttgcttctttcactgtgacatcaatggccaatgtcactttgtcctcttctctgttataaaagcctttgcttgggtccatcaattccttaattaataataattagtcaattaagggaatgtttaattgtcactcacagcaattgaaatgtaattgtatccccagttgttcgatttattgtcaaaaacatggtcatcgagttttcttccgaaatccggccactcccgttccttgcg

SEQ ID NO: 1160 - DNA, 1091 bp, Heterodera glycines
  misc_feature (1039)..(1039): n is a, c, g, or t
tactgctttttcatttttatttgaataaatttgcatcctttaacatatttgctctaattgtaagccaattgaaatcgggaacgaatccaaaactttagctttgagtaccgtgtgcccacactcctaattggtagttttttgccggctcatcctatatttatattattgcatttttggttttccttttttagatttgttttatccctccccattgagccctgtccctatgcgaaaccattgcaaacaaaacaccatatttcctattccttaatttattttatttaaatgaacgcacaagaagcatttaaggagggattaaatcatggaaagacatacaaaaaaagtaattatcagaggacaaacaaaaaattagtgcatatacaaagctgatcagagaagtacgaataaaacggtcaaacatgggataatactatgcacatttaagggaagggggggggggacgacagcgagcagtccgtcaatttcagtctaacgaaggtagtcgccaaagtcccggagaagggccaactgttcgttggtgatgacaaaatggagccggtacttctcgcgcagggcacccagcttcgtgatggggtcgagaaattgaatgacctggaaaatgggaggaaaatataatgaaaaagcacgggagcgagttaattgaagcatagtcaaaaccgtggagtttgatggacaacaaactggacaagttcagccacttttatcatggccggggttggtttctccccagaggccgtcacacccccccccccccccgaaaatttaaaaagctataactcatgataaaatttgcgctagaaaaacttgattttctaagtgcagggcctatttcatttttggaaaaacaattcggtagggtatatttgatttgttcaaaaaaaattagcgccagtatgtgtgatccctgacagtgggcgttttgtgcttaaaagattaaatttttgaaaaattacatggtcgacgaataagcgtgaaatgcgctccacgtccgtctcgggcattcggaagacgtccacanacagttcgggggaccgcagcggacatccgtacgcaaacgcagccaaatggag

SEQ ID NO: 1161 - DNA, 11167 bp, Heterodera glycines
attttttggctttaagttattaaattgtaaaaattcaaaactaaaaatttttccctaaaatttttaacttggccttttccctgtttttaatcccacccggaggcggaacagttcaaaatttgtaccacattttctggggaaagtccaagtacgttaaagggttccagaagattctatgaagcagtcacctttggaagttattaaaaagaaataaggaaatattcgatggggtgcgatcctttcaaaaaattactctcgtcttctaccccccccccccctccctcgctttttgtgcactgtttcgtttctaaaattggttccgaatcttttggctttaagtaattaaattgtaaaaattcaaaactaaaaattctcctctgaagttttgaacttggctttaccctgcttttaagtcccaccgtgaggcgggacagttccaaaatttgtaccacattttactgtggaaagtccaagtaccttaaggactacagaagagccaatgacgcagtcacctttggacagttattaaaaagaaataaggaaatattcgatggggtgcgatcctttcaaaaaattactctcgtcgtctaccctccctcgctttttgtgcactgtttcgtttctaaaattggttccgaattttttggcattttgaaattaattgcaaaaattcgaaacaaaatactctgaagatttgtaatttcacttcaacatgcttttaagtcccaccgtgaggggggacagttccaaattttgtaccacattttactgcggagagtccaagtaccttaattggacaattacttgtcaacgaacacagtcgcctttggcctcttatggaacagaaaagggtggatatcagtagttagtccagaagattttggcccctaaagttcgagcccccttgactgcaaatgattttttgttaattaattaccggggtgaatttcgaataaatcatttgtttttatcgtatttcctggggatgttggttattttacatgaaaaaaaataggtgtcggagtatttttaaaattggattgaaaattacgatattttctaaggatgtgagtcaattcaatgattattgtattttttgtcatttttctaaagatgagctgtcccacctaaagtgtaatatcatttttattttttctgtttgaaatctccaaatgtcgggtcaccaagagtcaagtcatcaaatgataaaccctcaaatgtacggtcccccaaatgtataggtccccaattgtcgggtcccttaacgtagggtccccaactgtacgatcccaaagtgtagggtccccaactgtatggtccccaaatgtcgagtcacggccccacccccaagtgtctggtcctccaaatttagtgtacacaaatgtcacaaatatagcgttaccatatctagcccaatgtcgaaacccataaatataaatccacaaatgcctgacaaacaagtttatggtcaccaactaatcttaaagatgttttttattccggtttctctagggtttttaataaaatacaccattaaattttttaatattttattcacattttttataaattaaaaaaaaaaaataatttattctttatttttttttcttaatccattaatgttaagaactgttacagtaatgacaaaaggtgttccataaatgttaagactttttcttactacactttgttctactttgataaattgattgaagaccgcgtctgccacatttgagctaataggtgttatcggcacaattatgtctccttgatctaacatttctgaagaaataactactccggctttatccgcgccacccaaagttctcttagcatcttcgatagcttcattaattgacgattttatacattcttctaactccttagtgggattatcacattggtctatattttgaacgacaaattttgattttgaccttaatagttgaaactttttactactagttgtatattcatctatttttttgatacaattttgacttttttcttggtgtttttcttgtcttagcgaatccgaacttcgggattttttattttctctttttgacgcatttctcgtagaccgtttcattttttgttatatatcttcttaagtttttttccttttcaatttctttaaaatactttgctacacccaagtctaagtttcgtatctctgagcaaacatatttatattttttcctatatcccgtcctggacaattttttattccgaattttcttaccaaaaaaaaacttcaacaccgtgaaaataaataaaattttcaaaatactccaccttctaaaattcaaatacctgaacgtatgttttttcattgttttttcaaaaatactttcttgttttgcatttattacgttttcttcaaggtctttatttgtgaaggatgtctttaaaaatcgcacttgtacctaaaccgtatcagtcctaatttgaaaggacgtgcttaaaaatcagcagtttgcctaaatattaataattcccttccatgagatttttgaattttttggaattctatttaggtgttccttaaagaactttactatttttaaccaatttttaacaatttcacagaaaaaactccaattttttcctgacgacgcctgtcgtcgcatccggaccaaaatgccttttaaatttatgtccaaaatctgcaaaaatactgaaaaaatattgtcaaaaatcgctaaatgaaaagattttttggtcaaaattgtgataaagacaaaatttctaaaaaattttccaaggtggtgcctataggcaacgccggtgctaaaaatatggaagaaaattcattttggagaaaaacaactgaattgaataaaaatgttaccctttttattcttttgataacagtagttactccaccagattttcggggttgtatttcagccccgccatttcagtcccagtggaaagggacgtttcagtaccaaatttaaacctttaaaaaacacctataataaatatatccaatcccagaagaggtaaataattgaaaaaacatctgaaggataaaacccaaggctaaatcgtattagagaaggaaagggaggcagaggatgggtgtcaactgtcatgccttataaggaaggcaagggacgcatgccacctgagcgcccgcgtgtgtgccatttaaacgctcgcgtatgccatttgagccccagagttatttttacagcgcacccatttgagccccagatttatttttacagccccgccatttcagtcccagtggaaagggacgtttcagtaccagatttaaaccttaaaaaacacctataataaatatatccaatcccagaagaggtaaataattgaaaaaacatctgaaggataaaacccaaggctaaatcgtattagagaaggaaagggaggcagaggatgggtgtcaactgtcatgccttataaggaaggcaagggacgcatgccacctgagcgcccgcgtgtgtgccatttaaacgctcgcgtatgccatttgagccccagagttatttttacagtccaaccatttgagccccagatttatttttacagcgcagccatttgagccccagagttatttttacagtgccgccatttgagccccagagttattttttaagtttagccatttcactcccagtgcccacgggatatttcagttctgagacccaaagcctattgagtacccaaagtctacggagggtcattaacattccttttaagtgcatttcgaccaacgcagggccgacggagggtcattaatcattcttttgagtgcatttctatcgaaacctaagcctacggagggttattaatctttcctttgaatgcatttctaactaatgcctacgaaagtgtcataaatatccccttaggaaatgtggagtatgttgtgccaaagctaactgactgccattaaccatctttgtgaacatgtttgtccacccgaaactggaatggtcattaattatccccttgggaattcttttggtgcatttctgaccgagccaaagccaatggaatggtcattaataaccccttggacgcattttgactgtataatgcccacggaagtgtcaataatatcccacttggaattgaggtcaagctgtgagtcaatgattaattgtgacagttgtgactatgcaaaacccaacatcagatattctgtgcttgagacagctgcctcttttggcaaggtgccaaatttaacccagccgaaaaaataagccccgcctactcggtggagtataaatagcctgtcatttccagcaaaagtacattttttccattcatttggaaattttgaaatttttctgcaaacgactaacgcgctctttcccttttgcttcctcgctctctgtgcactatttaaaccaatttaaccataaccttttgtttcctaccatccctttaaatttttgcattccctctttcttcactatttaaaccgaattcaccaaataaaaaatataattccataatcttccaataaacctataacaatataatttaaataatattacaattaaataattaattacaaaaatactttaattttctacgtatccttacatcttttacctacttacccttttttgcttttgcttttcctctttgctcactatttaaaccaatttcaccacttaattttaatataaatccctcaatttaaaaaatataaaaaaactcaaataaacttaattaaatcataaaatttttaaaaaactttacttcataaaattaaaaaaaaaaaactttcctttattcatatatacatattttacccaatcaatcaataaaaactataaatatgaagcgtgcctccaaagcccaatcttcatctccctcccccaaaaaatctcaaaccaataaatgcattcgtaaaattgaccaatttacttccaaaagtcttaaacatcattttatccgttccaaatctaaatttgttattgatcaaattgaaaaatgtgcagatccacaggctgaattacgttcatgcgtgcacaaggcggtcgaggaggctattcaagacgcacagaacacacttggagcaaataaggtaggtgtcataatttcttcggaacttttagaccagggagacatcatactgcctataactccaattacatcaaatgtcgtggacgccgttttcaaccagttttgtaaagtggagcagagcaaatcgaaacacatcaacttatatggtgctccctttataattaccgtcaccgtcctcaacactaatggactaccgcgacaacggacaacaaagggaaaagggcgaccacctgtctcctcacaatcgcacattttcaaagtcaacaacaacgacaactattgccttttttatgcactggaactgatgcgctactactctttgtataaacgaggaatcattaccgaagacagatggcggtggattaacaacaaccaaactactgttcttcgtcaaaaagtactacttttactccgcgatgctgggattccgacaacagagacggagtacgacgcggaagtttatatacatcaagtgcaagggttatggaacgtcaaatatccaggtgagtacaaaattttcatatttaacgattaccagatgcgcccaatcaccaaatccgatatcaccgactaccaattccccattcttctctaccacaacaacaaccactttgacggcatcaaaaccctgtccaaattcttcaataaacgttactattgcctctcttgtgaaagcgtctacgagcgcaaatctcaacattcaatgaattgctcttcactctgccatggatgtagggaggttggcgtcgactacccatgcgagccacaacagggatacttcaaaaaatgtttgcactgcaacaactatttctataacaacgactgctatgaacgccacctccacaaggatttgtgcaccaaatttcagcgttgcgaagattgtggggtaatttataatgttaaggttcacggaaatgtaggccaccaatgcggagaaaggttttgtcgtctatgtaagcagtttcatttaaaagaggaagatggcgagaacccctgcaaaagctgcttcatccaacccctaaaaccccataaacttaaaccatacaggatcatcgcatacgattttgaggcgacacaggataaaaaagtaggtaataaattcgaacacgaggtaaactttgcagcggctaccgttatttgcaccgaatgtatcaacaacgacaactggaacaaatctctacaaggaaatccctgcaaaatttgtggcccctaccgcacaatcaccttttcacccttcgactacacggagacaacagtcgaccaaaaaattgtcacacaacaaccactaagtgaattcgtccagtggcttcttttcgaccacaacaaaaagtttcccacggttgcctttgcacattttgggggccgctacgacatgacgatgatcatcaaggaggttttagcgcaaggaattcacaacccggacatcatcaaacaaggaaatcgtctctacgagctgaaaatcaaggacaatgaacattgcccactcacataatgcccatcaaactatctggcctcatcaaatcttttgggcttcatataaaagataaacaacattttccacacatgttcaacaaatcatcaaactatgacaacattctctcccatcttcctccacgtgaagaatactgtcctgatcaaatgaaaatccccgatcaacagaaatttgacaaatggtacaataataattacaaccaaccttttaaccttaaggaaaaactccctgaatattgttgcaatgacgtacaaatactcacccacgccctcgtcgaattacgccgggaattcaaacaactgacacaacggaacggaaaacacgggggaatcgacattctttggcaagccatgaccattgccagcgcttgcgtcaagaactttgcactcaatcatttgaagcccaactcgctcgccatcgtcccggagaaaggctatacaccacaacagaaccaaagtgcactggctatcaaatacctcgactggtactcccacatcaacaatgtcaacattcaaactgcacactcccgctatggtgaatatgtctttaaacgtgagggtcaggtgtatcaagtggatggttatataaaagggactaatgggaagagggataaaattattgaggtaaatgggtgtctgtggcacgggtgtgaggagtgttttgaggacttggacgaagagacgaagatgccgaacggaaagacgctaggacaattaagagagaggggagtaaggaagcacgagattcttcgccggtacgtcgacttggaggttatttgggaacacgaaatcaatgagcagctgaagaaggacaagcaaatgagggagtttttcgacaactggaaggaccactcaccaatcaaaatcagagacgcttttcatggaggacggactggaccaatgaagctactccacacagctaagccgggacaaaaaatcagctacaaggacttcaccagcctttatccgtggaccaactttacgaccgactatcccctcagccacccaaaaattatcagctttagattaaatgagcaaactgtcaactggcgagctccttccgacaacccctacaaaggccttctcaaagtcttgcttctacctccaaacaacaacattaacgtcaccgttatgcccataaaatttgatgagcgactcctctttccactctgtgaaaagtgcgccaaacacatcaccaatgaacacccgaatggcctcaaagacgacaactacagctgcccacacttcaatcccaatgaccgtgcctttgtctctacctgcactcaccttgaattgaatgctgccttggaggtcggctacaccgtcagaaaactcttccatgtcctgcaatacgaccaatggagcgacaacatcttcaaatcttacgttagcgaaatgatggccctgaaaatccacgcaaccgggttcccgtcgtggtgcgagagcgaagaggagaagaaggaatacattgaggagaaccgtcagcgatttggaattttgttagacaacgaaaagatgaaggctgaaccggggaagcggtacatcgccaagctttgtctcaactcactctggggccgcttctcgatgcgaaatctactctcaaaagcaataatcaacaatgacccttgcgtcctccgccaatacactgacgacaagaaaatcgaattagtggacttggaaatgatcgacgacgacaacgacgtattcatgctcacctacaaaccaaaagaggagtttgtcgacgaaaataaatactccaatgtcgtcatctccctcttcacgacatctgcagctcgcctctacctctatgaagtgttaaaaaaagttgccgacacccccgactgcgaaattctctactttgacacggacagcatcatctacgttcaccccgaggaaaacgacccactaccaacaggaaagggacaccttggagaactaacagacgaaaaccccgaccacaatatcttggagttcattagtgctggctgcaagaattatgggatgaagctgcaacgcaaggacaccggtgaaatagaacacgatttgaaaataagagggttcacccttgatgcacaaactgttcaaaaaattcattacgatactgttaaggaccaaatcttacgctatggctccgaagacccccctgaccctatcattgtaacttacccccattttattcgccctaatctaatccaaggcaaagtgtatactcattccctcacaaaacattatcaacccatattcacaaaaggtattattaatgattcattccaagtcctcgaatttggttatcgcaaatgataagtatgcattctcaattaaattttctgtatattagttttcttatggttcccttcttttctttctctctgtttatatcactcatgtgggacggaatgacccctggttgatcctctccaacactccaggccatccatctgagatgaaggtggacgagctgttcattattgtaatgcacagcctggtgcgtgagtgtttggattggggaccgaagggtgaagccgttccctgggtgtgtttgctcactcttttcaaagggaactctaagaattctgatatgccttcaaatctatcaaaagagttgcatactttctttttatcatttctctttattttctattttacacttgtatttttcatttgaatgtttattcagaaataaaattgaaaaatgtgtcattactaatattaaaaggtataaattaaccaaacaaaaaggtatttaaggagaaaaatagtcagggttttgtaactcaatttggaaattagaatgtcttctacttcttcaaagaagactctccaatctgtagtggagcaagtaattcaacaagacgcagaaataaaaagcagtgagaaaccactaaaacagaatgagttggaaaagagtgaacggaaatcaacccacaccgtatataacttgcttgaccacaaacgatccttttggaaattggcccgaccaaagtttgcagtgatcaactttctctgcccagggtgtcgtcgaatcaactataaacacaaggaccagttcaagttgatgggagaagatgagttccactttacccaagtgatgtgtcccggttgcgtaaagtacaatatgatgcagactgatatctataacaaacacacaaagaacccccactaattgtatttaagattaaattttaacattatataattaataaagatgattgatgaaaaattttttcacttgaacgatttgaaattaaaattgccttttggcatggtaataagtggaccgtctagtagcggtaaaacaacatttttactaaaatttttgagagagagaaatgaattgattagcccacaaccaaaatcagtgctctattgttatggacaatttaatgatagtatccctgtactacaaaaaatgggtgtacatgtgcacaaaggacctcctagggatgaattgctgagctctctaaagaagccgctcttattaattctagatgaccttttaacaataattgatgagaaaagtctatccgaattattcattaaaaaggcccaccatttgaatattggagttatatttataacacaaaatttgttcgagagaaagatgaaggtagcccgaattaattctcaatatattgtcctaatgtccgccccgaatgccgcgctacaaatacgtaatttgggtgttcaactgtttccaaaaaatcttgcatttttcctaagtgcgtataaagatgccactttatcaccttatgggtatttatttttggatttacacccggcatcgacccctttactgagaatacggacgaggatatttaaagaagatgaagaaaaagcattgtatattcaaaatgattaatttacctaaaaatgttattcaaaacttggattttttaaagaaattggtaaaaacaaagtcttttaaaaagagacaacaaatatttaaagaagcgactagtgaacaaattgcattattaattgaaattagttataatatattaaaggggtactttccgctcacgaagagacaaaaatatagacttttaccatacgcaaattttgtaagaaaattagcaagagttagaactgagacgggtgcaaagaaagtttttcaacaaaacggtggtggttttttcgttaatttgactcctttattattaccagtacttattgccgcgctaaaatatggagaataaatttattctcgttccctcagacttgtacaaaaatttattaaaacctgagtctggcgagattaatgttgaaaatgctaaaaataaattgtcatcacttttgaagcagcgaaaattggacgctacttcaaaaaatttactttataaccaggaattgaggcgtttcttgaaactaaggaaggaagttgaagataaaccggtaaaggttgagctttcagatggctcattaatggtgtttaaaccaaaacagcgtgaaagagatagcaaaattcctactcaaattgttaatgatgaagaattggatgaaacaggctctattccaacacttgaagacccttagactactgctgaagagagtgatgctgagccaacaccataaacggcaaagacgagaccattgataagaccaatgcgtg

SEQ ID NO: 1162 - DNA, 2015 bp, Heterodera glycines
aaatttgaatttttgggtgtatattccgtgggtggaggggactcttatgggggggaggggagggggcgcgctttggggtgtggggcggtgccgtagggtgtaaggactatgttattttaattaaattttattttaaattaaattttaattattattttaaattaaataattccccaaataattatttcccatcagtgggaggggggcgcactcattgagggaagagatgaactttattatatgaaatgtgaaaaataaataaaaaaatgagaacagatgggaggggagggattagcagtgggggcaatcactgcggcacttctgcttccaatactcaacaatctgcctcatccttttgtcacggtcgcttcgacgggacgaagtggtggatgaagaagaggaagaggaggaggacaccgagctgaaggcagtgtccggtctgttgtcaaacagaattgctcgggcggtcgcgatctgttcggccgagaggcgcttgtaggcagtgcgcacacattctctaggaatgcgccgtgaagacgaaggggcctaattgggggggggggggggttacatttataggtaaaaggggtttaggctaccgtttgcagaacatcgcacaacggttgaggcgtcggggcatcgtcgaccggggcaatttggagtgccggtgcaaatgcatgttggttctgctgctgaccgaattgaagaggagggagttccaaggcgccctgaagccgaggaaacggcgagttgatgaaaaatggcggaaaagcgggccgcagaggagacatgttgtgaaaatgcatttggagcacgctaacggcacggtcgacaatctgcgaaatcagcggccgaggcggcagcagcagttgttgttggtgttgtgccgggaacaattgctgcggttgttgttgttgtgccgggaacaattgttgcgggtgttgttgtgccgggaagtttgtcaattgttcgccgtcaatgtccaattcgatctccacgtctgccggagggacttcggcgggtgccggtaggacaacggctggcggggcaatggcggcagccggtgggacagcagctggtgccggcgggacatccgcgagacgctccttaaagcgaatgcattttgttttttttgctacacttattaaaattatgttaccaacggcacacattgcccgtcgataaggccttgaagggcaaagtcttgctcgccggccctcgcaaaaacgctaaatttacaaaaaacaaacaaatttgtgctgatagacacggtttcttacactcttctggccttttgaacattgagttgcccgttttcgttggcgtaaatgctgacaaaggtcagaagccgacctaggctaaacccggcctggaataaaacaaattatttttttttgaccattcaatctttacgtgtgctatgcaaccttcatctttaagataaaggttgacgccccagtgggtgcgaatttggcgatgctcggcgcggtacccaatgtggtaccatagccgagtctcacggcaaattgtgcacgggcttttatcgtacaaggtgagcgagacaatttcaaattcggttgatccgtcgtcatgctcatcaatgtccagagcatcctgctcagggtgccgatgcacacactaacgcaaaattttcattaaaaaaattacgtaaaaatgctatttatttttcttttcatgtttttaaacaatataaagtaatagagagagagagagagagagaaaatatatttaacatgatttgttaagaaaatccctcattttattatttcaccaaaattgactatgcatatttgatcaaagcccaaattttattattgaagcgtcgccaaatcatttcagtgggacgcctaaagtcacttattcttttgtgtccaatattcctagcattaatctttgttgatcactccccgagccaaacaaaggaagataacatctttggccattctgacaatgaaaagacggcagattgacaaaagaaacaaatttttggaaag

SEQ ID NO: 1163 - DNA, 2997 bp, Heterodera glycines
agtccgttgatgagcggtatcgggttcttcccggtacgttagagataattaaatacaaaatgtcctgaaattttaggattaaaaaagtaaggattaaattttatcattaccatcaaatcgtccggcgttgtgcgcaaaaatgtacgtatcataactggtaaaagcagttaaaatccactccacaaaatccttcatcggctcatgtccctcagcctcactccaatccttggtcctcacctccccacaaattttgcaattcgtcctatttttgtcgtcacaacattccgtacacgtaactctcaccgaaatataattgatcacatgctctttctggtcccccttataaatcgaatcctgcgatgtttccgaatcctgtaaaacaagacctattttgttgttttgttgtaaaacttacccaaactacaattctgtagacgtccttgtcctctttttcctcaatcggcataatataacatccccgcttggggtcgtggctcacactacaaagttggcaataagtctcaccacattcatggtccttcttcggattaaataaataagtcttatcacaaatcacacaacgtttccataatttacaagtctgatgtccttgatgatagttataacactcccaattgtaaaagtaacggcgacacttcgggcattcaatcttcactccactctcctttccacacggtactccgcccactctgttgcaataataacaccttgcccgacactccaaagtatgataaatatcacgcgagtaaaagcactcacaatcaacgcaaaatttcctcccgcgattaaaaaagcagacgtaattcttcagaccatcccagtgagtgttctccaaaaatatcggcacgaccatctctcgccccataggccccttccataaaacacggatcgatttccgcggatccgcagacttctcaaactcaacaatccggaattttccggggtaaatctcatcctaaaaatcggtcatttctgtgttaacaatttttaaactcacccaataattctgaacattcgataagtgctccactccatagctatattcgttaatatcaattccacaattacgtaatagttcaacagccgcctctcgttgtctcataatattattcataaaacgattaaaaatattccgatgcacttccaaataaagctttgacgccaccaaagcataaaacaaacaaattttatccacattcgaaatccttaataaataattataatttttttttctgttttccttttttttttctcttttttttctcaaaaactcaccttatccgttggtgttccttgaatccgaaatcaaatttgtgtacatttctcggcccttctccactgggcacggtgacgcaagtaattttcatcataataggctcagacaacaaaagcgttttcttattttcatccccgtccccgctctgccctaacttattaatctcctgcataataacatccgcattgttctgcgggtacgccctgtacggtaaccataccggggaagcaagcccggcacccgttattgccacaccaaacatccgcactttccgcttcatcctttcttccgtagtcttaaaagccgccttaatcattgtgtcgattgcgtccctcatcgcttcgtcagggcgtctcacatccgaattgatccgaaattccgtaatgttcttcgtgaatccaaatttttcgcaaatcgtcgaccgttcgtcaattaatttataattttccatttcctcagtaaaattgttcctgaaaaattattgattacacttgtctcttaaatatattattaaaaattgcttaccctatagctcgaaaatcccattttttggtcgacggaccgcctttttgcaaagtcccgttgcgttttgaagtcattttaattaaatttaatatatttaaataagagcgcacaatttttattttagcaaaatccaacttttggttgaactgaatggagaagtgaatttggggggcttttatagtggccgcagaatgcctcgtgtcagctgacacctggcacgtgactgtttttcattgacattgtggaatatttcgttgacaaatgataaattttccacgaatgggcagaaagtcacgtgtctattgcgaaatatgcaacaaaaaaaaagtcacgtgcagattgcgaaatcgatggggaaaatgcaaaatagggaaccaatcaatcaattttgattgacaggtgacataattttggtcaatattgcgaaatcgtaaagtcacgtgcaaattgcgaaataatggaagagaaaaaaaaaagaccatcaattatttcagaaaattcaatttcattaatttaaatgaatttttatttattcaactattgtccaattaatattcctatatcatacaattaattcgaatttcattgacaattttggtgcttatcgattttttttttcacgactcggaatcgcggcgcatcgacggagcggatgagagtggcggtctcattatcgattaattttttttttgcgcggcagcgacatcgatagggaggacagtgctagtgtcattatcgattatttttatcgattaatttgcgcggcgatgcatcggcggggagggatgggggtagtgtcattatcgattatttttatcgaatcatttcgcggcgatgcatcggcggggagggatgggcaaaaaaaaaaaagcacccgtgcggatttgggaaattggattgggtgggcggcaacttcaaagggatgcacccctcccataggcatgggtccacgggcggcaccttcaaagggctgcacccctcccataggcttgggttcgtgcgggaaacacccgtgcgcaacttcaaaggactgcacccctcccataggcttgggttcgtgcgggaaacacccgtgcgcaaccgtgcgcttttgggactatatactacttctgtcttcaatttcttcatttcctttcgccaggggtggagcaaaagccgtcaaaatagctaaattt

SEQ ID NO: 1164 - DNA, 2517 bp, Heterodera glycines
gataccatttatatttttagaatgaggagctgtcccccacagcaatttcacaaattagtcgagcgaaaatagtaaacttgagattattgaccttatcaactgagttcttctgcaacactgattcatttcatttttgtagcctaaggagtcgaaactccgaaattctcttggacttattaaaaatcatctcattacagtctaaatattaaacattatcagtggtgcagaggaccgagttgattagcgtcaacaatttccggtttcaattttctcgatcacccttgtgaaagttcgaaattttaccttcttctcctctaaaaataattgtagaaattaacagaaattgtagatgtgaatttgttgagctttttataaattcggtccttccccaacactgataccatttatatttttagaatgaggagctgaaattgtgaacaatttcacaaattagtcgagcgaaaatagtaaagtggagattattgaccttatcaactgagttcttctgcaacactgattcatttcatttttgtagcctaaggagtcgaaactccgaaattctcttggacttattaaaaatcatctcattacagtctaaatattaaacattatcagtggtgcagaaggattttctcgatcacccttgtgaaagttcgaaaatttaccttcttctcctctaaaaataattgtagaaattaacagaaattgtagatgtgaatttgttgagctttttataaattcggtccttccccaacactgataccatttatatttttagaatgaggagctgaaattgtgaacaatttcacaaattagtcgagcgaaaatagtaaagtggagattattgaccttatcaactgagttcttctgcaacactgattcatttcatttttgtagcctaaggagtcgaaactccgaaattctcgtggacttattaaaaatcatctcattacagtctaaatattaaacattatcagtggtgcagaaggaccgagttgattagcgtcaacaatttccggtttcaattttctcgatctcccttgtgaaagttcgaaaatttaccttcttctcctctaaaaataattgtagaaattaacagaaattgtagatgtgaatttgttgagctttttataaattcggtccttccccaacactgataccatttatatttttagaatgaggagctgaaattgtgaacaatttcacaaattagtcgagcgaaaatagtaaagtggagattattgactttatcaactgagttcttctgcaacactgattcatttcatttttgtagcctaaggagtcgaaactccgaaattctcttggacttattaaaaatcatctcattacagtctaaatattaaacattatcagtggtgcagaaggattttctcgatcacccttgtgaaagttcgaaaatttaccttcttctcctctaaaaataattgtagaaattaacagaaattgtagatgtgaatttgttgagctttttataaattcggtccttccccaacactgataccatttatatttttagaatgaggagctgaaattgtgaacaatttcacaaattagtcgagcgaaaatagtaaagtggagattattgaccttatcaactgagttcttctgcaacactgattcatttcatttttgtagcctaaggagtcgaaactccgaaattctcttggacttattaaaaatcatctcattacagtctaaatattaaacattatcagcattgtgtgacggagtacctggataactggcattcctgcttggatttttcgtcctgaactcagacgtgaacacccgctgaacttaagcatatcagtaagcggaggaaaagaaactaacgaggattcccgtagtaacggcgagtgaactgggaagagtccagcgctgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcaccccccccctctcctccccgccccattgtttgtcctccgatcgccccttttctccattcttcgccctcgggcgatgcgtcgcccatccgatgatcattattattattattacagtttatgtttaaatttccgataattcatctacagaaatgactttgttggtagctttttcagaatgcttcgtttgctttttaccttttccacaattttcacgggtttcggcctcgcctcgcccattaaaaatcgttcatcggcaacagaaacagtcgatgatcaaccacaaaatgtaatttattatttttaaatgttaaaataaaatttaatttaaacgcaaatttttttttgtagcaaatcggcacacaattcgttgaagtccgtcggttattagatgaaataaaaatagatgcaataaaacaacatggtcgcttctctgatcaggcaataa

SEQ ID NO: 1165 - DNA, 1749 bp, Heterodera glycines
agaatgaggagctgaaattgtgaacaatttcacaaattagtcgagcgaaaatagtaaagtggagattattgaccttatcaactgagttcttctgcaacactgattcatttcatttttgtagcctaaggagtcgaaactccgaaattctcttggacttattaaaaatcatctcattacagtctaaatattaaacattatcagtggtgcagaaggaccgagttgattagcgtcaacaatttccggtttcaattttctcgatcacccttgtgaaagttcgaaaatttaccttcttctcctctaaaaataattgtagaaattaacagaaattgtagatgtgaatttgttgagctttttataaattcggtccttccccaacactgataccatttatatttttagaatgaggagctgaaattgtgaacaatttcacaaattagtcgagcgaaaatagtaaagtggagattattgaccttatcaactgagttcttctgcaacactgattcatttcatttttgtagcctaaggagtcgaaactccgaaattctcttggacttattaaaaatcatctcattacagtctaaatattaaacattatcagtggtgcagaaggaccgagttgattagcgtcaacaatttccggtttcaattttctcgatcacccttgtgaaagttcgaaaatttaccttcttctcctctaaaaataattgtagaaattaacagaaattgtagatgtgaatttgttgagctttttataaattcggtccttccccaacactgataccatttatatttttagaatgaggagctgaaattgtgaacaatttcacaaattagtcgagcgaaaatagtaaagtggagattattgaccttatcaactgagttcttctgcaacactgattcatttcatttttgtagcctaaggagtcgaaactccgaaattctcttggacttattaaaaatcatctcattacagtctaaatattaaacattatcagtggtgcagaaggaccgagttgattagcgtcaacaatttccggtttcaattttctcgatcacccttgtgaaagttcgaaaatttaccttcttctcctctaaaaataattgtagaaattaacagaaattgtagatgtgaatttgttgagctttttataaattcggtccttccccaacactgataccatttatatttttagaatgaggagctgaaattgtgaacaatttcacaaattagtcgagcgaaaatagtaaagtggagattattgaccttatcaactgagttcttctgcaacactgattcatttcatttttgtagcctaaggagtcgaaactccgaaattctcttggacttattaaaaatcatctcattacagtctaaatattaaacattatcagtggtgcagaaggaccgagttgattagcgtcaacaatttccggtttcaattttctcgatcacccttgtgaaagttcgaaaatttaccttcttctcctctaaaaataattgtagaaattaacagaaattgtagatgtgaatttgttgagctttttataaattcggtccttccccacactgataccatttatatttttagaatgaggagctgaaattgtgaacatttcacaaattagtcgagcgaaatagtaaagtggagattatcgaccatatcaactgagttcttctgctacactgattcatttcattttagtagcctaaggagtcgaaaactccgaaaatctcttggacttattaaa

SEQ ID NO: 1166 - DNA, 795 bp, Heterodera glycines
caagaattcttcggtgaattttacatcgttggtacagggtctcctccagggaaaggcaaatgccggcaattatgcagtgttttctacacattcattatactgagacggaaagaaatggatagttgtcaaaactgactgacctccttcaccagtccgtccctttctgtctccaattgctttacgtactgtccattttcttccgccattaattccattcgacgttggcgaccctccaattcttctttgccctccaaataacgttttttgagcagagcaaatacctaaatgtccaataaagcagataataggcattaaagttaggcaaaaatggggaacaaaattcaaaaatcggcaaaaattggaattataagcccacaccgtcctaatttataatattttataataatggcacaatgctgcaaaaatgcccaaataataaaattgtttttaaatcttttcgtcttgtttggtattaaaatcatcaaaaataaacgctttgaaaattcccacaaaaatcggcgccaatttgccattttggctcaccaccttaacaattttcagctcccaattgcgctggcgttgcacaattttggcggcgtgcagcagcgcatttgcgcactgtgcgcattcgccggtgcgtccgctgtccacaaaatgcgcgtcgcggagcaaagcattgggaccagcagcagcagaggaagaagaagaagacgaggtggaggggagaagggcagccgcaacggaagaacaattggaggaggagaaaagagaagtgcggccatgctgaaaattgga

SEQ ID NO: 1167 - DNA, 1733 bp, Heterodera glycines
  misc_feature (1651)..(1651): n is a, c, g, or t
gcaataaaattacgaaatgcctcccgacctttagttgtttactgttttttgtgatcagcaaaataaaagttgcattttttgccattgttagcacctgttgctgacaaaagtccaaaagcgcgtccctggcctgcaattcgccctcatataaacacaacagctcgagcatttccttgctgctgtaaagcggtggcgactgcaatttctccacagagtgcgccgtatttttcattgtcacagaccaaggaacagcagcaggaaaggacggacgtgaagcaaaaacccgaaaaatttatttttttgactcgaaataaaatgcagatataatgccaaaaattggaaattttcaaattcaaaatttacctcaaacagaggtatgtaaaaacatatggaaaaattaaaaaatataaaataggtaaaaccccaagttcagatccagacttttttaaaatgtcgaactctattaaaatattcccagcggaatctaaacacacaaggcaattaaaacagaaaccaaaagtgcatttatttagcgttcataagaaagattcggaggtggacagaattttaaaattcctcgtaattttttacaagtaatgtgcaaagaacagaagcgttgttgatatgccgattaaagcatacctaattctttcattttttatttatattatcaatatgaaaaaacctttatcgatatgtatatgtcaaaattttttcccttgttcattttagcattgaatttctggtaattattgtagttgaaacacagcgccagtgacgcattgaccatggactacggcttgggacgcatacgccgaagactctccaactatggagcgatgtcaccgacaaagagtgtccaggaggtgcaacccgtggctttgtcttgggaccgtctcaccgttcggcaatttcttggtaaaccagtcggagttgtgtcctctatgtcaaagattgtttcgactttcttagactacgtgtccggcaaggccgacactgaccaactcgtggcactaatgggcgacggcggagtgggcaaaacaacgcttttgaacactttgctgaaccgaaatttgaagaatctgagcatggaggaccaagtgctgatcaacgcgcattccttgggccaattcatcaattacgtcatcaaggtgagtcttagcgatgcgaagtgcggaggttcgtgattccttgactcggatattccccaaatagtttttcgaaccccttttattatccttataatttgcatccaatttcagtacgtgcaacatgacgacttgttcatgggcacgctgactatgaaggagcatctgatggcgcaggcacagcttcggatggtcggacacacccaacggacgatgcgcagacgcgtcaatgaggtgggatttgggggatggacagaggcagtagcaaactggaaatcatttaaggtaattgacgagtttggtctgcaagagtgtcgccacgagcccgttggattcagcggggtaattatcatttttttcaaatttacaaatacaatttttaggacaaaaagggcattttcggggtggtgaggcggcgtccgtttgctgttcgcttccgaacttatgaacaatccgcaaatcatttttgccgatgaaccgacaaagtcaatttttggttgaanatttcaaaaagtccccctttagagctcgaccttgtcgtggcggacagtgtggtcttgaaagtctgcgtgcctgactttctac

SEQ ID NO: 1168 - DNA, 3690 bp, Heterodera glycines
cccaagttcagatccagacttttttaaaatgtcgaactctattaaaatattcccagcggaatctaaacacacaaggcaattaaaacagaaaccaaaagtgcatttatttagcgttcataagaaagattcggaggtggacagaattttaaaattcctcgtaattttttacaagtaatgtgcaaagaacagaagcgttgttgatatgccgattaaagcatacctaattctttcattttttatttatattatcaatatgaaaaaacctttatcgatatgtatatgtcattcccttgttcattttagcattgaatttctggtaattattgtagttgaaacacagcgccagtgacgcattgaccatggactacggcttgggacgcatacgccgaagactctccaactatggagcgatgtcaccgacaaagagtgtccaggaggtgcaacccgtggctttgtcttgggaccgtctcaccgtttggcaatttcttggtaaaccagtcggagttgtgtcctctatgtcaaagattgtttcgactttcttagactacgtgtccggcaaggccgacactgaccaactcgtggcactaatgggcgacggcggagtgggcaaaacaacgcttttgaacactttgctgaaccgaaatttgaagaatctgagcatggaggaccaagtgctgatcaacgcgcattccttgggccaattcatcaattacgtcatcaaggtgagtcttagcgatgcgaagtgcggaggttcgtgattccttgactcggatattccccaaatagtttttcgaaccccttttattatccttataatttgcatccaatttcagtacgtgcaacatgacgacttgttcatgggcacgctgactatgaaggagcatctgatggcgcaggcacagcttcggatggtcggacacacccaacggacgatgcgcagacgcgtcaatgaggtgggatttgggggatggacagaggcagtagcaaactggaaatcatttaaggtaattgacgagtttggtctgcaagagtgtcgtcacgagcccgttggattcagcggggtaattatcattttttttcaaatttacaaatacaatttttaggacaaaaagggcatttcgggtggtgaggcgcgtcgtttgctgttcgcttccgaacttatgaacaatccgcaaatcatttttgccgatgaaccgaacaaagtcaatttttggttgaaaattttcaaaaagtccccctttagagcctcgacttgtcggtggcggacagtgtggtcttgaaagttctgcgtgccctgacttcctacgggtgtacaataattttcaccatccatcagacttcgttaaatttttactgggtacgaattcgcgtaaaacttaatgttcaatgtggtcccgatccctcttcaatgtgtaaattatgacctttttatctaaaaattaaccccagtaatttgcattaaaaaaaatttgaagagaagaaacaaaaagtttgcacttatgccctatgccaaattctttattattaggcccattatttttgaaaaaacctggtttaaccagtttgggagaggccggactcgggaaccggctgcctaagaaaatctcggtctattcatgttattgactattttatttgcatttgaatttctggccatttgtagttgaaacacagcgcaagtgacgcattgaccatggactacggcttgggacgcaaacgccgaagacagtccaattatggagcgatgtcaccgacaaagagtgtccaggaggtgcaacccgtggctttgtcatgggacggtctcaccgttgtccatgccaaatcgggacggaaaattcttggtaaaacatgttggggttgcactcattgtgtatataaatttctaccttttacagacaatgtgtccggcatggtcgacgcgggccaactcgtggcactgatgggcgccagcggggcgggcaaaactacgctactgaacacgttactcaaccgaaatctgaagagtctgagcgtggaaggtcaagtgctgatcaacggacattcctttggccggttcatcacttacgtcagcggggtgagtcgttgtgattcaatgttcaggtgttgcggttcggaacctggattcggaaatcccttgggtttttggggcctcgtttttcgaaccctttttttcataataattttccacccaatttcagtacgtgcagcaggacgacatgttcatgggctcgctgacggtggagcatttcatggcgcaggattggatggtcggagacactcaacggacgaagcgcacacgcgccaagaatgttctggaggtgcaacccgtggcattgtcttggcacggtcttaccgctgtccatgcaaaatcgggacggaaaatccctggtaaacacagccgagttatgtccattatgtcaaacactgtcaagttttttttagacgccgtgtccggcttgaccgacgcgggccaactcgtggcactgacgggtgccagtggggtggacagaaccacgctgttcaacactttgctgaacaggaacttgaagagtctgagcgtggagggtcaattgctgatcaacgcgcactctttgggccaattcatcaattacgccagcggggtgattagtggcataagaaccgagggggtcaattgatttgacacatttctcattttttgaaaatttgacagttatgtttaggtgtttggttcgtcatttgtagtcagcaacattctccgtgttctgtctggattcccgattgtttttcgtattcaggtgggagaaattctccggcctttcaaacgtcaatatttatatcaaattattctttcttattttgtttatttgataaattttgttttgaaaaatgtcttaattgtgtcttaatttattgtaacctaccaatttgtatttattgaaaaattttcgatttgattaatgctttgtctcttctttagatggcagatcgcaggcgttatacacccactgtaagtctaaaactgtctatctaagttcagaatcactgctaggatttgcgaaactttacatagaaaattcaatgaaaaatattttcatttattttttatgtgaattcgattcaaaattagtcatttgaaagcaggtcatcgtaaaactcacggctgtgattctgagttaaaaattaataaaataagttaaattggataaataatttacgtcattgtcagaatccggttagtagcagattcccagccataaatgtactgtaaaaagggttaaaaaattacaaaattttaatgttatgttgaatgaggttgactcatacattatacttactgccctaaacttggccggtgtgatactgaccatcccaccggtagatactactgagataaacttgaataatgctcgaacatttttaaaaatcgttacgccaacacatgaaagaattttttgaagaatttttgggtttatttgtatacaaaattaccttttcaatttttattaatttaaaatgtacatccgagaactaaaatccccagatgaacttcttcccgttttatcgaacacaactcgttcttacgctcgttggaataatagtgtttgagttttttcttatttttaaattaaaaaaagttaaagtttattagtgtcatagtcagaaatggtcctcttaattattataatttattttcaggagcgcatgcgg

SEQ ID NO: 1169 - DNA, 5364 bp, Heterodera glycines
atccaaaacatccagtgtatgtttaatagaatttattgttgccttctctaattgcgccagtttagatgcgcaacctcttcaaattgcccaagccggcaattttcaaaacctcaatcagctcccaaattgttagtcaacgaaaatttccattcaaaattaccatttagtgcaacaaaatcaacagcaatatggtcagtatccgtttgttcctactcctcttgggtatccgccggcgcctcagggaaatccgtaatttgttcgtcgtcgtgtttctttcttttttaaatgttttatgtttgacaaaaagaataaatctgacaacttatttttgactttggcaaaaattttaaccaataaaaagctcgaaagttcaacgaaaaaagtcattagcattcttggcttattgttggtgcttcctcgttttcattgtcccgcttaaaatcgcatgtgccgacacgcatcacctcgtccattgtgttctgatagatgtttaggctcgcctgttttacgcacacatagtcccaagttccctagagaaaccgttgcccatttattccctttgacaatggcctagcagttgaaatggcagaagatgaggtggagaagagcagccgcagcggatgagcaattggaggaggagaaaaattgctaaagaaaagtgccgccatgctgaaaatggggccaatgaatggggataaccgaaaattttgcaaaaaggaggacggtttgtgttagcgttaaaacgttcaaatttgcacaggtttccagccatataattgtgaattcattttgaaaacttacgggaatttgggtcggtcgacgccgatcgataagcatcgaccggtaaacattggaatttgagaggaattatcccataatctcttgctttttacataacaaattcaaattttcccgtcaatcccagtcgcatactcccatcttccgcattctgttccatttctctaaaaacaatgtggaaattgtacgattttcgcatttacccaaacccgaaaaacgagttgaggtaagcctttgtcccttctgaataaataaattcgaatgattattttattggtagtcttctttaattcggtctcatccataaaatttgattttaattttataacggttgttcaacttataattatgtaatagtaatagtcatctcgtaactctttgaggccactcgaataaacaaaagtttagatttgttatattacgacaatttgtttcttttgaccaccaccagcaaatcaatctttttgccaaaaaatgcaacgaacatttttgtactcagacacatccgacattttacgacttcgccacttttacgcctccatcggcaacaacagcagaaacggttgacattcattctaaaattgtccaccaccgaaccaaacaaaaatgagttcactcctcagaatcctttttccttaaatcgaccattgaccatttgttgtccgagttggagcggacgcgcaaacacagctacgaattggccggacggaacagaaaactcgagcgagaaaacgagtgagtacagggcacagcacacagacccgggctggccaatgacatttttggccaaaattggtcaatttttggctttctaatttcaataattctcgtgaaattcgcgtccaccggtgcgcggtaaacagagaaatgcaaattttaagtaaattggtaaagaaaagtggaacttataaacaaaccctgtttatgggcctggtccgaccacctatcacatggcatattttgagcatttgaaatactcaaaaactttagcgttttgatgaccgaaaacaaggagctgaagaccaaactgagccaacagcacagccaatcgcagcaattctatccgcgaactccgaagaagcgcaagtcgcagtttccgtacgcggacgacaacgatgaggacgcgtactgctcgcggatgggcggcgacgcgtcggcggttcgccgctccgtttccatgccaccgccggagacaccgctgggcattatcggcacaaccgctgcgggacagagcgttgtccgtgccggcattaccaccgccgccgcacgccaggcactgaccgtcaacgccagcgggggcatcaaacgccgacgggcgctggtgccggcgttggtcaaaaacagtcggatcagccaatcgcatggcgacttgaccgggtggggaccatagttttattgcaagaaaataccaaaagacggcggcatttgatttatccaagaatcctatcttttaatggaatttttggactgaatttgtgagaatttttggcaaattctagtgaagttggtggttccgcggtgccgacaaataccgtttgaattcaataatttgtttgttcgccatttttagtagaaacaattcggacgaagcggtggacgacttgctgccgtcggtgtgcgaaagtccgtggctgttcgccgaccaaatggttcacgggttccagaagagacgcaacctcctcaaacactcgtgcactcgttgcgagaaaaccatcggtttcatgtcatttatgtgaaatgcacgcgatgcaaaggtaagctaagaaattggatttgggatgaaaacggattttttagaagtttttcacgagtcgtgccgccattttgcgcctttgccctgcgtccgtcggcacaacaccccgaaagtggctgggaatggcaacaaatcggctggacgtcctcgccttggtgggtctttgtttaggaggactaaccagccaaaatgtcggttctcttgcgtttttttggtcccactgaattttacgcgtccaaagtgccaaccgattttaacagtgaaatgaaaacctgttgaagcaatggcaagaaatgccatggaaagatgcaaaaaaaagaaagaaaaaacgtcaaaaagtgccaatttttacaagaaatccgcttattttcaggtgatttctgtcccgacgctcgcccgatggttcctccgctggtcattttctgcacttatttcttggaccactgcaaaacatacatgccgtacagggacttgtaccaaattgaggggtaattctttaatgaaacgggcaaaaagaaattctgagggcaaatttacgaccatttgtttattttgggccttaaattcaaaaatttccaaggaaaacattggttccgataggtgccataagtaaaaattgcaagccaaatcattagtggaaatgtctccatttttagaaaccctgctgaagttgaggccgtcacaaagcaatttctcgtcccaaacaaaagctacccgaaattggtacaataattgattaattatactaattattatttgcccctttttaggacgcttttcctcccgcagtcatttccgcttgtgtcaacaaatttttgatgcaaatccgcgacccgttgatcccctattcatatggcaaggagatttgtgcacttttggaccgctgtttggccatcgatgggcccattttggagggatttgccggcattgtcgaggatttgccagtggtaagtgtttccatttgctgagttttttagacctattcccattaaaaggcacacatggacacgttgggccacctttgtcgccattgaatcgtttggtcgcgaattcggtgagaaaattgtacaaaatttttgcatgaaattcactgacattcgtaattatgccataaaattcgttggcccaattttccactggggttttcattttgagacttttcttccatttcatttggttatggggcaaattttatggtccaaattgctctttcctgaattttcagcatttggcaaaactctttctactgacaatggtcatgcgttatttaaaaaattttatgtccattgaatttttggcataatttcctagtttgattgtcgaacccttaaaattcggacaactctgacaattattgaaaattgtttaagttcggtctgttgaccattgacgctctgtcagttccgcttggtccgctcgttttcggctccgctcgccctgactgtccgccgctgctgcgccaccgctgcgtcagtgccatggcccaattgcttcggttgggcaacgacgacttctggaccgacacttctgtccgcacactgaccaccagcagcagtgggggcacgccaattgtgcgcaatccgtcgcaacgctcggcacggagtgcggtggtggcggacggcggcggcggaacgccacagcagcccaattttggtaattcaaattcattttgaaaaatggagtccgagaccggtacccattttctattaattcagagccctaaactcaaattcgaacaaaaagacgaaaattcaaactttagtcacaaacccattgaaataccaaaaaacgctcctcccttttgctgcacagttcgccactaccagcagcagcagcttgaagtagatctgaacgcgacgggaaacggtgacaccagcaacaattgggagtcggctcggaacagccaacagtgatgatgaaagccgagatattgattgattgggttgactgtctgactttgtttgatttttctctctcctccggcccaattcactttcactctttgtttctgattacgttttgaacttttatgcctgtttttcccgcaaatttatgctttgccaccgtcaatcattcgtttatttattttatttttattgaaaattactttttctgaccctccatttatttgaatgagcggaaaaaaaatctgaggacgcaacaattagccaaagtgccgaattttgtgaacctttctcttgactctcattgattatgaatctcatcattgtcatcgcgtgcaccgacccgagttttgtttatttatatgacagttttttggagatattggcgataaaactgctcattttcggaatgtaataattgcacaacaaaataatgtttgatggaaggagacactaattagttaattaattagtaattagggaaggcacacaatattttgcataggtaaataaataagtgatcatttgaatgcgctgtgtgtggcgttgtaccttcttcagtcagcgtcagcacaggtggcaatagtaattaatcgccacgacaacgacggacagcggcacaatgacgagcagaagcgtgagcatattggagttcttgatggtccgttcttcgccatctgttatggaaaatgaaaatgacacgcgaagttggagcagttcaattcatcaacggcaaaaaggaaataccaaggaaacagtggcaaaatgcgcccggggcaaagcctcgtggcaattcttggcatttgcgaatatttgatggtttttgggacttgggccattgtccgcccgaattaggacaaaaagtcgaaaggatggggaataagttcgagtttctatccaatttttggt

SEQ ID NO: 1170 - DNA, 2833 bp, Heterodera glycines
  misc_feature (2769)..(2769): n is a, c, g, or t
gtcagcacaggtggcaatagtaattaatcgccacgacgacgacggccgccgcaccgacggacaacggcacaatgacgagcagaagcgtgagcatattggagttcttgatggtccgttcgtcgccgtctgttatggaaaatgggaatgacacgcgaagttggagctgttcagttcatcaacggcgaaaagggaatgccaaggaaacagtggcaaaatgcgcccgggcaaagcctcgtggcaattcttggcatttgcgaatatttgatggtttttgggacttgggccattgtccgcccgaattaggacaaaaagtcgaaaggatggggaataagttcgagtttctatccaatttttggtccggtgatattttgcattggtttcagtgattctcgcggtttttttttgtcccgaaattgtccaaaaataaaattttctttcaaatggcggttgagaaaagatacggcgaatagcatggcaattggataagttcaaatgccatacataacctatcgaaaaccttcaaatttacgagttgtccgtgccgccctccccggggatgatttaccggaaaccccgagagtcttgcccgaggcctaaaaaaacccgagtcgacacactctccatcaacgagaaacgcgaaaatgccggcctattgccaaaaaagttctgtctgatgttgccttcccccccccccgtgcccacccgtcggatggtcaaaggtggcgaattcgccgggtggcggatcaatgcgttcgaacacccggcggtcgtcctcgtcatgcggcgggcccatctgctgctgatgctggtactgctccaccgccgttcgaccgccgccacttctcccgcgtgccgtcgccgccgctgtgccggtgccaccgttgtcaatgtttgtgttcgccctgcgttttttgatttttttgggcattgaaaaacgcacggcatttttttttgtccaaccgaaggaagaggaaagtgttgcaaaagtgttcttcgccacgagcagatgtgagcccaccggtccaaattgcgttggcaaccaagcgcttcgttgcagcacgttcggatcactgaaaatgggcaacaaaatgggggaaatggtgaaaaaatgtctaatttcccaaacccaaaggcacacgccccgggggggtgtacggtatcgcatgacaaatgctttccgtattactgtaatctttatgaggtcagcactccgacaatttttgagggtcttggtataccctggcataaattcgtggttttaagaaggtgaaaaagccgcggtctttggtcaaaggtcgagactccgattcgagactgaaaaattcgatttcagcgcctaaaattacccgaaaaatattttgaggggatctcacaaaagggataagtaccgtttttcttttcccatttggctgtttttcttctcacattttgtttgttttttccgttcgccgtcgtcgtccctttcccttcgccggtgccttttcacttcgtccaccaaattttgttaaaaaagttgtcttccttttttgttctaccaatctccctctaccattgaattgcagcactgaaatgtttttattaattatgaaattctgcagatggccgcctttgatgcgaataacaatagccgtttatctccagaagtaaattttatttgcatattgcttagggtaatttggtctcagtttgttatcacgggtccggaggaattttcagtggaagaattcagaacaaaaatttatgagcatggaacttaatgtattaattctggttcggctgaattgtttaaaatttcacttcgtttaatgtttaagctgaaatccctatgagttttaaatttaccaaaaaataattttttggcgttttgccttaaagcttaatggaattcgttgtcagctttgttgcactataatttaacaattttctgtttaacttcttatgtacatccgagagttagaatccccgggtgagctccctttggttttgttaaatgcgcctcgttcttgctgtcgtccgactaagcatgttcggatttattaacatattacttttgcgttaaataaatacctattgtgattttttgagaaaggaaaaattttcaaactaatagtttgattatgattttggttcagtaacaccaattcaaccagtaaaattttaggaacaattccgagcagttttaaatctgagaagaactgcgcaacgccttacggtcgaaaactcgaggttggacagaatgaacgcgatgctggttgtactttttcagcgtcttacaggtttttttttttttggtttaccttggtgactaaaagtgcaaattttacttttattaaaaaatctaaaattgtgttgaatagaaatgtcgctttttcattgtttcattttactatggcatgtatggtcaatcatttatataatttcacaatattttcagcttttgccgttccaccggttgtacctgttgtgcctgtcaacgcgaacaataacaacagacacagctacaatgtatgttttcatttggtattaatgaataaacgatgaaaaataaaaattggacgcgaccgggactccgggattttcaagggatcctgatcttggtcccagttttggaaaatagacacccgataaaagcgagcttaaatcaagatttgaggtcggactctaactaacaattgggtttatcggtcttaatatattaattcaaaaaaatccggtgaatcttttctttttttttgaaaattaacatttattttagaatctaattattanaatattctattaatttttttatgacatcataaaccataaaaaatcaggaattacagcgcgaact

SEQ ID NO: 1171 - DNA, 716 bp, Heterodera glycines
tagagatcggtattttgaaaaaaacctggacctggatttcctggacaaaaatccaggtccaggaaaaatccaggttgccaaaaaatgacctggacctggatccaggaaaaatccaggcctggatccaggtccaggccaatcttagtgatttagtctctttttaatatgcggaattttttttttgaatttgaccaattttagccgcagttgctttgccgcacaatgtcaaccccaacccgccgggagttttccaaccgggtcagcaattgtttgacgacaattgtatgcgcatgatttttccaataagaaattttctacaaaaatttaatttgcagttgttgatgcttatcttcagaatatggacccgaactaaaagaaattcatccgccgatgatctttcactttattcattttaaaatatttaatgtgtgtgtgacaatgagaataaaatcacgacttatttgatttcattttcgatgtataattatttgtcattaaattattaaattttgatgttttttaagaaaaatagaaaaaaattccgcattccgttccactacgataatattgttttcgcttcattttgccattgctatttcctctaaaattaccaaaatcttgaatttgaagattttgaggaactttttattgggccagtggtgccgataacgcagaaggcggtgaaaatttggaatttggcctttttacatttttca

SEQ ID NO: 1172 - DNA, 2067 bp, Heterodera glycines
ttgcctaattctattatttgcaaccttgtcccattgcataatccttcattaacattcaaattacgcaataacataatcatcgcacccttttttaattttaattcatggtttggcatacttgaacatttaaatgaattaagaatttctggagtgaaagcattatttttcctttcgtccgtttcatctatgcttaaataaaccttacagttccctggaagtaaatctaaaatttcttcattatatttgtcacaacagcattatacggagataagattgcgacttcactaataaaatcctaatccatgttgtttaaaatattgccaaaaatttcatcaattcaatttcctttacttatacaattatttggaacttttatatatccattttctcccattgttccatttccaatcatgatcaaatcttcactgaattgtttttcgtttatatttgctcgcatgttttgtgttaactttaatgttttaaataatttccacattggtgaattttttattaacaaaatcaatttatttacatatatctaagccatttttagatgaaaaatgcgaatttgaaaattcgactttttgttcgaattggttcctgtgttcgaaattgattaatacaatttaaataatgatcaaagatattatgaaagaggtcaatttaaataatgatcaaagattttatgaaagagatcaaaatgatattatgaaagagatcaataaactttcagcaaaaacaacaacaaaatgttttttcctttctttatctaacagtaaggaattcgtgtcgaaaaaaaaactattttaaaaaggttagttacagcattgaattagtataatggagatttcgtgatttttcttcactaaaattcacgtccctagtcattagtacccttaattggaaaattcatatccatatttcatatttgtggttttttatatccatttttacatgcccgttattacgtccagccgtaataactcaaaacatatataagctctttttacggaaataatacaaagaaaaaaaacgatcacgaaatcctaaaagttgtttgaagggaattgagggaagaagaatgccgcgaaaaaaacaatttcgtaacataaaacaacaaagattattatgacaaataaggcagagtgaagtccaatggaaagcaaatgcaaagaaagaacgaaaaacaaaaaatgttttcgcttcaataaaaaatccatttctcattcaaaaaaagcaaaaattttgggacggaaagacattctcaaataatataatagatagatgacatatatcatcattagggctgccaaaagtatgcaaatgcatatttttttcctggcttctccatgctctaaatagtacgaaaaacactttcttttttgtgttcgtatgaaaatcgggacttttatttgcatatttttgcatattttgggcctttatgcatattttgcatattttggcttgttttacattttcatgcatattttgccatttttcttcaaatattttccgattttttgcatattttgccatttttcttcaaatattttccgattttttgcatattttgccatttttcttcaaatattttccgattttttgcatattttgccatttttcttcaaatattttccgattttttgcatattttgccatttttcttcaaatattttccgattttttgcatattttgccatttttcttcaaatattttccgatttttgcatattttgccatttttcttcaaatattttccgattttttgcatattttgccatttttcttcaaatattttccgatttttgcatattttgccatttttcttcaaatattttccgattttttgcatattttgccatttttcttcaaatattttccgttttgaatatcccttaagtaaattttggcagacaataggatgcgctttagtgccgaaaatcttgagaaattattgattttcaattgcaaaaaaaaccgataaaatttatgaggaataataattttttattggatttgcaccactaattttcaagtttttttgtgcatatttggtgcatattctac

SEQ ID NO: 1173 - DNA, 7960 bp, Heterodera glycines
  misc_feature (72)..(72): n is a, c, g, or t
  misc_feature (116)..(116): n is a, c, g, or t
ttttatttaagtgttaagtctcacccatgaaattcatcatcgaaatttcggttgcaaatttatataatattntggttcaaaataataattgaaaaatttgttgagattatattttntcgtacaaaaagtccaaatattttcgatatttttgacattctgtccgttcatattcttcaaatttatccgcaattttatcacatttccaattctttctcataaaaaatacaaagccaaggtgtgattcgtatttgttctttgaatatttactgatttgagtttttggtgtcctttcataactgcaattagccttttgtcgtcgtcctaattaaaaatgattaggtaaattaatttagcatgattaattgactgatggaattgcatttgaaatgtgaattagaaaatgatgaataatgaaagaaaagggattataaaaaatgagaatgatcatataattattcaaatctattttttacaaaattggatttgtatattgccttaagcaatatgcaattatttaaaaattagaattggtcatcataaattatcataattttttaattaatattttaactgcaattctatcaaagagttattaatcagtgtaattaatttatctaattttgattagggagacgacaaaatgctaattgcttttgttagagaaatgatcagaaaatgcaatgcgacttttcaaagcaaaaatatgagacataccttggcttatttattttatgagaatgaatttgaaatacgacaaaattgatggaaaatatgaggaatatgaacggaaagaatgccaaaaatatcagaaatatttacaataatttatgcggtaaattgtctggtcagaatttcgcaaatttattttcgccaaggacaacaatatgaatatataaattaaagaatttttcaattatcattttaagccaaaattattgaacgaggagagattgaattatgaatagaattgaaaaatgatcaaaaagtgccaattaatgaaatgattttgcaattggcaattgccacagcaaatggctgccaaacaaatgaaattgtgaacaaaataattcgacaaaaaccggatttatatggacaaaaaaatccataatatggattataatatggacgaaaaaattgcaaaatatggacgtaatatgaacaaaaatgctgaaatatggacaaaaaaacacgaaaatatggacaaaactttctgaaaattggtttgaaatttttaaaaaattaaaaaactcataaaaaaatttttaaagaaggaaaaaattttaattcatgaattttataattccacaatttagaactcccatttattatttactgaaatatatttgaaaaaaataaaaaaattagtaattttcttgtagaaaataatttttaatcgaatgtttctattcaaaataatggctcaatgtttcattcgtatttttgaggtcctggtttaaaaccaacacaaaaaaataatacaatttttaattattataacaaaactaaacagcgtataaaaaatcttttttccacaataaaagtgcataataatttttcttttagtaaaaatgagccaaatcagtcaatttttgataatacactacataactttttgattatttgttttcaatttttgccgttccggaaaatccattcccatttatccagacagaaaaatccataaataaatccaaagttgcacattccttgcgcaaggcacaacaaaggcatgacatcatcaaaattgaactcaacaaaatgaccaatatatttgtaaacattgaattttcgatggggacatttaaatcctcccattcactcgcatacaggtttttgccattatttaaatatttattttaaagcgccatttcgtttcagcaatcgttgattaaacaataaaattttcaacataatcactttacattcaattgtccacatgaaaattcattttaatttatcaaagcgatgattgacacagaaattaatgaatgttattattttgacaattggttaacaaattaatattaatgataaaatcactttgactgtgttaaaaattcgtttctttttaattccatttgattattcataaattaatattttttaaaaaataacgctaattaatatatgtatataatttcaaaaaaaaatcatttaaataatgataaaaatgcaataaaataataataatagtaatgaatagataattaacttaaactagggttagtcacggtcgtttaaccgaactgaaaataccgaaaaccagcggtaccaattttttggtatttggttttttgattttaaaaacacacccctttcagttcgctgagaattatgagcaatttttaaactgaaaaatattcatttaacaataaaaaataattcccccgaaggcgtataccggcaccgcaggatttattcgttttcccgaaagttttttaaggtcaaaatcttcgatttgaagttcatttttatcttatttcaaaaaagctagggaaggctgttttaaagacaaataatatccaaattaacaatttgcgcctagcgttatgtgacggaaattttaaattattttcatttttggacatttttatattcatttaaaattaaaattgttttgcatattgcttataagttgggttgacataagtaattgtttttttaattcatttgtgcttttgaaagcacttatcagtccatttaaattaagctgaccattggcaatccctaattcaaataaactaaattaattttaatattttaataaagacaatataaaaatataattaaattttatttgattctttaaaattaatttaatatttggtaattataattttaaaattatcagccattatgattaatttaatttttccattattcatatatggtataacaatgctttccgaattggccgaccacggtaatttcaaatttatttaaaaaaaaacccaaaaaatatattatctaatatcaactcaatattctagaaaatgactttccgacatctcttgatctacgctacactcggcgcggagaacgacgtattccttatccacaaaatcaaggtaaattcttgaatgaaaattttgttgaccaacatagttcggtgccactgtttccgtgccattgcggatgaagaatccttaattttttctcagttgaccaattttataaatttgatttatatcgacaaagaaggccattttaagatatttctaagcatttaaaaacattgtcaaaagttgtaacaaaaaacttcaaaaaaagtttaaaaattttgagttctctggcacgaaacgttggcacgaaattgaaactagaaaaatttaataggaatcaaggccaatagatttgttataagaacctggataagaaatggaatttaacatagtaggtcggattagggtcgagtccgacctgaattctgggtcgggatttggtacgcaaaaaacgatagcgataggttctgacgacaaacttgttctgcacccttttaatttttggtattctgattacggagggttcgcctattacagatattttggaatttttccatttccgaaaatttctagagcactgcggtgcctgttgggctttctcggcggcccttgttcattcggcagcagtttttgaaagccgagtcggcgagcgtgatcgtcttgtcctctattccgctcaatatttggttgattgtactattcgtaagaagaagaagaagccttcagaagcttgcaatgggattgccgtcatgaaagcattaaagttcactaatttttaattaaaaagggataaattgtgagggtttttgaatttcatggttttggggcccgacatttttgcctctaaatttgtaaaagcattatatctaaattcgcggctttttttcaacaattcgcaacgaatgcagtcaaaactttataatttttaaatcattggaaagcttaacatgtttcaaagctgcttctaactattgcttctcgattagacaattactaaaatagctatatcagaaaattaatttgaaatatttgaagtttaaagtttttcttccttaattttaacaagctaaaaagcttttcgaattttgtaagggtaaagaaaaggtgaagcgcttttgaatgatcacaagattattagatttggttgacaaaaaagtatagtcaaaaaacttatgttcgcaacgaaacgtctgcgctatacgacctaaaatccccgtaaattttgaaacgtgatccaaaaataaacaatttaacttaatttttacttatacatgtttcctattgtaaattacgaaattccagtaggctttccactgatggtgttccactcgacgcactttacccgtacttgagtggcaaaacaggtcagaaattttattgtacccacaatcattgggtttgatgtaaataaaatccaagaatgcctaattaatgcccttgtgctaagttaagccatttttcggggtgatcacgtccatgaaataggtacgcagaacgagtgcggagttgcaggagaggtggcgcttgtccggaccaaaaagcagggcctcttgtataaagcagagcccgggcaattcggatttgttcgcgggctaacggcgcaaatgacctatttgacgacgtacagactgccacttgcagcccgtatgttttaaaaaaggaaaagccattaatattaaatatatcaaaacatgaggatattttttaattcttaataataaaaatttttcagcttttgtcgattttaatttatttttgattaatctgaacatttttaggtatgtatgccccggaatcattcaaggcaagcccgaacttttagtgccaggatgctaggggctatgtaaaatatcattttaggaaaaatagtagtttaatttttaaaatttacataaagaaaacctttttttttggttttctaaaattaataaattttaaatgttccttttaaagtttttaataaaaatttgtaaatttatctcatctaaaataaacatattgagaatttctaaaatggaaatttggttctaattttattgtatgattttaaatatgtatttatttagaagccttaataaataaatgggtaaaattctggtttgttccccccttttcaagaaaaaataaaagttttcaaaaaagcatctagcacaaatagggatctcgaggtcgctgatcacgaatctgaaacccatttcgaccaattttgaaccccggaccccaactcgaacaaaaaacgggaattaattttaaccaaaattcacttttatgttcgaacctcaacagaatttaatgtccggggttcgaattggggtttagattcgtgatcagagcgacctctaaaaccctaaaaaagtcgattttttgaaaaattttatttttgaaaaggaggggaacaaaccaaccgattaccaataaatgtttccaaatttatacccttaaaaaaatcattttttaagctttaacggtaaaaaaagtggtcaaaataaatttaaaatgtgcctttaaccgagctttctaaaaaatagcataacttttcttttaaacatgatttttttgaaatctaacagtcgttagtttttttcgaaaaaagatactttacatcctctgttaccccaaagtcccgggactcaatattccatgcccacttcaagacttacaaaagcaaggaagtctacgacccttcccctgaggaatgcaaggccgcggaagaggaccctgacaactcaatgcacatcattagcatagtgggctatggcgaagaaggaggcaagccattctggctgatcgttaacagttatggccaagagtggggtgacaatggtgaggccaaatttgttagaggcaacaatgcgtgttgcattgaggattatggatattatgtcaaaagtgtagagcattattgaaattgtgtctttgaatggctctactgcagattgcgcgtcaattttgtggtgctaaaatcatgttggtgttagggaccgaattcaaataggaatagctaacctgttgggcattcaaatcaaataacaaataaaaaaaataccaaagggttttctaaaattacaaatgtagaaattttatcgccttggagtgcagatatttggacactaaataagtacaaaaaattatggtctgaaaactaagaatgggcattgactggagaagtaattgcagtggagccattaaaaaatattgtgttgaacgtggaaatatgttaaataaataaatggaaatattggttttttaaatatgttatctaattttcctttaattcctcaccattttgctgaatcaacacatctgaatagatataataacaacaaaatttccaatcgatcgacaattttgattgtatgcattttgtgctctattaaaatataagcaaaaaattcacatcatatattattagtatttaaattatatgtaagaaattagaattggacaaaaaaaaacccgcagcaaccgaaaaaataaaatgtctttccgactattcagcgcctggagaaaacacgaaaaaaatgtgttgtattgtatttcttttttcttttattttgagcaatttgggatatgaaaaggcaatacatcaatttaagagcataatattttaagttcagctcgagaaaaggtcagttcaaatacgtaacatttaatctagtaaagaccgaatgtgattgatcgattggttcctttaaacagccgatcagctttgagaagatgagggcgggtcggcaacttctcaaagcgaggccataacaaataaaagaggaagaagctgttgtcccagaaaaaaagcctagtcaacagattgctataatttgtgtgtcataattagggagcgaattcataggtttatacacatgaaaaaggcacataattttccgatttttctcccctattttactatttttgcccttttttaccattttcgttcatattttacattttttttgtccctataaatcccgaaattgaaaattttcaccgctaagcatccgctccttagtcattccttacaatttatatatgtcatatttctatattttgccaaattttgagttatgtccacattttataaacatagtaaaaagttaactttcagctcttttgtgtcaaaaatagggcttaatattaaaatatttcatttttgttttcattttcccacgatattaataaatttcagtttatttttctatttaaaatgatttttatttttgagaaagaagaagatgctttcctaaaaagaagcttaattgattcatttaagcgacaattaaccttttttaagggtcggtagtcttcccaagctgattcattattcaataaaaattaaaatcttttattgctttttagctaatttataagcaaacaatcaatggctttaatttaaattctccggccttcacaatgcttactgctaatgaggccgttcaaagagaccaagatgagaaggaagtagaagaagaagagtcgtgggccaaacgttttcctccatacagtgcagaaacggaaattgaacagcttgacgaatttagtttgcttcatcaacaaattgtggccggccgtgttgtgccgtgttgtgtaaatttgccagaaatcacggtcagcaaaagcgggactaaaaggccaaaattttcagttttttgatgtcatggcaaaactatttttttacatataaaatgatgcattaagctgaaatatttatctttctaagaaaacactaactggcatttcactaagttggaaaattatgttgaaatttttgaagaaagcaaaaaagattgtgtattttgtgtaaatatgctcaagtgaactaactaccagataagcttggtaattatgaccacagtggccacgaccacgacaatttcaccaataaaaactgtgactaacaaacaaacagatttattaaccaacctaactggcgcagaatgaacaaaacgcttatcagtaagcca

SEQ ID NO: 1174 - DNA, 1504 bp, Heterodera glycines
gcagattggcgcgtcaattttcgcggtggctaaaatcatcggtcggtggttagggaccagaattcaaataggaatagctaacctcgtcgggcatctcaaatcaaataacaaataaaaaaaataccaaagaggttttctaaaattacaaacgtagaaattttatccgccttggagtgcagatactcggacactaaataagtacaaaaaattatcggtctcgaaaactaagaaagggcattcgaccggagaagtaattcgcagtggagccattaaaaaatattgtgttgaacgtggaaaatatcgttaaataaataaacggaaatattggttttttaaatacgttatctaatttttcctttaatttcctcaccattttgccgaatcaacacatctgaatagatataataacaacaaaattttccaatcgatcgacaattttcgattgtatggattttcgtgctctcttaaaatataagcaaaaaattcacatcatatattattagtattttaaattatatgtaagaaattagaattggacaaaaaaaaacccgcagcaaccgaaaaaataaaatggtcttttccgactctttcagcgcctgggagaaaacacgaaaaaaatgtgttgtattgtatttttttttttttttatttttgagcaatttgggatatgaaaaagcaataacattcaatttaagagcataatattttaagttcagcttcgaggaaaaggtcagttcaaattcgtaacatttaatctagttaaagaccgaatgtgattgatcgattggttcctttaaacagccgatcagctttgagaagatgagggcgggtcggcaacttctcaaagcgaggccataacaaataaaagaggaagaagctgttgtcccagaaaaaaagcctagtcaacagattgctataatttgtgtgtcataattagggagcgaattcataggtttatacacatgaaaaaggcacataattttccgatttttctcccctattttactatttttgcccttttttaccattttcgttcatattttacattttttttgtccctataaatcccgaaattgaaaattttcaccgctaagcatccgctccttagtcattccttacaatttatatatgtcatatttctatattttgccaaattttgagttatgtccacattttataaacatagtaaaaagttaactttcatacaattgctcttttgtgtcaaaaatagggcttaatattaaaatatttcatttttgttttcattttcccacgatattaataaatttcagtttatttttctatttaaaatgatttttatttttgagaaagaagaagatgctttcctaaaaagaagcttaattgattcatttaagcgacaattaaccttttttaagggtcggtagtcttcccaagctgattcgttattcaataaaaattaaaatcttttattgctttttagatagtttataagcaaacaatcaatggctttaatttaaattct

SEQ ID NO: 1175 - DNA, 2073 bp, Heterodera glycines
tttggtttgggctattgtaggttatcaaatttagaaagttttcaggaaagaaatcatagaaaaaatttttctaagaaaatttcaaaaaaaaaccttgaaaaatttttcagcgatatttttggaaaatttgaaaaaaaatggtaattcatccataaattttgaaaaaaaagtataaatatttttcaaataattttctttttgaagtttataaaatattttttaaacaatttttttttcttgaaatttcctttaaaaaaaaattttctacgatttttttcctgaaaaatttctgtttgaaaattttttcaattattttcgttgcgggggaacaatacgggggactctgtttataaaacagcaaactggtgggattttacagccaatcttacgatataaattagtggtcacaaatcccgaccaattcctttcaatcggcatcatttagccattcatttttaaaggaagtgtcaccgtatggccaatttaatgccgcaatgcatcacaacgacaatgcctacttttacaataccacatgcattgctgaatatgagggcaccgattcggctggtaaatgggcgaccaattaggggggggggataaagccatttggggggtggataaagccatttggggggggggataatgccatttgggggggggggataaagccatttggcggggggggggggataaagccatttctgttgaggagggcaattatttgcccgatttgatcattcttatgatgaagcatccctatttttaattaattttaaaacaatgcttttccttcctttagccgattattactccaaaattcaaaaaggctgcacggcggggagcaacattaacaacaattgcaacagtaatttcgctgttcatcaacaacagtcaacatttgatgcaaatctcagctatcaggccattcctaatcccgtaaatttaaaatgcaattgattttaaagggataggctcgtttcctttcccctccgaatttttttctcaattttcgaatttcgaatttttcaaaaaaaaaaatcttaaaaattttattataacaaaatttcaatatgaaaaatttagaaaaaattttcagcaattttttagaaaaattattgaaaaaaacttagtaattcatcataaaattgaaaaaatcgttagagaaattaaaaaaaaaatttcactaaaattttctagggatttttaaaaaagtttctgtttgaaaaatttttggttttaacgtggtgggggagtggtgacaggaagtggcgagaggggcagcaactctctcgtcggcttccgattgttttctcctctcttcttatccctcactctcggcctcctctttttctctcgcccgaccgttaatgggacagttccatgaacattttgcattaatttttataatattcaggcacttaaaaaaattaaacattttcacgaaaaatttcccaaggagcccccgctgaacaacggcgtgccctcctcctcaaccgtttcgctgcaacattatggcgttgcgtccacaacgccaaaccaattttgcatggacatggaccacttccatcaccattacccacagcaacaccaaactcacaatcagtcggcaagcagtccgtatgagacgaggagtgcatgttatgtgcaaacggtgggcaaaaagtcactaataaatgaccaaaaaagcaaagagaatgtttaaatggcatttgtaacggaagcgtacactaaattacggctaatgggctaattaacaaaatttttaactaaaaaattcttattttgtcaatcaattcatcaattaaaataaacaaaatgctcaaaattgaatcatcatatcaactatcaacagggatttagcattgtacctaaccgtaaattcttggtccttccatgtcccggtcccgagattttgatgaggccattttctggtgggacaacccgggaataaataaataataagcactggtaaaataggaccatgctttcaaagttttggtcacttccattcagacactcgtaaatatttgataattttgggatataataaattgattggatgatttgaaaata

SEQ ID NO: 1176 - DNA, 1897 bp, Heterodera glycines
agtaacggtctttgagcccttctcagcaacacatgtccctccacccgggtcaagccaaaccgccgtttcgtccgccgcgtagacatgtgtgtagctgaaaattagtcgtttgaaaaaaaatttctcatttacctacttatttttgtgtatgagttgttgaatatataatatgatgttgatgatgatgtttttgtatgcatcgggttctttttgcgctactgttgtcggtcgacgtaaggaaaatttatgatggtgcatgaatttttccagccatccattactagcctaagagaaaaatgttcaaaaatttttcgaaattttaccgcaaaattttcaatgtcttcgtaggcggcgctcattttgattgcttgcgcagcaatcatatttcgtgtcacccgcactttcttttgtcgcaattcagacacccactggaacacagcttcttcgaagttcctgtttggaactttccttccgcccccttccaaacgttttcgttttgacgattcggccctaaattaaacgaattaaaacattgtgacattacaggcatcttactctttcatcaaattcgcctcttgttttttccattcacggaccatttttcggtcgactccgaagtggcggctagcggcatgaatcgaagacttcatgccgaagtctagaatctcgactttctcttggattgaactgtgacaatgcttcgtcgttttgtttgctgcttggttctgttgaaacgacggcactcgcactttggtcaacgtcatcgtcgagccagcacagacagcaggtgacttttgagcagaatccctcttcgccgtcatgtgaaaatgagcatggcgctatcgcatggcaaggttttttgcacttccagcattggtgggcaccagaacaaggattgctgcagtagcagcaaaccttaagataggtaattttgaaaagaatttttaataggtaggtactttttttagtcgatgattcaggtaaggtttttgttgcgtccataattaattataaaatgatttgtatttggcacctgaaagttaaaaagcaacgtagtttttcgtaaagttgaataaaagaaggttctgaaaaaattgcattaatttgtagaaatgaagggttgaacaataaaagccccccccctcgattggaagccccccctcgaatataagccccctttggaggggggttgaacaatagaagccccggggcttataatcgaggaaatacggtaaatgatttattttgaattattgattaataaagtttttaatttattttttgctttcgatttaataggctctaatataaaaatggaaaataggctctaaaaagcccaaatttagggggtgtaaactaataaaatttattcaaaaaagtaaaaattaagccaaatcagtaatgaggtgcgtaattgtgaaaaccaaaaattctaataagaaaaataaataaattaattttttagatgcatttttgagaaaatttttcatttcttaggagtgaatttttgaaatttttgggttggtcgattcttagagggcatatatttttgacaaaaattgcctaacattataaaaaaaaatgagtaacgagggcgccaaattttattcccaactgatcaaatctaaaattaatgattcctaacaattgttgatcaaaggaaaccgattgtctgtcgaaaatagaattgagcaatgtctgatgttctccgatcttcagcagcagttcgtcacccttgtaccgcatgaagcgctcgaactgaaaacaaaaattatgttttaactaggaaatcgactgttgtccaacctgcttgctcaaaacgtggtgaaggtgttcgatgccttgttcactgatccaggcgaaccatccccagcgcttggcaaagtctggaccatgg

SEQ ID NO: 1177 - DNA, 2549 bp, Heterodera glycines
aaaaatattaaaagtaacaatattttaacaaaatgggggaaggaaaatgataatttttggctttttgtgtatcaaaggaatccaatatgcctatcaaaaatggaattgagcaatgtttggtgttctccgatcttcagaagcagttcatcgcccttgtaccgcttgaaccgatcagactaaaagagaaaaagatttgtaagctctagaaatttgattgccccacctgcttgttcaaaacgtggtgaaggtgttcgattccctgttcactgatccatgcgaaccatccccagcgcttggcaaagtctggaccatgggcgagaagccagtgtaattttggggtgaatccagcggcattgtttgtgtcgaatttagccggatgagtttcccaaagtttcttgaaaaggggaaaatgagaaaaacagaaaaaaagtatctttgccttgaaatagccatgaatggaggagcatttatttgagaaattgtcgatttgttcttgggtcatgaggtcagcacgtccaaaaatgtggagctcccgaatttcgtcaaggaggtcagcaatgtccatcgaaaacggtgttccgatcgatctgatttcggttgaggcgagaattaggcgcttcatttggtcacctgaaatcattttgaaaaaaaaggaaaaaagaaatatcaggaccagtgtattcttgtgtcttggcatgacgaattgctcccgattttgccattatttcttgtaatttgcgtttttctgctggggacccatttttttcaaaaaagtcaatgcatttacgtccggcgctgtgaagtgtgtgaaatggtgaaggaatcacatttgtcggtgccacgaaaaagagtggcaaggctttttgactgccacatgaaattgagtcccgagtagtgtgcttgcccgtgtctgctgttcggtaactgaaaattgcggcgccaccgacgatcgattttgctgtccttgtcccgatgatggtgttgcccagagctttgtatggaattcggcatagtgcacaagggaagacggaggctggtcccatgtgccccatccaagcgcatatgaaagccatgtcgccggtcagaaaccttaagaaagattgtgcaaaagaattaaaaaattataagaccattcaatcgtcaaatttcgatcaaatgacaaatccgcgatttgctcaagctgttccaagaccggacctaggcgcgcttccatttccgagcgggtctcgggtccctcccaaaacgcaagtaaagtcaaatttttgggcgaattgacgttggagagcaaatttccaatttggagggcaattttgactgatccacatcctcgatctccaacaatcgcaacaaacaacttttgttcaaattctttcagtcgtgctaaaatttttacttgtctgttttcgctatttgtcccaccgtggccccgtaatgtctccactcgtttggccaacactgcctattgttcgtacacaaaagagtgatcctgccctcgctgttcaccgcttcaaagcgggcatgtgttgtcagtcgtcgtcgcaggccattgacttcatgcgttgaagacaaaaaatccaaccctccggcacttttgtcgtcgcgcatgttgatcaaaatgtctttcagctgctgcctttgtcgccaactgaatcccaacatcagttggcctgatgacgggcctgatgcactattctgtcgatttcgggcactggagtacctaggaatgctccgctttattgtcaaaaataagaaagaaggaattgttcacctggtcggaaaagatgactgaggtcccgagctatttcctttgcgcgtgttgtccggctctgtcttgacaagtcctccaatgaactgactctcttggcctttttcgttgttgctccgtcggtcgcttttttagctggttcatctcttctgttctcttctgtagctggcgttccagtgtcgcaattcggcgtttcgtcctgtttctgtctgggtggcagtttcgacggtttctaaaaccgtttgggttgacttgactgttgctcgaaaatcggtgtccgttgtttggtcggtagttgttggacgcgtgcggacatggcgccttataggcgttgttgacagtggccgtggacttggccgttggcctcaaaaaatggaatttatctcaaaaattttgttttttggacttacgaggctcagcattgaatgtcgatggcattgtatctgttgatgttccctctcctgttgttaatggagcttctttagtttgcagttggcctgcaaaaattggattttttaattaaatgaatattttggtcaaaatgtcactactttttggtgttgaaccgccttttcttccacttttcctgcgccattccgaccgctttcgctttgcttcagtacttgaatttcccattttcttgaacttatcagttttactgcgtgtggataccatttttaactgtaaaagtgaaggaaatttattgaaatattcactcagttgaaaaaatttttctacagttgagaatttcttgaaattttgcatagtcccatattttaacccc

SEQ ID NO: 1178 - DNA, 1496 bp, Heterodera glycines
  misc_feature (39)..(39): n is a, c, g, or t
tgtatttttcgtttttattgcatttttgtaaataatttntgggcaaaatgccaaaataagttttttcattttttttatttttaggctctaaaaataaaaacctagaaaatagacactaataactcgaaaattaacttaacaaccaccaaaaaaatatgggtttcgtgcatttaaggccacggggagctcaggaaaaaataggctaaaacctaaaaatatcaaccctaacgtcacccattttcctacattttttgggacattgatcatttgaaacggcccttcctctccaaaacccgcacatccatacttttgtcactttggctcatcacgtcattttatcatttttgaatttaattttattaaaatgtggtaaaaagcaaatacagtatctaattttgtaaggaatttagttagcctcacaagaaaaagcagagaaatgaaaggacaattaattcattgatcaattaaatgcttcttttcagcttcacttcatttgtttttctctaatacaacgcactcgaactaattgtaagcctaatgaatcaacagcaacaaaatttcgcacaacaattcttaaattaaaaaatttcaaaaagaaataaagtgtcattaaattttatattttaaatatttgttgtttctttacaatgcaaaattggattaagattgttgtcctatttaattaaacttttttgataggattgaactgacttcgttttgatccgctgtgtctttattatttacagcaaatggtacattgctggtcgttgagttgaccacgttcacctgctgcgggggtggcgcgctattcactccgctcaccgcggatggtcgcgcggggttcgcttcactaaccgccgatggcggcacgggttgcactccgctcaccgccgatggcggtggggggcatgcttcactcgcggcgggtggcggaggcggtgggaaattcggaggtggcggtggtgggaaattcggtggcggcggtggaggaaaatttggaggcggtggcggtggcaaaaccgctggcagcggtggcggcggaacagtctgtactggatcatctttacacccacacaatgtcacactttgttgacgcgtcatttgcatcggtggcggcacctaaatttaaaaaaattttaatttttttttgtaaccaaagtaaacagtgaaagaaggtatcatcagatttgacatgccatcaaaattatttattaccttatttgactgataaaatgggacaccctttggaggtcaacttgcctgtttgaatttaggctttattaaaatcatttttgctttttaatgggatgggacggttccagatccggtaaatattgatcacatgatccaggacccaaaatggccaaaatatataagtattaatcgatagctctcgatctgtgatggaagaattcgaaatcatttttgggtctgtaactcttcagggattggttgccgcaaaaaaattctttcggattcttccattacagaacgag

SEQ ID NO: 1179 - DNA, 1949 bp, Heterodera glycines
tttatatttccgttatttttaaatttttgtatgttttatgcaattcatttaatccttgtgatattcgctttatctgtgaacaataagttttttctatgtttttttattaccatcatttgcggacttggaagcgatcgagctgaatttgcccttggcaatgctccaattgctaaggcacccgctccaagcgtggtcaaagttcgggctaaggtgggcccagcagtgccaccagcagaagtgccattttctaaaaataattctggaaaataatttgaggtgccaaaagcagcgtgccgttagtagtcaatatttccaaaggtttttttgacacgacaaatttatctaaaattttgcatattggtaggaaaaggttggactacgaattcagaaaaacgtaaactttgcatacctatatatgaattcttataagcaaaatatgttcaaataaattaagaaatggcactcgatacttcttaaatattatttgtttgggccacctttttgttcactgtttggtggtcgtcggcgccgaacttttgtgatttgctcctttctttggctccttccaccagcagttggagaattgttttgctcatttaatgcttaaaaagaaaatttacattaaaaaagaaattaaaattcatttaatttttttttgtgaaataaattcactttttagagataatttaaatgttttatcattttaaatttaatttttaaaattttgcttaaaactaacgcattccatcagctgatggcattgggtagagaacaaggcacagtccaagaatgaaaagcagggcgacattataaattaaattcattttctctttaattaatttcaaattttttttagcagaaaaaagtgggaaaattttaaataaaataaattaaattccggttaaatacaataataaaagtggtttttatgaatttatatgccaaaatatgctaaaaaacaaataaatacccatcatatttacaaaaacaagaaaatatcaatcaatttccggctaaaagaattcgtaggcaatcattatcaattaaatgctcgcaaatattgccacaaaatttgcatcaattttcaactaagaaattatgaatcaaagttttcttttgttacttctcatgcttcggtgatccaatcggcgggttaaactttttaccataatattcttttgcgataaatattaagaaatatacaaaaatccaaagtgttgaaggaaaaaaaataaacatgttttcatgaaaaactggaacaaaaggtttttcttgaaccggatcgatccgggttccggatcagagactatttgtgccccgaattgggtctggtaggcctccggaaaatgtgccacgaaaattttacaaatttgcgtcttgaattcgaattaccgttttatacgaagcctaacaatcaattaagattgaaaagttagctcatttattaattgtgtttgcatatattagtttctgtcgttcttcacttcccttctatgtaatattggtcatttgtaaaattatattctatcgatttttttacaaattcttataaaaaaatttcattttttctttcaataaaaataataataaagcattaataatttccgttgttatgttccttctattatttttatttctttttcgcaattcttatgcctttgttgcgcaacaccaaaggcaaaacgaatgtgaaaaattatttgcagggattaaaggtatttacatatttatttatcaaaaagaaaaacaaatacattcttcctaccttagatcagccaatattcgtcggcggaatgaaagaaaatttcgagtatttgttttttttttgaataaaaactagagtgccacgggaccgggaatttttgccaaaaccgggaccgggacttgctaagctaatttgtggcgctgatcacgaatatgacctttgtttttcaaattccgaacccgaa

SEQ ID NO: 1180 - DNA, 1394 bp, Heterodera glycines
  misc_feature (1369)..(1369): n is a, c, g, or t
tcataaaaacaagttccttgcgttttcgggggcacagaccatgaatccggtatccatttcggccaaatccgaaccccagacccgaattcgaacaaaaacttgaaagtcccaattttcgaatttagcatttttgggtcaaaacggcatacatgatctattattgaaagactgatggcttttagtttgtttccgtgtatttaaactaattttgaagaaaaacgctaatttcgaaattttgacttttcgattttttgttcgagttcgggtccggcgttcggaatgcagaacgatgttcttatagaagtttatttctatattacaatacaaatgccatacaactttattaaagtattttttatcactgacgcattttctactgacgcattttccactgacgcattttctactgacgcattttccactgacgcattttccactcacgattttccggtcacgcctactggccgccgtagtcgagtgtgcggcggttttttagcgcaataagctaaattcaattggatcgaattcgggttcggaattttgaaaaacaaaggtcatattcgtgatcagcgccacaaattagcctagaaaattatttcatatgtcttttgagtgctcttcatagtgcggtcaattgagtcccagctgagtttggcactccaatttcggcactttttcagcctgaaaaagagcaagcgcgcccctaattatatttttccaacccatttcgatcatttttacatcgattctgaccgtttttaagcatttttgagtttggggactatgaacaatattttcctttttttaaaatatcattcgatagccataagtgttgtatattagtctaaaaaaatcaaaaaattgtatgtttgaaaaagttatggccaaagtacacctaattagcgaaaagtcatttttagagatgaaagccgaacaattcgataaagattattcaaatttgctcgaaatggctttgtccaaaaatgaatattcaatgaaagaaaattatgaaaacgaaaaattaaaaatagaaaattcaatttttaaaacatatattgtgcaatttttagaatcagtcgaaatgaacgaattaaatgacttccaagagaaaattttcattgaaaaaatagaccaatttaatgaaaaaatcagcaaactttcacattctgtagaaaacaattgcaaagtgtggaaattttggcgtgaaattggtaacaaaagtgtccattttaaagtttaaatgccaaagaaattaaattttcgtataaaattctttaaaaatttaagcctcactaaatttggcaatgattagcaatttgtttgaaccacttgataaaattgacctgaatgaaatcgaatgcactgaaantgaaaagaatttgcaaaaaaatgaa

SEQ ID NO: 1181 - DNA, 1675 bp, Heterodera glycines
ttttaaaccaattttggtaattttttttcagaattgattggaaatttttcattgaaaaattgcttaaattttagttttttggagtatttttaatcccgaaattccgtgcggaaaatttgtattttaaagctttttctacaaaaaaacaaattctcagcaccctagtggtgagtaacaaagatttctgcctattttggtcttaatttttgtttgttttttttgtactttttatattcattttaatctttaaagattttatgccatttgaatatcatgcatatttattacagcttaatttaaaactaatttttgttaaaaaacatttaattttaatttatttattttttgtaatagacattgttgatgatgagcagcttgctttggactacacgaaaatgttttcaaaaaatccaacaaatgccaaaacagcggagatagtcatttcattgcgtctaacttttgcaaaaataattaaaaatttcttggccgtttattcctattataatttgcagcttccaaaaaagtccaaagtgtcaaagaaagctgcaaaatttgttgccaaagtggcggaaatttgggaattggaattttgggccattgttttaattcgaattgccaccaaagacagcggagctttggtcatgctttatgacgctctttatgtgctgtcagtgatgctaacattgggcaaaaatggggaatacattaccaaaatgccaacggaactttcgccgcgttcggctgaacggcttttggcggactgtgaaagtacaattcgggcccaattttatgaggaacatacagcaaatatgctaagattttacgagaatggcatgttggcccacgacggtggcaattcgttcagcaactttttggccaagtgccaattggacgggtgcgaccacaaattccgagtgcgcattttttatgctaacggcgagaaaatggcaaatgatcattatgacaaaatggttaccaaatacccaaaactgaagcaaatgctacgcattggttcgtatttttaagattttttctttttttttcttcaactgttctaataaatttttataaatcccggcgacgataaaaatcattaaaaatgaaaaatgttttttttggggtaaaaattttagttttaaaagatttatttattttgaaaaaatgcaacttttcttttcctgtagtttatgagcaggtttgccagatctgaggatttatcctcattttgtggctttttgataggtcaatgaggatttttttggaaaatgagaatttgaggatgtttgttgctttttgagaaattttgaggatttttgaggcttttggggaaaatcctcagaatcttttaaattttgataaattggcataatgtttggcaatttaaaaattttttttaatgaaaatacgcaaaaaatatggtcaaaattcttaatttttcccccggcggcgcctatcggcaccgccggaccgtaaaaatccttaatttacaagcaaaaatttgctcaaaatcgcaaaatttggtcatttttcggacaaaatctgttaacaaatcgcattgaaaattacaaaatttcccccggcggcgcctatcggcatcgctggcccccccctgcgccccaaaagttttttgggaaaagcgccgcaaaaaatcaacttcgtttttcatgttcagaat

SEQ ID NO: 1182 - DNA, 4479 bp, Heterodera glycines
ctgcttctgctgataatggtggaaaacgtgaacagtcgtcaatcgtttggccgagttggaaattttaatgaacggtgccatggaagcaattccaatgaaggagattgaccaaaacgaacaccgtttactctccgatttatttgaaaagaaaaatgaacttttcggcgaaaaaattgcgccaaaatattcaaaaaatccatgtgacagggaaaagcatttgaagtttttgtttaatttgcacgaaatcgcaatgaacaaactaatggaggtaaaagatgcatttacgaaacgattggaaggtaaaaaaaagtttatattaaatttagtcaatgaccgaattttttttaaataaataaaataataaaaataattttggagcctatgaaagtaggcatcattttttataagaaggctatttttctgtggctttattatgctaaatttgtagataattaaataaaaaacgtctccgaaagatcgatcgttcaaattttcataaattttttcaccgtaaatattgaattccatcaaaataaaaaaatgttttcaaacacttcagaatccttcccatgaaattcggtttttcgcaacaaaaatatttaaaatttttacccgataaatttcgttttcttagtttttgggttaaatattatattgattaatttaaaacgaattatgcttgaatgataaaaataaacacaacaaaactcagacattcaaattgataaaagccgacttgaacaaataatttgtgatgattcaaaagtatttcaacatttgttgctgaattataattttatttttgatgcgttgccaaaaaataaaaattcgaaacattttggacgaaatttacatttaaatgccaacatttctgagcaaaacacatcatcatcaaattcaccaccatcgtccttattatcatcaccatttacaacgcaattaacagctgaaaatggtatatttaacagaagcccaaaaagcatttatagaggctttcatttaaatgaaaaacatttaagtaaaaattttttctgtaaatttcgcaatttgtttaaaaaaaaattaactttaacaaattggggcgaataaaaaaaagtcttaagatttcctatccataatttcccaaatgactgctattttgtatttagaaggtgcgagactgtcggattttgataagcagctaatgcgttcgtatgaggccattatggtggacggaatggcaatggcgggagaaagtgccaaaaaacaaattggcatcaatgcgttgtatttccatcataaaacgatcatttttggactgatcagggaaattggagaggacaaaaagaaactggaaaaatttggcaacgaattggccaagttaaaagtgaaagtggccgagttgaagctgagttcactgccgagcgatgacgacgaaaaaaggcggcgaatttgttggatgaaaatctttttgaaatggtttatgggcaaagtagcagaaaaaaaggaacgcacaccgacgggactgatcagcgtacgctttttagggaataaaatttaaattagagaccggaaatttcaaatttacggatctatgcgcgggattggaactcaaaactttttgtgggggacgggatctcgctgaattaatcccgcaaaaagttcgcatttttacgatagcctgtacgggatttttaataaaatttctcctactggggtaacctttttaaccagggttgccagatctgaggatttatcctcattttgtggctttttgataggtcaatgaggatttttttttggaaaatgaggatttgaggatttttgtggctttttgagaaattttgaggatttttgaggcttttggggaaaatcctcagaagcttttaaattttgataaattggcataatgtttggtaattatttaatttgaattttggtttttaatagagtatcaaacggaaatctcacccaaatttagccagaaaattacaatttttttcgaaaatccacaaaattatgaatttttatgcatttaattattcttcacgcctctttcaaaaaatctctacctggaaacctttttaagattttctccgattgcctagcaaatttggcgcaaaaatgactaaatttcgctctttattgataatcttttaaaaacaattttttttgagagatttttcaattctttgccattttcacgtcttgcccattgtaagttctgaccatagtttgattttcattaactccaaaaactcgaagggcattttgtccagaaacgagaagtcagaagcattttctggcttcctgctacgcctttggcacagacagcaaagcctttttctgtacgggaaatccaaattttaaacgttctaaaaatgaaaaatatttaaatttaaatatgtatttagaaattgcaaatggaatttgaagatttggatgaaaatgactgcaaagatgcgcgttacctgcagtcatattttgatgtcctattgtccagtgctaattacacattgacagttaatgttttttcagtcatgcaactcttggaccattctccacaatttgtgcaatttgtcaacgacaattgcatccaatttggagcgattggcgccaatgaaaactgtataaattatattttaaaatatatttaattcttagttttctaaatcgtgaccggaaaatgcgtcagtagaaaatgcgtcagtggaattaaaataaagttcggtaaatatggttcatagggcccagactcaaaattaaacaaatgatatatcaatcgatagctctcggtctgtaatggaagaatccgaaagaatttttggcaggaaccaatcaataccatccctggcgagttacagacccgggactgaagtggcaaaatggctttgggactgaaccgtccactgacctaaaacgcatggaacaaacaaattagataccaatcgattcccctcggcatgtaaagcatgaatccgagaatttttggacaaaagagaaattgacaaaagttatgggtgctcaaaagccccaaatgagcttaatataaaaaataatttagttgaattaaaaaacagcttctggatacagattcgtgatcagtgacctataaaacccaatgaatttgtttttatgacattaaaattttcactgacgcattttccgggtgctttctcaattgcttgatttaggccgggtattcagaggaaaatgccggggcgttggcgccgcagttggataattttgtttttgggggatcaccggcataaaataaattaagcaactgagcacagatttcactttctttacaaaagaaaattccctccgcccacaataaaatgccaaaataatttaaattgtatttttttcacagcttcgttgcacgaagaagaaatattcaatttgtacatcacttattttgaaacgaatgacattgagaaaatgcacaaatacgaagcgattattggcctaaaatttatgttaaacaatgtccgactaattgaagcggaattgataccgaaactaaaaaaagagggggatgaaaaagcgcaaatggccaaattccgtgccgaaatgttggcaatgctcaaaatgtttgacttttgcatggaaagtgtggaccaattgattcgcatgagttgcccgctgattgaatacaaggcactgttttccaaattttatctcaaaagtgccgcggcaccgttggccgaatggcaaccgccgtttgactgtttgacaaaatcattcggccaaattttaagcgattttcgcaacagtgtggcgagccaacattttcaattcatgcaaatggcattgaacaaagacagaaaaggaaaattggcacagattttgagggaaaaggaggacacatttatgagattggagaatttgattggcgaagaaatgttcaaatacctttggaacaaaagcgaaaacagacaaaaactgttcaaccaaaaatgtatgttcaagactcgttaattttaggctaggatttcgggttcgggtcgaaaaaagcaaactcagtttttttatcgtgtcaacaaataattccgatagaaaaaattgctatattggttgcactgaaatgacgacaactttttgaagattgtggataaatattttcaaaattttaagtttaggtattctttaatctattttgatacaaattttattaaatattttaacttttttgcaaaatattaacttttatttaaaagaaattttgaattttaaaaccgagatggtcggggtaccctggccgggaattccctgttttttaggttctggtagggccgtgatgaactgggaaaataaagcagtgataaaattaaaccgaactgaattttttacatcttagaaaaattaatcccggttaaaaaatgaattctcgactttttggtcccgaaattcccggtcccagcaaaaatttattaattggaattttgcatttttcgcacccccaactaaattttaattaagtctttgacgacaaaa

SEQ ID NO: 1183 - DNA, 2931 bp, Heterodera glycines
  misc_feature (48)..(48): n is a, c, g, or t
  misc_feature (97)..(97): n is a, c, g, or t
tttttttttttttttgcagccgttttcttcactttggccggcttgcgncagatgaaattggggcggacggcaacaccgggcgtacaaaaaggacttngccgcttaccgcgcaaagcgaatgccaatcattccgttcctctgctgatgaatggaagattatgatagggatatgataatgatgatcagatttgatgtggggttcttggcgtttgtgttgtctctgattgaatggttggtgatcggctaatttgaaaattgattgaatcagcagccgaatgatcggtccaacgaaatttaatgtttttttttcgtttttgccatagaaaaacttcttaattctcgatattacaatacactgactactactgcttgttgatggtgatttatcctcatttgaacacttttccagaggcatataattaattaaatttgtattttttcaaaaaattattttgaatgtcatttttgtgatcactttgatcaatgttgaccttgaaatgctccggaaaaccgcttttttcataaattattctcaaaaatgatggagtaaaccatcagcatttctaccattctctacaccgtaattacccaataaattaattaattgtccacgccaatttccttctctctaaattattattattattatttttgttgatcagtttagcattgtcacaccaccacaaattgccgctgtttgttgccatttaaaaaacaaaaaatatgcacttcatttcacttatcaaaatatacctattatgccttggccatgttaaatgcatatcacacttataataagtttgacctttgccagcaaaaccggtttatcaaaattagttaacttaaattagattttttgtttttcgaaactttccaaaagtttaaaaatcttttaaattcgaccggttttgtacgaccaccactttaatgacgtatttccccatttatttatcattttttcgaaataaattactaggatgatttaggcaacacatacgccccaattatgcatgaattgttggcattgaaaacactgaagatcacgggcggccattttggctatgccaaattttttggtttaattcgtaatcccggcaaatcaccgcgggttcctttccggcggtggtctgtccgcggtatgctctcgagaggaatcctttgaaaaatataatttgataataaaagtatcataaattgaccgttttcttccataatgtttccgttttaacctacctacataaaatatttttaaaatgttgaaattaataatacagtttcctcgcattattgtaaggggtgtacggttgagtccagcagcagcagcagcagcaaacaattgggcacttcagcagcaggctcggcaccataactcttctccacaaaattggcgcctcaccccaaatatggtaccaccaccaaccattccaatcagtctctctctctgatcaagatcagagcagattttggcacgggaaaattttccttcgcgaaaaacttgcaattttcctcggaaaattctcgcttaatgaataaacagtgaacatcagggatgtgccgagccagacaaaatccgattccgattaaatcgccgattccgattatggccaaaaatccgatacggttttaaaaccgattacgattatggcccaaaatccgattaattgcgattccgattacgattccgatttttttaaaataattttttcccaaaaattttattcataatcaaaatcataaaaataaaagtttgtccacattctgaggcaataaacgttttctcagatctgtcacaatcaacccagcggtggagaaaagccgttcgctttcagtcaatgtagctggggctgagaaatatttttttgatagcttagattcggaaacgaaatgtcttctgcatacagaagcccaacaactgttttgttttgcaaaaaacgatcaagcatttggaaggtggatgaccaacgcacctgataggaaaattgcaacttagtaataattcattcatggttcttttctgctttaatgtcccaacaaattttttcttcaaatttcgacttttggttcgaattcgggtccgggattcaaaaataggtgaattggctgccatgttcttaaactgacaccattaacaacccttcaaagactttgacatttttgctaaataacaaaaaacttgattatatcggggagaattaatccggcactgctttgtgagaaaaatttaatttcagtcattatgttaaaataagattaaaagattcgtttcagaaaacatttttttcaaaattcattggtattctcgctaaaaaaattccttcaaaggtcaattcttaggggtgtaataatcggatttcaaggcaaaatccgattacgattatccgattccgattatggcccaaaatccgattaattgcgattccgattacgattacgattccgattcggcacatccctgattggtagcattgaagaaaagatattagcatcagattgaattctgttttttcaattaaaaaataaagagatagtacgccaaacagagataaattacaaagaaaaagagaaacgacgagatagtactaggcttttctctgcacagtggggcgtacccataatcgactaaaaaacgctaaatatgtgcataaaatatggactaaaaatgcttgaaatatggaccaaaaagctcaaaaatggccaaatatggactaaaaactgtcaaaatatatgttttaaatcatcaaaatgccaaaaaaggtttatatttcaatatttgcttaaataaacttaaaaaatacaataaacaactaaaaaatggatttaaaattaaaaatgcaaaatttttttgtcgttgtataaaaaaaacacctccaagtttgtcaattttaaaaaaatttgttaaaaaaagaaaagttcgcaaaaaatggtgaaaat

SEQ ID NO: 1184 - DNA, 4686 bp, Heterodera glycines
acttataattagagaaataatttctgtgttttcccatttccggagaaaatttatgaaaaatattctcatgagatttttaatatattttatgaaatatatgtttttttgaaatttttataaaatcctctggagattattaattattttataatttttaattatttgactgacggggagagaaaaacagtttaacacactctctctctctcattgattgagtgaggcgatcgtttgatgattaaattttgttgtaaaagccaaaattggccgcaatcttcagtcttttcttaatcatttctttacttactttactgataaataattaaataatatttatgattttaaatttaaataatttttttcaaaatttatttaaaaggaaaaaatggacccggaaaaggcacgacagcacattcctgagccggcaattttcacttatgcatccaaagatgccattctctacgccttaggaagtgagcaattaagaaaagtgccgccggcaaaattaaaaaaaaaattttgggtggtctaagtttggaaataaaaattttaaaaaattttgaggcctactcaccaaaatttaattatctttttatccgccgagttcaattttttagttggtgccaacactaccgaggatttgcactatgtttatgagggtaataaaagaaatttaaaaaatatatataaataataataatttatacgcaaagcgtgacgccgccaaaataaaaacaacaataagataaagcaaaatggtcacatatgagagtggttcataaatgtgtaaaacgaaccaaatcaattgagtcaagaagtttagaaaaaaacagttgaattttgtaacctaacttctttaggtaataacctatagaagcgagaagcacgaacaaaaaatgaatggtatctaacattagttgagcaaaaagttggcttaattaaattacccagtctactagaaaaattgggttgaggtttattatattaaatttttcatttttcccgtccaggccatcccgactttcaagtgtttccaacctttgctgttgtgcctgggatggtggccgtttcattggtcagtttttaaaggccaatgtaatagaaattgatctgttggccaatcgaagaaagtgccaaaagcatttttggaatgcgtcatctgattcattattcatttcctttcatggtctgatcagtgatcagaaaattgatcagaaatcatcgttcggcattctgccggatttggtgacccataaaacaggggtttttggcaccaaaatcagccgatcccacagccaaagtaatcacaaggaatttaagaaaattggcattttgccggattttgagaccaagaaaatttgggatttttggcaccgaaatctccgctcccccagccaaatccattctgtcccaaaattttgatcatctctacgcatctagaaggttaaaactgatcacacatcgatttaagtcggattggcctggcattcaatttgatctgagccgggtgcttcacggcgaacaatacattgaactgtacgcaccgtttccggccgacggtgcgcgactgcgctccgaaatccgtgttgccgacctgttggacaagggggcgaacgcagtgatcatctccgagggtacaacaacaaaaacaaaatgcgcaggggatcatcaatcatctttaattttatcggagaaaaatgatcaaattgctggactaaccgatggatttggacccaaaatccttccgggatgggatcccatttacataatcgccgcatatgatctattatcattaaactgtggaggattaatctaggaatgcgagatcactgatgggtcggggctgaaattgtgggattactatgattaatcctgcatttatatgcctaatgagacatttgaaaaatacaaaaaattcactatcgttaattaaaaaataattaaaaattaatcattttcaagtgacaacattcgacgatcagtctggcgaaaagctttgctttcaacaggcaagttgttgtcaataataaatttttttaaaatataataatgaaattttcagtttggcatttttcaaggcggcgccggccggctttggcgtaattttttgaattttgcattaattatttattatcattaattaggtaattaattatctccccccccccccccccgttttctttagggcattcgaacttcgccgtccgagcgcaaagtgccgccggtgccgcaggggcgtgagccggacgcggtgttggagcagcgtacgctgccggatcaagtcgcgccgaccccttagagctgtctaaattattattttccaacaggctgccctttaccgacttggctcaggcgacctgaacccattgcacatcgatgccgactttgccaagctggccggctttccacgtccgatcctccatggtagtgtacggtgtctcaaaatccaacccttcgttcgacccggcccgacttttttctcgaccaagaaacccaatccgttttttttttcgtttgattcgtcccgatatgttgatcgagtaaaacttacagagaatcatggcttgacctcaagacaagacctatgtcacaaaaaaaaagattcgagactttgctcgaatacgaaacagagactcttgaacagcgaaaatgcctgtgccactcaattatcagtcatgccatgataggctaatgttctaaaaaattaaattttcattaaaaaactacaaaaatttcaaacacacacttcttgagagaacacatttaaggtctgtgctcacttggcatttcgtgccgactcattctccgagcatttggtcgtaatttggcacaaaatttgcactccgtcaaggtgcgcttctcggcacctgttgtgccgggccaaacactggtggtggagatgtggcaacagcacgaggacaacgacaacaatggcactgcccccaaaaaagtgctcttccagaccaaagtgaaggagactggcaaggtgggcaccactatttatttatttgaaataaataattaaattttaaacatgatttttcatatatatatatatatatatatatatatatatataatatatatatatatatatatatatattattaggttttctcatagttctgagccccttggattaaaaaaattggcgctaagattgtgttgtccaacggttgtgtggagttgcgcgagttgcgcatcagcgacaatttggtggtgccaaaaagtgtcggtgaaaatgccacaattggccaagtgccaaacgcgctcaaatcggccgaactctttcgcgcaattggtgccgaactgcaaaaaaacagtggccaactaaagagtgttgaagacgcactgatcctttacgagatcaccagcaaagggcaggtggtcggcaagtacagtaagttttttttggttgtttttaatcttacggtatactgtaatttttgaacacaaaattcgaaatttttaaatttgtttttctgaaaattaatggcatttcgccaagtttaagaatatttttaaaagcagaaattccaaagcctggcaggctccgcttgtgaaaatttttccaatttttttatgaaattgagaaatattacaaaaatcattttacttacaaaattctaaaattctgaaaaatcaaataacacaataatacattaagctgttgaactgaaggcgggcaaagggcacgtgtacgaaggtgagccgcgtgatggacaaaaagcggctgcaactgtacgtgttgacgacgacgattttgccaagttggtcggcggacaattggacggcactcgggtgagagagagcaagcacacaattaaatattttaattatcaaatatatttaattatggattatttatgctgcttgctattaattaatctatggcacaaaaataaaatttgccagtttttcatttgaatatttttccactaaaaagaaggaagttttaatgaaaagccctgttttaaaaatcaatcacggaaaaagttcttgagttagagaaaaaagccagtatcagtaccaaaagttcccgtccgggctctaaaaagaatttagatttttccaactatttacattttgtgctgtaagcgtactccccaacaatagtgatgctcgagaccaaaaatttcccgagactcgacaccgagaccgagaccgaaaaccccgagaccgagacccaaaaaacccgagactcgagacttttttcaaaaaattttcctattcgcttaaaaaccgtttaaaaaatttttttgactctattcttaaataatttttgtttttttattttgattcaatttgctacaatatttatcatttcaaaaatgaccaaatgttattactagggctgtgaattttagtgacgaaaaatcccaaaatagttaactaaaatagtgagtaaaaatgccaaaatagtgaagaaatagtgacaaaaagtccgaaatagtgacgaatagtgacataattttcagccaaaaattgagcaaaactaatttttattcactatttgcagttgcaaatgagttggactgggatttttaagaccaaaaaacccaaaatagttacctaaaaaaattttttaaattaaaaatttttgccaagaaagtaaatttttgagaaaatttttttttgatttcataggagtatattttgaaaaattttagctcgattcttaggggt

SEQ ID NO: 1185 - DNA, 3671 bp, Heterodera glycines
  misc_feature (2740)..(2740): n is a, c, g, or t
  misc_feature (2807)..(2807): n is a, c, g, or t
  misc_feature (2822)..(2822): n is a, c, g, or t
  misc_feature (3665)..(3665): n is a, c, g, or t
gaccgatagtgacatcagaatcgaaaatttttaatgcagaaatgcgttttttgagctcctttcttcaaatcaatcgagcaaaaaatttagttaaaacctaaaattcacagccctagttattactagggatcggattcttagttttttaactattttttctgcggctttaactcgacgagaaatgcacgaaaaacacattctttttcgaaaatttttcgtttttagtgccactattcatcactaggaatcactattttggagcttcgccactaaaaaaaactatttcggaagttagccactaaaataattttttgccactattttggcattttttggaaaatttcccaaaaaatgcaataaaaacgaaaaatacaccccaagaatcgacctaaaaaattttcaaaaatacacccctaagaatcgacctaaaaattttcaaaaatacacccctaagaattggaaaaatttcacaaaaattcttcccccaaatttttttttcttgttcaatattttctaagaaaatattttgtaactgcaatcagtgaataaaatctttttccttaattttaaattattttcaaattaaaaaacagctatttaaaaaattacacccctaaatttggaactttttcgccactatttttgccactattttggaatttttttctcactatttagttaattattttgggattttttatcactaaaaatccgatccctagttattactttgagacagcactaataattgcactatgtatattttgcacattttaactgctggttttttgcaaatttaattgcgcataatttttcaatataattatatttcaaatacatacatactatgatgataggtaatacaaattttgattgaattttcacaaatttaaccttcatcgttctgctgctgaccttgaaatttataaatgaaaattttgtaattttggtttgatttttcttttttctggcaaaattttcaatttctacccgcaccaacctattgtataaaaaaaaatacatatattatcggcacagctgaatggcaccaatgctaatgtcgaggatgatgatcatacggcacgggagaacgacggcgacggcgacggccaaaagtttggcggactgttcggctggttgtggctgttgctggagatgatgacgggcgtgcagttgcgctttcggcaactgttgctgcaaccaccaccacgaccacctccagcagcggaagattgatcaggaaatgcgctttttgctcaatgccaatgccttccggggaatttaatccccctttaaaaaattttaaaaaaatttggcaaaagttgtccctctcatcagaaacatatgcccttgctgattcgatcgtttttttgttgttttgaatagtcaattttcatttataaaaattgcctcatgccattcccatagctctaccgtaatattttaaaatattttatcgtagcccaatgactactgtgattttttttcaaatcagttctagattctttcaagatttctatatgttgttgttgaatgctttatatagtcagaataaactgttttcgcatttttggttgcttttccaatgcctttgatcattttagaccttccgctggtcaataatcattccctgatcagtgagtgattatcccccacaattatccattaattgattgcttttttttcatactgatccatccattatcccccctaaatttcttcccattttaaggcgtttctcagcggtcggcttaaagtgcagggcaaattggcactgttgcagcgcatcgatgcagtgttacgcaaaactcgcaatgctcagcgcagtaaactctgaattcgacgacccgtttaacggggctaatggggcgcgacttttttgatttatttttgtaattcatgtccaaaatgtgatttggattctggatatgcttcacttatcagcagaggaatcggtcgctaattctgatgattgataaaaaaaaactgaggagatccatatgccattgggaaatggctggataacaaaattatccatgagcttaaaacgacgaagctcaaatccatgggccaaaatgtgcccccagggcagggccaaaacgacggggctcaaatccatgggccaaaatgtgcccccagggcagggccaaaacgacggggctcaaaattacttagaactcaaatataccccagagccaatttggcggaaatctcaaacttatccatgacctcaaaacggcggggctcaaaataactgttagctcataatttttatttaagccaatgtttggttttttcctttaaaaacattgctttagaaagtcaatttttcctttgttttgatgaatgagtgagtgagtgatgcccgtctcgactttggcacatttgcagggccctcccctgactgattggcactcctcggcatttttacgattttctttaatccaattttgggacctgccggccatgcatccacgacccttcttttcgcttgtattcattcattcattgtttttatgaccttttagcctcacttctaacacattacttatccctcagctagctgccaacaaatatataaatttgagcatttttaaataattaaaaaatatttttaattcttttttgtttaaattttagaattttactaattttcatgtgtctaaaaacttaaaaatttacaatgttcgcatcaaaatcctttttaaaaaaacaccaatttatttacaaacatttcctnagcgttgcacgaaaattgtatacacagaaagtgccaaacttttcatttatgattcatattttaattnttcttgcacttttcncaatttttgaattaggaatttttcacataaattttttgcacttttaaaatccgtccaaacaaataaaatggtactccatttgtttttggtgccacattcgataaaagcttctgcaagccaacagatattagcttagttgctttttgcctccttcttctctgtctatccgtccgttggattttttggatgggcccacggaaaatggatttgcccctagggaatttttagctttcgccgcacggcacaaaaatttgcgttggcacagttcaaagaaaagtgtgtgccattgaatgcaatcgacacgaacattcaaacggaaattttttgcttaatatattgctttttataagtaattaaaattttgatttcgatttcgatttttttggcgaatttatttcaaaaaaaattggcaattgtgccagatttttgattttgtatccaaatttcattttggcacattgttttaaccgagttgctttattcatccagtttttgaataattaaaaaagcgtgaagcatgtctatgaatgagaagggcatatgattacgcttcatgtgccttatttgtgccccacataaatctgtcaaaaaaataaattttgtgccggaaatgaaatgggagaatggcatttttagtcaaataagccatcgaaaaacagacaatgtcataaaaatttattgaaatattgtgaaattaaaaataatttttgtgagccgaaaatgaaatgggagaatggcatttttagtcaaataagccatcgaaaaactgacaaagccaaaaaatttttttatccttttttcgagtgagagaatttaaatttacaaatttttaactaaaaaaanttattt

SEQ ID NO: 1186 - DNA, 5838 bp, Heterodera glycines
  misc_feature (2594)..(2594): n is a, c, g, or t
  misc_feature (2610)..(2610): n is a, c, g, or t
tgaatggttaatgcggtaatgggaggtggtcattgttgtgccaggttggccttggccagtgctttcacgcttattttgtcttccatgattcattcggtaaagactgattgggccaaatgcctaaaaatattaacccgaaatttttgaaattttgaaaggcccaaaaaattaaagaggatttttaacctgtgaaatttttttttgggaaatcatgaattcctggtccccaagaaactcaaatttacctaaatatggccaaacccttgaaaatttgttggccatgttttccgcctaattgcccccccccccctataaggttggtgccgtacatggtcaccatttcctgcgcaaaacggcacaacagaagcagacggaggatgccgagctggaggaggagttggacttggacgaggaggaaaaccgttttggcacggcaaattcggtgccatagttaaataaagcatatttaattgctttaaaattttatttttctatttatttaaaaatataaattttatatttttatttatttagcgtcaaaattaggaccgcccaatatttttattattttcagaatttttttttaattgagaacgaaatttttttccaagtaaatgctaagtaatttgattaaagatttgggcgttcgaaattccatgccatccctgctggtgtgtaatatgaatggttttccttaaaaaccagatcagggtcattttggcacggcattttacacgtccaatgagtttatacgggttccgtttttttggcgaaaatatttacaaaaatcgccattttattgggtttttgaaaattagggtttgacctcctcccctgaattagaaccccccccccccccctctcagaattctttcaaaaaaattttgctaaatgattggatatagggcgacaaattggattgaataattaatttaatttgaataatagactgatcggaattgggggaaaatggtttaactgatcgacggggattcgaatttccattatttcacttcttcttctcccattctttcgacatcccacttaaataatgctcttccttccttaaaactcgttcacttcaatcacggtttaagccgatccaaaatggcgccacggaaaagcggcaaaatgccttaaaaatgcaaattaaaaattttttttttgtttccaaaaaatgatcaccgatgattagtccaatcactatcaatggcattccaacaccgtggcaactgctcgcgttcttggctaattatgtaaattaaaattgttaataagtaaatatttaaaatttaaattctaggtccttgaaaatgggtgtatccttcaaaaaccgggttcaaatttcaacactggaactcttaacctttcggcttgctattaaatatatttaattttaaataaattctgggtccttgaaaatttgtgtgtatgcccttgaaaaaccgggttcatagtttcagctttggcattctgtctgtacctttcttttgcttcaccaccggcggtgccggtgccacaaactgttcattgtccatgctcttgtccttggccccaaaatggcacgtgcatttccaatcggtggcggtcggggcacgcattttggttgtagcttcaacatcggcacgaatttgattggcaccgtcaggaccttccttttcacattttgctttgttttctggaccaaaaggggaacaagcccacatgttcaagaaaaatccatctgaaaatgtaaaaaaaaaataattaaaatttttaaattttttaaaaaaacttctgaataaattttttctttaatttaatagtcaattaaaattttaaaaatatattaaattttgataattttgttcacaaaattttaattttttttaagtaaataatgcaagccaaaatgaacgttctaacaataatatttaggtcactgacttaattatttttttgccgcttgtttcgatgaaaagtgcttgaaaacaggcccatagcgcccggggggggggggtttgaaaattttaaaagcaattttcttaacaaacttcaaaaacagctaaaaatcccttcccatattcactagggctgggattctgactcgaaatcgccttaaaaagactttaaaaaaattgtttctatattttttgtatcttctaccatgatttttttgtttttctatttttgggattttggtgacttttttagtcgaatttttgggtggatttttcgtcagataaattcaatcactttcagcggatgaacaaaacattgccatacaatgcgtggctttggaacacattgttttgatttttttttcatcaagactagctgtgaatatctccgtgttcagggcgtccttgcacttcaatgcagcagctaacatgaaaagtgaaaaaaaatgattaaaaaaacaacgcattaaatgggagggagtgcagtgcttacgggaatactgaaatgtgtgtgtgtactggaaagatactggaaaaaggcagcatggtttttttgagcaattttgcgtacttaatttttcaaggacattgtttctctctttttttctatatgttattcgtaaaatttgcgtttgaccagcgacaatcaatgtnccttatataaaaatgnctttttctttttttttaaataaaattatttggataatcttacgaaaagcaaagctttaggttccagttgaaagcaatttttaattaacccatttttattatacggtaattaccgtggccatgtttccggttgaaagcaattttttaataaatgtttgtaaatggtcattaccggtgttgaattgacctggtcgaccaccaccgaattgaccgtaaccgtgcccgtgttcaagcaaaacgctgatgatgcacaaccgcaaaagaacggcgaaaatggacgggaaaagcaagcatttgacgaagaccatttttggagtttttaaaactctctttttcccattaattgccatataaaattcaattcaccatttaccgttttcgattggaaagaaggcaaagtgatgggaatggatgaagcaagaaaggaatgttagctgattggtctgatcaatgaaaatgaaaaatgtgtgatttttgatggcttttcgttgcctatttatggacagacaaaaaagagggggggggaggtggaaaatgggaaaatggccaaatcaccacaaatttacactccccaagcacaattttttgtccaatcgctgggaaaagcgttggcaaaatgagaaaaagcgaaaatgggaagccgaatcatcgccaaaacggccgatggaatgccatttccgatggatgggaatggacaaattagacaattttcggattaatattccatacaaaaaaaattcatttttttgtaccatccgacgaccaatcgtttgggaaaagtgttggcaaatgaatggaatggaaattgactgaaaataataaaaaaaaataatttaatatagtaaaataaagaattgatggattaattatgtattgtataagaaaaagccattaaattttttggaggcatttaattaaggatgaatggggataaaatggaaaacgatggataaacaaaatctcgaccgtacaaaatatataaattaactcatttgtcagctaacaactgacagaatgtcaatgagtcgaaaatttcggcttacataaaatgcgttttttaaaaacaaaattctgtatcattaatagggctttcttttttaggcacaaaaaatcgcgaaataggcacctaaaaaggcataaaaaaatcgcaaaataggcattaaataggcataaaaatcctcaattaggcacaaaaataggcaaaaaatttttttattaacgctttttaggtattaaaacacgtaaaaacttaaatatttcaaatgtaaatgaatagtttaaagttattttctaaataaggacaaatttttaaatcaaaatttttattaagaaaaaaatatattaaattttgggatcaatttttagaaaacttttttcaattcataggggtgtaatttctgaaaatttttttgggtcaattctaggggtgtatttttcgtttttattgcatttttgttaaggattttttcgaaaatcctaaaataggcactttaagcacaaaaaccccgaaataggcaaaaataggcattataaaagtcatcgtagactccccaaaccaaacggaaaacgcgtttttcgtgcttatctatgcgtatcaagtgcgcaaaaattttaggcatttgcctaaaaaaggaagccctaagcattaagtattgtacatagtacacaaaggtccatatgctaaaaagctcgttcttctgaattttgtcaattcagttttttgaagggttccaattttgacaaaataaaaaaataaaaatgaataaacaaacctactgtaattggattattgtaaatttattcgttcccttttaattcacgtttaaaatttcagaacatcaatccccccactattaccgaattgtttttcaagaaattttaattttgagaatgtttcataaaatttagaattagtatacagtaaaaatttttttcgtgtttcgtgtttcgctttcgtattttcatgttttatttagtttcgttttttcgaattcgtattttgcataaattttataaatactttatggagtaaatatccaaaatttaacagcccataaccgtttccctgattttcttgctttcttgattttaatttaaagcatattgagttacatgttcaatgagatatggttacggtatttgcaaaaataagaaaaaactcttgcccaaataacggcccttaaaacaacaattttttccaatcattcacaaaaatgtatctcttacaaaaatcattttcctgtcgcaacagtgccactgatggttgaacaaatatattttttgctatgccccaagggagtagccagactcttgggattcgtgagggaggttgaattcaaaaattcgatttttagggggtgtattttttagaaatcccgaattagtgagtgtattttgcaggaatttgtacccgtttttcgtaactatttttttgccattttggggttccatttttcaaaaagaaagaagtttaatgtaatttgttaagagaattgcttaaaattttcaaaaaatttgcccaaattctttataaatttaacttttttggattttgaggcggctttagcccactctcaaatcagccccttcccccctggcaacgcccttgggctaaacaattttttttttttgctgtgccccacaaccaacagcaaaaagatgatgaattctgggtggtgatcatggtcaatatgatgctgatttgataataataaaatgcaggattaatgatcaaaaaaagccggttcattttccacatttttttttatttgcttcgccgctgtcgctgcactttttgctttattgtgtgctcattcaaattgctggccaaatggaaggaattttggtctttcatcaacttccaagcggatcacacaaatgtgccgttggccactttggtgaatttgtgccgtttttgccattatgattctacatttttcaaatctttgttttaagaggatcagcatcgtcttggtgtgttcgtccatccgagattgttcttcacaaattcgtggtgaattgcgaacgccttacgctaatcggaaaggactcaaaaactggcgaattcggctcaatgtacaacaaattgcacaaccaactgtggatgatttgcaccaatggccgaccaatcgaagaacagcaacaccaattcatggacgaattggccgcgaaattgcctcccgctggacgccattgcattccgataacagtcaatcagcaaagttgatgc

SEQ ID NO: 1187 - DNA, 1425 bp, Heterodera glycines
ggtcacctagatatattgaaaaacatttccaggatgcaatgaccattgttcgaagatttggaaaaccagacttatttgttacaatgacatgtaacccaaaatgggaagaaattcaagaaaatttatataaagaacaagatcctagcgaccgaccagatattattgaccgtgtttttaatctaaaaattaaggcacttttaagagatgtaacgaaccaagtttttggattttgtattgcttggatgtatcccgttgagtttcaattgagaggactcccacatattcatttacttattacattggcacaaaaagacaaattacacgatggagaagatgtagataaaaggggaattagtgcaaaaattcctaataaaaaccaagacccacaactttatgaattagttaaaaaacatatgattcatggcccatgtggaatattaaacccaaattcaccatgtatggaagaaattaccgacaaaaataatgttaaaattaagcgatgttccaaaggatacccaaaatcatttcaagaaaaaacaattgttttagaaaatgggtttactatctatgcaagaccaaatgatggaaattttgttgaagtaaaaatttttgatggaaaagtttataaattagataatagatgggttgtacctcatatgccatatttattaaaaaaattttcctgtcatatcaatgttgagaaagtcaacagtttatcttctgttaaatatttgcataaatatattcataaaggaccagatagaactggtgttaagttagttgaaaaaatcgattttgatgaagtgaagcaatttaccgacgcaaggtttgtaagtccaacagatgctgtttggagaattttagaaaatccaatttgtgatagaagccatgcaattaaaacattgcctgttcatttatcaggcgaacaaatttattattttgaggaaaatatggaagaagaagagcttagagacaaaataaacagaaatacggaactaatggcatattttgaattaaacaaaaatgatgaattggccaaaaataaatattatcacgaaattccagagttttttgtatttggaaaaggtaaatggaaaaggcgtgtcggaattgaaaacaatataacagaaaatttccaaacaaaaacaataggtaggttggtaaaagttttaccttctgaaactgagagatattatttgagattattgttattgcatgtaaagggcgcgacaagttttgaaaacttaaaaacaagaaacaatatttgttatcctacttatgcagaggcatgtttggcctttggattgataagagatgatgaggaatggaaaaaagcaatagaagaagcaaatttttacatgatgccttcaaaattgagaatgttttatgcattgattttggcacattgcggaccatcaaagccca

SEQ ID NO: 1188 - DNA, 6979 bp, Heterodera glycines
ggaaacgcattcgcaagtccgcagaacagcgtctttaacggacggaaagaatgcgcacagaaatgaacggcagctttttggaaataaattcagccgaagaaaaaagacgaaccttcagaggtaagaaataccgaaatcagagtcgttggtaattttaaagtttacattggatccggaattggttgaaaaggatgccgaattcgcgatcagcgacccccgaaaagatttcacaccaatttgttgggggaggggggacaaactccaccaaattcctcaatgtccgaaatatcgcaaaaaataatcacaaactttccgagttgatttaagagttaataaaaaacaaagacgacagtttctggtgggttggcttcgtaacgactagagatcgacctggacctggatccaggcctggatttttcctggatccaggtccaggtccaggccatttttcggcaacctggatttttgtccaggaaatcaaggtccaggtcaaatgtgaaaaaaaatccaggtccaggtccaggcaaaacaggaaaaaacctggattttcctggacaaaattttagaatttattttttcaagtgaccgatgttttttcaagttttcaaaaaacagattaaataaatttaaaaacacattattattattaattagatatttttagatgcttctaagcaaataattaattttttcaaacatatttatttttaaaataaatttcaaaaaatccaggtccaggcctggatccaggtcccgaggagcctggatttttcctggacctggatttttgtccaggaaatcaaggtccaggtccaacatggaatccaagtcccggcttttttcaaaatgtcgatctctagtaacgacgatacattccccgcaatgggccaatggcgacgaaaacggaataaatgaacgaaatttggcacgtggcgaagaacggcaaatgtgcacaggcataacaaagaaaggagggtgacagagaatggaaagaaaatgcgaagaaaggaacgaattcatttgtcagataaaataagcagcgaaagaaacgccaaaataacaaagcccagaacaaacaaagtgaatatcatatgaacactctgacaaactcactcataacaaattagacacccaattagccaatcaatccctttcttccccgtcgccctccgaattttgatcagattcactttcgctggaatcgaaggttttctcgggcaaagaataaattcgtatcacatgcttaatgaaagcaattgattacagctgatgtgtgaattacactcacctgaagggggtctttcatcatcaaatatttcccgggcggtttctccatgaaaaagtcgatgattgcgcgtaaaatgccccagcaggtgtccaggttcagattcatgttgctggccgattcgtttggacgaaactgctgggtgccgaggatgatgtgttgagtgctattgcgtgagttgacgcggctcacataactgatgattttgggtggtaaaagcaaaacaaaacatcaaaacgacgcaccccaatttaatgtaatccgaaccggccaaaatcgcctgcagcgtccacttggccaatttaaaagaattgttacgcatttccgtcgccagcactgcccccttttgaatgtccagctttgaacgccaatcgacaccaccgcttagctgtttaaattgtctgttgtctgatttgatgaacgcgagcaaatatcaatgaatttttctcagaatgtctgttccacaattgaatcttccccatgtactcaccgaactgtcccattcattgaatgccttcacggtcagtttttgtacttctttcgtgctggtccccgccagcatcaccgcgtcgtgttccgttcgtgccaccaatgttatcgcagttccgtttgccattgaccccaagttccaagtgcggtatttatacgcacaatccgtccggcctaactgttcgtcttcgaagggaattcgctcctcttcgaatttgaaaactttcccgtctctctttagcacttgacgccgaaaattttgattgacgtacagagcctcggaagccaagtcattggcattgtttatcccttgcgcgtcgccactcggcggatcgggcgctgtttcactaacccaaaaagcatctaaaataattgacgggtaaaaaatagactttcaggatgtatgtgcaggaattggccactgaactttaacctaatcccggattaacgcaaaattaatgacgaaccccaaagccgaataagccggttgggaatggataggtgtaagaaagagaaaaaacagtggataattatttgtgggggaagtgcatattattttgaagacgcgacaattgcacttgggatgaaatttttaaaaaattgtaatgaaaatgttcaattatttctcactccaaacgccactattctaattacaaaaagaaatgtcaaagatgtgataccaattggagaaactcctgaagttgaacgtttgtcgaagaaaagtttatcgccaattcgatatgcgatgatatcccaactattcactgaacgattagccgccataattgtggtcaaaatgatatctgtggcgaatacattgccgacattgttgcaggacagcttaaccatgcgaaattcagcaaagaagtgaacacaacaacctttctgaacaccgggtcttcagtggtggtcagcgaataaaaagacgcgtggaatttctccaaatgcagggggtttttgacgctcagtttgtccattaatgctttatcataaaagtgaagggtgccgtacgtttcgccgggtctaaaccatcggttgtttagagaattcccttagaaagaacttacatatcctttccaggttcaatgtttggcaggtaaagtttgttcagctggacaaagtccaactccttcagaaccgcccaatcgggtcgaacttgaaccgaaggctgtcgccctttgcccgcctgtcggtcattgaagcgccgcccggtcggtcgctgcgctgtgccgcgagttccaccgccccgacgcaaaaacactttgtacgctttttgttgctcccttaaagaaaaattttggagcagtcgattttttatttaactaacaataaattcgttataaaaagactaaaattttaaattacccagtcctaaattattatttttaatgttttttaattgagtacattttttacaaaaccaaaacttgtatttaagagttttcggactcgttggtcacaacttttttgaatgtcataagcgaaagtacgaatttgcctattgttaggacatatcttccccctttgttaaagtatggcaaaaccaatacattagcagagtaattacaatacttgagtatactccgcttcatcttcgtcgaaacattgtacttctcatattctcggcgttcctgctcacgttgagccaatttacgctgcaacatatattttattaagaaatatgcgatagttttgcatacaaatggaatttgacgacggaaaggcctctgcggcttttgtggtcgactcgagtcgaccaattggaagttcgattcctcgttgtcgtggatgtaatcgaattgaacgcccgcagtcgctgaggagccatacacacgctcattgtaccgatctcctgcaaaaaaacaaaatcctctcgaaaaactctgtcaaaaattacgcgtttcgccttttttgaaaaagcgatcgacgcccaaccaatcgacgatacgcccaatccgatcgcatttgttgaaatgttgatacggaaggcccacaaactctgagagtacttgactgtcacttacagaccccggaccccatccgttggagttcgacacacattcaggcagatcaaattgtggtagagacattattaataactactagtactgaaaataaagagaaaaatggtaaatacacaatataaaagaaatacagaacagagtacttgaaagtgaaactgaatcaaatgaaaaatggaaattcatatgaaaaacaaataacgaaatgccaatttcagaattgtcaatacctaaattacttacatacagtatggtgcaaaagtatataatcaaacagtttcatttccatttcaaatatcgtccaagatataagacaactttattctttacaaattcaggtgatttgtcatcacagttcaatgggaacatcttctctcttaaaaataaaaggcataaattaaaaaattgaataaaagataataccgtaatggcgattctctgagtgttttagctttgtttgttggtgacttttccgactcatttacacagatttcctctaaatcactgtcggcacaagtcatttcgtcgctattttctttttccaaatcgttcaatgggtcccaagtcgtaacaaaactcaaatccgaatcctaaagtggataaggacaactgtattttttattcttgagtttacattaaatcacctgctgcccaaacaattcgtcctcaaagtcttcttcttgcaagcttttgtttggtgtcaattcttccactttttcattatttttcatgttgaaactgcagcttaattaactttttttttaaaaagatgtgcattaaataccccggtcattatttaatgtttcactcttcctaattcagtcttcatgaacagaaaacatttgcaaataattaacaaataaacaattttatcaaaaataccgtatttcttcgattatatccccccccctcgattagaacccccctctcgaataaagcccccttttgaggagggttaaacaatagagcccccgggggctataatcgaagaagtacggtattacatatttattcacaaatcgaaacaaatgtgaagaaaagtattattattaggaagaagatactaaaactgattttatagaattgtttttttatatgatgggctcaatgttctcaaataaatattgtaatttgcgcctttttactgtatcaaattatgattttgcggtatgttacataataagcaaattgccacggcgaaaggcctgcttacatgatttttttaactttgttttttcactcggaaaaattctaaatgtgaaaaatgtcatataatttcttagcactctctctattttttgttttacatttcgtgaatttttgtaagtgaaattttggctctaatgcattttatgagtccaatcgagttttatgagtccaatcgagttttatgagtccaatcaaatatttgtgaataaagtacattttacaattttattcaacttaggagatttttcattccacaataagatgaataaataaaaaagttcactttgtttgcgcaagcgctagaagacattgtgtttgttctttagataaaagaactaacattcgttcaatgcatacgatcatagatttttataacttttatagagatctttgccaagtgtggcagaaagacagcaagcagaagggcggctgggtggccaaggccttgttgtggaaatcgatgaaagcaaattttttagagcaaaatataacaggggggagaatgataaatagagcctacgattgggttttggtctattagaaaggggcactaacaaagttagattcttcaacgtacagcgtagagatgccgacactctcctgcctataatagctgataatattgaagctaactcaattataataagtgacggatgggctgcttatggagggataaataacatgcaacagcaatacgaccatcgttgggtaaatcatcggatgtacttcgttgatcccaatgacccaagagtgcacactcaaggcattgaggcgacatggagagcactcaaaaatggattgcgacacttgcacggaactaactctgacatgtttgttaccaacctatctttatcagtatatgttccgtcggttccatggaaatgcaaaaattttccaaaatattctggaagaaattcgatatcaatatccactataattgtggctttacattgtgtatttcaattttaggctgacagtttgaaaataaaaattggactcaaacttttattaaaaaatcattggactcataaaaaaatgattggactcataaatttttataggactcataaatatttgattggactcatatattctgattggactcataaaactcgattggactcataaagtgcattagagccaaaaattttattcattccgttaattggagatggtaattattaaaagaaaattatgaattttaaaatcaaatttaattcaggtggaattgctccagcaatgttgttcactggcattgaccgactgattgcaattgctttttcggaattgtatgaaaaattacaatattatcaaattgttaagtacagtaactttcagtcatgatagccttaaaaagcgactgtatttggcactgttaactgtaatttctgtagcctatggtgtctgcttctctgctacggtgtaccaaaatgaaattgtagatggtgatcagatgaccaccggatcatatttggattttataaaggtttagttttatctttttgtgatttctaaaattttcaaatgctttatagatctcacctatttttaatacaataagttttttgcttacttcaatgactttcatcatttatctgcttcttggaattgcagtacgtataaaagcttcaggtaatctcaagattgatgaaatttaggggtggaaaaaatttacaaaaatttttaataaattttatttcctacaaaaatgaaaaagtcactaccataactcggaaagaatttccattattaataagtagggatgcgagcgatttttaggcacaaaaaaagcgcaaaataggcattatataggaaaaaaattgtttttattaacgaggtagcaaatcacgtaaaaacttaatcaaaaaacttaattttgcgtatatttcattgttttaaagtttttccgtataagcacaatttttaaaccaaaatttttatcaagaaaaattaaattaaattttgggggtcaatt

SEQ ID NO: 1189 - DNA, 4593 bp, Heterodera glycines
caattttgggctccaagtacaaataagtttattatttatttagtaatcagaacgccaaaactttgcaaaacttaaaatttattggggattttcccttgtaaaaatggaagagccgatctcgagttaaaaacttaagtttcacaaaataaacttggaatcgttaaagggggttaaaatatgggcctatgcaaaatttcaagaaaatttcaactgcagaaaaattttttcaactgggtgaatatttcaataactttccgacacttttacagttaaaaatggtatccacacgcagtaaaactgataaattcaagaaaatgggaaattcaagtactgaagcaaatcgaaaacggaaggaatggcgccaggagcgtgctcgaaaaggcggctcgacgccaaaaagtgacgaaaattgacaaaaattaattttattttaaaacactgcatttttcagcgctaaagcagaccgaagccgagacaacaggggaattgtcgatgagccacttttgcgatcaatcaaatttgaccggataatcctggcgccttttcacgtcttccagggcattggaaatgcactgatcaaagagctcgaaggattaactgaaagcgcggaaattgcgaacggatttttcagaagcatcgcggccaggagggaagcgttcagaaaaaaagacatgacggggaattcaatcagaaaagttctgattcatgctgaccaattggagaggctttactcagctgaatggcctcaaatcatttgcaaaaccatgggacacttggcaaagatacaaacttttacaaaagagattttattttgtctttcttgaaaataaaaataaaatttaaggcccagccactgtcgccacgggatttggacgaattggaaacgtcgattgatcaatttcggacatttctcaacgatcagccacggatgcgcactttgctcgcctaaacctaaggtccacttgctggtgaaccattttgtacccttcgcccgacacaccaatttttggcacttttggacgagcagggtcaaaaagcattttgaaattttagcccgaatttttttaggcgatgaagcattgcattcggtgtggaggcgtttggaacagctgtggaaaacaatgcctgacgaagaacaaatgcgtcaattgttggagcaccattttgtctcaaattggcttctcgagacgggaaagctcgacgaaatgaagcgggtcagtttggtgaaaattgggtttcaaataaaattcccatgcctcaggaccgtgaagaacaacaggaacaaatcggaggccgggagagcgacgaagaaagcgatgtagaagaagaacaattcgattttgaatagacacagttcgataaaaggtttttcttcgtttttacaggaaataaattttttatttaatttttgagcttcattaaaaactgtgttatcatttcacttatatttatttgctttaaaaacctcaaaatacagttaaagcatgcatgggactcgaacctgggaccccccttttggtgactaactcacagaccactaagacgaaaaaaccaacttaattgtacttggagcccaaaattgaatcgccgtgtatgataacatttgactaacaaatggaagattgatcaaaaataaaggagaagcattaaactgatagtacaatttggtttgcatttgtataatgtttatcagcacatatacacctcaacaaacatacatacggaaatatgaaaatgagtgggtttacacacaaaatgataaggggaattgtctgatctccagtcgcgttcccagggcgcttctccatccttctgttctgttagtgttcgatgctcatcgtcctcaggccggcgggaagcgggtgatgctgtggctcaggttcgccgcgattgtcagcgttgctcccgtgttgttgcggccattgtagcgcgccgacgagaaaagggtgatgagccggcggccggcgaaatattccactccgttcatcacgacctggaaaggggaagtgggaatttagtccagaagcaaatgaaaaaaactcacttgatgcgcccgaatgatgtagtcgagacagagcatgtcgcacacccgctccaccacgtcctcgccgaatgcgatgcccgctcctctggtgttcgggatgacgccacgaactccgcgcgcagggtccgcccacaaaagatcgatctccagcgtccgaagcggcgggtcgatttgcggacgattcaggtggctgagctgctccaggctgttgatctggtcggagaggccgccgtgcatacctgaaaaataatgaattagtatgaatggacaacaacaacaaaaaatgtgactcacacaggattttgtcgccgatcaggccgacgtagggcatccaggcgaacgtctgattgaagaggtcgtagaggcggcggggacccggacgctggtagcggcggttgacctcatcgaagaagccataccttaaaggtggggggggggggaaatttaagtctgaaacaacacaaaaaaatgcgatccttacactctgttgatgttggcgcactcgtggttcccgcgcagcagcatgaagttcgctgggtatttgacctgcaatggttttggggatttaatttggtctgttaaagattcacaaaaccacaccttgtagcagaagagaagaacaattgtttccagtgactgggggcctcggtcgacgtagtcgcccaggaagacgtactgctgctctggagggttgccgtgcgtgtggaagatcctctgcaggtccgtgaattgtccatggatgtcgcccacgacgacgaccggcggctgaatcctgacgagcgtcggctgcattctgaagatgtccgtggccgccatgcagagttgtttgagctcctcgtcggtgatctgtggaaaaaatgaaatgttttaattgttgaaatgtcatgtcaaaaaaatcccacctcatccgtgaagcgttggacaggcgaatgcctgaccttcctgatgatcgcgtccacgaagctgcttgacaggccatctccttgcacaagtgttgaagtcgttgccgaaggccgagactgctccgccgctgccgccgccgttgcatcgaagcagtagtcctctcttgccattgttgcgccgggcacgtcgcttcgtgggattaaagatgcagacgatgagcaatatataataacaataatatgtgggcaatgaattatgtgatgaaacactgcaaatgcgctccttttatatacattatttccgttttcactatgggtcaagtccaatgcagtgttagacaaaattatcatttcgccaaatagcgtaattgacgtaattttttgcgcactaatttaaaatttttcttgaaaaattttaacgaaatgcaattcaaaatcgtaaaaattttgcaaattacaaaaaaaagtaatatagataagtaataacaaattaagtgaaatacatgtgttacttgattatctcttatacaatttgccattgttgccccctttttaattaaaaaaccttcaatttgctctcgtaaattaatctgcgaatagatccttccttttttgctgctttattgagtattctgcagcctctgcatgatcacaattcatttactatcgtaataaacagaaagaaaaactaaaagcattttttcgagtcaagaaaaaaagcaagcataaaaacttcttttagatactaaaattgttcggttttgttaggaatgaagcgagttatggctgatcaaaatcaaaaatacaaaaaaggcatttaccagtgtaaattttaaattagtgcgcaaaaaattacgtcaattacgctatttggcgaaatgataattttgtctaacaccggtcggggtcggtatgctatggttgctgccttggctttgctcgccagcacattctcgaatgaaaagtcaaagattggacgaatttggaaaggcaaaatcccaacgagtggcagtaacgacgagaaaagacggaaagcagatggaaaattggggacaattttttcgccgaaggccggggaggaattggcggaaaccgcagcaacgaattttgaaaatttgttgaaaatcagcaaaagtctgagttttccatttgatgatctgaagagtgcacaagaagatgccaatgaaggatttaaaaggccagatgaaaagtcggaattccgttttgtccgttgtttttacaggtctgaccctgcaacgcgacttcatgccgaaccggtccactgctgacacccttaccgcccctttcaacgccgaatgcactaccgatgagcccaaagcgctgagggcatcgcttcttagagggcgaggatgtgctaatattgtgattttaaaatatatttggcgttttgttatttaatttgtttcatttttgtttgtgatttttgtgaggtgttagttgttagttttatgctttcgtcagttctattgattgtcgtcgactatttaatttggaattaaacgataattgtatcttcggcattgggctgtgttttgtgtttgctttgggctgttgtcttttgccgtgtgcagtgcaacaacattattaaaagcccctgacgacaacttttcccctttctgtttttta

SEQ ID NO: 1190 - DNA, 4148 bp, Heterodera glycines
agcatgtcatttttgcgcttagtcccagtgagttgctgcattcaaggaaaacataaggacatgccaagggcaatttttgtaatttcaaggtgattttgccaagatttggctcctcaaacatgccctcctcgtcgtctatacgcccgaccgcgagcattttggcattgtgccgattgaagcgatgttcatgcgctgtgccgttttggcagtgaacagtggcggaccactggaaagtgttgagaatggcagcagcggctttttgcgcgattcgaacgccgaagaatttggcaaagtgatgaaattggcggtgaaccgaccacaactgatgcaacagatgggcgaggctggtcggtccatcgtttgtttattctccggggaaatggaaatttcaattttaggacgaattcgtgtcgaaaaacatttctcatttggcgcctttgcgaataaaatagatgaaattattgtcaaacttggaacaaattcccggcaatgagaccgtttattccccgcaacccagttttaattgagtccctcccagaacatttggaatgtttttattaatttctatttatatattattgtttgatttttttagagatttgataaattattctgtgctttcactgttctacttagtgcaggaattttgagattgtcgggcatagggcttatttgttagaacacttgcggccgcttttttcaacaaatttttctggcaattccaacaggcttgctcgcgttttggtctagaatatgtcccaaaaaatagacacttcgtactttttagtcgatgtttaatgagtgaagacaaaactttttaaaacaaaaaatcaaattacaaagcatcacatggcttattgctctttcaaatgctaacggaagaactgattggattgcgcattttggccaaaatgccgcccatattctgcgtctgacgattgaatgagcgcgacggggcgaatccgagcaatttttgcaaattctggcggagactcattgtgcacagaatataaaggaaaatgaaggaacagtcggtgaaatcgtcgcctgaaaagcaggggaccaattaagaaaatcagacaattaaaaaaagaaatcactgaccaaccaaattgcgatggctaaggccctggacccaagtgatcggctcaaatggcaatttggcaaccacacgaccctcgaaaatgctggagaaagtgctgagcaaagcggcgaacacaaaaccaatggcgagccttagaaagaggccaaatgagtgggtgtggtgctgttttggtccacaaaagttacatggacttcatgcggaacatgctcaggtcgcggttggtcgacttcagtctctcctcctcccgctcgattttccgtttcgtcgttttgctggccgcgttcgccgcacccgcaccgcctgccgcgtcccctccggcgccaattgcgtcctttttgcgctccaacttcttcgatttgcgttccatcgaaaatttcagccgtttgtactcgtcggaccttcaaaggcacatggacaattttggccaggaaaacattgtcccaaatttttgccaatgaaaatgcaattggccccgttttgccaccgacctgtagacgagcacccaagtgagtccctcgccgagcaaagcggtgaaaaaggcgatgaaaattatcaacaaggcgtcgctgtacatctaacaaattatgggaaatgcaaaatgattttaattggaaaagaaaaagaaatgcaaaaactccggtaacaacggaataaatatgaaaacgatgagaattattaaagctttgttttccattcgtcaacgttttaaacaaacattcaaaaaaaaaaatggaaaatatcggccaaaaagcgaatataaattagaaactgtatcaacaatcgcaataataaactaatacagtacggaaccgacatttgccataaacaaaatatcaacattgggtataatcatcggacattgtcacatcgaattgactccacaaaataacttcgaaatcccgaaactgctcttcagacgaggaacggctcgatgttcagctccagcgccgagcatggattggtcagcgcgaagttggcgagaaccgtcgggtggagcactccgaaagtgccaacgcacgcattgcagaacaaaacgttggcacaccgtccatcaaaataactggggtcttaacgggcaaaaaaaggactaatttggcaaaatgtgttactaattttgccaaccgtccgattggacgatgcgatagcccccgacggatggctcggagtcgttgcgctcgtaggcaatgcccaacatttgcatgattcggtccaacagtccgtggatcacctcgaaggagccgcttttgctgtagaaaatggccgccaaatggcgctcatttcggcattttgtatctgatgtttgcgctttttaaccattttgccggaacattgccaacctttgctctcgtcgatgaacaccacgtcctgcacttcgaagagacgtagtggcagtgccatgtccttgttgttggcgatggtcttcaaaatgccgggcagcagggaattgcgggccacctaaaaatggtaaaagaataatgtattttgtctaaattttggggaatggcacctgaaaatcgatcgttttcggatttgaaattcgcaccaccgagtccatttcgtggtcaggtcgaagcattttcgagccgacgtcttccgtggaacaaagcgcaaaagtgagcaccttttaaaagagggaatttaaaatgagtaaactcactctaattcgatttgttctcgccctgccccacttctgtccatccgctgatggccaactgaagacggagctggtcggacagtttgttgagcggaaacggttccgccacagtgttcgactggggcagtgccgtcggaattgcgttgtatccgaaggccaacgccaaatcctcggccaagtcgcactcgtgcaaaatgtcgtggcgagtgggcggaacagtgacctaacggaggtttattaatttggcaattgcaaatatttaaattggcaattaatttttacaaaagtccccctctggcaaattaatttataaaaattgaaacttgctttgactaaaaccgccggcacttcgtccccattttgcgctttttcacttcgcttctcctcgccgctcattgtcagcttcaacaattccaacgctttgccaatgtccaccgtttgcggctgttcctcatctttgatcggcacgcattccaacgccattttggacaacaattgcacggctttgtccgctccgatgtccgaaatgccaattttggcggccaaactcagcacatcgaccaaatggtcccggtaatccaatttctaaaacaaagagtgacacactcacatttaccaggaattaaaatgcggaaaaggttttttgaacaattaaaagacaaacaaattttgaaaacgacgaccgtttaaacaaagacagcgtttttaagtgaagttggcccttttaaagaccaatgtttgggtttcgcattccactttttgttgaaccaaccggaaaaaggctgaaggtgccattcggctggacaatttggacaggctcaacgctaaaacatgtaaatggaaagtacgagttattcgccggataatcaatcattccaattaattgtgatttggtctctccaaatgccactcacttgaattgctctgtgcaatattggctgaacatggtgaccaacatgtccagcacaatttccaatttgaccaggtcagtgccggtcacttctatgaaaatgttgcgcgtgttcagtgttattttggaatgttccgagttgattatcggcggcattgagcagatgacgccgtccgcgtccaaaatcaccgggtacaacggcttgtcgcggatgatgtgcaaatattcgcggagatgcgacgactcggactgaaacgggacggagagtcaattttgggaaagaattgatgaagaagtgatttcttatccgtcccttttttttactataatttccaataaaaatgcctctgacttttaatgcacgaaaattcattgtcaaactcaaaacgcacgtaaagttccatctgttcagcggcgttcatttctctgctctgattgagcggtttgaaacgatgtcacgcggaggaaggggcacatat

SEQ ID NO: 1191 - DNA, 5549 bp, Heterodera glycines
aacggggaaaatgttgttgtattacaaatcaatgaaagcagtaattattggcctaaaatgcagccaaattcgaatggcgtttggttgtatttgagaatgggaagacatgccacaaccaatccaatgacggatttgcataagccaacctttgatggtgtccaagtcgtgggtgcccatggaggccaatgtccgttttcggccaatgttttggtgcaatttgtcctgcaagtcaatgaacgaagcgtaggcatcggcgtcaaagtgaacgtcgcggagaatggcaccgacaacaaagggacgcacggcactcacctgaaaatgcataattttagtgggaaatggaaacatttatttctgcttttttaccgattgatctaccactattttctgggttttcggcggattcgtcagagaataaacgggaggtgtaattctaaaaaggaaaagcaaacaaatgatcaacgatggcatttcgatgacttggcacttcgtacttattttggaaaatgagcaatgcccgtgccaatccctccacacaaagcaaatcgtagcgattggcggggatctcaattttgtacacttcctcctcctgtcccgtcttctcgtctttttcaaccaactaaaaatacatccaaagcaaattaatttgacaaaacaatttaaaagcccaacaattaccacgtcatcgacttccaacccgtattggaagcacaaatcatcgacttgctgttgcgagagcgaaacgcgcaaatgtttgtccaacaaacgctttttcacagaaatagtcggcattttattgtttttcttaatgtcagtgtttgtttttttttatatttgtaaattcaattcccaataaccgagcaatatttttaacaatttgtatgtattatgtatgagaaataaaaagaaatctgttacattaccaaaatattcgctacaaataaatttatttttaacataatcagaacgcaaaactttgcaaatttaaaaaacgagcttttcccttgacaaatacaaaagccaccaaaatgcattttcaaaatactttgatagaaatcgatgaaggaatgggttcaaattataggcctatgaaaatctgaagaaaattaaacaataaggaactttttacaaaagcacagtttttcttttactctcattttgatgcactatttccatgtctctaacactgtttgtactttttcttttgtcaacagaattatttttcaatattttaaaaattaaaaagtaaaataatttttaaatttaaaataatatagttatttaaaaatatttgctacataaaaaaaaacatatacctaactgaaaaaataaattaatatgacaaaatgcgccttcaactatttttcgtgaatgacaaatgaaaatttaatattttaatttttttttaaattttccaactccatttttgacaatttttttttatattttgcaatttttattctttctgcgttttatttttgatccataatccatattttagggttttgtccattaatccagtctcaatacattatattgtgaaatgcttttttttagaggtttttgggatggcatcgttcaaaaagcaaaaagacaataatttactggattttggacctgcaattctaattgtaatttatcctgaattctatgaatatttttgaagcattggttaaaaataatcaaaaatacaattgagttgaataattaatggagaaaatggatacgtttataatatggagatatttataaggaaaaaggggagaccaaacagggaaaaacaacaaaatgaaagaatttgtgaagagaaaccaattcaaaggatgaaaaattaaatgatatacaatttaaaatgtgtgggagaaaaatgacagaaaaccaaagggtaaaagggaagagagaataaatgaccagcaaatgttgtaaattgtgtaattgtaatgcatttgtatgatgatgagaaaggttggagaatatcagccgacggcataccgaaaatgacaatgccaaaaaatcataattcgtattacgcttaatgtgttttgtgagtggggggggggggcaagaaaaggccaagaaaaaaggagggcgggggcagcgagttcattcatcattcacttgacgagattttctgtccaattagtgaggcattttgttcgtagagaaaatgggcacaacaaaagcaaacacgtggcggatgcgaagtgatcactgaaaaaggaaggcgtgtgaatgaaagtcgatgataacgacgtgaaagtgaacacactgattgtaagttactgtattagggtacggtggggtggggttttccgccagtttctaacactcaaattcttcactaaatgcgatcgtccgtccctcattaccattggttccgatttatgacttttttttgaagaaacattcttagaaaagtgaggcttgctgtactgccaagccgatggaacggaatgactctctctcctctctctctctttttctctcccaatgttggctttgtgtgtaatttttctcgacaattaattacctttgcttgacccctggcgctgctgctgccgcccgcgttttcatcattcgtttcttctgtcgagccttccctcgagcggagttccccgccgctgggcacaaaatgggacgacgaagtcgctgccgcaggcgtcggtgcaattgtcagcgcccgtccaccgctgcgcggtgccgaaggaacatcgccgcccccgcaattctttccgctcgcgttccgttttgccgacaacgacggggaggaggcggcggatgaacagttgttgaacaatggcaaccttcagaacgaacgaaatggcggtggtattaagtcaggacggtaagtaaatgttcgccctctcacttcactccgccgttgttcagcacaatttcggcctctccgcccacgccgaagttgttgttgctgttgctctgtgccccgtcgtgtcgcccatcggcgccactttcgacagtcgaagcagctgaagaggctgaggcctccttctgctgctggttgtgctgttctgactcaatctgatgcagccacttctggtggttgtgcttcaggttgatgatcagctctgaatttccatttaaatttatacaaaatgccggcaaattgtatcaaaatggcccacctgattcgggtaagccgggcagcacggggaacagtcccgcttcgttgagcgcaatcgccagcgggttgacaatgtgcgcgatgaatgagtcctgcagtttggcaaccgccggctcgttccggtccatgtacggactgaccggcattttccgccttttttcatcgtccccctgggaattacaatgttaatttcgaattccttttttaatgattggccatgaactccttccccttccccacctgttcataaaactcctggcaaatgcgttctgtccattgtctgtgcagactgtaaggtttggcgggcgaatttatgtccgcaaattgatcagcatcagcgaaatcagcacacgatcggattcgctgttcaggtccatgtcgggcactcgctcgttgaactgcatgatgatgtcgaagtgctgcttgaggtcggtggccaaaatgtactccaggaccaaatagctgcaaagtcaaaacggtggaaaataacaaaaaatattcatttttaaatgccgtcaattaaaaactgtccaaaaatgagtgttttcgcttggtccacgcaccgaaatcgtttcgtttccgccgagtcgagattctcgatgaattggaattgagcatgggaattgagcagtcgccacgactccgccgcgtgatgattctccaacacggaacggtcgttgtaaagaatggccttaaatgggagacgaaatggtcgaaaattcaacggaatagggcattttgtctcttccccaccccctcacaaatggcagccattcacactcacttttcggtcttcggatgccaccaaaaatgcgtttgttcgcccgggatggtcataatcgtgcattgcagcggccgtgtaaagagccatcaactaaattttaaaaaaaaagttacaatttagaaatgcagtgactgtaattagaccaaatccacaaatgccatccaatgtcccctaatatgttcccaccgtctcacctccaatgggctcatgctttgcgcaagcgcaacagccgccgaatcgaacgtctgctgctgtgggtgagcctcacaattgcgatgagtagcgccggtggcggtgttcgactgttgctgtcgcagcacatggcgaccaccgccattcgtcgtcgacgtggtcggctggccgttgtggttggtcaacggctgttccgtggagtaggcggcgtctgtcgccgtgtcgttgttcgcctcttcgtcctcctccaactcgtcttcgtcctccaattcagaggaatggtaactggaacaaatgaatttttcaaaatggactcaatataattgccaaaatcaaatggcatttgcctgcaaaaggcgtgcacgggatgacacgtcaaatagtaagtgccgtgcaaaacgtcggccgcatggattcgattgtgatcttaaaaatgttaattttgcaactgggtgcttttaaataaaagaaattcgtacatggaatgtcccaatagcccgattcgagcgcatgaaaaaagttgaagaattttgtgtaggaaattttgaaggtgcggaacaggtcggcctctttgaagatggcgtaagtcaactgaacgaaacgaactcttttgagtattaggaaaaggttgttgaattagcttcggtattgtaaattattttattcttcaaattaagcataaaacactcaaatattaagactttgaccccacaaaatcaagattttctagctttcgggagccgaaaaatatccccccatattctaacagttcaacagtttttgtttgtcgacagaatgatttcagttcgaagtgtaaggtgtgtgttttcgaaaagtctacattcggggggaggggaatatttttaactgagaaaatattttgttcatgtgccgtttgtccccgtgggcccggagtcggggccgacaaacagataatgtgcgtatttattttggtcccaattttctcgagatgttctaagtaattcccgcttaccctgctcaacacggtcctcttgtgtttctcggcaagccgaaaaatggggaaactccattcctggatctgtcccagggccgggtcacgctccagctccgcccggtcaaaggttgtgccattgaccgctttgtacaccgtgggaacatcgccaccggcgccgtgttgccgtccgtccttcgagggactacaaaaaaatgggggaaataagccgaatttatgaatcatacattaaaaagggggtgggtcggaaaaattttttgcgaaggggggtcggctgccgatgaccttttttttgcttttcaaacccattctttttttcggcgcgctttttccaaaaaaatttcgggaacaggggggccgacggtgccgataggcaccgccggggaaaatttttggatttttttaatgaattttgttaaaaaaatttccaaaaattt

SEQ ID NO: 1192 - DNA, 2730 bp, Heterodera glycines
gtttccctcctcctcctcaactgatcgggttttccctttttttctcacggttatgattcagttaccgttgctgctgctgttgttgctgtactgcttgcccacttggttcaccaccgtcctcattattattcaccagtcgctgtgaccgccgtctctgttgctgtttgtgttggtccccaacttcattgtgctgctgctccttccatgccatgtcattcggcgcaatttgctcaacatgttgttgctgttcaccgtgaagttcgtcctcatattcgtacaaatttatgcgttgtggcaaactgttgctgaaattggtcgcaatgccaccgccgtgatggccgccatggttttgaatggtgtgagcgtgagagggcttccaacaactgacaaaaaagagttggttttatgattttgattatctaatcaaattctatttcagggcagggttaatttctcattatatttactcctaataaggaaagaattgcctcgcccccgcctcatcctaatttgtaagccattaactttcatcaaattccaaccaaccatcctcagttggattagaatgaaaatatgggaaaaaggaagagggaataatgttggagaaaggaggcaacggataaggaggatgaggattttgtcggagaagagaggggtgaaaaggagaggagagtaaatgatgagagagcgagagagagagaaagtgccgtgccagatttaataaagagccgagaatgacaggtggaggaaggattggccaaaggcatacatcagagcaagatggaagaaatgccacacattggtcgtcttcgagattctcgacaacagagggcagacacttcagtggtgacaagggaggaaaagagagagagagagagagagagagagagagagagagagaaaagagagagagaagagagagagaagaaagagagagaaagttgaaaagaagttaaaatgagtgagagatggagaaaatagaaaaggatgaggataaagcgagagagaagtgaaaaaagaatgggtgccgtccgtcaatttggccataaggaaaagtatgcgcagaaagaacgaactacaacaaatgtggcaaacgaatctcgggatttgaattgggttcccgttgaaaaccaattacaatttgctaattgatagcccatttgcacagtaaccacctgcttgatcgcgggcgagacggttcgacagcaatggttggtaaacccgtggctaaaaagaataaaatcatttgtaaatgtcggacataaattaaggggaaataaaaactcacctgaagtgaccgtggaaaaagtaatattggagacacgaggctttgcagtctgtaaaaataattgtgggagatttaaaaaaacaaaaagttatataaatggatggctcaaaatatgatgccaaaaaattataagtatttaaaaatggcaatgcgatcattacaaccaaacatttatataatgagatgtgagacaagggggagggagcgaagagttaaacggaggatggaaaaaaattgtaacgggatagggagattattggacatactgacacatacagcatgagcaaggaagaagcccttcatagttttcataacggacggacggtgacggaggatggcattggcaaacaaacggagaaaggaatacaacaaaacatcaacaatctgccgctggtggtgccaaattagcacgcgccgaaacgacagggggaggagggggctaattggcatttatagtatgggtcgcatagaaacaacccatcaacagtcggcataaacacattttggtgccaaaagtgttcacaattttgagaggatggccgacctttttcggtttttatgatggattggcacaggaaggtggggaagggagggaacaccaatgttttaagtcaaaataaagcccacctctcccctcccccctcactttcatccgccttttccccctttctgtcatattcatccacttcggcgaatgccgggaaaagcatcgcaacgcaaaaagaaaagaaccaatttgccaccccctcaggcgaagggtggagaaagtgccgtgatgggtggaagagaaagtgagggttcctttttgtcgaaagaacaatttaaggtgaaagtggttggaatgggggtgggcatttcttgacgcgtgattatgacgagctcatgcaatggcgccttaaacatattaactgcccaaaggggaaagatttggcgctatgtttaaattaatacttagggaaaagcccaatttaaaacaacttcaaatggaaacaaacaaaaacataatgaatcaccagaatatcagaaaagaagtagctaaattagacaataaaaaatgacaaaatataaacgaatgaaaaaaaagtgcaaaaaatgatgaaaactaagaatgatggacaattgtcggtgggattgccagtggacatgcttcaccgttcgcagacagatgcgctgcttaaatacaggctattagctgctgcactcatccgggacggatggataatgtgacggttgtgtgcagttttggtaatgaccgtcgatggagggaggacacatgtttgccgacgatgtccaccgtagcgtgaaagaccggtcaatcggccggcggttggtcgactcgcgcagtacgttcccaacccctgcagaagagagggtggcggagcggagcatcggaatgacccccgaggaaggggggggggggtaattgtggggagatgaggggg

SEQ ID NO: 1193 - DNA, 2017 bp, Heterodera glycines
aaaaataaataaagcgcatagaatgacggaagaatttctcgctcttgacagatgaagcaaattaatttgccttaatgagagagaagtagggggaaaaaagaagagagagtttgatctatagccacgaggtgtttttttttgatatgacatgacagtttaaagaacctatgatggaagttgattcatttttggaattaagagtttttatttaaaccaaacaaagttaaattttcatcttttgaaaaaagaagtccaatcgaccgatggttttggtcttcaatgacaatgttcttccccccatcacattatcccattttcggacttacaatttgtctgaacatagccgatcaggtttgcaaatcgtcatcatggacaaagtgtcataggtgggggtgaattgaagggagccgtggtagggaaaatgagtgcgcaactgacgcaaattaccctcccccccccccttcaccactcccagcaatgctaagaacagagagacatccggaaaatgggggaaggattaaaaacacattaaaaggatgaataatgaatgatggacgagagaggaagatgagtgggtaaattgtaattcggtgtgtaaaatgatgggcattggaaaaaacggcaggactaatgtcagtaaaaagggggaatatggaacgctaattaaatatgtatctgaccgggacttcacactccaaacaatgccgaaggcatggagacgtcctctgtgaagatggtaccaaatttgttgaagaggaatgggcagaatggtactgctgatgcgacagtccggaagtgctccgttccgacttctgcttggccactttgcctttggcagcactgctccgcaaatccccacccggtgaacacctttgacaacttgcgcttaaaaagtgcagtgtacaatgcaggatcattgtgctgattttgtgtggtagcggaggatgaagatggtgagcactgacgtgtcgttggagcgaaagaggaggagcacagggagggagaggcggacggcaaagccaacgacggcatcagcagcgaaggcgtggaagcggaagaagccgtttggaacagcagcagacgccgactatcatcagcggaattcacaaatttggcaccgttgtcagcagttagcgatgctggattcaatgcaatgttggcatttggtacacccccgtccatgacgtaataattttatttttttaactaaatcgtcaaaaataatgttcgatatacttaatgaaatgtcaattactatcattattataatgttttcgtagaaaatgaagcaataaaaatcgaatgaatgtgaaggtgaattgtttgggtttcgccactaactgacacataattttaacgtgagaacaaaaattgaagaaatttttggactacaatttcattggcaatcattcggctcaaatttctaaggccaattcttttgccgaaacgaacaatgaatgaatggacgcgttggattgtttcatatttaatggactttcttttctctatcctttttagtttgccaatgacaaaaagaaaatgggtagggggggggggttaaattacagcaaaataaaaagaaaacaattgaaaaagattatctgataattgatttttgatagtctgtcaccattaacaacaaataaattttttgccttgaaaaattttggagattcccccaggggataaaagagaaatgggaggagagatggaaaagcttatcgtttaacaaataacagatgactcccaggggcaaatttgaaggaggcctttataaatggaggggaaaacactccttttgaaccggggtaaacaacagcagcagaggacaaaaagaaaagatggattgtgtgaacggacggcacggatggagaagaatataatttgggagatgatgatgacacaatgacttagtgaaaaaagggaggtcgtcgagaaactcgtcgagagagggaggcattcgggactcactccccccaccatccccctttgtgtgctttatgcccctcttccaaat

SEQ ID NO: 1194 - DNA, 1330 bp, Heterodera glycines
aaagaaagacacaaaagagaaagagagcgagagaaagagaggggggggggtaataagcctcaccgggaaaatttctttctaattaaaatgcagaaaaagccaaaattactaaaaaattaacgccacctcccccaaaaagccaaggtcaaaagtaaatgcgagagaagacgaacggaataaaatgaacacagctaatgggatgaaagttaagaaaacagaggcacagaattaaagacgaactcatggaaatttgattaggaagaacaaaacggagggaaaagtttagaaagaatgaggcacacaattacagcattttacttttaaaaacccatttttattccgtcagtagtgatgagcattggacagaaataatatacacttggccgcatttcggccaaaattgttttccaatgtttgcttatctgccgtgtgaatcccgtccatgcccataaatgcaaatagtccaacaaaaaaagaattctcatttccaaaaagattacttaatatttttgaatttgttcaatatttatttaaagatggtcaaattaacaaagtcccatcagactaatggccatagaatttcactctctgctgctcacgaaaagttcattctctcccttttccttcgtcgaagttaattatgcaaattgtacgttcgccatattcactcgcatttgattttgttcgttatttcgttctttacccccccccctcagtcctcaactaaaagcaaataaaaaaccaaaaaattcaatttgaaaggcccgagattaaattataaaagagaatatgcaggagaaatgagagagggaataatgttgcggagagaagggaaattgaattaagagaaaggagaacagacagtgaatgagagtgacacagaaaccaatgaaaaaacaaaagcccagaattattaactaattgcctaaaattaggaattaaacggccaattgtagcaaaaattgagcttcatctgtatttatgcttcaggtcaaagaaatttcactcattgtcagccaagagtacaccccaaaatgtcgccgcaacaaaaaaaacctaaaattatttgatacttttccgttatgcccccccccccataagaatgtcatgatcccgacaagggaaaccacttttctggggtacttttaggcactgatcaagaatctggcgtcaaaaatgcaaaaatctatgggtttatctattaatttcatcatatgattttgtcaatgatttttaaaaaaggaataacatggcatatccttaccaaatcgattcctctcctcgagagggatctattgatactgtttttagagttctacgatgtctctat

SEQ ID NO: 1195 - DNA, 1838 bp, Heterodera glycines
  misc_feature (1775)..(1775): n is a, c, g, or t
aatgggagaatgaatgatttaatatggccaaaagaaagtatttaaagagaaaatgtgcgcacaattatgccgaagttagctaatgaaatgtgggaacaaatttaatgggaggagcgagaaaataattgttattatgctgttgttccaaatataaactaattatgggaaaatgcaaatgttagcaatgcctattttaaacggcaagttaataggcattgaaaatagaatgcacattcgcatatcacatgcaatgaaaatgaatgctttttttgctgtttgcgcaagagcatgacatttacccaaatgccaattcccaccccaaaaatggcattccgtttgatactctttccttacgttttaccatcacgagaaaagcaaaaaaaaaaaaactttctcttcacaaaacagtgctattcttggcatggcattaccccgtataatgagagaattgagttgcagctttggcacccgccggccaacacttggaccaactccgactcgctgatgctgacacaacgcttccgtcttcgtcgacccgcgctgtcgtttgtgccggagcgagagcgcattgtggccatcattgccagcgtgtcgtcgccctgcaagtcgggcagctcaagaacgctctcgaatagcgtctgttcctggatgggcccaagtggactggaagcggtactttttccgttgttactgttgccggtggtagtgccagaagcggatgccgacgagtgatggcagtgccgctttttgactgcctcgtccgtcactgaaaaatatgctctcagtgaagacgaccgttcgtttttaggctaataaagaggggaccagttggaagaaggggacaaatgatccacagaagctgagaggaaaagcatggtaatggacgaggaggggggggggggagggcatatgggcacatttgttaatccttcagcgcatttgtggacgaatgggagggtcccgtcagctgacattaccattgccgtcctcactctcctcgtccctcaatcaattaggccaacactgttaaaactcacttaatctccggatgctcgggtcttgtcttgacagtcgtaggccggcgttaatcaatggcaccaagtccgattgggcacgtgttttcaaaaattgcttttgtctcccgttaattagtggcggtggcactcgtctgctgcccatcgcggcgggtgacgtcattttcttctgtgaattcttcagttggggtgaatttagacgaattgttgctgaatgattctgttgcgatgccattatcactgaacgactgccgacgatgccataattttagtgccgaagaataaattggatgtgcaaaatcaatttctaagagttgaagtagtccctttggcacttaaattctcgtcctttcagctttgggaagtgacgatatatttgtgtgaaaatattggggaaaaaacattcaaaacaccagagaatccttcctctctatgtcacttaaaaatattaaaaatggccgtaagggaaagaatgcgcaaaaggaatgaattaataggtgaaattaatacgcaaaaaaagtgctctttcgttcggataattaacgacattaaatccattaggaaaaaaaattcaaatcgctttaattctataacaagcggaaatccggttttataggaaattttatccgattgatgccaaagaggatgaaaccaagccaataaccagggtaggaggaaaatccctttacaaaatgaaatttaaaaatgtgtaatttttaaaatttgacttaagtccctcanaaattgcttatttagggccataaaataatttctgtcccaatttttattcgagtttcagagaat

SEQ ID NO: 1196 - DNA, 8010 bp, Heterodera glycines
  misc_feature (7931)..(7931): n is a, c, g, or t
  misc_feature (8003)..(8003): n is a, c, g, or t
actagagtccggcgggatcgggactcccgcgggattttacgggagtcccgctcccgactcccgctttttcggtgaacgggatttttaacgggagcgggatttttacgggattcccgttcgggactcccgtcccggaaaattttgaactcccgatcccgctcccggaaatttttacccaaaaacgggagtaaaaatgcactggtaagaattgattttttttggtaaaaataatgatttttcattgaaaatctgttaaatatatagccaaaatttcaaaaaaatttcccggcggcgcctatcggcaccgccggatccttaaaatccttaattttcttaaaaaacttgctcaatttgcaaaaattggtcatttttgaacagaatctaacaatgtattgtattaaaattttcaatttttttcccggcggcgcctaccggcaccgccggcctccctcctcctccttggtcaccaaaaagttttttcaagaaatacaccgcaaaaaattttgtaaaattaataaagggagtcaaaaatataaagttaataaatgttttgttcgaattaattataaaaaataatttatttaagcaatttgaaaaaattttctgatttttgactcaaaaataagatttttttatttcaaatttctcctttataaatttttctatatatttttaatttaataaattgattgtcctttaaatttgtgcattacaaatatttttgtgagtttttaattaaattttcgaattactcccgcccgggactcccgttaaaaatggacgggattttaacgggaatcccgttcgtgactcccgtcccggaaaattttgaactcccgatcccgctcccggaaatttttttttaccggactctattttggagcaattaaaatctatacagaaattagtgattcacagtgccgagttgtgtcgtgaggaacgaaaattgtttagaaaattttatggaaaggacaaaaaaaatttccaaattactaatgatatcatttatttataatttcattgactgaacatttttaaatttatgtgcatttgcaggtgcaactcgtttttgagaaggccattgaacagttacaagactccgaacgcaaattcaagttttaaaaatttttacaatttcaataaaaattattaattccaggcatatcaatttcgaagatatcttcaaaatttaccacaccagattccagttgacatacaagtaggaaataagcttttgtcattaatatcaaatcagatattacattgtgattgaatcagttcttttgtaaaatttatgtgggctaattagtcttccgccagattagggatcattttgatcaaaaagggttactcattaaaaaataataattagaaagaaatgacgcaatataactttaggactattatttgataggttggttatataagggtttgaatatcatattagttgtagtttaagattaatttgcgacatcaataaggaaaagatcaattcaatttaatgaaatgaattgaattaattaaaatcagagttagttttaatccctgatcactgataagtacagtaattacttcatttcgtccatcacaacagattcggtaaaatggtagtgactcttatgattggaatgaaaaatggcgttgaaaaactgttcaagcagcgtccactcacaattgaccagttggacgagcagtacattgacaaaggtggcacaaatttaaacaattttttttttcatttttcccaatggccaaattaaattttatggcaaaatttgctcatcttttcaatttgaatttttaattttcagaagttttggtacaaaattggaagcccaatgttgtgtatttggtgcaatttccgcacaccgattcggccccaagtttatccccggcggcgatccaattggagacatggctacggatcaaagaaatcccattttatgtgggttttaattggggaaattgaaaaacattttaaaataaacttaaaagtttaaacactcatatacttttaccactcatttttattcaacattttagaaaataaaaatccaaaaaacaattttctttaaaaatttttagcgattatctttggtagaaccaaacgaaattgcaaaaatgaagtctggttgatgcctaatgtattccctattttcttgttttttaattatttctcaaaagttgaaaaatttaacggtgctatgtcaaccgacaaaaagtgcaaatttgggcgacagacgaaagtgcaaaatttgctaaatttttgactaaatcgactcataacttttctaaaacgcaaccaaattgcacaatcttggtatcatacgatatcccttgaattgcattattagcatgctaaatttcaaaaaattttattaagtttttcaaaaattcaagccaaaaaattggaaaaattgtcataacttcaaaggctatcgtatgataccaagattgtgcaatttggttgcgtctgagaaaagtcatgagttgatttagtcaaaatttagcacttttcctcggtcgaccaaccacgaaatttaactatttattggggattggattttcgtttaatttttattattttttgctttagactgtcagtgatggtgttctgtttcgcgctctttttgccgatgacaaagtgccatttgttgaatacaatgggcagaaaatattcggcacatccgaagagataattgacactttgaagcaggaagctttatccaagggcacacttagcgaattattagggttgggacaaaaaagtgatgaaaatgagcaggaaatgcgcaatttaattgacaatgttctatacaggtgatattgagaaaaactttttatttaaaaatattaaataaaattattttgcttaatacagtatccattttcatacaacatccgttttatcagttgcacttaatatagtctccttgttcatacagtatcctacagcatccgtgttgtcggttcaccttaatacagtttccttataaagtatccctcttcatacaacatccttgttatttgtctttatacaacattcatcttatcagttcccattaatacagtttccttcttaatacagtatcttgctgcatgatcgttttcaaaatttggcaagttccgaggccgaaactcatttggccaaaaacattgattttcaacgcattgtgctgccatcagtgctcaaggaggcgaagcgcaattggttcaaaattcagccgttgccaaaaccattttgggatgaatattttgccaagggaaaaactgtagcatatggtagcaaatcatggaacggttacggtattagtgagaaagaatggaaaaaatttgtggacaaattgagcacggaacacattccgaaagcaatgaccaaatttgtgaagcatttgaaaaaacaggtgggcactggaattgggtgggacattttggcattttgtcactgtcattgtgcctagctgatttaaaaaagggatttcttcgagagaataatctttacatccgcctgatttatttttccatttaagcttcttcgccagctctcggaacgaccttctctcaaattttcggatgtgggttttttatacctacaattaatatgatttagataccgaaatttaaattttccattactgtacggtactgtaatcgataaaaactatgagaaaaagatagataaattcaacgataaattgaagaagctttttgacgaaacaatgcaacaaattgagcaacagttgaccaaaatgagtgcaaaaggaaaaaaaacgaaattttacctttttggcgaaacgccgtcagcggtaagaaaaagttgaaaaaatgttgcctattaatttgggtgataggtcgtttcgtaagattcgccattagccaagctttttctctttttctctattagcctgcaaaattttaaaatatggtcaactttagaaaaagttgaatgaaaataatactgtttctgccacaacttatattaaatttgataattttgtttgaaattttgcaggcttatagagaaaaagcctttgctatcgaatgatgccaagaatgtaaaatttggttgcctttaagcaaagttatgccatgttatgtcgaaaaattcgctaaaatggctgattttacgaaacgacccagcacgattaatttggaaaaatattaattttaatttaaactggaattttttaaaaatcattttcacgaaaaatttttttattcatatttatttgttttaaaattaagctaaagtcaggaacatttatttttgcaaattaagtataaaaaatattttttgaaaaaagtctcgactcaagaaaagcctcatttttgggtctcattctcgactctaaaggtcaagtctcggtctcaagaagttttgactctcgaacaaaactgaaaatcagcctttattaaaaatggagagatggaaattctatgccaataatatttttgttgctaaaaagttttattatttttatgtgcttgtttagttggactccgttctcttcggcattctttcccaatttaccaacaccaacacaatttacaatggacattatgccaattctatttcggcaaaactcaatagaaatccgaatgatccgttgaaaatttattttggccatatgaaagacatttttatgggccaaaataacaccgaacaaaatcagtggcaaattaatgcggattggaaatttgagaagaaagcgaataaatataacggtaaaatgggagagaaattataaaataaaataaaataaaatattcatttacaataaatagatgattttatatatatatttaattaacgttcgaattagaacttctttaaaatttcgaatttaaaattaaattaaattatatttactttaacccaacaattttttactttatttttaattttaggccctttcattttgcgttttgatgtgcttaagctcgattatgaacaaagaaagcggttcaccaatgatgaacgtaaaacattttcgccactgtttaacaatggaaatgccgaaaattctgatgaaatctccggcactttgttttcggaacgaaagtttttggcggtttacccaaaggtggggaaattgaagggcattttgaatttgggattaggttagatcagcagaaattgcatttgacattaatgatcgggttgatcagcagaacataacataggtaatacatattgaaatcgaaaaatgtatccaataaagaccaaattttcaaagtcacaaaaaaattttgccaaaatttacctttaaattaaatttattaaaatatttcttactataaatttgaatccattttgttaaatttaaaggtcgtcactttcattgtgcaccaattgctcagcttgttcaatttggaacgatttgccattgaaatggcggaggtttcttttttaggttttttaaatttggcattttgttttgttttttcagttacccactgttgttgaaattcgatcattggcggattacattgaatttattccatcagattcaaaacagaaattattgcaaaaattagaagaaaaaattggaaaaattgggactttatcagaaaaaaaagtaaaaatctaaaaataaaataaaataaaaaatatttttatttcattaattatttgatcaaaggcattaattattttcttttttaaaactatataaattgttttttacattaattttcatttgagcgtatgaaattgggccgtgctttgattcatttgatggcctcatatttatgcgaaggaaaaattgggcaaaatgattgtgaaactgaacatgatgaaaaagcgaaaaaataccttggaagaatttgcaaaatttcgtaaaattaaattaaaaaaattattaaaatatttatttttatttccagtgaaaaatactttgctgaattgtctgtgatcgtccgaagcttagtttaccaaatgatgtacacaataaatgtggaatatcagaccaaagaatccgtaaaaaaatatttttatttttagtcaaattaaatttgattttacctttaaaaataatacaaataattgattaagctcaaaatgtttggtgccgcattgcttgactttgatggtaagaaaagaaaattcgctattttacatttattcaaaatccaataaaatataattcaaaaaaattaattcaaattgaaaaaaacgaaaaatatttttaaaaacaatttctcttttattaattaattatatggaatttttagaggaacaaaccattaaatacgaggccaaacggttgcgcaacgccataaggcatttggagaaatttgagagtgaaaaaattgaatacttacgaacgaaggtccaacaacttggcattttgatgcagaaaagtcagcaaacagattcgaaagatcctcaaacaatcgcagatggacaaaagtcaaacgaagaaattaaggtaattaagaaattacgatagttatatcggaatttaaaagtgcaaatttgaattttgatcaatttgctttttgaaactcggttcagagctattagactgatggctttaagctttatccattttgtattcttttttgtgaattaaacttcgaatattgaatatttcttatagaaattgcaaaaagaattgagcgtttgggtgttgcgcagtttcattgtgtccgaaatgcgtgccttggtcgatgcgcttgacgacgatgataaatttagccgggaaaaagttacgttcaatgacattgagccgtcacggaaccattggctcaatttgaatgtactggtagaaaagtgcgagaaagaggacagaacgtgcaaaatgaacagggagcagatgaagcaaggctttcaaatgatcactgaacgcaaaaagaagcacatattcaaggtggacaaatggggcgaaagtgatcaaaactaaacaatagaggttgggaaatcggggtagagggattaaaagtgatcattggaggtggggaagtggaaagaaaagagattagtgtgaaatgaaattgaagtttcaactgggtataattaccacgttgggtcaccctggaaggccgaaccgatgccattcgtctaattggtatcatgtcactgatgagtgaaaaattgaccataaccaaatcaataatcaagccccgatcgggaattgactaagtgattctcggaataaaagtaacaattaattttttaggaactttgggccaaaacggtggaccaggcagagagcgtttttactgtacaaaaataccacgaagttctctcctatcggttgggccaactgcgcaagttgtacgagttgcgcaagtcgcagttgccacgtgacgaggcggtgaacatcaaaaaggtggaggcatatttggaaaatattcaataaataaatactatttatttatttttaaacttaaagattgacgagcagtacgtcaaagtgaaggcggagctgttccagcgactgggcgattccgaagtgaccacgacggaggacaacgacgagggggcggaagtggtcgaagtgctggcagaagtcacattcacatcaagtgatcagaacgataataattattattaaaatgaattaatattgattaacacaaaaataaaattgattagatcgcaaaaaatatgtataattatatagttttattttattaaaaacattattttattattattttagaaaaacaaaatataacagcagacgcagaaagaattcgaaaagcaattaaaaaaatgtttgtttttgttaatggacaatccgaagaactcaaaaagatgtccagtgaacagcttaaaaaagtaaaaatgcaaaaaagaaaataaattaaaaatttaaataaaattacgaattaaaattttaggatgaaatgcgaagtgaaattgacgcggttgtccattagcattctcataatttatttgtaaaaaagcctaacaaaaaccccanattaattctaataaattcgtctaatattttaatattaagtggtacccttccccatgaattgtttctttcaanatttatt

SEQ ID NO: 1197 - DNA, 3984 bp, Heterodera glycines
atgaaatgcgaagtgaaattgacgcggttgtccataccattcttttactgactgaaatgaaaaatttgattgatttattggacagaaaagaatttcgaagagaacacttatccatttgcagctttccgtcaatcatatttcaggtggataaatcataaaaaaggaaaaattgaaacttaaaaagggagaaatttgtctaagcttttcttgaaatttttaaattttcaattaaaactacctaaaaatgtttacttttacaacgcaaattcttttatatttgcctcattaaaaatttctttccttcattctgataatttgaatttataaaaatatatgttttttaaatttcagtggcgaactgttcattttattgcgtgccaaagtggaggaggacggcacaaactttgatgaggaagaaatcgccaaagggttcaaatatgtgaagggccacaattcaatgcaccgtgcccacaaattgcgggcttttctgttcgattgggccggcaaagtggcgaaggagaagaaatttgtcaaagtgagtcagttttggcaatcagtgacataatgccaaattttctttttttcaatttttaaatgttaagaagctcgcctggcgcatgggccaactgtccaagctgtacatgttgcggaaagagaaaattgatgaaaaggacatcaagtcgtgggcaagcaaacaagaagagttgagtggggagatggagaaacgatggacggaattgaagaccataatggaaaaaatggtaaaaaaataaataaaattatttacaaaaatttaatacattttcctaaaatatttcaaataattggtgttttctcagtcggcgcatcgacctcccccctagcattctcataatttatttgtaaaaaagcctaacaaaaaccccaattaattctaataaattcgtctaatattttaatattaagtggtacccttcccatgaattgtttctttcaaatttattatttaaactggcaaatttttttttaaatattcaaaaaaattaaggccgataaaatcatcgaaaatgccactggaaaaacagacaaagccccgctcgcagccgccaatgtttatgccgaggatggaaagcccggaacaatgccattggaggagattcaaatcgaagacaaacgcgaactttgagaatgggggcacttgttaccatttgaaatggtagtttttattctttttgggattttttattttctgagcagatactgtgaaatatgtacaaaaaacaacaaattttggacttttttgcgttcgtttcgaatttagggatttgaaaataaatcccgttatttattcatccatttatgtaaacacgccgtttttggcattggttgtattttccatataccgaattttttcgattattagtcccccctaaattataaaaccctttttgagggaagttgaacaatagaagacctgctgggtctaataattagggagtccaattctatggaaaacgagttatcataccatattcagccattttagatgtattttactagaatttaatgaatttgaagaaatttttgcaaatttacccctcaattcggaaaatttatgtccatatatttgccattttatgtccatattttgcgatttttggtccatattttatggccatatttcgcgactttatatccatatttttggactccctactaataatagaagaaatacggtataccatatttttctatacacatatttcttttaacgcttttattgacttttgcccttttatttattttatttttatttttttgatggtatgcataaacttttatggcaattagtttctgttgtatatgaaatataaggaaaaaagtttattctcctaaaatattaacatttaattaaaaattataataatctcatttggaaactaacactttaatccaaattaattattccgtcattaaaaaaattattctcaataaagccaataagtgggttgggttatgtgagacagaatcctacttgtggtgaatgcagccgttttgggtggaagcgaatgcgcggcctttagcaatcttggccggcacttcacgcccccatcacaagtttgctactgacagttcctactttgaaaaaaataaaaacccattagcacggtgcagggtcgctacttaaaaaccatcataatgggcgttatttaaaaaaccatcataatgggcgttacttaaaaagccatcattatgaaaatttttgtcgaaaaattatttataactttgctcgaaagcaaccaaatttttaattcttgatatctttgatagccctaagtgttctctatcagtctgcaaattttcaaaaaatttcgttaagtttcaaaaaagttatagctcgaggaactcaaaaaaccttgattttcgaacatttttggccataactttttttaaacttaataaaattttttgaaattttacagactcataaagaacatttagatctatcgaatgatagcaaggattaaaaatttggtctttttagagcaaagttataagcaaaaattttcattatgatggtttttaagtaatgacatagcaccattagcactcggctggctcagaaggcaaacgtccccgctaaaagttggcgataagaagtaaagttggaaagaataaagaatcgttcactaataaattatcgattaaatcaagctgaaaatttgaccaatatttattaagggaattgtcgagactgagttttattttccgatttttaaactgctaatttggatagttcatttgctgatttttagttcacttgttgattttaaatgattttctgcctatatttggaattagttacttttttaataaaatattaaattttcactttatcacttgttcaattcaaataatatacaaataattaacgttacttgcgccaccactaaatgtttttaagtatatcaaaaaagataaaattttaaatgaaaagcgaaaaaataaatataatattaaaaataaataaataataacgactgagaaaataatatgcaaaaaattgaaatttaaataaaaataaatataaggcaaagaaataaattatagaaatgtggtaccccgtgtcttggaccgatcctcaactggcttcattatgcattaccaccatgtctgagctgggttgcgcataagggatttctatggcgtgaaccccaaacacgccactcctcgagggggtgccaagtcgttatataaaagccatcaaaaagggcgttatataaaaaaccatcaaatgaaaatttctaacagaaaactgcccataacttttgtcaaagtcaaccaaattataaattcttggtatcattcgatagccctaacatttctctacaagctcatctaaatttcaaaaattttttcaagtttgagcaaagttatggccaaaagtacccaaggaacctggttttcaaacatttttggccataacttttttgaatcctaatgaaattttttaaaattttgcaggctaatagagaaaacatagggctgcgaatgttatcaatatcactttattttgttcgttctaagaatgttttgatcaaaatttttgatcatcaaaattattttatgctaaataaaaaatttacgttataaattgtttatattttttggtttcttgatttcattttatagccctcattgttctctaatagcttacctaagtttcaaaaaatttcgtcaagtttcaaaaaagttataccaaaaatgtctgaaaaactggttccttaactacttttggcaataactttgctcaaacttggtaaaatttttgaaaatttaggtgagctaatagagaaatgttagggctatcgaataatactaagaatgtttaatttggttgacttagacaaaagttatggacagttttctgttggaaattttcatttgatggttttttatataacgccctttttgatggcttttatataacgactcgggaccccc

SEQ ID NO: 1198 - DNA, 1184 bp, Heterodera glycines
tttgacgagatcagattggagagggtgggctgagaattacgcgaaaggcgagaaaaaggagtgaacaataaatcgattaacggaatcttttttctaccttttccataatggcttctgaaaaattattcttaaattttcatagaagttaagaaaccgggccaaaatttcaaaaaaaaatttccccggcggcttctaccggcaccgccggcgcctaaaagttccatttcattcttaaattgagtcaaaaaccaggaaaagctctaagtatttataaaaatttttatttctaaatactttctgacgaaaaaactcaatatatttattttattgaaaggggttgatctctcgccgttcctctcaagatttaaattagatatttaaaagaaatttgatggtgcatatatttttaggtaaatttttttttgaaaacttcggcttaggcttcgaaaaaattgggcttagccttcgggttcgagtgaaagccgagcttcgcccaaaaatgtgctcatcacttcttatgtgtgtctaaaccatacatgtatgttaattcattatgaatttcaactgggacccgagtgtcatggaacagttcgtacaacagagtttcatacaaaaaaatttttaagaattttcaattaaagaatttttttcttaaaaaaaggaattattttcaaaagaaaaactaactcttaaaatttttcaaaacaaaattggaaagtaatttgaaaattagcagaaaaactagcaaaaattatttaatgttttcttaatgtctctctagatttgaaaattcattttgactttttttgtaaagaaactccattgtacaactgccattgccattatatgctattgcttgggaccggagacgcaaccggaatttttcctataaaattttttcagttttaacttttaaattggtaaatttttgagtaataactagggctaatatttatagttttttcactattttttttcctgagctctccgtggcctaaaacttacgaaaaacaagtttttttttcggttcttgttatcctacttttcgagttattagcaactattttctagttttttatttttaggaactaaaaaactataaaatttttgaaaaaaaactattttcaactatttttactagtaaagaaaaatttgttatgaaaaatgcaataaaaagcgaaaaa

SEQ ID NO: 1199 - DNA, 1338 bp, Heterodera glycines
cagaagccgcaggcggacggcccgggggacagtcagagcgatttcaatttcaatgctttcttgggcaagccggacgagttcagcaaggaagtgactgaaggaggcgctcttttcgatttcaacttttgagtttttcctttcatttggttttggttgtgctgtagctgttatttttattttaatctgcttatcattatattttggccatttttgctttgtttagcattgttttgttctggtcagttcatttgtgtaagtaactgtgtttctgtttatttccaataaaatcatttattcatttttacttctttttttcgtttattcgttcgttttcaatcaactaattacctaattattttttcagtttatcatttgttctgataatttctgttttcctcctctttaccccaaaagctatgcttgccacgcgtcccttccgtttcgatcggcccgcgcctcagccgcagcgagtccatccgttgtcactgattcaaatggtcactgctgcgaaaatcgttgacgaacagcagcgggccaaagaacgaacgcagacgccactgtgagttgagagtgacgcgaactgttcaattttggttggaaatgaccaattgctttgttacgatatccaaattgggtggaaattcttttggttacgttttgccattggtctcaaaaagatttgtttgtgcttttcttcgttcaattccccttcctttctcatcagagtttatcggatggatccgcaattgctcatccgagaggccaccttcaacaaaatcgcacagaaacaagcggcggccaaatatttggcgaccaaaaagcgtcgggagaaggacgagcagagaatgcgcgagttcgtccgccgggcggtgacgccgcccgactttggccaaatggacgccgacgcaatggtcaaactgtcggattttatgcctgtactgaatttggaattctttttgagtgccatttccgaatgcttttttcatttgtttaggccgtgccggcccaatttgaccgctcttttcgctacgaaacgctcactgttccggtcaaaattgcctcggacggagtgtattcatcggacgacattctcatcatcggtgctcaggtgtgagagcgaatttcgatttggaaaactaattggaaattatgcgggagtatttggcttttctaatacgctttttgaagatggaactcgcgaacaaaacaatgacggcaaagtgacggactgctgaaggaaggacagaaatttaaatgactgactgacggacgcaaatttgccttaatttgttcattttttatttttcattgactcatttactcgatctgctgtggaca

SEQ ID NO: 1200 - DNA, 6732 bp, Heterodera glycines
  misc_feature (91)..(91): n is a, c, g, or t
  misc_feature (6597)..(6597): n is a, c, g, or t
  misc_feature (6599)..(6599): n is a, c, g, or t
  misc_feature (6672)..(6672): n is a, c, g, or t
atcctcagtttctttggcctaactttttgcttacttggccaattcctatattcatggtatcaaacgaaagcttaaggtctatagaagcttnttgtataatctcttattttttgctaaaagcaatagccaaaaaattattctcgaaaaaattgaatttcgtgatttctcattgtaatttcttttttaatgccagtatttgctctttttttgcatttataaaagcccgagacttttagctctcatttgataccaagaatatgtttattgaaaaagtaagaaaaaagtttatggcctaagaaactggggatggctattcatgggacgcataatatgacatgggacgcataaaaccgactagaaccaataaaaattcaaattctttcaaatgtctttttcaaaatcaggcatagcaaagttaataatttgtcatgattagagaccgcattttgaggcaaatgccttttttttctgcgcactactttcgatatattaagcataaataacgcattttccacttggtttgaggcttctacgttgacttttattatgccttttttttgcctttttcgggattttcgtgctttaaatgccttttttggcattttgccgttttcatgccttttttagcgttttttccgaaaaattccataaaaaatgcaataaaatcgggaaaatacacccctaagaaatgacttggaataattttagaaaatacacccctaagaattgaaaaaatttcagaaaatacacccctaagaattaaaaattttcttaaaaattgatcgccaaaattttatcttttttctttaaaaaatttttgatttaaaatttgttcttttggaaaaacattataaaacattaataatctttaaaaatgaccaaaattaagttcttttgttaagttttacgtgtttttgctcactaaaaaccttagaaaaattttttttatgccttttttcatgcctttttcgggattttcgtgccttttcatgcctttttttcaattttttggtgcctattatagtgcctttttcgggatttttgttgcctttttttgcggtctctagtcatgatacattctttgtatgtgtgtggtatatacagcaaaatgaatgaccgtaaaaattacagggaggcatactcaagaaaatgtggaagatcagttttttggacgcagtgtttggtgggggaacgaagtgtttgttgacttgggaatggcagtgctttttttggggggggggagagactcatttcatcacaactgttgctgctgctgttgttgtggtgcttgttgctgctgctgttgctgacagtgactcatcagatgggcgaacaccgcgcgaatggcccacaaaaactgtgtccaatccgccttctcccaccgctgctggcctccgccgctcggcgagaaaatggtgccggcaccggcggctgcggtcagcgtgacggcatcggccgagtcgacgatgaccagcagaaaggcaccacgcccaccgttgacggacagtcggtagatggacagttggatgtcgctgaaacaattggaggcgttgctgcaaatgaaaaaatcttagaatatttcaaaatttcttcttgcgtttttctcatggattttgttgtttgtttttttttgcaaatgattcaacgcttaaaaactgtggtgttctgctttgatagcgtttattcaaatttatttcagccaattttttcatttttgccttgttatttttcttactatcatttgcaacaaaattcagacagaacattttttgtttctaattctatttaattttgatgccaatctacatatttcattattttagacgctttttattgctattatttgttccaattttaatatgaatttcccatcaagaactcgaactcagttggtaagctcttataacgcactctgttattcttaatccaacgttgtcgttaatttgttttaaataaaaatgggaagtaaaataggttaaaatttttatgcagttagcgatggcattcccatcttaactcggcgaaccgccccatctctccagtgaatttgccgttgtccaccctttctcatgggcgttggaattggcatttgtttctgttcccctttttccaacatttccattttccaatgaatccaaaaagaattcccattgaattggtagctgaaactgttgggtttttgaggttgaatcggagatggggtcagtgccgagtttcagcttcatttgatcatttccttctcaaaaaaattggcaaatggttgaagaaatcaaaatctttggttaaaaaattacaatttcttatttaaatgatctgatttcaaggtcacggactgcatcgattactcgaacgaaatcgaaggaattattcgtgctgttcccctaatatggcaacgatttgaagaagcatccaaattctttagaggtctgttttacaaagctcttgcctcatttcgatttgttcacatttcccaattttttcattttagtgatcaacaaatttgtcggctatttcccaccacttcgcgattcatttcctacgccaggcaacgaaacagtaaacattagaaaacactaaattaattaattaaaaattgcttttctttttagttggacgaaattctgcgctgtgctggtgtcggagtcagattgttagttgaggcagagagtgtttcggactattccctctcaaacttacgtggcggtgagtttgacgagattgattctactttatttaaaatacatttaactcgggttgtttggccggattgcagatggtcacgggatttcagcatttactaacgccaatttttgagtttttttgggaacagggaacaaaacgggaaggggtcgacagatccaccgggaaaacaaatttgaaattttttactatttttaacagatttcgccagaaattgtaaatttagaaaaattttggaaaatttcagtaagtgagatattggagggggtggggtaccaatggggaaaaaccatattgctaaattttcggtacaccttaaacttttagcttaatgttaacactttttgttattccagccctgttcgccatttattattcggccgtgtactacatgccaacgactgatgactgattttgctgatggacttattcgtgacgaaaataaaataatttgttgttgcatttctctgttgttctgataaaaatttatttctcagaaggtctttttctgtaaggcatttcatttatgcaattgagaacacatttctcaaattaaccctgtaaagtgtggcatcaaaaatttaggactcctcatcactccgagataaatgtttttttaattttttggaaaaaaggggagattcctaaatagtcagcgatggcattcgcaatttaacgaggcaaaatgcccaatcagacgaatgttggaaaattgtgaacaatgaatttgccgttgttcacccttttttatgaaaaggcaataatgaagacaaaaaagtcaatgagtcggctgaaaacgcctagaaaatgggcataattttgagtgccgatgaaaaatcatttaggtaatcactttttgttttgttttttcgttcgtttattcgtttcccatcctaattacctaattatttttcatatcatttgataatttctgttttcctcctcttttcccaaaagctatgcttgccacgcgtcccttccgtttcgatcggcccgcgcctcagccgcagcgagtccatccgttgtcactgattcaaatggtcactgctgcgaaaatcgttgacgaacagcagcgggccaaagaacgaacgcagacgccactgtgagttgagagtgacgcgaactgttcaattttggttggaaatgaccaattgctttgttacgatgtccaaattggatagttgggtaaattcagttgaaattccatttggttacgctttgccattggtcggtacttgtacaatttacaccccatagaaagaatttttaatttttcaaaagccatgaaaatatgtttccagtggtatttggggtcgctaatcatgaatccggcatccaatcatttaaattatttttagaacaaaaatatgaatttgaaaaatttaaattttctactttttgttcgatttgggttcggatttggtcgaaatggatatcatattcgtgatcagtagcgaccgaacacccctggaaacacgtttttatcattaaaaatataaaaaacttctatgggtgtaaactgtagaagtacccattggttcccaaatgatttgtcctggtgcttaattaagacagaataacttctacgaagtgtcaaggaagcgagtgagattatcagaaagttttaattgtgaatgaattgaaaagtccaaatttatgaattttgaattgaattaatttaataacaaacccaattttagttaaccaaagggagcaattgaagcgcaaaatcattttggcgaagatcgtcaaccaaagtttcagtttttagtgctttttactattacgttttcgtttagagttcactaaaatttggggtcgactcgcattgaacgtgggagagagttggcgaacacggaaatgctgaagcagcatgttgaggacgtcgtgaaggcggagcagtacgcggcttggcacgtcaacaagtaaatgaagcgttgagaaattggcacaatatgaaacactttcagggtaaagttcgagctgaagcgcaaaatggcactgaaggaggaaatccataagatggttggcatgcttcatcaggtgaagcacagcgtaagaatggggagaattggcaccgtttgcttcagaattcactcgaccgcgacattgagaaggccgaaaagtcattcggcaacttttactccgacttggccaatgcgccgtggctgccggagaagcgagagattcagagggagttcaagaagtacgacgacgagttggcgaagttccgtgaacagatcgccgagtacatcaacgccatttctaagatcaaatcggaaggtacgcaatggcattttattgtttaacggacaccaaaattcagcggaattgcatgccaagttgccgttcaaaacattcgtttatacgctcgccaattattcaaagcaatcgggaaaagtttgtcagctgttgaaaaaggaacagaagaaggcaaaacaggtgaaagtcatggattcaaagatgtaatttggaatttttacaatatttagcttcgggaaaagctgtcgtagatgagcgacgaggaaattcgcaattcggggttaacttttgatttgggatcggttcaaattattacgtctttaggaacaggacacggccatagtggaggccgcaattgaatctcatggacaacgcatggagcaagaaagtcggaacgaaaccatcggagagcagcgccgcgaggatgacaagcgaaacgaagcgaacgcaattcagcagccgcaacagttcgacatggacactcaaaatgacattgtcgtggtgggacagcaaaagctgcagcgtattgtggaggtggaggagaacagcccaagtgacgccgaacagatgccgcagcaactgctcatggacagagagagtcagcaacacgtttttgccacgccgctccctcccgtttctgcgccgcgcggctgcgacgacggcgaccagcaggcgctgttcgacttcttcgggggcgaaggcggcgccgatcagagcgccacggaaggctctttcaacttcggctcgttcatgaccactctggcagggcccggcgcgaagaaggggcctcagaagccgcaggcggacggcccgggggacagtcagagcgatttcaatttcaatgctttcttgggcaagccggacgagttcagcaaggaagtgactgaaggaggcgctcttttcgatttcaacttttgagtttttcctttcatttggttttggttgtgctgtagctgttatttttattttaatctgcttatcattatattttggccatttttgctttgtttagcattgttttgttctggtcagttcatttgtgtaagtaactgtgtttctgtttatttccaataaaatcatttattcatttttacttctttttttcgtttattcgttttcaatcaactaattacctaattattttttcagtttatcatttgttctgataatttctgttttcctcctctttaccccaaaagctatgcttgccacgcgtcccttccgtttcgatcggcccgcgcctcagccgcagcgagtccatccgttgtcactgattcaaatggtcactgctgcgaaaatcgttgacgaacagcagcgggccaaagaacgaacgcagacgccactgtgagttgagagtgacgcgaactgttcaattttggttggaaatgaccaattgctttgttacgatatccaaattgggtggaaattcttttggttacgttttgccattggtctcaaaaagatttgtttgtgcttttcttcgttcaattccccttcctttctcatcagagtttatcggatggatccgcaattgctcatccgagaggccaccttcaacaaaatcgcacagaaacaagcggcggccaataatttggaattctttttgagtgccatttccgaatgctttttcatttngnttaggccgtgccggccaatttgaccgctcttttcgctacgaaacgtcaactgttccggtcaaattggctcggnacggagtgtattcatcggacgacattctcatcatcggtgctcaggtgtgagagcgaattt

SEQ ID NO: 1201 - DNA, 2434 bp, Heterodera glycines
gaaataatattaactgtaaattcagtttcaaatcatgctgtatcaaaatctaagaaaaattgtgccatcagcagattctcaaccgttatcctccttcattcatgatttattacgacggaagttattaagctgcactcatcccgaatttccatacaaacaacaaggtgtataatacatcattgtgttctttatttcatttttaaatactttacagatataactgcatattcttcgacattgccaaacgtgctttacgcgggtgttgatccaacagctgacagccttcaccttgggaatctcctcgtgctcaattccctgattagagcttccttttttggttgttctcctattttattaattggagaagcaacagcttccgtcggagatccgagcgggcacaaaagaggtgccagacaaaacatctaatgaattattgataattttaattagacaggaaattgttattacatgaatttatctatgcgaattcaaaggcgttgcaaagacaggtggagaaaataaaggcgaatgtttcatcattgtatggggaagacatttctctcgaaattcgaaataatgcagaatggtataaagaggtgagtttggctcgtgggtctcttaattttcagctttttattagatgcggattttggactttttcgaatcaacaaaaagatttcgcatgagtgacatgctgaagagtgggccgatcaagtctcgtttagacgactgtgaaacattgtcctatgctgaattttcctaccaaactttacaagcaattgactggctaaaactttacgaagaaagaggctgtctttgtcaagtgaatttattatcgaattataatttccataccccaaaaattctcttttgctgttagattggcggaactgatcaatttggaaatatgagagccggttttgagcacatacgagcaaataccgaacgtttatcaattgcgctttgtatgcccctactaactgataaaaatggacgaaaattgggtaaatcttcggaccaaaacggaggcactgccccactctggttggatcagttgaagacctcagcttttgcattttatcaacatcttcgacagctacatggtaaaagcaatgttttaataaaatgcacttttttaagccgtatttcataaaattataacgtttagatgatgctgcggaacattttttggttagcttttctcttcgcaaataaccgaagttgaagatgtacttgaagaacacagaaataatttgggaaaatgggtcgcccaattcatctagcagaggaaatgacagccattgttcatggaaaagctgcgctggaaagagccaagaaatgctctaaaattttattcgatggtgaataccacaaattaaatatttgaattttaatgtctaatgtttaggcgcttcgagttcggaactggaaaatctcaacccggatgaaatcacagaaatgttcggctcggcctcaaccttcgaaattgtatgtggttcgataaagacaatgggtgatctcgccgcaatgacaaaacaggatggaataaatttgatgagagctggtgcactgaagataaacgggacaaaagcgactgacccagaagaaaaaatagatttggaacggatcttaataaatgggagatttacaatagtctgctggggtaggagaaaattttctttaatcaaatggtcttaaaatatgtttgtttacaaataatgtgtgtaacataatgaacgaataaatttgtcattgaaaacgaattataaaatttgtgtggtgttgaatcggttttgccaaaacactgcaatcaaagtgaccacatacatgcctgcagctatccagcattgtttcgccttttcctcgtacttttcttccaccatttgtctaaaagtttttcggtcaaaaatgcatttgcttatttagcttaattgcagcgagtttttatcttaaaaggcatttacctttctagctttgcttcttcctcaaggtgaaggtctggaaacaaagtcacagcgtgcatataaaagaaaacgccaagaaggcctagaaagacgattccccacacggaaataatcatactgaaagaaaaagaataaaaattgtgagaccgctggttttcctcaccaaaaagcagacatctttggtccaaaaagtggacaaatcttcatcgcgagaggaaaggaaagcacgctaaaataaatgttaattagttttcagaaaggataaatggcaactcatacaataagcaattcgtacaataggcaatttacaataacctatccctacatatgtacgagttgctttttgtacgcgttgtcatgacaccgtcaaaaggcaagaattaagaaaacaaataggtacatacatatgataaaaataaaacaaattttgaagaaagtaaattctgaataatttttctgggttttgagga

SEQ ID NO: 1202 - DNA, 2074 bp, Heterodera glycines
  misc_feature (8)..(8): n is a, c, g, or t
  misc_feature (2000)..(2000): n is a, c, g, or t
atcatacntgaaagaaaaagaataaaaattgtgagaccgctgtgttttcctcaccaaaaagcagacatctttcggtccaaaaagtggacaaatcttcatcgcgagaggaaaggaaagcacgctaaaataaatgttaattagttttcagaaaggataaatggcaactcatacaataagcaattcgtacaataggcaatttacaataaccaatttaataaaaaggtctaactctaaggctaaagcttcggcctagccctatccctacatatgtacgagttgctttttgtacgcgttgtcatgacaccgtcaaaaggaaagaattaagaaaacaaataggtacatacatatgataaaaataaaacaaattttgaataaagtaaattctgaataatttttctgggttttgaggaatacaaaatttaatggttggtcttcgattgttggttttctttttttcctactacaacagaacagcagatggaagaaatgaaaagagaaaaaaacgcagagagaaagaaaataaagacattttcttgctgattgggtgacaaaaaacaagcgcctaaaaggcaaaacaaaaaatgggcattaaattagcataattttagaattttgaattttaaagtgcttttttgtccgcagaacgaatgtctgcgttaattccatttataattgttacactgttttgggctgtcattggtgcaggaggcccatttttggtaccaagtggtatgaacagaggtaatatatattttcaatatatttcatcgttttcgaatgttaaaatgaataattatttgtttccgattttgtatcattattttttaagggatcattcaaacgatgatcgtactgaccgcagtctgctgttatatgttttggctgatcgtctaccttcaccagttgaaccctttgataggaccacaactgcccgtgaaaacgatttggtggattcacaacacttggggtatataaatattgtacaattgcctatttctcaacacacatagtcgactcaatcttaattttcatttctcaaaactccgaattaatatcttacaatacatttctatttttagggaatgtgaagaattgatgatcgatgattgcagtgattttccacttttgggtgtagtattagtgaattctctatttctgtgaaaaactggcatgacaaaaagacacatataatttttcaaccttttatttctataaaaattgctttattttttattccattgaattaataattgttttcattatcaataaacccatgtttttttttaaattaattttccaatttggttttatttctttacaattagtccatcaatgagtggcaccgataggttgccaagtatttctgcaaatgaatcattttcgattgattctgatgttgccagacgtttttgtcaggaaaacagagaaattgttcaggtgattattttaacactagtctttgaggattttcttcatccggttgttcctttagatttgtgcgttgttggcgtacaacaaaacatatatcgaattgttggatgaattaattgccaaagctgacgaggccgtaagacataacagagatgcgcaaaaggtggtcaaggataagctgcttcgtcctgataacaagccgggaaaacgtcgacggagaaaggatttcggactgcactaccgatacccatacttcagagatgccagtggaatggtaccagcacaaaacatggagtctttggagttgtctcgcgtctgttctttcaacccactgacggaagaagaaaaaaagtgtcagttcattaagaagcttattattgtttttgccgggctcaacttattgttacacttaaattaattaattttaaagggacagaaaaagagttgagggggttgcgagaagccgtggcgcagtcgctcaatgaacaacaaataataaaattggatgccaagtgatttaatttttatcaaagtctttttcaaatgtttttgtttgatagaaaggaggntctctatcggaaattgcgaaccgctggagttgagacgacagacgaacaaatgaagaattgccgtggggaagtgg

SEQ ID NO: 1203 - DNA, 3687 bp, Heterodera glycines
  misc_feature (39)..(39): n is a, c, g, or t
  misc_feature (70)..(70): n is a, c, g, or t
  misc_feature (147)..(148): n is a, c, g, or t
aaaactggcatgacaaaaagacaccatataatttttcanccttgtatttctataaaaatgcttttatttnttattcatgaaaattaataattgtttcgatttatcgataaaccccatgttttttttaaattaatttcccaattggtnnttatttctttacaattagtccatcaatgagtggcaccgataggttgccaagtatttctgcaaatgaatcattttcgattgattctgatgttgccagacgtttttgtcaggaaaacagagaaattgttcaggtgattattttaacactagtctttgaggatttttttcatccggttgttcctttagatttgtgcgttgttggcgtacaacaaaacatatatcgaattgttggatgaattaattgccaaagctgacgaggccgtaagacataacagagatgcgcaaaaggtggtcaaggataagctgcttcgtcctgataacaagccgggaaaacgtcgacggagaaaggatttcggactgcactaccgatacccatacttcagagatgccagtggaatggtaccagcacaaaacatggagtctttggagttgtctcgcgtctgttctttcaacccactgacggaagaagaaaaaaagtgtcagttcattaagaagcttattattgtttttgccgggcccgtccgggctcaacttattgttacacttaaattaattaattttaaagggacagaaaaagagttgagggggttgcgagaagccgtggcgcagtcgctcaatgaacaacaaataataaaattggatgccaagtgatttaatttttatcaaagtctttttcaaatgtttttgtttgatagaaaggaggttctctatcggaaattgcgaaccgctggagttgagacgacagacgaacaaatggagaattggcgtggggaagtggagagaataaaaaaccgcacaaattatattcggtaaactttttgataatcaacccaatgctagtaaatgttcagtggtcgtcccgtggatgaggtgattcaggaggccaaaggcgactttagtctcgtcgattgggcaaaaattgcttcttctgtggtaataatttaaagcgaatttcactcgtttgttatgcattacttaaatgtttagtttcaaggaacgcggtccatcatacaactcaggcaaaagtggttctgtgacatgatgttcaaccaagaaccgtggactctcgaggaggaccaagaccttctctcattggcggccgatttttctgattgggattcgattgcgcaacacttaaagacaggacgaagcgctttccgttgtttccagcggcacgcctatttacaggacctattaaaagaaaaaaagtgcacaattatattgtttttaaagtacatttttatttttcttcttacaattaggccatggactcccgaagaagacgacaaattgctctcatacattcgcctcttcaaagttggcgagcaaattccttggacaaaaagtaattttttcatttttttttttgatttaattcgcttttaacaccagtttctatgtacatggagggtcgtccaaaaaaagcgtgtgaatatcgttacgaacgttgtacaagtgaagcgttacgccacggacgatggaccgaagctgaggatatggtattgtctgatggaattcagttgtaacaaaaaaaaacatttagttgctacttcatgccattaacaaatatggtcctcaaaattgggccagaattgcgagttttgtgccgggaagaactctgttgcaatgccgtgaccgatggtgtttcaatgatttattcctcaaaaacatttgtttcaggattcacgtgttggatcacaaacgccgagacttgccttggggatgggaggagcaccagcgtctcctttacggcgttgagctatttggtcgcagtgaatgtgccaaaatttcaaaattgttgcctggtcgaaacaatatggatgttcggatgcgaattcggttgcttgtcaaatacaaaattgaagtaaatcacaatcaaaaaacatccagtacggttaatttttaaggaaacaatgaaccccaaaaaggacgtcgtctttcgtcattttgccaaaaattacttgtgttgtaaatcacgtcgaacatccgtcgttgacaaattccaacgctatctcgagactgaacagcaaagccaaaaaaatcagctgctctctcgactgggacttggtacttatatggtggattttgcagattatagtaagttgataagacttacaagcagaagcattatacttattttccggatagtttaactatgagttataaccacggtttattttatggaaatttgtattttcttctttaatcgtgtttaagcaaattaaaatttggttaaagaaaatgacaaaattcaatctattttaaaaaaataatacatttgacttaaatataaaaaggattctttcagttagcgccttaaaaatgccttttccccgaaataacagattttgacgctgatgcattaagcatacaataccgatatttagttcagtttggaaaacgagaataccaaaaattgcgatttctcaattttagccacggttaagaattaaccgcaagttagggaatgaggcctcagctgttttatttatgcacccaatttagcggacgtgaaaaaggaacgtgctgagaaatttggtcaatggactgtgaaggggtcaggaagatgggttcgagcgttgatgaaaaatccaaacgaatataacagtgaagatctgatggaagagttggacaaactgcccgaagaaaaacgggaagaggtaaaatgagggacaaacaaccattcccgtattacataatggcattatcaggctatcgaatggcttcacaaatcggatgaacgattagagcaagaaagacaaatggaagagacaataccggaagacccagtggaagcgaaagatttttacgagcgaatgtatcccaaagaacgactcaaagaactttcggaatttgttggaaaattactgaaaccgacacaaaagtatggttgtaaatgaacaaaaaatttaaaatatacgtgaactttgttaagtgatattgcctactttgagcggcacagagttcgaccaggacacatgaaattgaggaaggtaaaaggcacacaaaagaggaagggccagaagcggagaagcggagaaagaacgagaggttggcgaggaagctcaatggagaagacatcgaggaaagcgacgtcatcggaatgcgatggtccgatcggatgatcgctgaaatcaacaaaagtctcgaggaccttccgcaggtgttggtttatccaataattccaatacaaactcacaatcagctgatttccatttaggaaaaacgtcgtgaatttgtggtccgcagtctttgcaacgcggtccgacagcgcgtccatcaaacgaatgtcactctgctgaagtccaagcctgactacagagacaaagtaaagacactggtacacgattacattgaacaggtggtcaatttaagtcgtttttctgtgattttacaagatttaattcaggtggttaacgatccaatagtgccaaagccaataaacccaaaagtaaacaacgaaaaagttgttatgttgccgcaaaattgccacaatctgaccctgaaggagatgatgaagttgaaactcccaccgaatat

SEQ ID NO: 1204 - DNA, 3259 bp, Heterodera glycines
  misc_feature (39)..(39): n is a, c, g, or t
agagatttgctaaaatacaatagtatgggatacgcaaanagtcaacagatctgtgtgaagtcaaaagctcatgaggttcttctttggtattcctaccgaacaatgacactattttttgtggctgctgacaaagtgttgatgagcaccttgtcacagtcgggcgacacgcgaattgttaccgaatcgtcgtgccgcggtgcgcgaattcgtttaattgccgaagggatggcatagccaagcagaagagggccgggcgtaaaacaggcgacagaaattggcaaaagcttaagagagtagcaaaaagtgaaccaaacaatgtaattaaatggaaccattttaccgaagcaaggtccgagtcggcgccaggaaaagacaacttaattttgaataaaaattataaatgagacaatcgtttacttttagcagcataattgcgatcccagtattttgaacgccagtttcaatagcctaaataaatcgttttaaaatggttaaagcatgcgcttgaatgtttttacaatagcagtgacatcagcaggcgcctgtgccaaaattattgaagagaaacagccgaacatgaagccgcaccatggcaaaagcaggccactgacaaatttttatatttaagtgcaattaaattaaattaaaaaactaacgctaaaagaacggtccaagtaatttgagcaaaaagccataaattaatggagatgccaaagataatgatgaacacaagaacgaaaatgatgaaaggtctcatcagcttaattacaaaaaatttaatgttttgatagatggtccttcttacttttttagcttttgtggccattcctggtttgtatttggcgattgtcagaccaatgagaagaggaatgaccaacatgagcaaagaggccactattttggcatatggaataaacacggaacgtctttcggagggagtcgcaaagtcggtagacaggtaaattgacttgagaattcgacttccgagcacatttatccaaaagggcatggcaactaaatgggagagataagacgataaaaagggcaattcgaaaggggaaccaaatgacgaacctaacgctccaattgtgcttagaaatgtcattgtcacggacaggttggcgtttccattgagtaggacagtccaataattactggcacctcccccgggggaacagccagtgacaaacagaccgagtgccagcaaatgggttctacggttatcatcggagaacagaaacagggcgatggtgtagcccaactaaagttacaagacactcaaattaaaataggaacaaattcttgacaaattcgaaaggctaaccaatggcataatgataaactgagtgaagaagccaattgctggagccaccggtctttttaccgatgttaaaacaacattgaggtcaagctaaacgaattgcgacttgatttttatattaattgataaatgtgattttacaatatgggacatacttcacatcccatgagaacatttgcaattgttatcaagcacaccaaacaagtgacaaaaatgcggtcgaggaattctctgttagggacttggatattcaaagtcgaggaataaattgaagtttcattgtagaaaaacgaagaattaagtgaaatgttactttccattcgctaaaaaaaattatgagaaaaatagtcagtaaatttttcttcggtttgcgctagttaaagcgtgacttcttcccattagtctgattcttttaagaaagtcggcaaattaactgaagaaaatgttgtcacgccaaccacctcaataaacgcaaaataattaggtatgtaagaataataaaataataatgtactgtggtgagaaattattacattattaaattattctcataaaaataattaacgttgtgcttccacaattcagttgaacaaacgaatgaaaagaatgggaataataggaattagaagagagaattggtggaacagaagcagaacccctgaggggtttgaattgaaaagggaaaagaatgaaagagaaaagaaatgcgaaaggaatgaaagggaaggaagagagcccattactgacacttccattccactttaaacatttgcttaattctttcacccgtcaaaactaacaaatcaaacaaaaagcattaaaattaaaacacaacacaaattcatattaaattaacctagtaactacctaaataaatcttgtgtttatcaaacaaaattgtatttcttacagaatgagttcaattctcttcttccgaatgcgtgaccaatacttaaacttaaacccaaacttcgcgcaacttttagtgagcgtagaaagaatgttggtgaggagaattcgatcactgcacaacaatgaaatggttttgccttgggcgttttctttttttcgccgggattttaataaatggtttgtttttaattaaaaaaaactgaaactatataaaccaattttcagtacttcctgcttctaattccctatttcgtctattaaaatgccatcgttttggtagaaaatgcggcattttatgtgctttcgatgttcaaagatgcgaatgccccgcagaacaatggaagaaattaagacaaagttgtagccgaagcttaaaaggtgggaggagaaattataaaagcgataaaattttagaatttttaaaagtttattcatttctttagggaggcgattaatctgtgcttctcaaaaagtgcgaaaggctgggcgatgttacaaacgcaaaaaacctggggagttttgcaaattctctgaccaatgtattgatgagggaccagtacaatattcctgcataggaaacttatgccaaatccctcctggtaaacctttttagttttgtttattaatttacaaaacatttttagaatgttctccggggcatgtttcaattggagccgaatgccttccatacgcagtcactggtggaatttttaaagttatgttagtagagtaaagccgtgaggtcccactacccagtgcttaatgagggaatttagtccaaggggagccctcttacgcgtccgtaattaggcccctcagggcttggaatggaagggatgatgatggaactctgggggtacctcccaggcgggggattggccgttccactgaatgactcccgactgacccctttggctggttctccattgccttttaagcgccccctcgggatgggaggagccctatcggagagataaaatgtggggggggggaagggtaaaggccatttccggtcccggccttaca

SEQ ID NO: 1205 - DNA, 4328 bp, Heterodera glycines
  misc_feature (3880)..(3880): n is a, c, g, or t
tgcaattacgtgccgcagaagaatggatatttgtgttgtgagcgtcaaattcgtacattttgtcttttcatttttgcactatttttccgcttcgtttaggttcgaccgcgcaatgccccgaccctttgtctatcccccagctgagtcaactgacaaacgaagtggtcgactgcatgaccgagcagtgcgggcccgggttcacttgccaattctcaaacaatgggaagggacggtacatttgctgctcaattccgagccagcaaaagcagaataggaagcaaatatccaaccaaaattgatttctctggtcattttaaataaattaaacgcaaaaataaattcatcattctcaattggaatcttttccagccattcatttctttttattttatcccaatttttagttttatttatttttaaatagcgcataaaaaatgacgacaaattgggagaaacttagaaaggttttaccatgattaaaagttaataaatttatttatttttaaggaattaaacgaaacggaagaaaagggaaaaggaaattcgaagaaaagaaagcgaaaagtgagtgaaaattgtaacaacaaatggaagaaaatgcgagaagaaattgagaagaatgaccagcagaagccggaaaaggcaattgaaacgacaattagcgcaaagaaaattttgatggccatcgattgcgaatatgttggagttggactgaatggagcggagaatatgttggccaggggtaagaaaatggagagaaattacttaattgcaaagcccatgcaaattcagtatcaattgtcgacgccgaaggaatcgctgtctatgacaaatacgtcaaaccggtgggtggccaacaaatttgaacttgacaattcgaaatggaaccgaataattctttcattttggttatttattggaagacaatgttttaagaccgaagaagtggtcgattaccggaccaaagtgagtggcattaggcccggccatttgctccgtggcgttccctttgtccaagtccaaagcgaagtgaggaagctgctctcagacaacattctgatcggacactcacttcgaaacgatttgactgtacgcatcattttctttatttggttgaattttcttttttctaaggttcttggcctcactcatccccccaaacttatcagagacactgccaagtttaaattgctcagagaaacgctcgacgactccacaaaaacgccttcacttaaactgctcgcgcacaatttgctcggtgttcaaattcaacagggcgaacacgactcaattgtggacgcaaaaattgccctgagaatttatttaaaatatcgagagaagtgggagagaacgctaaagaaaggaggcaaaaaatgaacggagagaaagagagagaaagaaagtcagtgaccgattattttgtttttgttgtttgttttgtcaaaattgcgattgcctttcattttcaaagtcagaaaaacactgtaaattataaaattcctaaaaaaaattcaatacaacgagaattataatcggtgaaatatttagagattttaatattttttacttatttcatgtttattttaaattgtaaggctatggaacaaaacataattttgaatttggaaaattcccgtcattttcaaaatccattcctgacaaatatagccgacagctcccgatacgttagtcgtgattggattttgcaaaagttaaatgaattggcgcaacgaattgtaaagcgaagaattccgacgagtgaatacgaagagggtaagacattcgaaatgcgcgcgattctttcccaattcattcccttcgttttcatcagatggtccttacgttggcccctcgggcattgcctatgctttggtcagagtgatgcgacgaattgggcaaaatcagtcaaattttggcgatggcattcggacaattttggcaacccaaaaagactttctaaatcatcaagcgaaggtgaagcggctgtccaaatttagttgaaacagtgaacaatcagatgaaatccgactccggcccgcacaaatgccgttatttgaccggcactttgggctttttaacggtccgaacggtcgtcgattttcacctgtccaacggggcggacatcgcctcgctctcggcacactttcgcaatttgctaccaattgttctccgtccgggttatcagcaaatcggggacgacgaaatgctcaatggccgtgccggctttctcgcctctttgcttgaacttcggtgggtgcggtagggtttcgtcaattcttacatttatggggctttttcagtttactttttggtcaacaattactttccgacgatgaaattcgttctgttttggatgctatggtttcttccggcagaaaatggtttcttccggcagaaaatactccaaaaagcacaaatctccggccaaactgatgttcgaatggtacaacactgaataccttggcgcggcgcacggcgtcagcggaatttaccaaatgatgttaaggtgagtgattggacagacgaagtgtgatcaatcaatcatccgtcatttggggctttattgtatgcattttgcagcttttgggacttgttggatgcttctgcaaagtcggatttgaagcaaagcgtcgattggctgttgagcacccaattttcggatggcaattttccctcgtcgtccgatcgaatcggtgcttttccatttgtgaaatttgacacattcttccattcatattttatacttcaatttcctccgcaattccaaaggattgtctgaggaactcgtccattggtgccacggcgcctccggcgttttgcatttgctcatcgtcgcctctttggtgtttaaggaggacaaatatttggaggtcatcgccatttattgcccttgggaatgccaattttatcaaaattcagtcggctgaacgatgtgtcaatctcatctgggcccgaggaattctgcgaaaaggacccggcatttgtcacggagtggccggtgaattgtgagagaatttagagagagagagaaagagagagaaatcgggcgggtgaataatagcactgaataattattaatttaattaaaaagcaaaggcatttccaatgtttgtgttgtcttttcaggcaatggctacgcttttcttctcctcttccgactcaccaaaaatgacaaattcctgcaaatggcccattggttcgccttcgtaatgatggccccctcttttgaggtgtgtctcttcctttgctgtgcctttctgttcgaatcgctccgtccctttcccttaggcgtccgcccgtgtccccgactgtccgtcgagtcttttcgaaggatgggccggcgccctctgttttctcgccgaccttttggagccaacgacggcgcaatttccgctgcttccgattcccttcaactgaattcgaagggatgaatggatgtccttccagaaaaatgattcttttttgaatgtcttagaaacattttttggcatttcgtttgtctgccatttttctcaccatatgagtgccatcatcataaagcggctttctttgttcattttggcaacattttgtcccttttcccaccatcttcatttgtaataaatgtgtcaaggccgaattctgtcttgtcaacagctgcttaaaagcttcttccatttcctcggtgtctcacttttctatttgcccgttggactgccaaattggtcatccgtcggcggcacttttgctcttcggcacccgcttcttcccccgccccccgggcggtccgtccaccacttttggtgccatttgcctcccttttctgtcggcggtgtccgtcttttatttgtgaggcaataaattttcaatttcttttttttttggacggaaaagccaaccnaataagtgaacatttatttccatttatcagctgctaaaatgctttttcaattccattttttcattttgttcctccatttttctcgcctcttttaattgcaacatttgttttgtgttttttcccttttctctgcgggtcccccccccccgggggcataaaagcgatttgtcttggccaattacgcgtttcccaattccgtttttttcacttttcggccattttgtgtccctttttccgttcctcccaaatccctcacaatggcactgtcttttccccataaaattcatttccttttagatgtttaaatacgccgtgaggatgtaccgccgcgtccctttcttttgctccctccgccggtgtggccaaccctttggtgcgcgaagacaaactgaaaaaagggtacaaaacggaggcggtgagttgggggggggggagagggaaaggggga

SEQ ID NO: 1206 - DNA, 2062 bp, Heterodera glycines
aaaacaccgttgtctgatcgatcattccaacgtgattcatcagaaaggggcggtcaatttggcaaaattggccaatcagtgcgaccatttgctcgtccgccatccgaattcggtgcagcagaattccgttttcgtgtgccttcgcaaatgcctcccaataaatgccgagcattttggcattgccctcttccatttggctgcccaactcttttcgccgttttgcttcgctgatcaggtggcgaaagctggccaccaaaaagaaattgatctatgggaatgcaaatgtgaaatggcagagagtgaaaatgtgccgacccaacgaggcaaaatgccataaaattggttggcagaaagccaaaaggaattcaatgccagccggaggaatcgcttccactcgtgatttgcttcaaaataattgatcgtgcagcgagtgttgcgctcaaaagttcgctggcacacggagttcaacgcttccgtcactttccggacgtacactttttgccacgtgaactttccggtgccgtcgggaggaatcacattcttcgggacagacagttcccgttcaattgaatcgaattttaattgggaattttatgtctaccggtccgtccatcggtgtaagtgtgaaactgaaaaagcgcttggccaaaggggacgaccatttggtgagtcggccatttttgcgcatcaaaaattggccccgttcgtccgtttcggcgttggcaaaatgcacaaaatatttggcataatcagcgaaactcttttgatcataagcaaacacaaattggcgttgtgtgtgcttggattggaggtggtcaaagatggcactgttcagcagcgcggcgttggccaatttgtcccaaatgatcactttgtatttggccggagggacaacctgacaaatggccatcatttaaaaatttgaatttgatttagtccctttggcaatggttaaaatgtatttgcctgtgccaaataatatttccttttgtcccaattggcatttgttacaaacgatttaagaatcgactgtttggcaacattcaccgcaagcatttcaaaaaacagaaaaacgaatattaatttgaacagcgccgacataagcactttaatttagtgaaaattaggcggaccaaataatattttataataatgcaggtttatattttatttctattgaaaataagacaaaattaaatttattggcgaaagcatcgattgagaaaatgaggctacgctttctagcccaaatgcgttttttgtttaatggtaaatatgtaaagcaaaaattagatggatggtataagcccatttaataacaatttcagacgtccccaacccccttcccaccccattaaaagcgcacaaacgaatgtctttaagcacataatctggaaatgaatactcacggagaacgtgttggtcgaacaacaatgaaaatgacaaataaatatttccatcgatcgattaatcgtaaagaataagtctccatctcaaatgtttcctcttaagcagtgaaacgtgtggcgctcaaacgtccgttgcgatagcataagccttccgtcagtcgcttcgtgtcgaccacaccgttgggaagtcgcggaatatctttggggaagaagcgcctaaatgacaaaaaatacaaagtgaaaatgcaattaacgttatactctccatgccaaactcacttcatagttaagtaattgttgcggcccctcttggccaattcatccgcctgccaaatgggctcgggaagggaaatagcgaaactaatgatctggtggctgtagcacaatgcattcagaaagccctgaagttcatcctgcgtcatgccgatttcgtccaccaacacactgtactccactggcttgccagtcccctaaaacaagcagatttaatttagagaaaactttgcagttgcttctgaccttttttggatagtgtgattgcatgaaaaactcgggtatgtccggccgaaccattttctcgttaatcaccgacccgggcgtcagattgacaacagtaccatcgtgaaccatgaagaatttctgtgaaagcaaaa

SEQ ID NO: 1207 - DNA, 3267 bp, Heterodera glycines
tttgttagttaaaactcactccgacggtggatgggtcaaacgaatcgcatgtggcacccttcacatgaagcatacgacgttcctgtggcgtggtgggtgccggatgcgcaacatcatagccaatcacgagcacgtttcctttttccaacgcaaaacgttcagccgagcgctccaccaacggcatgtagttgaggccaaagtttttgcagttcaatttgttgatgatgttctccaatgtctgagttttgcctttgtgcacaatttcggtgaccttctcaacggacacatgttgagttggcacatggtaacgtgcttcgtagtatttcagcagtccatgtgagtcctcggttttgtagtcaacaagcctgttaaacattaaaataaatataattcccttggcgactactaacatgatgaattcgatgttcgagttcaaacagcgttcaagcatctccacccaaccctgaatgccacttcgactaaacaccatgaagatcgggttggtcagctccaagccacgttttcgcgctttatcaatcagcttgctggcaaacaccttcacaaggccttccttcgactgcttgtcaggccgcaaatggcgctcctcggtaaggataatccaattcaccaattcgttggtttgcagatattgcgcctgtgcgcccaacttggtccattcggtctaaaaatgctgttttgataggaaaaaaaacataaatttacattgtccggacatgggttgattatctgattcttggcgtagagaatacgcggactggaacgcacaccgatcacgacgcgatttgatgtttggtcgacggtgataccaaaagcgctcagcactgggttatccacattgaacacattcattttgaacgcacactgcagaatcttgtccattcgttcattcggaggaacggtgttagcctaaacatttgttaataatcaaaaaataatgtaatgctgtgcagcaacggactttcaagagctttccagacaagcccgagtccatcttctccaaaggcacgcgctgatcctccatgatgactaattgctcaatggggaacgtctctactggacgaccttttggcactggagtgttcggaataacggcaggaaaatcagggaagtcgatggtgatgccgtatcgcaaggtgaagtactcgggcatcgacacacgtttgccctgccatttgacactaaagcgaaatcattaaacataaatctgtgttagactgtaacaacgaaaacatacgacagctttgacatcggttgatcagtgaaccgcccaataccgaaggatctatgctttgcatacatcacattcacacgcacatcgaccagcactcttcggatatggttccaatcgttcatctgcggcatgcggttgttcataatagcaaaaatagttggcacaagtccattggactcgtagaatggcgacactttgactaaaagacaaaacatttggctaggaaattgactctaaaacgcactgtccaaaacaagcgcaggcgccaattctccatagttgcgcacgactcgaactcctaaaaaacccatcactgatattgagcgaaaaggtgaatacccttcgcaactccgggacggagtataatgccattgccagcagagactcgttcctccggggacacttcgtagagtttgccggctccaaccggcgagtaaatgtctctgcaaaaaacaaagcataccatattgctttctgtgtgtattacaatacctgttgatcgagaattgggaaagacacatttccagaaaagtgcgcacagtgcgatcttcgtcgaacagagacttcttctaaattgtaaacatttgcaacctgaggtctagcgttcaaaaactaaccgaataatactgacgataatccgaaatgtccaacacaggcttctgatggtttggcgtaatagtcaccaaaaagctgtccatcgcggtatgatctcgcacgtagtcgtcaacaatttcttcatgcgtaatttcaatcttcggacactcaaggtggaacggcatggatgagtacatagtggctttgctgtcgtagacaatctcgcccatacggcccttttcgtccggtttcatcccgaattgtcccgtcttctcataggcaatgatcaacagttcgtaacagattttgcggttgaatgcgcgaaggccactgaacaaaggcatttgataaccatggtaccgttaccggattagggattagtaacagtggcaacgaccgagaccccatatactagaatcactaaaatcgtactcgtcagttccacgggtgaggctcttctgtttgaccatgttcatcacttcgatgtcgtaacggtaggcttttcgaccctcctccaccttaatgagaaacatcgaacaaaggccctcctccttgatacgaaagtccttcgatggctctccaatggccttctgaagtacgtgaaattagaataaattaaaatggtgattcaaccttcttctttttcttcagtgcttttgcctcattgtcggtggttttcacctcagtatcagtagccttcgcctcattgtcaggtgctttgacctcattgtcacgcgtttgcgcctcattgtcaggtgctttcgactcagtgtcaggcgttttcattttatttagtcgtcagcaaaaattatcaacagaaaggcacaaatctaatctgcagaattgataatgtacgagcatattaagtgagatagaaaacagaaacaaatgttgattctttaagaacaacatacatatttagattgttatcaagtcatcccaaatcacctacttcctattaggttttaattacatatgtttatacagaaaaataagggttctagtgcactttatcctctcgacttttaggtgtccgtaatatttaagttttccttacgttaaaacttattcttggtattaatcggagcttagtttggatgtttaagtgcatttagagctaaattaagaacggaagtaataaagtaataaatatcacagaaacatattcgaattctggtaagaatagtgaaaaatttttttttaactttgtgtagacaaggggaacttttaacagacatttttatgcattaaatgcatttttagtacaccgattgtttaaaaacaatgcttttttaagtcgtatgaagaaagaagactaaaaacgattttgaaatagtatgtatgtaagtggaaaggaactaaaaattgcagaatgacgaaagaatattttatcgtatgctcttaagaaaagaaaaattcct

SEQ ID NO: 1208 - DNA, 755 bp, Heterodera glycines
tgcttcttttctatcactttgtccaatatgtttaaaaaacgatgcaatgcctattttttgtctttaattctctccacggagttgcatttatttgagctctgcctgcacctgggtccgagtctgtattgttttggcgccgccgttttggcgccagcccaagtttttgagttataactttttttcttgttgaccaaatctaacaatcttggtatcattcgaaagcttaacattttagaagatatttctaagctattgcttcgcgattagacaattaccatagaagttataacatgaaaattgcaaaatcagtcgagacatttttgaaggattatttctctataaactaatattagtaattatatacatagtgtggattgtactttcaagaagtggattagcataataaacgtagtccatcatgtctacatgcgacgcgcattatgtgacgagttgcacacacaaattagatttggctcatcatcatctatctgtcctcatcctctgtctgccgtgggctggtaaaattccgtaatgagccgtgtcaacgattgccgccgccgccgccgtcgtccattgtgacgttcatccttctgtttgcccaaaaatacaatttcatcatccccgtcggtgcctgaaaataggggaaaatgcaaatttaaaaaaaaaaatttatttacaaaaataaatcttcccctcttctcttcaccgaaattcttgtttaaaaacacagcgaaaaaaatggggaaggagcagtg

SEQ ID NO: 1209 - DNA, 1929 bp, Heterodera glycines
  misc_feature (1850)..(1850): n is a, c, g, or t
gaaccgtcctgttccgcagccaaacgtattttttctttgatcatgccttttggtattgttttttgatcgtatttgcttaaaaatcatataatcagaaccaaaaaatatgatatcaaccaaaagtccaattaaatattttttaataatgcacaaaatttcgccacgttaagtcctcggcaaacgtttggctctttcgtttggagtggacagtttcagaaacttctttgcctgatttttaacagattttgtgataaaaaatgccaatttggttgattttcgtcttaaatttaattttaaattaaggatctgagaccggcggtgccgttaagcgtcgccaagaaaatttttgaaagtttaattgtgatttgttttatgtaattttcgagttgttgatcacgaatctgacatcaaaatttagattattcagaaccccggacccaaactcgaacgaagtcaaaactcaaatcttcgaattccgcatttttatttcaaaacgaaactgaatcttagtccaaaataaaaaagttaaattagggaccacaattctttgccattaccataaaaaatcatttaaactcgaaaattcggaatcatgacatttttagtgaatttttgtctttttcgtccttttatactcacaaatttgtccattgaaattgcgcaactaacagctttttcattggttgaaatggctatttaaaagcgattcttcgtcaattgttgtcattgtcccagtattatttctttttttttgatttttgatttttcttttttatgttcattcgtgtcaataatttttcagcctccaatttcagccacatggctacgactgactggggccaattcgacgctaacggaactgactacgatgccatctacgacggcacagatgacgaagcgggcactacggacaacgggcagggcggcaacgtgctcaatcacttgctgactcaggtggaacattcgcgacaattgctgtttctgtttataattgaaatcccatttcaggttggcgccggaatgactcttcagaatctgacgctgccggcctctgttctggaaaggcgctctctcctggaaatgtacgccgactttttcggtgaacagcatcggatttttggattttaaagaaaaattcccatttttcagcccatccagacgaattggtcagcgcggcttacgaaaccacacctgagaaaaggtgtttccttttcgctgacaaccaccctaattctttttttaacagattccttgccgtcctgaagtactatctgaactccttcttcccggctcgcaaaagtggcgtcgccaagaagccgtacactccgattttgggcgagacatttcgctgccgctggacgctgccggacgtgcctttgaacacggagcaaactacccgcggaccgttcccgggctctgccagcaatcaggtcgagtttgacgcaagtgccagggtcatcattttaaacgaccaaaatttttcagttgacattcatcgcggagcaagtcagccatcacccgcccatctctgccttctacgctgaacatccggcctctggcgtctgctgcacttcgtacatttacaccgagtcgtacgtcgccggcctttcttcccttggcgtccgtaacatcgggagagcgactgtggtactaggaaatgtaagtggacagaattatcggacaaaaatctgctgatttaccccattttcctttcagcacaatgagacttacaccgccactttccctgacgccatcgcacgaaactgtcacgccacaccgtggttcgaactcaccggcaaagtgaacaacattttttgtcttaattcatttccagctaattttttcccccnaaatttcaggtgaaagttcgctgcgcgcagactaaatacgtggccaaaatcgacttcctggcaaagcccctggtcttcg

SEQ ID NO: 1210 - DNA, 6417 bp, Heterodera glycines
ttttttggtaaaccccatcggatttttggttttaaaaaaaaaattccaatttttcagcccctcccagaggaattggtccagcggggctttaggaaacccccccttgagaaaaaggtgttttctttttcgttaaaaaccaccctaaattctttttttaacagattccttgccgtcttgaagtactatctgacctccttcccggctcgcaaaagtggcgtcgccaagaagccgtacaatccgattttgggcgagacatttcgctgccgctggacgctgccggacgtgcctttgaacacggagcaaactacccgcggaccgttcccgggctctgccagcaatcaggtcgagtttgacgcaagtgccagggtcatcattttaaacgaccaaaatttctcattttttcagttgacattcatcgcggagcaagtcagccatcacccgcccatctctgccttctacgctgaacatccggcctctggcgtgtgctgcacttcgtacatttacaccgagtcgtacgtcgccggcctttcttccattggcgtccgtaacatcgggagagcgactgtggtactaggaaatgtaagtggacagaattatcggacaaaaatctgctgatttcccccattttcctttcagcacaatgagacttacaccgccactttccctgacgccgtcgcacgaaactgtcacgccactccgtggttcgaactcaccggcaaagtgaacaacattttttgtcttaattcatttccagccatttttcccccaaatttcaggtggaagttcgctgcgcgcagactaaatacgtggccaaaatcgacttcctggcaaagcccctggtcttcggacaagcgcatcaaatcgttggccaaatcttccacgggcctgaacggaaggtgccgctgatgacactgaagggcgagtggaacggcgaaatcatgctgagacgcactgcgcgcgggtcattccatctgttcaccaacgtccgggccaagccagatgtgcggaaggtagagatttttcaattttcactaagctgattattctttttatttttgtcaggagtgcgttccggtgatggagcaggaggacaatgagagccgaaagctttggcgtcatctcactgcagcgttgtacaccaacaacacacagatggcgactcaaagtgagttttgaaaggaagggttcaaattgcattaattaaggttttccccgtttagttaaacagcacttccaacaacgccagcgggacgaggaggcggagcgcaaacgacagggacgtccatggagcgcgcgccactttgtcagagagggatccgggcttccgacagacgcctggaaataccgcgatgcaccgtgatagcgaacccgaaattgtctgtatattgtatattagcccgaaattgtctgtatattgtatattagcccgaaattatctgtatattgtatattagcccgaaattgtctgtatattatgtactaatatatgtgtaaatatgtacttgacagaccggagccagaaactcacaaaaccacttataggttttttatgtgctgaaatcgagaaaaattttaaaaaaggtctgcggcaacgcgtttaaacaattggttttttcaaccggttaaaaatggggccttcctgattagaagctttttctaacctattgcttagcgattagacaattaccaaaaaagttataacatgaaataacaaaaaaaccaaagttttggaagttttttcctaataacttttttagaagctaaaatttttgtttgttttttgcaagggctggcgccaaaacgaccgattccccctgggtccatgccatcgtttggcaacctggatttacctgggttttcgtcccgaaaaaccaggtccagccaggtcaaccatgcaatccaggccaggcaaattccgatctctaacactccacaatttaatgagaatgcttaagattcataatcgcaattaaaataatacaaaattatcaaaaaaaggaaattacaaatttaaccaaacaagtcgaattaaattaagaattttcatttagaagaacaacattagtcttgctaaattatccttcagagttcagcatgttccccctttagctcttccgggttagcacaagcggtcggagattttgccaaaaagtgatattcgcacttggacggttcgctggtttccacaagttcgaactgttcaccgcactcgaactgcaccaaagtggacctacgaaatgaaacaacatacaaggaatatgaatcatcctgtcatccatcatcacctctccggtccattccaacacgtttggccatgttcatagcgttgagcctcgaatttgttgccgttttccggcccggcccacttgccccaatggctgaaaatggagaatataacaaatacatcataatgaaatgaaagtgggcgccggtaaaaagggagagcagaagataaggaaaagaaaaaaattggacatataaaattttctaatttttcaaaagtcagtgcctttttcctcacactatgcaaaaagcacgggaaatgaatcaaagacaacaacccaacaaaataaacccgaatatggggtggcaaattctcaccccaggctgatctccgagtgtccgtttcggtccttttgcaccgttcggtcgaacatgcacagtttgtacacgtattgggtggtggtcaattccgcgcattggcccttcagcggtgcccacgcgctgtccggcccaaattctacgtccaaataggaggaggattctctgcaggaaaattaaatggtgagtttaatttgccacaattagtcgacctaattagcctctccaagtcggacactttgtcggcaacctgaaaagtgttggtaaaatcaatgaactgccgtgcccaatgccatcgcttttgcccacctcgtcgtactctttgcgagcctggtccgcccgttcgataagttcgcgcgttttctgctcatatttttcggtttccttttgtccctcttcgccgctttggtcgtccgttttgtcgccctcttcggtgccagcggggatttctgcatcttcttaaaacaatggatttttatttaggatgtgtttaaaatcctacgcttttccgctgcgctggcgatttcatcaacaaactctttgaccatttcaaatttgtccaaaaatgcggcaaaatcgagtgactgaaaaggtaaaattaaaaaatgtgtccaaaataatcgccaaaaatggcaaaaatacttcctcaatttgctgttgtttcgcgtcaccagtttctgttgtctctccatcacttttctttttaaaaatgtccttcagcaattcgtctccgcgttcgcccgccgcccccgcggcacttccggcggtggcaaatcgcttcagcacatccgaagagattctgattgagaacaaaaaagggtaaagaatttaatatcgatgaaaatttggaggacaatgcaataaaaaaggcgacatttagcaggaataaaaccctaaacaagtagacccaatttcctccagtgctttatgcattttctctctccgattcaaaatcctagaattccctagaaatgattgatttggcttattaaaatgattatcttttctatgtattaaaaaatgcgaatttaattccccgaattcgccctctgctgaatgtgctttcccgccccaccattaaacgcactttccgtccccgtccttctccattttgtcgaacatttgctttgcctcggcctccgtccgctcctttttcgcctcctcccactctttttcctccctgtccttcgcctccttttccaactcttccgccgcttttttcgcctcctccgtcccttttttcagttcggccaattcgtccaactccttttgcttcttttcaacttccgatttcttttccgacaacattttgcctaaaattgtcaaaacatttgcgaaaaatagtgtgtttttcattacgccagttattgcatcgcattacttccaattcccccaaaaaggccccagttttcaaccccccccccttttcccattttcaaccattccccatcctttttttccaaactgacccccttccttggccaactctttgcgcttggcatagcctgccgtctgcacttcggcctgttgcttggcatcttcgcgcgctttggcacccagcgaatcgcacacatttggacattcggtgcccgagtcccattcgtcggacccgtcacagcaatctttggggaaagacaaagcgggtttatcgctacaaaaagccccaaataagacacattaaatccataccacagatgaaatcgttgactcggctcgacggcaaagtttgcggcctaaagccgaaattggtgcagtaaaaatgtccatttttgcacgccgacgtccctaaagaaaaatcgaaatgaaaaacgcatcccatataagtaagtccttcacaagggttcccgggcaaatgatgacacgaaaatgacagccatttcggctattcctcaccctcctccggtccccctaaacaaagttaggtaatttctctgcgttctgttctgacccggctcgtcgcttccgtccgcgcagtcgcaatagtcgtcgttgacctgttcaaatgggatgctcttcttcccgtccaaacactcaaattgtgaccgcgtttggtacaatggagcaactaaaaataggaaaaaaatttaaaaatactaataattttgccatttacgttggggagagactcctcgtggccgagttggtaattccttttcctccccttttgagcacaccgaagaaaaatggacagtcaaaacaacaaaaagagagagcagcggcaaaaaacaaatgcaattactcataataaattatttgcagaggacaaagagaaattgcttaattgttgttgaactaatagatggaaagaaatgaacaaacggattaaagcaaatgatcaagtcgcgaaaacgtgtgacgtggaagtggaatcaatcaatgaacaaaaatagaggatggactaattgatgagcattccgaatatacaattaaggtacagctggaaattaagagcttggtcaccaaagtaccggtttttaggtccttaaatggaacttcagtaccgggtctgtaaattttccgtaaagaattgaaaaaccccgaacgattcggtcaacctcgacggtcggggtctcgtcctaataaaatggtcaaaaaataaatttttcagcgaacaaaaagacggaagtcacaatttttcagaattcaatttgttcgaattaggtagacctattttggtcttgaattgtttaaattgcttttatgcgcaaattatactgtacacaataaatacatacacatacatacatcgaacagccatatgaaatgtgggaattatacaatagctttgccaacatatatgaacattataatcaatcagaaatggcatgtcgtcgcgtttcatctgtgtcgccctccgtcgattaggtccttttgattcgcacttgaattgacgtgcccctcgtgttctttttgttgttgcagctggtacagtcatgagccgaaatgccaaaatgctgcctcaaaatggacgacgcctgttcctaaaagcagtccgttttaccaagaactttattattgtgtaagtttcgaccgaccgaaagtgcattcataagtgacggcgccgaattgtttgttgttgctcctctggcgacgcacagcagttgcccgacaatgccgacgtgatgaaacaaagccatggtgaagtgccggttggactgaggtcggtcctcgagtgatgcgcggattgtgttcagtgtccgttcgagcagcgccgcgtcaggattctcacgaagcagctgcgccacaatatttgccagcccaccgctcagcaaatggtcgtacagcggcataggagctcccatcattgcattgaccagcacccagtaagcctcctgaaaatgtcaaaaatgaaagtgaaaaggaaggaaatcggatagtcaaaacacacctttctcttccgtgggctcgggtcacggcaaaggcggaaaacactgtcggacagtccgtccacggagaacaggcgcgtcacgtgctcagctgtcccggccgcaacgttactcagaatccagaggcattcccgcgagacttgatgaatgtccgaatcgacgagcattttctgaaaataaaacaatgatgcgggagtataatcgccgccaaaaacacactcacaaagtcatcgagcactccaaagtcgagaatggtggtcgtttgctcgtccgtgcccgttatgatgttcccgaccgtccgaagtgcgccagtcaaagctcggattgagtcgctcttcagcagtgtaacgatgctggtgacgaggcccggctgcgcaagaaggaggtcaatctgtggaaattgtagaatatatcattcgaaactcgacaa

SEQ ID NO: 1211 - DNA, 2020 bp, Heterodera glycines
  misc_feature (1867)..(1867): n is a, c, g, or t
  misc_feature (1986)..(1986): n is a, c, g, or t
ttgtcacttattcagctgctaccaggcctcttttttttgttatttttgacttctttcgctctcttctctttttctctctcatcctgaaaaataattgccaattttatcaattttcatgaaaatttggtatggctccgtccgccttaaaacactcaaacagctgtctcatcgcacgcaaagacactagtgtaactaaaattagaatatgcgtgaaaacttttccgctaatcattactttttttcatgccataattttattcgaacaaatgaataagaaacgaggctttactaaattagttgaattgccacattcaattgatgggtccatcttatagagaaattgatataagcaaatttgtttaactaaatttattcaaaattacaaatttaccatgaaatttgaatgtaaaaatgcttataatgaataaatagaggtacaaaaaataggcaattcacatttgacttatagaggggttgaacaatagaaggcccctctctggtagaaggccccctctaattaaaggcccctttttggaggggttgaacaatacaaggcccgggccttcaaatagcggatttacggtattttggaaaatacaggatttacaggatttgcaggattaatcctgccggatcctgtcatgtaaaaaattttgaattccaatcctgcaacaggacccgcaaattagatttttatgcaggattcagcaggatcctgcattgattttttgaatatttttaaaaatagaatgccaaatattcagaaactttcttttttcaaaaatttttttcttaataaaaatttttcgtttaaaaacttatccttattcgaaaaaagtttatttggcaaatcggtctttttaaacgcattaaagaagattcagtcgattgcttggagtgtaagcaaaaaaacgttattaatttttcatcttcatcattttttggtttaaaaatatattgaatacttttttatactttgaaagacttttttattaatacagaattttttgaaatttcctaaaatccgcaatcctgcgcaggatcctgcagattttaatggtcgggttaaaccaagctcatttgtcagattaagacaaccaatgtttcaaaggtcccaaaaagctcggattaccgtataccctaaaaaagcccccggtggcttttttaactccactcaaaatgggggctgtactgtattttaagaaatacggtaaattttaaactcatttttcacatttattcttttttattcgtttgaatacagtaaatagaggcatacaatatgagatatagacaattgcatttgtaagcagacacagttgaaaatcacataggtaataacatatctacatatacaatacgaataatatacatcataattacggaactcggattggctcttcttggcttgaatttcttcttctcctcctcctcctcacaacgatctgctggtggttctcgttctcgacgcggattcagcatcagcagatggtgatggcaattctctgaaaaaatggttggaaaatcagaaacccccaaactgtaacacacccaatttcgttgtcgttgaagccaatgtggaccaaattgtcatgaaacgccgcattaattctcgtagtgttcagccattccttcaactgtgtgtcatcaaactccatggaagagcgtagcaccatcacaatcgtctgcacttctccagcagcatcaactcgtgtacgacttgtcagcgctaagcgttcttgggtgatctcattcgccaattggaccgtatggttgaatcggaacggcaacgtcgatagcaccatgaactggacgggaaccacggcctcggcgaaggactgaaaaaattgaaacaataatttcttanattgatggagtcggaagacagaattcgaaatttccgtgttttgctactccaccccgaaaaatttaaattctaatttttgggggttttcaaagtcactgatcacggaatatggtgtcatncaatgtcgaaacaacacccatattcgtgatcaag

SEQ ID NO: 1212 - DNA, 1263 bp, Heterodera glycines
tttaaaatttttcaagggcggtagcaaaacatggaagtacccagagaattcaagcagcactcactcactcaccctgcacaaattgttcataaactcgtcccatttggtctgcctccatttgatgagtttcacggagatcggcgcttgtcggtagtcgcgcggcgagtgaatccacgtgtacagctcacggcatgttgggtcagtattttcagcagcatcggacggacactcgggcaccatatccgtgtgaattcggtgcaggtcagggcagtcgaacagcacggtcggcgacacgtgtttgcgcagcatggccaaatcgcacttcctcaggcacaccaatgtgctgatcccgtcccgtaacagtggccaaacatgtcgcgcaatcacttgccaactgcgaaactccgtgtgccgagtggagaattccagtgcgatgtcctcggcgaacagacggcgaatccggcgcagaaatttgatgacgtccgcgttgatgaacctgcaaaaatggggggaaattatgaaaattattgaattttttcgaccaaatggagagtgattggaagccgacgacactgctcggcatcggcgtggtgggcagtggcaacgtgatgaagttggtgccgtcttccgatgtcatgatttctgcgccgcctcgttgtgctccttcccgctcgcagatgtgaaactcgccaaagcgccactgccgtagcatgaattgcttgtccaccagcatgttgaaccgggtgttgaccagcgccagcttcatgcccacttctgcacgaccgagccacgccaatgtttccatccaagcgaagtcgctgagtcggctgaaaaaaacaaagaaaattgtgatttttcaaaaaattttctaaagttttatcacttttggtccatgcgttttgttgtcctctgcttttgctgctgctgatgatgatggtgatgattgtgagatatgcccagtgtttaacagcagacagatgacgtcggttgttgtgcacagttctgcgtcgattgtttccgtctgctgttgctgctgttgcgttgtcgaggccaacggaaggcgaaaatacggaaatgaatgaatgaatgtgtgggaagagcgaaatggccgaatttcgttgcttttatactcgctgagcatgccgccgacgaaaaacaacgcggagactgacaatgagacgactctttcccgcctataaaaggcacttcccttccacccatttcccatttatcgaccgattccttcaaaacattcatttctcc

SEQ ID NO: 1213 - DNA, 1171 bp, Heterodera glycines
ggaaaggccgtcgtttgtgcccagcggagcgttggccaaggaaagtggcagcaatcggtaagaaaagttggcaaactaacaaagagctcaagcaactagtgaaaaaaattttttcttgaatttcccataaattagaccagggttcccaagttttttttttcaaaataaggataaacgaggctaaaactaagatttttacccaaaaataaattttttctacaactaatagtagcgtgaaggaaacgcaataaaatacatgaaaatcgacttaaaacaacattttattagcgtgaaacattgaatttttttccgttgaccatttttctcattttaccgcatatgcacttttttgcggcgcttttttccccaaaaaaaaacttagagaaagtgggggggggggggagggtccggcggtgccggtaggcgccgccggggaattttttaaaaattagttttgtatggttagtcattaaatttgatcgcgggagttttcggtgttactgcttacaaatctatcatcttaaaaaagtttttgtaaaccataaaggccctttttgttttccactttttaaaatagcagcaaaaatttttcaaaattctctatcccgcaaattttttccaacagtcgtgctgacaaagatcgccgggagcgggacaggggacgagaacggcgggagcaacaccaccatcatcaccatgaacaccaccatgagcatcgacggaaaagtggacggagaggaggaggaggagagggggagccaccgccgggcggctgggacaagccgaaatgggaggacgacacggtcaaaaaggaggaggaagaggggggaggagaagaagcggagaagcagcaacagcacaggggggagggggaggaggagaaggaaaagccgtcatttgtgcccagcgggaagttggccaaggacaccaacacgtacaaggacgttctgatcaaggttcatctccgaatagtgaaaatttgaattccttttttcgaaaaccctaatttttgtgaaaaaattttccatgaaaaaaattgtgtataccaggccgttttcgcgccagcgcagtttttgaactataacttttttcactattaaccgaatccaactttcttggtatcattcgatagccctaaaggtcctctattaagcctacaaaattgcgggtt

SEQ ID NO: 1214 - DNA, 2736 bp, Heterodera glycines
  misc_feature (2637)..(2637): n is a, c, g, or t
gtcctgtttgtttctgttttaagagctcaacaaacttcaaacccgtcgaaagaaaaattttgaaagaaattgtttttggcaaaaaaaataccgtaatgcaattttttggcgcagatttaataaatctgaaactaaatcccccattcattcgcgcacagaatggtgaccgaattgaggcacaacgttactacgagttgagggagaagcatgtgttgcggttcgggttcagctcgcgtgagtatgtgctgttgcatgagcattcggcagcagtcggcgcagacgacgaggcggaggaggacgaagtgatggacggattggggcggcgaagagcgaattgcggcggcggaggaggacgacctgttctgataacgatgataatgataatgatgtgatcagtgatcagagttaaattcgaaatatacaaaatttaaaaaaaacagaccatattttcatacgcttctaacttgtataaagttggtctccgaaaacacaaaaattgtgaatggcgaattcgaaggattttttgggttggtctcttaagcctgtgatttttttgtttgttggcaaagggccaattgaagcggttgttcaattttgtaattatttggcaattttttcctctgtgtttactgtgttatttgtttatttttatttttcttgtgccttaaagggtaattatcgggcggagttagcgaccgattgcgcattttattgacgatgacggtccattgaagcaatttgctggcatacggtagagtgttttgttttccaaatgactcatgcgggtggcagctgtgcttcgtgcccattctcccgttcccaattcaggatagtttagaaggtacccccaacccttttttggcatgaaatttttttgtttctaaaagccgaagaaactgaattttgaaaaattcgagttcttgacaactttgtttgattcggaattggttgaagggtttgccacattcgtgatcagtagggctgtgaatttaagtcactaaaaatcctcaaaaaatcgccaaaaaagtcacaaaaaatgcatgttagaagcttcaaacaacctttagaagactttttaagtcattttaaggccatttagagttagcaaaaaaagtcatttgacttaaattcccagccctagtgatcagcgaccccaaaaatcaaaatgttttcacggctttttaataacaaaatttttttgcaaaagggggggggcatctaaactagagtgaagcgggaccgggaattttgggcaagaccgggaccttttcgggttgaaaaaccgggaatttttggctgggaaaaacggtcaaaaccgggaccttggtactctgttgtccgctaccaggtcccggtcccgcttcactctaatctaaactattatcgaatttgctatccttttccagtgaaaaaaaaaattaagaaacagggaatttcagttttaaagcatttttaggagggagtgaaaacgttgtgtacccccgcacactgttgtcaagggtggcgggggaagtggcaatgcccactgattggctggattatgtttgggggcgtggcgtcacaaaacgacgctttttcagcttagagactccgctatttgtcagttaacggaaatttttaacacccctttcacattcttctccatctttcagtgagtacgacttgcccttcgacatgtgcgtgtgcattgaccggcagcagttctttttcggccaatgtcacaccgttttgggccgtaattcgcccaccaaattgccatcaatctgtcgcaaagaggcgttggtggaagcatcggagcccgtggtcccgaaaaatatccaacaataaaaaaaattcgaatttttttttttgttgcagttttatgcctttgacattgaaacgccaaaggcgccgctcgattcttcgaatgttgaggcggtggagttgggcgtgttccagctgaacttgggggcattggcccaaattgtggtgaacaaatttttggaattttcgataattacctaattagataggtttcagttttcagttccaaaattttgtataaattttttgaacagatttattccgataattgtccatcaacaaccaaaaattcatttttacaacacttttatgagtgcaatttttctgttaggacggtgcgcgactcaccatggagcacgacgagttgcgaaatgaggccaaaattgcggacattggcgccggaatggccgactttgacgcagtttctgtccaaattgacgcggtcctgctgcaggcactcattgagcgaccgttgcgcaccgatctcccgcgcatttaccacttttcggacgtcggcgcaatgtttccgaacatcattcagaccaaccttatcgaggaggtgtgcatggcatgcattcacaacgtgccggaagcgaagtgcaagcgcccgctgcagtgggtgtggcggggcgaatttggtcagtctcatcaattagcgcgctaattacccccataataagtgcactcagtcgcttgaaattgggcgtcagccgaggcggtccataggggagaggggcgggggagtatttggatggcatttgagggcatactgtaatcatgggctaataataagtttatccatttttttcaaaattttaaatgttgccctcttanagttagtgtgtacatttgcagaattttgtcggaatgcgttcaaacggttgcacgacaacggaagaagttcagaagaagcggcggatgaccaccaccatt

SEQ ID NO: 1215 - DNA, 522 bp, Heterodera glycines
aacaaattgtttatttcttcagatttgcatcactcgacctttacctattatggaaagcagcgctgtaagttttttcttcttttctatcgcccaggatttggaccgtatttcggccatttttactccctaatttcgcatttggcaatttcatggcttgccgtccatcaaaatggagagagcgaactgtggagaagtttgatttagggggctgagatggtcggtcggtcgatcctgtggcttttactttgctggggataaccccctcccttctcctccagtaatgagggtccattgcattcggtgggggtcgactggacgccagccaactgagcgccagcccggtttttggggtataactcatttcatagttgcacgaattgaatgaatttaatatcgttcgaaagctctaagtgtcctttattagtctgcaaaatttctaagttacaataaagttctggccaaaaataaattcatccaattcggacaactatggaatgagttataccccaaaaaccgggctgg

SEQ ID NO: 1216 - DNA, 5183 bp, Heterodera glycines
cccccccccccccccgaattaatttgacaaaaagttgtttttagtcgacgcatgctaaaagcactcattttttttgagaaatctatggcgtaatgttgcattttttagagccaaattggctgggtgaatggctgagtttttctttgtttcgccatgggagggcggggcgttctccgccactgacctcgacgccgtccatctccgcgtttagttttctatcgactcattcatttgtgcattcccttttctttattagtttttatataataaaaacccattttccgaacgaaaattttttgcaagaattccccaaataaatggctgagtgtggcaaaaaacgtaaaattcaaattccgaccgaattggtcgctgaattggtcgatgctctccattttgatgtccgttgggccatcgtccgcgtttcaacggcctttgacatttttgtttttaaaaaacaaaatgcttttataattgccaaaaaagttgcaattcgtccctgtaaagtattttattttctttaattttagcaggaagctatcaacggaggaaaaagcgccatttttaactttgttggcactcattgtgacgacccaattgcgctgaaactccattaccaaagtgagtctttttgaatgccttcaacggcagtccaaggatttttgatttgaaaaatgttcccttcgggagattttgttttctgtctgctcctatctcttctggcggggaagtcgtgcggggagcagctcgccccccccagaaaaacagaaattttcagcgatttttttgtctttttgaaaaatctttgtagctcatcataaaattttttttcgggagagagggggggggggggtaactggtacgagggcaaaatgctgtgtgaggaaatgaagtgcacccgtcgtgcgaatcatttaacaaatgcctaggccttcgcaatttcctcattttgaatgccgttgctgtgagtccgcccgttaatgatttgtcgtccgtgccgactttcaaaaatgccgttgtccaaatgaccaaacaattgccttttgaattgaaggaacacaccggcatgtgtaagttgtttttgggtcttatttttgcaattgttaacatttaagtcatgcgttatttcaccaattcattgattgcgcaaaatcacgactacagtgattccggtacgacgaaaaaagactgaagagaaagctaattgtctaattattcctttaggaatcttccttttttggaaaacctttaaagatgcaaaattaaaggaaaaaggctctgaccagtccgttgatggtcatcagctggaagacgcaaagaccaaagtgtttgactttgcgaatttgttttgtgatggttcttctcgaccgtatcacattgacagtgcgtaacttttgctttgctttccaaaaactgactcccctgggggtttttttgtacaaaaattactgttaagcactttggaaatgttttggtaaaggcgagacagtggaacgttcggacggtcttcagagtgattcgccaatgccccctttggtcttcgagaactcgttggagcaattaatcacatacaaatgccagacaaaagaaattgccgattctttcgcccgctgtaagtgacacataattatattttattatatgccaaaaacatctttaatcacatttagttttggaatctttcattgattccctgttccatcaaagtggtgttttcaatttgaagtcggggaagctctccgctgctgaccaccaggaattcttcggcgatccgtcgtcatcgcattcgtccagtgcaggtgcacagcagccgcagcaggaattgtccgctggtccgtcatcgatttcgtctgttgttggtgaacagcagcagaaggactcgtctggtatttcgtcggcacaacacattggacagagttggaaaatgcatcgaaattttcaatgattttcaacttttgttctcagagcgagccaacattgcacagtacaaagaagctccgaagaaaagcaaaggcggaaacaattaaagtggaaaggcggcaaaggagggagggaatttgttggatttcgttgtcattggaggcactttttgttgagttttaaatcgacacgaaacggcgtattttgttgtttttggaaaatgttcagttatttatgttcttttaccaatatgcataaagacaatgtttaagaaaaaacattcattgtgtactcgcggagattctcacgcaaaaagcaaagtgcaaacgcccgctgcagtgggtgtggcggggcgaatttggtcagtctcatcaattagcgcgctaattacgcccataaataagtgccctcagtcgcttgacattgggcgtcagccgaggcggtccataggggagaggggcgggggagtatttggatggcatttgagggcatactgtaatcatgggctaataataagtttatccatttttttcaaaatttcaaatgttgccctcttaaaattagtgtgtacatttgcagaattttgtcggaatgcgttcaaacggttgcacggcacggaagaagttcagcagcagcggcggatgatcaccaccatttgccatcgcgagaacccttctctttacgtggacaatgatgagccaacatttcgctacaaatacaaacaaatgccgaaggtgtgctgcagggtagaggtgtgccgtgactgaaaaaacccgtgaaattcacggctttcgtgaccgtgaccgtgaatttttagcgatttttttttgttatttttatcggggatcccaactgaaaatttttaaaacacatttgtcagacaaaaaatcatcatttggggtcaaaaatcagcattttggaaaattattcaaaattaaaaaaaataaatttttttttgcgacgcgctttttacaaaaaacttttaggaaaccggtggggtccggcggcgctggtaggcgttgccgggaaaatttttaaaatctcaatgcaatttgcgaacaattttcaccaaaaaatgcccaatttttgaaattttgagacaattttctatgaaaaaaaagttttgggggccctatggtgccaataggcgccgccgtaggaaaaatagaaattctgactatttttaacacatttcactgaaattttgtggcttttacactgaagaaaatgaaatatatatgtataaagtttttttttggaaatcaaagtaattcaaatattcgcttcaaaaaaaaattataagtgaaaacagtccttaaattgggacaccctcgtttcggcgctcacgtttcggcgccagcccaaatttttgggctataacttttttttatttcaaattggtatcattcgaaagcccttcacttgctctattagcattacaaaaatcaaaaatattttctagcttttaaaagagttataaataaaaaacttcaaaatttttgacttttttgcaatttcatgttataacttttttggtaattatcgaaccgagaatcaatagcttagaaacagattctaaacatgctaagctttcgaatgataccaacaatcttggatttggatgacaaagaaaaaagttgtagtcaaaaaacttgggctggcgccgaaacgaggtggaccccttaaattttacattttttattatcaaatccaaaataagcacgtaatgttgaaataggcacaaaacttagaaataagcacactttggaaatcttgatttaagccgatttgtttatgaaaagtattggatgccctgcggtgccgataggcgccgcagggaaatttttgcaaattttgctccaatttcttatataactttgcccaaaacatgaccaagttttctctataaaacaatatgaaattctgaaattttcaattttatccagtgtaaatttttcacggaaaaaccgtgaactgaccccatgaatcgtgaccgtgaccgtgagtgagaaaacccgtgaaattcacggtaaccgtgattcacggcacacctctactgcagggagtggaaaaacaattaattacctattggaaatttatggcacaccatttcaattactgtttttgtttttatgtataacgccctttttgatggcttttatataacgacatagcaccgtacagagagagaaagtaaaagggcagtcagtgagggagagagtgtgtagggagaggcagttggaaattcggagctcgtcaatggatggggaaaaatggtttgccaaaagaggctaaaaagaattaataccgagagatatgtgtgagacaatttatccgaaagtcaaaaccggttctgctttggattatctctcgagatcgagaactgaaactaaaaataaattcgcatttttatgaaaagtgacagagagtctcgcacattcaaaaggggttaagaagaaattatcccataaattacatatgagacaaaaacaaataatgagaaagtttgattttcttgtccattatttatggaaaaaaacacttttaattgctcaatttggaaatgaatgtgacagataattggtgaacaaatgaatgaacgtgataacaaaggcggcattttgacacaacaacacatacaagggcacaatgccaaagaaacattttttcgaaaaaataaaaatttctgagcgcgcccttggacatgtttgagatgatcaaatgtcaaataaaaatgtggtttacttgtttgttgtctaattatagtatacaatccgagaaaataataataaaataataatcaaccaaatgaacgaattaataaaggtgcatttttttttgtttctgatcaatcaataacggatcaacaaaatttccaccgatttccgcacgacctgcagaacacaaaggtggtcatcggctcgtccgcgcttcgcgtttgcatttggctgtatgtgcaacatttggacccgcacttgtgacacctgtcgagtggggggaggtgggtaattaatcaattaattgatgatggcacacaattttggtttggcacccacacccccacacccccgccggccaacaaacacaaaaaaacaaaacaaagaaaaaaaattgcactctttaagcctccatcccctcccccgtctatcttggcaaattattaaagccattatcattattaattgggattcagggtaattaacagcaaacgaatggggacagtcagagccaaaaacttgagaaaataatgtttactattattatta

SEQ ID NO: 1217 - DNA, 1642 bp, Heterodera glycines
  misc_feature (1590)..(1591): n is a, c, g, or t
  misc_feature (1599)..(1600): n is a, c, g, or t
  misc_feature (1636)..(1636): n is a, c, g, or t
aaaaaaaaattttgagggggggggggggggggacgatgaagcctgctctcccagccaaattgccaaaatcagtccccaaagtttttcgcgatttttttttaaaagagccgatcaaaaaatttatgtgttttaaacaaaaaatcaaaaaaaatttgaaatgcccaaacgattgccctttccccgttcaaaatgccaggagggagaggggagggagaggatgggggcaaaaaaattgtaaagtgcaatttttgtcttccgcccaaaaaaagatgatacgactgtttggcgtgtcagtcactcaatgatttttcatccaattcccaaaacggtccaatgttttggaagtggacaacgccctgcaaaaagcacaataaatgtgtaataataacaaataaatgtgtgatggcaaaagtactgaaattgcaacaaaaaaaaacgcagaaaaaacccacttgaacatgtccgtcggagtgcctgaaaatagggaaaaatttttttatttaaaaaattcctaattaaattagtttgaaaaattaaatatgtgaatgtgtccccataaatcgctgattttttttccaattcgcgtaattttagcattttttacggcataaaaccggtggaaaccatccaaaattggggacccaaaaccgtcaaaagtcgcaaaaaggtgccaagttttccgtcggtcacaatgttgcgattccgaaactttccactgaccttcttggacggacatttggtgctccaaaatggtctccttggtcaactgttcacggacctttttcatctcctcggatgccatctcttcagcggtcatcacggcaaactctgcaaaaaaaagggggcaaatttatttatttatttttttaatttcatttttgaaatgactgactttctggcgacactgcgccagtcagcacattctcacgcaatgccacatttttcttgtctcgcaaattgaacaccttcaaaacaaacacaaatatttagttgactggaaaaagtgcccggaatggcgccgaaattcggattggtaaaccaattttggaacttaaaaatgaagcaatttcgaggattttttgggtcatttgaagaatttaaaggaattactaatgggtgaccaggtgatgtggcacgactaaccactttttatttgatattgtagtaaaaaagcacgtagttggtgcctaccgtattttctctaattaaggccctgtctccattaaaggccctgtctccaattatgtccccctttctgaggatgttgaaaaataatcgcccgtctctatttatccccccgggggataaatggaattattattattttttaaatcttatttttaataaaaattaattttaattaattctaaattgaaattcatttaaatgtttaataaacatgaaaaaataatacagaaaaatcacttactttactcaagtccgaatctaacccaccccggtgctatgtgttttcaattttttgaaatttaattattaatccctaggggtcttatgagacgggggtctggggttcgagtccgcttggctgcggtttatttttttaggtacttgtacagtttacaccagagnntgccgcgnngtacccgaaaaccgacatttttctcgacccgaaccngacccg

SEQ ID NO: 1218 - DNA, 909 bp, Heterodera glycines
tagaaattctatccgtcatatcggcttttggaattttaatgagtaaatcagtaaccgtaaatgacattctatgcttctcttgttggatacacgggaagaaataatagttagtccttttgttgaatttttagaaattctatccgtcaaatcggcttttggaattttaatgagtaaatcagtaaccataaatgacattctatgcttctcttgttggatacacgggaagaaataatagttagtccttttgttgaatttttagaaattctatccgtcaaatcggcttttggaattttaatgagtaaatcaggaaccgtaaatgaaattctctgcttctcttgttggatacacgggaagaaataattgttagtccttttgttgaatttttagaaattctatccgtccaatcggcttttggaattttaatgagtaaatcagtaaccgtaaatgacattctatgcttctcttgttggatacaggggaagaaataatagttagtccttttgttgaatttttagaaattctatccgtcatatcggcttttggaattttaatgagtaaatcagtaaccgtaaatgaaattctctgcttctcttgttggatacacgggaagaaataatagttagtccttttgttgaatttttagaaattctatccgtcaaatcggcttttggaattttaatgagtaaatcaggaaccgtaaatgaaattctctgcttctcttgttggatacacgggaagaaataattgttagtccttttgttgaatttttagaaattctatccgtcatatcggcttttggaattttaatgagtaaatcaggaaccgtaaatgaaattctctgcttctcttgttggatacacgggaagaaataatagttaagccctttttgttgaatttttagaaatttta

SEQ ID NO: 1219 - DNA, 1087 bp, Heterodera glycines
  misc_feature (85)..(85): n is a, c, g, or t
  misc_feature (933)..(933): n is a, c, g, or t
ttctatccgtcaatcggcttttggaattttaatgagcatttcagtaaccataaatgacattctatgcttctcttgttggatacancgggaagaaataatagttagtccttttgttgaatttttagaaattctatccgtcatatcggcttttggaattttaatgagtaaatcagtaaccgtaaatgaaattctatgattctcttgttggatacacgggaagaaataatagttagtccttttgttgaatttttagaaattctatccgtcaaatcggcttttggaattttaatgagtaaatcagtaaccataaatgaaattctatgcttctcttgttggatacacgggaagaaataatagttagtccttttgttgaatttttagaaattctatccgtcaaatcggcttttggaattttaatgagtaaatcagtaaccgtaaatgaaattctatgattctcttgttggatacacgggaagaaataatagttagtccttttgttgaatttttagaaattctatccgtccaatcggcttttggaattttaatgagtaaatcaggaaccgtaaatgaaattctatgcttctcttgttggatacacgggaagaaataatagttagtccttttgttgaatttttagaaattctatccgtcatatcggcttttggaattttaatgagtaaatcagtaaccgtaaatgacattctctgcttctcttgttggatacacgggaagaaataatagttagtccttttgttgaatttttagaaattctatccgtcatatcggcttttggaattttaatgagtaaatcagtaaccgtaaatgacattctatgcttctcttgttggatacacgggaagaaataattggtagtccttttgttgaatttttagaaattctatccgtcatatccgcttttggaatttaatgagntaatcagtaaccataaatgaattctctgcttctctttgtggatacacgggaagaaataatttgtagtccttttgttgaattttagaaattctatccgtcatatcggcttttggaattttaatgagtaaatcagtaaccgtaaatgacattctat

SEQ ID NO: 1220 - DNA, 6607 bp, Heterodera glycines
aatgtgagaaaaacccacttcactgaaatgttcacgagaaaagaaaatattttgcctctcgagacacatggaagccaagtatcgttcgacactttattaagagcaaaaataaagtcaacaacttcactacaaatgcaagtcacgctcaaaggtcacaaagtcaaagcaatttatgacaaaaataattgtaccgtaaacataaaatcgttagaaggatgttactcatgcaccaatggagcagaatttaaattttcatgtacaaccaactttggtaccgcattggcaaatgtaaaatgccctagtcagaattttcaaataccatgtgacacaaaagggaatcaacagcaaactcagcttttctttaatcaaccgagtgtaaaagaaagatgtgaagttatatgtccagatggaaaaagtgaaataacaattgaggccactctgaattatgtgagccaacaagacaaaataattaacccatcgaataacaaaaaggaaacacccgtacttggaacttccctcgaacaattttccgatatatttaatttcatatatacattaatcaaaacaaatctttttaattttttaactatactttttactttgattgtgatgataacatttataatttgtatatgtccaatgatttacccacttctttttaaatactttcctttccgtcgcgggaatgtcgcgactacgcgaaataggatttttaatttaaaaaataaaaacattaaaaacaaaaaacatttaaattaatgttaaattaaacagctaaacattaattaattaaatgtgaacgaaatgaatgaattgaaagaaagaaaaatcattagtcattttctgtcacaatttttccattagaaaaattgtcaaatgttaaactttaattatgaataatttgaacgttaaaagaaataacagattttaaacaaatgttaaaatgagacaaaatgtgaatgatattaaagaaattgtaaaatgttaagaaaactggaaaaggctaaagtggcacaaactggaaaatgagaaaaggttagtaaaattggcaaatgttagggacagaaatttggacatgccaagttggcaaacaattgttcaagcagaaactgccggtataaaaggaggccacaaaccccccaccaatcagtacaccaacggtttctgagaggcattgcctcgtcctccttttcctccctccccttccccctgtgccgacaacagccaccgacaactgcgccgcccgcccgttcgtgccgtcgactcttggccctgtccgttcgtgcgccgacttctgtgccatgccgatccgtgccctgccgtgcccgactaccgccttgacacaccgcccgctcaatgccgcccgtcccgtgccgttgacgtgtgccgagccgaccactcccgttcggtccccaaattgtgccgtcctccgatttgtgccgtcccccattttcccccattgtgccgtccccatttctgtgccatcccccattttgtgccgtcccccatttttcccccattgtgccgtccccatttctgtgccgtcccccatttgtgccgtcccccttttttgtgccgtcccccattttccctccattgtgccgtccccatttctgtgccgtcccccattttgtgccgttcccccatttcccccttcggtttaattacccaagtttgaggactccaataaagtgtattttgaatcgctttcccgcctcacttgacccccagcaattccaccatccccgattgaccgccaagcgtccaccccaaaatttcgccacaaccagtccctctcctggtcaccattgcgccagccgcccccaccccgccgactcgcactactcgtccacaactcaaagcccagcaccaccaagcagcgccggccctctaccaaccactgaactcatcagcacccccacatctcgccaaattcctacccctcccatttgtgcgccatcgaaagcgtacaagtggtgccgcacgacccgggaacaattgcacacccgcctctaccggaccacaacaaccgacccttcgaaagcacgtcgccacttttctgaaaaacaccggccgctcaaccattcaccaccggactccatttgaaagtaaacacggtcacaaacccaaaaaaactcacaaaaaagggccaccaagcccaacactcgaaattaagggataatatccccacaagtcaaaaaaaaaaaacacacacacacaacacacaaacaaatcacaattcagtgagaaaggaccacccaccgccatcccgcgcaaagagtgaaaaaccaaaagaaaagaaagagcattttcggaccgaccaacccaaaagaaacggagacgaaaccaagcaaatcctcagacggacaacagtgataaaagtgaccactgtgatcaaaaatttctaaactgtgatcaaacccaatttaattttgtgataattgtttacctcaataaaatattaactgattacaatcgcagaagggaataaattggccaaccaaaattaagaaacaacacaaatcatttttaaaggaaaaaatgtctggttttatcaggagcaaaatccctctcctcaatcgagtgctaagaaaagaaatccagtcgaccaaaacaaaaatcgaggaaaacaaatttgaatttgaccaaaataatctggacgaatgcacacgggtgttcaataaaacaaaggaaatcatacaaaaaattgagccaaactttgagaaattaaaaactttacacaaaaaatggcaaaatttaatgagaagaatggacaaagaagaatggaacacagaatggaaaatccagaaaatttttcgcgaaaaacatgattatttaaagacaattaaggaaacagacgaaatcctcgacactctgaaagacataaatttggaggtaaaaagaagactcaaagtaatcaaagcaaaaccctcttcagacactgaccaagaggatgaatcaaatgatgatgaagaagaaaacgaagacgaagaaattgaagaagaagatgaagaagaaaaagaatacgacagtgaccaggaagacgattcaccggaattgacctcaaatgaccaaacaaaccgtaaacaaacaccttttgtcaattatcgatcgagaataaaacttccaccccaaactctgacacacttctccggaaaattctcccaatggcccagcttttgggacgatttcaaatcatcagtccacaatgacccaaacttagagaacatacaaaaactgaaatacttgcgaggactcttacatgacgaaccataccgaattgtgtccccttaccccctcacaaacaaaaattatcccataatcatcaaattactcaaatcccgatacggtaatccacaattgatcagagaaaatctgcacagcgaattaagaaatttaagaaaaccaaatgaatccacaagcgaactgagacgatttatcctattcattgaccgaattatcctacaattacaatcccaaggcgaagaaataaaccatccccaaatcaagcaatccattgagactaaactccccttcaatatccgactaaaactgagagaaaaattcaaactttactcgacaaaagaattaatgaattttctcaattcacacactcaagctcgtgaagacatagaacgaatggaagattcaaacagacaaataagaaatttcacccctcaccggccacctcaaaacagaccacaaaggcaatcctacccaaactattcccaaccccagctaaaagcaaaccaccgaaaccatcaaaatatgcctctctcgccatatcccatcacttctgcattaacaaccaaatcaaaacctgtccgtttggcagaatttaaaccaaaaccatcgcaacccaaaccacaaacaaaaataaaattttgtcgattctgtgaaagagacaatcacttgagcaaagaatgcaaaatttattcaaccacggaaaaaagaagtaatcgagcgcgcgaattaaaactttgtctaaactgtctgaaaaaaggacatcatttgaaggaatgcaaatcacctttttcatgtttcaattgcaaaagcaaacacaataccctcctatgtacccgaaaaacaaatcaatttaatcaaagagaacaatttacaaacgtaaacgtcacgcaaaaccccgaagaattcgaagaaacccaaaattttatgtctctagattgcgatcaaactgatgaaattttacaaaatgacgaagaagaattgcttatgaccacggaagcaccagtattaaatcccgaccaaaacagaacacaaaacgaagtaattttctttgacaatgggtcacaaaaaagttatataacagacgaatgtgctgattcccttcaattaccaacaattgacgaaaaattattggcaatatccacctttaaccaaaataaacccaaaatcatttcatcgagactagtcaaaattggaatcaaaacactaaacggtgaaatcgagtacgtaacattacagactgtggaaaaaattactgatgttacaaaaatggtcaacagagagactgttgatatacgcaagagaaaaataccaattaaccatgcctgtccacaaattctgattggtatagaccactattggcactttatgctaccaaactcacaaattcaaatactcccctccggattttactcaatcgatacaaaattaggaaaaatattatccggaaaaggtactattgaagacacaaatattaatcttgtgaaagaaaagcgaaaaaaggatgagacaaacgaaatccttcaaaaattctgggaattagaaaatattggaattaccgactctccacatttgacggacgaagatacagctctcatacactttgacaaaaatgtcatttttgaagaaaatagatactacatccgatggccatacaaaagagaaacaccgaatttacccacaaattttggattatgtttgggaagattaagaaatgtagtcaaacaattgattaaaaacaaacagttggaaaattataataaaatactgcaagagcaaatggacactgacgttaatgaaattgctgatttcaaatccaaaaatttaattcactatctcccacatcaccccgttataaaagagagttcaaacaccacaaaaattcgaccagtttttgatgcttcggcaaaattaagaggaagcaattccctcaatgacgaaattcaccaaggaccaaaattattacctgatttgtgtggaatgattctccgattcagactcaaaaatttcgtcttaataggcgacttggaaaaagcttttctaagagttggattaaatgaaatagacagagacacaacacgctttctatgggtaaatcagtcatatttggacgaaataaaccaaaaatatcgagaaatcgaaatgagagacgtagaattaagacgtttcacacgaatacccttcggagtcaatgcttctccgtttttattaactgctgttgtgaatcttcatttatcaaaaacagatgaaatgtttgaaaagtttaaaacattacaaatagatgaagaattatgtcttagtggaaaagagaaacaattcaaagagctatgcacagaacttaaagaaaatgcatacgtcgataattttgtaatgatgtgtgacgacgaaaaggaaataaaattcaaacattactggagcaaagaaatattcaaattagcatccatgaatttgagagaattcgtgtctaatcacgaacaaagcaacaaagagattcaaaaaatggaaggatcagagataccaaaaattacaaaaatgttgggtataaaatggaatgtcgacacagacgaactcgaactacaaataaaaataccactaatgagtagagacacgacaaaaagacaaattttgacaatgatcgcaaaaaatttcgacccaatgggttggatatcaccagtaatactcaaatacaaactatttttccaaaaactatggagatcaaacaaagactgggacgataaattaaatgatgaagaaataagagagtggaacaatatttcaaatatagacgaagtttccataccacgctcaccatttacaagtcaaaatttaaaatgtgcttctttacaccttttttctgacgcctctgaattagcctacgccactgccgcatatttacacacaaataataaaactgacttattattcgcgaaaacgaggcttaccccactcaaaggcctaacaatcccaaagcttgaactattgggactattaatagcagcaagagccgtcaaatttatcattaaaaaatcaaaattgaaatttgaaacgatatgtatctggtgcgattcaaaatgtgtactcagctggttaaaatgcaaaaagaatttaccaatatttgtaaaaaacagagtggaagaaataaaacaaattgtctcagaatttcacatcactttctattacgtaaaatcagcagacaacccagctgatttggcatcaagaggtacaacaatgaatgaaatgaaatacaacgaattatggtggaagggactaaaatggcttaaattaggaaaagaaaactggccagcccacagtttctatactcctgaccaaaatgattcactttatgatgataacataatggaaa

SEQ ID NO: 1221 - DNA, 422 bp, Heterodera glycines
atttcaagtgtgtgcagcaggaacctccagggggtcttactagatttgtgtaaaattgttgttttgttttgctcacactgcgcagttcggtgtccatcgttttctcaaaggaacgcttcgtcagccattggcccactcggcccgccatatttgtgccaaaaacaaaggcatttgggtccttttgcgaggcgatcagctgctgcagagtttgcacgctatttttgttgtcgggaggctgaaaaaaaagaattttttgttttaattttagccaactattttttgttttcaccaaaaattggtacaattttcgggtgccattatttggaaaatttagcggaatttttagggttcgggcataggcgccgtcggggaaaaaattataaaaacaatcttaggttttcgggggcgctgatcgcgaatcc

SEQ ID NO: 1222 - DNA, 1045 bp, Heterodera glycines
atcattcgatagccctaagtgtcctctattagcctgaactttcccaaaaaatttcgttaagtttccaaaaagttttgggcagaagaattcaaaaaacctggttgttcgaaaatttttaatctttttgtaacctaacgaatttttttgaaatttgaaagattaattaattttttttaatttcgtgtatttgcttctctttcccagacatgaatatctgaatttctcactttgcccactcaaaaaaaaagaaagaaaaaatttattttataaagaaatattcagaatgatgaccgaccgcttgtaaccaatcgtcgaaggcaaagccaagtgccgacggacagagatgggcagtgaccaactccagcgatggcgagtgcaacaacagagtgccaggacgcaaatgggcacgcaaatgttgccaacacgaaacctttttagagaggggggggtagaaattttcatccaacaacatttaaaaaaaactaaagaattctaacgaagggagaaaaattaaggattgaaaaattggtagtgagaaaataaaaaaaaatttatcattagtcacactgaatgagagaggaaaaatcaaaaaaaaaaatcccgcaaatttttttttaaaaatatcccacctgttcagcgtggtcagcaaagaatgtgaacacgttgttcatgatgacaacatcagcattggccaaaatgtcagcatcggcatgaccatcaaaaaaaagaaaaaagtaaatataaaatttttttttaaaacttttaaaaattttcttctgctttttaaaaaattatatgctgacttactatttttttaattttccaaaaattacttaagtaattctagtgtttttttttcttgtaaaatttcagcttgttaaattttcgggggtggggggaggtgggggaaacggtaggggacggttcggtgccagcccaagttttggactaaaacttttttcattgttgaccaaatctaataatcttggtatcattcgaaagctttatatgtttagaatctttttctaacctattacttaacgat

SEQ ID NO: 1223 - DNA, 1380 bp, Heterodera glycines
tacagaaatgcgtcacgctcaatgccaattgcacgaccaatgcgtgggctaaacaaaataaatatttttgattggaataaaaagatatgtaattcaaaacacaggcaaaagaaatgatgagagagtgagatgaaaagagagagagaaagagagagaagagaggaaaaacgaaagagatagaaagaaagaaaagagacagtcgagaaagagagggaaaacgaaagagatagaaagaaagaaggagagagagaagagagggaaaacgaaagagatagaaagaaagaaaaagacagccagctaataaacattacgcagagaaagcgagacacgaatcaaatttgagagaaaaagagagagagagggacaaacagacagacaaagaaatgacaagttcaatcctcaacaattccacaccaataaagtgcagcagcgtataacactgtgccgaggcgagagccgatgtccaccaacactttgccatccaacgaaggcagacgaacagtgaacagatggtgaagctaggaaaaaaatagaaattctaaaaataatttaaacaaaaatttaaatcactcttacagtttatcattgcattgatatttatcccttcaaaatttggtgcatttctgctgatacttttcgaacgagtcgatgggtgtacaaactttgcttctttaaggggccatccccccggatggccccgtcccaaaaattctaaaaccttggggtgtggggtgggtttccttttgatgtttgccactagtccagttagtgtataacaaatgtaaagaaaatgagttttattttcgtatgggatggatgggggcagggaacgcaggcaccaccacacatactctctcatctccctctcttttctcttccgttttgtgcagcatacactctctcgcgcccagcagagaagaaatgggcaggcaaaatgagcagaaaattgaaaaaaaattgcctactttaaaaaatgaaagttcaaaatcacatattcttgtagctttctagcaataaaaattcaaaaatttgttaaaatttaaaaaatgggtgcgaaattttataatatgttagttaattattccctttttagcatagctgcaaaattttggtctttaatactgtaaaaatccgcaattaaatattagttattgtaagcaatgacaaaaaaatgaagagtttttctgcagcattgaatttgattatttctagcaatgtgtgcttcattttaaagggccatccatacccccggatggccccgtcccaaaaattctaaaacccagggtgtggtctgggggggttgtcgcgcacaagctgaactgcaggatggtcatggtttgaaagggacaaagcagcagaaaattaaatatgggttgaaag

SEQ ID NO: 1224 - DNA, 2645 bp, Heterodera glycines
  misc_feature (13)..(13): n is a, c, g, or t
  misc_feature (2635)..(2635): n is a, c, g, or t
aagccaactatantttgggaaaagcggaagctacaggcacattgacatgtgtaccaattcgcgcaggcgttttgcgatacgtccaagttgcttgcgcaccgacaaatccgttggatgccgtttgtcactgtgctgcagtgtgtcttttgttggcatcgcattttcacggcgcaaccgttggcgaacccatcgcaaaaactgctccttctgctgctgcgattgttcattgccatcggcggtgggagaaaagctggccaaaattgcctcaaattgtttctgtgccgcctccaatttgccattagcgtcgttcatcaccaaaatgttttgaaaaaatgtgtaaattttgttttttaaaaaattttgtataataatagcatcacagaatgaactcttagccaattaacagaattgcgaattaaatttttcaataaatatttgaggaaatgagaaacaaaaaattgtgggttttatgtttgagtgtcgggtgttaaagcatccataagggcatccattctctgctccaacattggcacaatgtcacgctccacgaacaaacaaaactcgtcaaggtcctgtcaaaacgggataaattaaaaaatgacaaaaactcaaaccctttttcaaaattcgacttttaggcctccaattttttcttatttggtcaatgacagctttcttggcatcaaccgaacgaaagcttttcaagaatggctcagaattgaattaaagaaaaaaaattttagacaaagcttttgtttggtacaaatgtgggcctttatgaagaaaaaattgatggctaaagaaactggattgaacacctacaatacaattgcctcaaaaaaaaaaaaaaaaaaaaatgggaaaattttaataaaatggagaatgaaatatttcacgaaaaacgatctctcaaccaccttgacgatgaacggcctgcccagagcccgtgtctcgtccaaatgcttcaggaactgtcgcattgccgggtcacaacgaatgacggtgcccttcttcacgttaaccattttatctagcaaaataaaacaaaaagaattacagagaatgtttaataatcagggattctttttttatgtgaatacatattttttcctggattctccatagcctaattagtaggaaaaaaactttcttttttgtgtttgcgaacaaaagttgggacttttatttacatatttttacatattttgggatttttctacttattacatatgtacatatttttatacatattttggactttttcgtacatattttcatttttttttacataatttgaggatttttgagaatttacagaaattttttgtgaaaatgtatccctaaaaaatcgaatttttttttcaaaaaatgatatatcaaaaattaattgttgatatattaaaaggtgattctaagcctattttggtcatttttatggcattttatgcctctgtttcactttttacgaagaattttttttccaaaaaataacctttaaaaaatttttatttacatgttttagtacatattttggggtttttgtacatatttcatacatattttagcattttttatacatattttatttacatatttcgcgatttttcttacataaaaaaagaatccctgttaataatataaaataaatatatatatatttactaaattcaaataaaaatatatttaaacattgcatgcaattttattttgaaaaatttattgtataaaacaagagattaaaaaaatgaaatccaaaaaaatgcttttgagctgttaggcatgattaaatgattgctcgagcagtacacaagtggttggtttgtggggtaaagaattgaaaaaagagcaattaatggctggcagtttaaaatcaaatatttaaatggttacaaatttagaaaaaaattttacacatttaaaacttttttttcaaacgcataaaaatggtaaaaaattaaattaaagcggcgaaaaaaaagagacgctcgtcctgtgcaagaaaatgaaaaatgagagagagcttcatttttgtaagcaaatgctcaaatacccgacgaagggattatttgccatgaaatttacaagcaaatgatggacaacaaaaaaaagtggttggtgtttgcacacatcacatcattcactggtcatcgaaagaaatttcctttttaaataaaaatttcttagtttttaaaatttaaaacatttagattttttcgaaaaaacatttaactttttaatatttttctggaataaagccgctcatgaagcgggaccatggccaccagggtcttgggaattcatagaagggccggaaatggttaggaatctcgatttaaacagtaaaaattatgaaacaaaatccaaaatctaatgaatttgtgcaaaatccactgaatccaaaactgagattatgtgcaaacactgatttttgaacaaaaagtaagcaaatagagataaaacaaaaaaaaaaaacttctggcacaacaatgattggtaaatgaatggagttgggagaaagaaaacggtgaaaaaatggataaatgacaaaatttaaataaaataaattcaaacgcaaaaaaaaaaaaatggattaagaacaaaaaaaaataaattacaaaaatgcgaattcagtttngtgctgatga

SEQ ID NO: 1225 - DNA, 2193 bp, Heterodera glycines
ctctagagtcgccgtacgactttttcggttggattatttgaaaatttcgcttttcccttttttggtattcgtccaccgatggtgaggagggtggcggtggcgcttcgtccaccacaattttcggcaattccgttgatgtcgttgaagttggacgatggttggtggtggtggtgatgttgtcatcggaaagctataaaaacaaaattttttttttgtgattttctaaaaaaaataattggaaaaactgaggggttggcaattcgattttttcaaaattcgttgcgtataaatttttcacctttccgtcagccatgctcaacacacggccaaggccagtgaccacgttggtcagccgatgtgtgatcaccaacactgtgcgatcagcaaattctttgcgaatcgactgttgaatgcgttcgtccgtttgactggaatttttttttctagtaataaataatagaaccatgacggaaaatagaaaaatttaaccggatgggtcaaaaaaaaaactttatcttggtcaagttcaaaaacccccggattttagacatggataaggtaacttacatcccaccaccattttccgctccatatcaccaaataaaaaaaacagaaaattttggggaatttttagaaattcataatttccaaaaaaaaaaattttagaaaaattctgtcaggaaaatttttaaagatttttcgagtgtcagggggggggggaggtacgggctgctcctgacaagaaatcttttattccagttaacaaagccactacatctcttacatgtccacgttggcggtggcctcgtccagcacaacaatttgcacgttgcgcaacattgcacggcacatgcacaccaactggcgctggccggccgacaaattgcggccacccgactcaacagcaaaatccagtccaatctattggagaaaaaataataatactattaggaaccacttggttagtgttacaaaaaaatttgaaaaaaaaatcccagttttacgcatgtcgtttgcaggaaaataaaaggaatacaaatcaatcaaaaaatggaaccgaatttccgagtccattatctgctccaaaccggctgaacagctccaaaatgcgtgcatcatccgcgccaccttccgggtccacgttgaaacgaagtgtgccactggggaaaaatggaaaattcgtaggttaattaaattttggattaaaattattaacattatctaattaggtagtaattacctgagcaaaataaacgaatcaatggcaactcgtagatttattagcaattaattatagaggattaaacaaaattttaaaaaatttacgcaaaaagtgtcggctcttgcgaaatgatggccattgaacggcgcaaacgtcgaagcccaacccgctcaatgtcccacccatccaaccgaatggtgcccgattcgatggggtagaggcgaaacagtgcattgcacagcgacgttttgcctagttcggcatttttttaaataaattaaattaatttcttttaccactcccggtacgcccgacaatgccaactttttgtccggaataaataatgaaggacacgtcattgagtgccggattcatttgaggcacataacggagactaaaaataataatattatagtaccagtggtcaatcgactcttatgatttcaaaaaaatttttttccttcaaaaaaattcgggtttcaaaaaatatatatatttatatttccattcccgaagcctacttacatgacatgatcaaattccaatgtgcccgattggggccaggccgggccaatttcagccgggtcatctccatctttgtccgattccacctcgatgttcttgtgaaggggatggatattattgataaagggaaaggaaaattttgcggaaatattagacttttaatttaaaaaaaacgaaaatctgcggatacgcgaaaaaatgagtgaaacaaaaaccttgtaatagaagctgacgcgttccactgacgtcagtttggcctccagttcagtttgagaacggaccgcaaattgaaaaatgccactcatctgtgttaaatgatgggaggtaaaattgaataacgaaattattcaatgtttgttttgtggaagataattgagactaattgggcgttgttgcaattgggtgcacttcatttcccacagatgagtggcatttttcaattggag

SEQ ID NO: 1226 - DNA, 3272 bp, Heterodera glycines
gggactcaattaaacggtgcgcattttgctgtgtccaaattgatccgtccggcgatggattagtgtggtgaaatggagaaaactgtgggagcgaccaccgttgtgttgacctttggcacatacattttgtgcattatcccatcgcttttaggctggcagaccaaaaatggaaatattctctcacgccgctcaacaaaattggccaaaaataaccaaatttaacaaaatgtgaaatggtggcggatttataaaagtactggcacctccattaagcgaaagaggcatttaattataaacaacttttgattcgtaaagcatttaatattggagtttttttcatccgggcaagtgccggtcctggttgttctccaaatttcagatcctcgtgctatttagttgatatttataatgactgatctgaagataattttatcaatccaaaacattcaaattgcattctttaagtgttagccaattaagctaaaaatgaaaaatgtcctagggttacataaaaaatgttgtgaaaaacaggcaaaatgtagaagtcatcaaatgtatagattaatgattttatcaacattaaactaaaattggaaagcaacgatttactaatttgcatcatcaaactgtcttaataattttataacattaagtaagtctgtaaaattgagcataataattataaaaattgtaatacttgttggggggggggcgagctaacgagctgctcccgttgcaattagccccccccccccattcacattcatgcatcattgctctgccatgttcacctgcatagcaaatgcaatggccataccggcctccgccgggtcaatgcgcccggtgagcagcacaatgaacagggagacgaagaaggtcagcccgaccaccaacaggtcaagccacaccgcctgccaccgcattgccgaatggtagaggaacaaagcaccactggaaaatgaaaaaaaaacgaaaaaattaatgtggcaacaaaaaaaaacagacggacgaaaaatgggccaagaggaatacataacgacaagttaaaaaccaaaaactttgacgaccgaatagaaaatggtctttttaattgcgggaaatataacattttcttgaataatcgtagaaaatttttaatttttttttggaattttcatttttgtttgttgcgaaatttcaaattgtaatttattttgaaaacgatacagggaggggggggggagttgtaccagttagcccttagcccaccgaagccaagggcctggctacgtccttggttggctgcattcattacaatgaggtagtttaaatttttttttcgaaattgaagaaattttaaaatttgggaaagtacggaggaggaataaagaaagtgacatattggcgttcatttctagaacaccaaaaactcttacctgttctcatccaagtgttgcttcagctgctccacaaagcgttgggtttggccaaacgcgtgaattgtcggaagggcgtccagcgaagtggtcaaatgctcaaacactggtgaacgggtgacattctcaacacgtttcaaactgaaaacaaaacaaaaaaaaagcattcgattcggtgcactcaaaaatgtcgattgaggattttggaccgtattttttttttttttggttgtaaaccaaataattaagcatgcttggaattgttcgattgctaaaatacattcggttttgtgcctacacctcaaaatttttaaaacggtcaacaaggggcgaaatctttggggcataaacattttctttaaaatgcaaaaaaaaaataaaaaattgttaccatcgaatgccggcacggaagcataggaaaaagagcaaaaagaggccaaacaatggagcacatggaaccaaaaagagtgggaaagtccaaatgatcatgaaaataaatcctagggaaaaaagataatttattttaaaaatattaacccttgcccaaacgaacccaaacaggtgaacattccctgaagcaatgcttcggccgaaaaaggcaacttcacatcaactgaacaaagttggaaaattagaaaacaatttgtgaaaagcaatccaattaaataaaatttaattacaaattcttcatgccttggaattagcggatgctaaaagttttacaatattttttaaatttaaatttgcttcagacaactatgaaaaaattagccatcattttaattgtaagtcaaataaacaaaataaaaacaagctgtgctcactttcgtccatgtctttgctgaaccggttcaaaatgcgcccggacggtgtacggtggaaaaaggcggcagtggcgtacagtacacggcgcaacatccgattgtgcaaccgtgtggcggcagtaagcgtaaactatgggacaaattttgtaggaataaaataccaaaatcattttatttaatgatttttttttgtgaaatttgacaccttgacaaacaccaatgccttgagcagtccgctgataaacaacacaagcaaagtgaaagctgaaaaatgttatgcattttattttggcctaaaaacgactcacaattaaaatttacaaaaaaaaaaagaaaaaagatttggaaaaaaaatatttaatagctgcattaaagcggattataatcgaaattttctgcggattataatcgaaattttctaagtttttttggcatataaaaaacgcaaaaaaatggaataaaaaataaattttttagatttcaatataattgccgagaaaatgtgaaccaaccaacccacccacccaccataaatgttgatgtaaaaggatggactgtcggccaaactcccaccagttccatcagtggcactgtgattgctgtgtgcggcacgctaatgtgggacataattaggttttgtaattttttttttttgattactgtaagtaggtaaaacaaatttttaagtcgtaccatccaatttttgagccaaacagtgccaaaaatgttggcaccaacattcagaatgaacgcagcaatgaccaatgagcagagcaaaggaccaccaccagcccgaatgtattccctgggggaaaacagcaaattttttaaatttttcatttaaaattcaaaaaaaaactgaaattttggaactatttgacattagaagaactcaaaaataacataacaaatcaaaatattaaattcttttagtaaaaaaaaaaatttaattcaatttttttaagaaaaaattgtatcaaacaactcataaattaaagataattatatacttctatgaaaaataaaatagaat

SEQ ID NO: 1227 - DNA, 3288 bp, Heterodera glycines
tcaattgccgttgaaatcgatgcaaattccgcaaaatccgttgcccaagaaagtcgtcggattcgaagacattacaaaaagggaagcgaatgatttttgggtgttccctctgtgtaaaacgattccttcctctttttacagatacatcaatgacaatgtgatcacttttcttcactgttttcgtccacttttcgccgcctgccaaattaattttgccatcgacgatacccttacgatctttaacagcactttggagccgattttgcgcaacatttgggctgtgatcgcgacgaacgtttgtgccatccaattgtctgccgaagttttccgccgtttgcgtcaattcgtcccctcaattctcgacgactgtccatcgcttcgcgttttcaatgcgtattactttggtttcttcacccaatttccatgcgatgacagtgccacggcatcgaatggacaagcggtggccaaatggcttttcactccccgtccggacaatgtgccgaaggtgttcaaatgctggttgcaatgggatgatgggcatttggcgtcgagcattgaagacttcaaaagggtgattattgtttgactgatttggcacttttacgggctttgagggtcgctgacaaaaatattttggacggcattcaatttgaatttttcagtttttaattgttttcctcattttaggaatttaccatgcttcatctcccgtcaatttcatcgctgtcattcgctttccgccgacttttgctgactccgttttgctcttcgatctgaccaatggatttacgcatgaacaattgacgttgacatggatgaacgatatcggccgttttctgctgatccgtcgtccaattgtgcgcgacgaaaacaaatgggcgaaatgggaaaaggaagcgattggctggcaattttatgatcaatggaacagaatcgacattcgttcttcgtgatgcaatcaatgatcgggcccaagtgatcagcagaagaagtgaatgattgttaataagtgatcgattaatgcccatttgacttttataaaattgttatttttgttgcggtgatcacaaattgtattatatatatgtgtgggtatatgcctttaggataaattaagagatttcctgaaataccaggctcattcttttgatctaatgataaagtcggtagtcactgttccttcggtttttattttattttttgttatggtaatttttggcgctgaaaacgaatctgagattattttaagctaatatccattttatgttgagttacatgaaagtttacgtattagcgataacgggagaagcggctcaaaatcggtggcattttactaaaaatgaaaaacaatgtcatgtcgacagtaaaataaatgtcaaatattttcaagtacgtacttgacattcaagtactaatccccccgtccctggtttaagcatttaatcgttaagaataatttttattgttaattgatttctacggatttctcaattgatgagccaaccgtagaacagccgaaagcagtgaaatgttcagtttaatacatttaatgagcacgtcaaaaccgaatttcatcttccaattttacactgcaattgatcgatcacttctcaacaaatcattcattgctacttttcgagttattaatgcctattttctaggcttttatttttagcgcctaaaaaaattttgaaagagcctatttttgcctattttggcgttttgcccaaaatttgtttacaaaaatgcaataaaaacaaaaaaatacacccctaagaatcgatttttttggaattttaaaaatacacccctaagcagagattcaaaaatttctgaaaataaatcccctaagaaatgaaaattttctcaaaaatcatctttaaaaatttttttggacaattttttgaatttaaaaaataatgtaactcaatactgatttgacttatttttttaccatttgaataaatttttttcattttacacccctaaatttgagactttttagtgcctattttccattttttggagcctattttgggggttttttagagcctaaagcctacctattttagcggtttttagtgcatataaattggagccctaataataaattatgtagaaaattaattaaaaagtacagtcggaaccaatcactgtcgaaaacacctggtacgggtcctgcctccgccatatttcattattttcctcttcgccatttattttcgtccttaccagcaggtgttcgacagtgattgatttcaaaagtgattgatttcaaaagtgattgatttcaaaagtgattgatttcaaaagtgattgatttcaaaagtgattgatttcaaaagtgattgatttcaaaagtgattgatttcaaaagtgattgatttcaaaagtgattgatttcaaaagtgattgatttcgacagtactttaaaattgcttttctacataatttattgtacatatgaattaatattaatatacaatttgcatatacaaaatttataattgaagtaagtcataaattaattaccttggtatgtttgtcagaagatttatcgctttctcattttgtatacaaatatctcctgctggactgtagtcaagaatataaagattgcttatataagattctcgaatcgtgtgggaaaatatgctaactaatgccgggtttgagtgccaagatgcaaatctgcaggctctttagcagaactcgaaaattacaaatcccttttcatgtataagaaagagcctatgcttatctgattatggcccggattttgttttttaactattttttttgcggctttattttgacgagaaatgcacgaaaaacacattttttgctcggaaattcttcgttttaacgccactatcgtcactaggaatcactattttggagctttgcaactaaaaaaaattatttttcgaagttggccaatacaatagttttttgccactattttggcgtttcgtcactatttttgccactattttggcattttttggaaaatttccatgcaataaacacgaaaaatacacccctaagaatcgacctaattaaacctccattttcgcatttcgatccaaaaaatgagttagggaataaaaatcgagttcgggagacagatttaagaaataaacgaaaacattccaacggtaaggaatttctgcgggatgaaactcctgtggttgagatattaaactttttggtagggaatgtttgtagactaataaaggacactttgggctatcaaataataccaaaaatctgcaaaagtgccgaaaa

SEQ ID NO: 1228 - DNA, 1236 bp, Heterodera glycines
gcaggagatgaagcattggcaaatgcctaaaatgtggaaaaattggttaagtagtaaatgacaaccacagaatgagtactaaataaataataagcaccgctttgaagtgttcaattctcgacgccaaattcccgtcatccaaagtcaaccagcagttgaacattttcggcacattgtcgggatggggagtgaaaagccatttggccaatgcttgtccatcggatgccgcggcactgtcatcggcagggaattcggtgaagagatcgcaatagccaaaaaagacaaagcgaagcgatggacagtcgttgagaattgacggggcgatttgtcgcaaacgggggaaaattccaacggacaattccaagacaagaatgttttttccgagcaatggccaaatgttgtgcaaaatgaactccgaaatgcgatcattggtcgtttcgatgtccaaattaattgggcaagcggcgaaaagttgacgaaaacgatggagaaaagcgatgacatttcggtcgatgtaactgtaaaaatggatgggaactgttggcaaaaaattttgacattggccaattttacaagatgttgatccatttgaatccgatgactttgcgtggcatttgaatttgcggaattggcaatggttttccatttaaaattgacaatttccatttgctttgtgccattttctccaattttgtgccaaattcgaataaatgccaatgtccatttgcgcgttttgaagtgttcgtcgacgtaaaagtcaaatcggtgactgatcatcgcaattccgaggccaagtttacgcggagagagcaaatcgaagacacaaagccaacagtcggcagagatgaaactgaagaaaaagggaaacaaaatttaaaattgaaaattggcattttaaattttaattttacattgctttttccattttttcctccgcttcttttcggcggtctgacattttgttgggagaaattattaagacagttttcgacagattaaattagctttttaaaattgaaaaattattaaaacaatcatttttttataaaaattcaagagaaaaaaactgttcaaatggtcaatttaaatggaattgttttcatttttgatttttgtgcatgaaaacaaaaaccgttttaaatttgttcaaattaaacaacaaaaataacaaatgaaagaacaattggaattttaaagaagcaataatatgggaggaattaaaagcaaagaatgaaa

SEQ ID NO: 1229 - DNA, 1845 bp, Heterodera glycines
aaacaaagtttttcttagaaaaaacaaattttgaaagataattataacaagtcccattttttcaaggcatcaaaaattgctaaaaattagtataaaagtggttgctcctcctccgccactttcattattattattttccattcgccatttatttgtgttcgtctctctgtcttcgaccttttcccatgacaatgtctttaaaagtgattctgtacgttttgcgcatttcttctcgacatttacccttttgcgttctcattttttagactcatcgctgtgccaatgtttgtcatttgttgtgccattcttttgaagtattgggaccgcttcaagaaaccaccaaaacaacaacgaggccatcgcaaaattgaaaaagtgccggaaactgtcttgacaattgaaaaagtgccggaaactgtcttgacaattgaaaaagtgccggaaactgtcttgacaatttgcctcgacgaaatgtcatcagacaaccaaaatgaagcggaggaaaagatgacaaaagcgatgtgaaactaaaattaaaaattgccaaatttcaattttaaattttattttcttttttaagcttcatctccgccgattgttggctttgtgtgttccatttgttgccgcctcgtcaacttggccttggcatttcaatgatcagtcaccgattcgacttttacgtcgatgaacacttcaagactcgcaaatggacattggattttgttcgaatttggcgcaaatttgaagcggatggcacacaggaaatggaaattctcaattgccgttggaaatcgatgcaaattccgcaaaatccgttgccaaagaaagtcgtcggattcgaagacattacaataaggtgaagcgaatgattttttggtgtttcctctgtgtaaaacgattccttcctcttttttacagatacatcaatgacaatgtgatcacttttcttcactgttttcgtccacttttcgccgcctgccaaattaattttgccatcgacgatacccttacgatctttaacagcactttggagccgattttgcgcaacatttggccaatgatcgcgacgaacgtttgtgccatccaattgtccgccgaagttttccgccgtttgcgacatttcgagccgtcaattctcaacgactgtccatcgcttcgcgttttcaatgcgtattactttggtttcttcacccaatttccatgcgatgacagtgccgcggcatcggatggacaatcggtggccaaatggcttttcactcctcgtccggacgatgtgccaaaggtgttcaaatgctggttgcaatgggatgatggacatttggcgtcgagcattgaagacttcaaaagggtgattattgtttgactgatttggcacttttacgggctttgagggtcgctgacaaaaatattttggacggcattaaatttgaatttttcagcttttaactgtttcccctcattttaggaatttaccaatgcttcatctcccgtcaatttcatcgctgtcattcgctttccgccgacttttgctgactccgttttgctcttcgatctgaccaatggatttacgcatgaacaattgacgttgacatggatgaacgatatcggccgttttctgctgatccgtcgtccaattgtgcgcgacacgaacaaatgggcaaaatgggagaaggaagcgattggctggcaattttatgatcaatggaacagaatcgacattcgttcttcgtgatgcaatcaatgatcgggcccaagtgatcagcagaagaagtgaatgattgttaataagtgatcgattaatgcccatttgacttttataaaattgttatttttgttgcggtgatc

SEQ ID NO: 1230 - DNA, 564 bp, Heterodera glycines
tatcggtattcctgaaaaggggtttggtactgagatgggatcttacagtatataaaggaaaacgtcgccgttcaacggcatcccaaagtttttgtcagaaaatcccaacgcccataaaagtgccaaatcaatcaaaacttcaactttgaacgtcaaattcgcttcatcatccttgcccaagtagcagttgaacacctttggcacattgtcttgacgtggagtgaaaagccatttggccaccgattgtccatccgatgccgcggcattgtcatcgcatggaaattgggtgaagaaaccaaagtaatacgcattgaaaacgcgaagcgatggacaatcattgagaattgatggagcaaattgacgcaaaagggagaaaaatgtggcagtcaattcaatgccatgaatgttttttccgagcattggccaaatgttgcacagaataaactccgaaatgcgatcacttgtcgtttcgatgcgcaaatcgatttgacaggcggcgaaaagtggacgaaaacagtgaagaaaagcgatgacattttggtcgatgaaactgtaaaaatggat

SEQ ID NO: 1231 - DNA, 6682 bp, Heterodera glycines
  misc_feature (2250)..(2250): n is a, c, g, or t
ctctgggtctgcgtgtcatttcaagagtgattgccaactcgggattagaaatggctcttatgattgaataatcatcgtattgctgttcggttagacccggataagcgcggcggaccaaacccgaaattctgttcccgagctcatcgacactctcgtttggtcggcgccgaattccgcgcattagttggtcgaaagacgtcaattgtttggcgtctgtgtcgtccaactgtcgaataattatccgcctgattagctggtattcatgcgggttttcggcaatagctgaattgtaagccctctctgctttgccaaagcatttcgatcgaagagcgcgaagtcgtttatcctcaggccattcctctgtcgctacatcaaactgtttaaaaaatgcgttcactgcgtctgatccgctgggccgtccaaattcggaatagagttcagagtcattgtgtacgagaagctgtctaggcttctaatggcctgtgccatcatgccgtcaaataccagtccggggtggacaggctgctgatattgttcgaactgattcggatgattttctctaattggcacattttggttgtgattttggaactggggagcttgttgggaattttgtgccttaaatcgctgagcataataatcgtcattgtgagcgtaggcatgaggtggcgggttttgtcgaaccaaatgatgctggttttcggcaacaactggtctttcgactcggagaggtcggtaccgttcagtattacccggggcattctcatacaattgttgattcattcggtaactgtttggctgtggtcgttcaatggcagtaaaattgttcctactgtgccccgtttgttgattttacttgacattcatgtcacgcctttgatttcggtcgagaattaaactcaagttttcagaaaaatgcagtctaagatcgcgctgtaaaagtccaaaatcgcgcgagtcatgcggtgtagaaaatattggcccatcattcgcatttgcatttactgttccaacttctaccactccaccaatttgttcaccccaaacttgacttcccatattttccctcaaattttgttgtagaaccacaccattagcattttgttcgttgtccgcgtccatttcctcatactccaactgctcatcatttgcgctgagttccattccgacaccgataagtcgacgatttgcggttcgctctaaatcagtcacatcattcccatttgctatggattcattttaattcggagctaagggcgagttcggtctgtttccaaatgcttcgaaattcccggtccggtgtgcattcccatcacggtcaactactattccgtgattcaaggctcttgtccgcgtcagcggtggtgtgcgaatcactcgcattacaaatgagttgtttcaaatttcgtcgttccgtcgaacaaaacctttcaaatcgcagcaatgcgttatttaatgaagcggcgagcccacactttcgcagcaatgcgttatttaatgaagcggcgagcccacactttcgcagcaatgcgttatttgcgaggcaaaatcggtgagtcgcaacaatgcgttagaccacagaaccgcaacaatgcgtttgttctgctcgtctggtgatgaagtgtcaactcttcagcaagccaacagatggacaatttgttgccggagaagcgaagctcgaccaatgagtaattcgcttttgttgaacgccgagcaaaactcggccagaagaaaatttgttttttttttgtcaaaccccaggaaatcaaataactcccctttttgtgcccaatctcgcccttttaatgcaaaattcccgacaccgcttactcagttgtctaggagcgccatgtagaacataaaaggtaactcgcccggtgggactcgaacccacgaccccagcaatccgtgccgtgctctaaccaactgagctacgggcgcctcttttagaggttctctcaggtcctttatcccactttctcccacactcctttccttctggcatcacaaccaaaatttaagggagggtcccaaatttctcttattttaacgcaaatcatggataaggtaagtcaaaaggacgtcgtctcccgctttgaaaaccgaatcatcgacataaatgaaaggaagtgaagtgttatggtgttgtttctctgcccattcacaaaattcatgaaaaaacccaaaaaaattttccagtcggcgccgccgtgccccaaaattcccctaagatttcaaaagtttacatanatttgccatgcaaaaattggccttttttggtgcaatctgttatctagtcagactaaaaatttacaaattttgcccggcgggcgctacccggcaccgcaggacccttttccctcgcacattcctcaaaattttttggaaaaggcacgccgcaaaaactcttaaaaaatgggtacttttgaagcggatttaattgggaaaaataaaaaatttaataaaggattattaaagggatttatttttgtaaaatgacgacatattaaatatttgtactgaggcaatacatattaaatatttataattaggcaagcacaaagtacatttttgtctcaaaaatttcaattacaaattgagtaataaacgaaaattgttgaaaaaatgttctgcgcctatttaaatgattttttttttattttgttcttcatggtgtcctcttttatatcttactatcgtttcactttatatttgattgatagatttttctgccttttttcccgaccatgccaaaattgaaaattggcccactaatttttctcgaattttttatggtcaaaaaccaaagctgatataacaaaatcttagtttttctatacaatttagaccagtagaatccgaatatggccttaaatgggacctatcttttaaacctggcttgtactgctccaactccatgcatgaagttcgagctgtacaggtttgttgcgatcccagagaccaaatctaagaccatattcgaactcaacatacccgattttccaaaaccacttttaaaacattagttacttggtggtcttgaaaaatgccgtttttggagaccactttcagtctcggctctccaataattcaatttttgtaattaaaattttatatttttgtgttcttatagtcctaactttgctctatttaatcactatttctctggctctgtatctcttttatttttctttaaatcagccatcaaaaatacctacctctaaaatgaccatttttacttacttaactctaactccctaaatacttttccattggtattgatctcttgccagaataatggcaacatcttatataataaagttgagtgtgtgtatgtatgtatgtttgtatgtgtcattgtttgaatttgtgtggcgttttgtttgagttttgcgttaaaaaatgatttgcaaagagatgaaaagaaattgttttgaaaaagaagagaatataaagaaaagagacgaaaataaatagttaagaagaagaagaaggcaaaagaaatagcacagaaaaagaaggtaaaagatttctcctcctaggatgtagaggttagagggagggatggtgggaaatagtgcactgtatgactgtctgtctatgcgggcagcggcaaatgggaggggcagacagtgaacagacgcgtgttgctgtggctgctgtgcagcagcagtctgttggacgcgtgcgtggtgtgtgggagggagggagtggggaaaaagagagattaaatggaaaagtaaaagaaataagagaaaagaaatgaaagggagagaacaattgaaaatttgtctcacatctcttccttatttacatcccattttttattttaataaaagaaagggaaatgagagtttttttatttctgttttcgcttcagtgagaattttcctatcttcttatataataaagttgagtgtgtgtatgtgtgtgtccattgtttgaatttgtgtggcgttttgtttgagttttgcgttaaaaataattttgaaaaaaaagaaatgttggttttgtttttttcattttcgttttgtcagttttgcaaaaagcagtctttaaaaatgttttctcttcttttttaataaaaaataattttatatgtttattaataataattaaatcgcattgaatgctttcaattgcatttgttaagagaaaaaaataattagtttttgttattaataaaaagcatttggaaatgaatgctcttagtacttttgtaaacaaaaagaaaatgtttttgtaaatgaattcctttgttattggattaaaattgatttgattagttatgaattaatttatgttgtgagtattgtttttgattatggcaaactcgatggaaatgttattgtttttgatattgcattgaaaaagttttgattcaagaatttgttttgaactttgaaatgaaaataatttgaattctttttatttttgttttgtaaaaaatatttgtgtattcgttcattctcattttctttaaatgtttttacttttttggtattttgttgttaaaagaatacgtttatgtttttgatgcgatgtttggttatgattttttcattttgatttttctttttacgctgaaaaagaatttcgtgatattttcgtctttgtctttgctgtggttttttgtggtttttgttgggttacgtttagataagtcgactgcttttcacacaatgttaagctgttttgaggacataatcgcgatcccatgtgggactctgttagcgtaagttattttgtttttaaaaattaattggttgttatgtaatttgaatttttaagatctgccactggtgttattactaaagtgatggaatcggagaaaaaagtcagcgttgtcttggtgtgcggatctggagaaaattttgttgttactgaatttaaacaaaattctgcgaacgctcttcaaaagtacctttcagttggaaatgtaaattgttgtcataattttaaattattttgtatgtttaaggtgctgaagcttcaatctgtcaaagcccaacgcttcaatgagaaatttgatggtcaaaagttttttcagactccatttccgtttgagtttgttgtgacaaagcactcgaaaatttgtttggtcaagactgaagttttggcggccgagaaatttacgcagcttgtggcgggccgtttttatagtaatgcattaaataaaaatcttttaaattttatttttagaaattaagtgtgttttaacgactccgttttcattaattggagaaatgttcgctgctgttgttggcgatctctgtgggaagcgcgcggatttatttatttcgggcgaaaaactcccagaaatgtttgggcaattggacagcaaggaccagcttgaactaaaacgttgttttgtcaaaattgaaggtttttgcctaattgattttttgtttatctatgatttaattattttgtagatgagtgtatgcagcttaatgttttggcttctgatgttaatgtgtgtggatgtaaagtgacgattggtgataagttggtcactccggtcaagagaaagagtgatgaagcaattttgagtccgcaatcggctaagaaatagtgtgtttttttgtttttgcttttttctttttatctacatataaataagtgcatgtttatgtttgtatgtttattgtgaatttattttggatggtgttagctagatttttgtatgaatttaaaagtgttgtcagttctatgtttgtatttgtgtgatgttttggatattaaaacgttatgtatgtgtttgtgtccgttcatttatgtggtgtattgttttgtttttatttataatgtggcttaaggatttccacaattaattgtgtttaatttaatgaagttttaataagaaaatttaaaaattaacgttgaacaggtctgtttaagttcttggttagttatataatttgattattgatcaatttgtttttcattgataaatcttaacatttttttctattttgttgaatttgcaattttacctttatatttattaattgtgttgttaataagcatttatttttttatatagacctaaaattacacgatattatatttcagtgatgaatttggcacaattttttgtctggtgattgagagaccggaagaatatcggagaattgcttaatttgagtcgcgttgcttgaaatgccagagaattgagtctcggtgattgattctggtgggttgagtcctggcgattggaatgctggtgggttgagtcccagtgattgaaatgcaggagaattgagtcccagtgattggaatgctggtgggttgagtgccagtgattgaaatgcagaattgagtcccagtgattggaatgctggtgggttgagttccagtgattgaaatgttggtgggttgagtgccagtgattgaaatgcaggagaattgagtcccagtgattggaatgctgttgggttgagtgccagtgattgaaatgcagaattgagtcccagtgattggaatgctggtgggttgagtgagttccagtgattgaaatgttggtgcgttgagtgccagtgattgaaatgcaggagaattgagtcccagtgattggaatgctggtgggttgagtcccagtgattaaaatgctggtggttcagtcctggtgattcgaatgctgttgggttgagtcccagtgattggaatgcctggtgggttg

SEQ ID NO: 1232 - DNA, 8523 bp, Heterodera glycines
ccctataatcccgaaattgaaattttcaccgctaagcatccgctccttagtcatcctttacaatttatatatgtcatatttctatattttgccaaattttgagttagtccacattttataaacatagtaaaaagttaactttcatacaattgctcttttgtgtcaaaaatagggcttaatattaaaatatttcatttttgttttcattttcccacgatattaataaatttcagtttatttttctatttaaaatgatttttatttttgagaaagaagaagatgctttcctaaaaagaagcttaattgattcatttaagcgacaatttaccttttttaagggtcggtagtcttcccaagctgattcattattcaataaaaattaaaatcttttattgctttttagctaatttataagcaaacaatcaatggctttaatttaaattctccggccttcacaatgcttactgctaatgaggccgttcaaagagaccaagatgagaaggaagtagaagaagaagagtcgtgggccaaacgttttcctccatacagttcagaaacggagattgaacagcttgacgaatttagtttgcttcatcaacaaattgtggccggccgtgttgtgccgtgttgtgtaaatttgccagaaatcacggtcagcaaaagcgggactaaaaggccaaaattttcagttttttgatgtcatggcaaaactatttttttacatataaaatgatgcattaagctgaaatatttatctttctaagaaaacactaactggcatttcactaagttggaaatttatgttgaaatttttgaagaaaaccaaaaaagattgtgtattttgtgtaaatatgctcaagtgaactaactaccagataagcttggtaattttcgaaaaaaaacttaagggaaggcaggtatttttcaacaaatgacgtagaactcgaaaatttaatttaatcacaggaaatttccgaaattgcggcccaaaaattgaactccgatcggtctgccgggggcatccctttgcttgatattgtcaaaattatcaatgccacaagacaaagcgttgcaggcacagcttatcgtgtacaaatactgttcaaattgagaaaaaaggtgaaaaacacttggaaaaattaaaaagtttttattcaaatttaaaaataaaaagattaacacaaaaatttaaaaaattattcaaaaaaataaatgaactaaataatttacattatttattttaaaataaattattaaagttaatttttaattttttattaaaaaaatgtaatagcataatttttactttaattttcttcgagttgtttcaattaaattagttaatttatattatttttggttatgttttttttctcttttttttattaatttttgattttttcacaaacaaattcaggacttgggaaaaaaatcggaggccaccggaagcgaagtgcgttgatatttaattaatttcatggaaacgaagaaatagtttattttttgaatttttgcaaactactgaacaatttatgactgggattttgtttttcaaaaaacaccaacgaaattttgattttaacaatgtatttttttcagaagagcaacattcaggagcgtagctattctttaagcccggtaattaaacaaaaaataattttaaaataattttaatttaattttaatatatttgttgaattttatattcacagatttatttgttcaaaatttatcgcaacatcaatgaaaccatagaaatcaattacaaaggtgtgtctaacggaggttcttatcattattggaaatagcaagcaaataaaacagaaaaacaaatttaatttacaaaaaaatgtcaatcaaaaagtaataattattcctaatttgtgccaagtctcgttttgtaaaactgccataagaaacaaaaacaatttaatcaaaagaaattcagattttgattcaaattcaagcaaagtttttatggcttaaactttatatgtcttaaaaaaataaaataaattttcctcttttaaatataattcaaatttaagaattgactttttaaataaaatttaatttaagaaatcgccaatttcgttaatgtgccgggcggacggtggtgtttgtccactggcaattttatgccaaaaattggccttcaatgttcgccaagttggcgccaattggaggcggaacaatttattttggtaaaaaacaattttttttgccaatttttcaaattagaagtaatttttgccatcaaattaaggtggcgctcgaggtgggcatccgattgtttgacacgtcattctttggccataatcgtggacaaataagcaaagcaattaaggcatataattttattagtcttttgctaattaatgtgacattttacaaatacataggaaatataatacttaattaattttatttaaagaccgaaaattctttttcggcctgttgttgctatttgggttagggctctgaatagtcaaaattgatgcaatggtttgagattaatgtcatcaaaaatccaccggtaaacaaaatttaatcacttaaatataccaaaaataaattaattaaaaatagcgtttttggttattttcaagaaatttttgccattgtttggtctgctacgaacggatgtgtttattagtgcaaaaatcaacattgttcggcctgaaaacgcccaggatttgttcagatatgggtgggtttggattaattttttattacaaaaagatgagatttgaaaaataaaatattaaaattacaagagatggacacaaaattgcaaaaatatggatttaattctcaagtggagattaaaatttaacaaaaaatccttgaaagtcgcaatattacaaactaaattctcaaaaagcgccaaatatggcattaaaacttagaagaaaaaaatacacaaataaagctaaagttttttagtttttggggaaaaaaagaaaaatatgaaaattttgccaatttgggacttattttgatataaatatttagcaatttttaagaaattattatttttttattgatattttcataaaaatttcccaaaatctttccaaagaccagattttggcattagggattacttaaaagtcagagcgtttgaaattttatgagatgtttcaactgattgcctttatgccaaagtttcaactcattctgaaaagtacgaattgaataaggaaatatgctttttaaacctaaaaaaaataactgcaaattccaaccccctgctttagaccgattaaaaaagaaattgactgcgaccaattcaattcggttttcgattacgcacattttagcgtgaaggagtgcatcgaccaatttgatgggtggcttttttattatttatattttgttatttaggaattttaaattctctaaaattataacttttttgtttttcaaatgtttcctctttttaattaaacattttggtataaaatgcattttttagtaaataaatatttaaatcattttcaacaatttttcagctatattgacttgtgcatggttcactatgcgaaggatgcttttaaaaatgtgtcaaacacttgctcaaataacagaagtgaccgtgaagaagtgtacagtgtgttagaacattacatgggtcagtggggggtcaatggcgcgacatttggggatttataacattggataccagtaatttggggacccaacatttcggggtccggaaaatccgttaatggacaacacgtcagcggacaatccgtcagtaatagacaatctgtcagatgtccttaaaataatttgatgtccccaagtcgcaaatccccaaatgttaggtagccgagtgggtcagcatcattgatttttcgataaattctgaatttttttgttcataaattggagacgagaccagttataaaatacaaaattttaattttataaatatgctttttttattttttaagaaaatgattttagatccgcccaaaaatcttttttggctcggatttcgggattttcatttcgaactagggattagctctaatatcactgcttagtacatacaaatcccctttctcgtcaacagacattggcaccgttcggtccattggcgtggcaaatttcgactcagaccatgtcgaacacttagtcaagaacggcatacattgtgtgccggccgttgtccaatgcgaaatgcatccattcctacagcgtgacgatctgcttgattactgtaaatccgcagggattttcctgcaggtggtcaaatttggaaaaataatctaaaaagtcggaagggtcagtgaaaaatgcaccagggaatcagataattttctaacaaaatttcagacgaattttttcaaattaaattgttaagccaatttgtgttttaaaaatttaccttgcggcacaaatttgcacgaagggcacaaaagccccttaaattttttctaactataacctaaatacttaaaatttcgccaattggatttgaattgtgagtgtctgtttctcatgtttgtggatatggtgctagatggtcctagaaaagtttctcattggggcgagccaggggacaaataaattagaaaatcttttctctattaattgttaacttttaaaggcccacagcatttttgcatacaaagaacaaaaaccttcctacctaaagcaacaccagcgctatttgctgctgaaaagcatagcatcattttacaaaattggcacatcggtgagtgatggatgattggcatgttatgggcatattatggaaccgccccgccccctttaaaagttaagcagttgtcactttgtttcctcatgcaacgcgccccacatgttggagcagtaattgtggaacaaacggatgatttgtttctcacaaaaaatggccgtccacggcgtgtgatgtcatgtcagcagctcaggaaactgctgaacggcctggtggccagcgtgtgcaacaacagcgaccaccttgatgaggctgatgagcactacgattacgacgacattccgccaaaatcccaagaacatcagcagttgagagtaggcactgctttgacaaaaaaaggaggaatgtcacgcaaaatcggggccttcaaaatgtccggggatttccaatctgacactgcgcgcgaatataaaaatgaagacgacgattgagggaagagactgttattcaaaatcaaatcaacggtgctatgtcgatcgacgaaaagtgcaaatttggtgtatcgaaaaaagtgcaaaatctgcaaagtttatttttactaaattaactcataacttcgcaactaaattgcacaatcttggtatcatacgatagcccttgaattgcgttattagcttgtcaaatttcaaaaaattttatttaagttttccaaaagttatgaccattttttcctgttttttggcttggacttttgaaaaaacttaatgagttttttgaaatttagtaagctaataacgcaattcacgcgcaatcgtatgataccaaaattgtgcaatttagttgccgctaagaaaagttatgagttgatttagccaaaagtttagcacttttcgtcgatcgaccaaccacgtaaatcaacatctaatttatttttaagacagaggcgaataatatcaaaataaatataggggagggaccacaactgatgagtaaaaaatagctttttaggaaacctctcagtatgaaaattttgaattattcgaaattaatcgaaaaatcaaataaagcattgatcagattttttgtgtcgtgatttcggctttattaaatcttcaaacagtcggtcaaaagcccttttagttgttgcgcgatgagcacatgcgcgcgctgcaacggatggacttgggcaaatcagggggaggccgcttttcggactgtgaacagtggaaagtgatgtgaaatgatgccataatccgttatgaggataatgaaaacaaataaattagcacttataccgtttaacttgcacgatttttgaaaattttggtatttcaaagtcatgaaaccattctctttacaaaatatgactaaatgacaaagtccgggcgctcggcctatctgaatgagtccattgttttatcagtgatcaaatggcatgccgctaatggaaatttgaattaaatattaatttaggcaaaaaatcatatattaatggattttacaaaaaaaaaatatttatttatgtagatttttagtgaaaatgccaaaatatggaagtaaaatacggaaatgtggacaaaaacctgaaatatggaaaattaaaaactatcaatattcgaatgataccaattttgaagataactgacgaacaaaaaagttatggccattcccatttgaaattgtacgaaacgccattgtacgaactgctatcgacccatttttggtgtcatgtgaaggaatggatggatgataaaatgaagatgatgacggaaaaaaagggacgaagcggaggggaagcggggacaaaggaaggaaaaggggcgacgaataatcgcctccggcactttcccgtggtgaataataaaaacaattttagcattctgagcagcaattcagagatgtgtcctgacttttaacaatcctttttgtattattttgtttaaatttgcaagaaaattggacagttttccaactcaagctaaatttcttgggcctagtttgatgcctaggctttgttttgtaaaatttataggcgtcattgaaaattcaaatatttaaaaaatttaaagtaatctggctttcacagggacccaaaattatatagtatttaaaaaaaattcatcaggaaagtaattataatgaaaatgcattagtaatttatccgtttaaaatttgtgcggtatatttttatttgtttccaagaattcgtttgtccatttttagggtcttcgtgaccagccaatggagtcgagttagttgctaatagttaataataaagtagaaatatctttacaatttttctattacgacccattggaattgtaattaaggaaaaattttatttaatcattatttaccaattcttttttgaattttattcaaattttttgttaaattttggttggattattcgttcgacaatttcatttgtttcccattcatttgctgtttcaattgtcaattgcaaaatcattcgattaattggcaattttgaatgcattttcaattttttaaatgatcaaatctgttctcatttagcaattttggttcaaaataattattgagcaatttatttatttatattcattgtaattaccaaatttaaaataaaactgggaaattttcactagacaatttaccgcataaattattggctataaattttaattagttttttaaatacaaattttggtttaattgttagaattccattgtattatatgtacaaatattcgtacaaaatgtccaaatatttgctatatttttggcattttgtccgtttataatcttcatattcaactgatatattgtcacagtgccaattcgttctagatataattcacaatgccaaggtgagcttcgtatttttgctttgaatatttcattgatttacattttctgacaatttctagcaaaagcaattagtattttatcgtctttctattaaaaatcattaaaaaattaattactccctgattaaattgtcttactgatgaatttgcatttgaaaaaggaattagattaattataaaaattatagaaaaagcatttcatgttctttaataaaaattaaattatctctcttattaaagtaatttttaataaatataaactcgaaaatttttaataaaaataacttatttgttaaaaattacttagcttaaaacataaggtcaaatgtgaaaaaaacactgccttttattgaagccaggatcaaattgtccagaatttttatgatttatagtgaattggagaaaggtaatatgaataatataaaaatgtcctgatttttacgattgtcctgaaatggagaaaggtaaaaaaatataaaaatgtcccgatttagagaaagacaatatgaaaaatataaaatgtcctgaattattacgatttgccctgaattggagaaaggcaaatataaaatgccctgaattattacgatttgtcctgaattggagaaaggcaaaatgaaaaatataaaatgtcctgaattattacgatttgccctgaattggagaaaggcaaatataaaatgtcctgaattattacgatttgtcctgaattggagaaaggcaatatgaaaaatataaaatgtcctgaattattacgatttgccctgaattggagaaaggcaaatataaaatgtcctgaattattacgatttgtcctgaattggagaaaggcaatatgaaaaatataaaatgtcctgaattattacaatttgtcctgaattggagaaaggcaatatgaaaaatacaaaatgccctgaattattacgatttgtcctgaattggagaaaggcaaatataaaaagtaaggaattattacgatttgtcctgaatggagaaaggcaa

SEQ ID NO: 1233 - DNA, 2872 bp, Heterodera glycines
ttcgttctttcgtctcccccccccccccccttcaatttgttgcggagttgctgctttgactgcctttgctgctccttttgttgctcctttctccttttcgtccgtcgcttcctttttctcttccgctgctccttttcgtcctccttttgttattctttttgttgttgttgctcctctttttgttgctccattcatttattattcatccatttttaccatttgtttcccatttcatattttatttttactttctaatactgtagttgcccttcttcataagtcagttttcttctcttttctctcccaagcaatcaattaattaattatttctcttttcgatgctttgtcatcaaaaatgaacgcttttcccattcatttttcaatttaagttttaatccgaaacaaacgatgcgtcaattttctttgcgttctttgagccttccttctctcactaaataatctttcaaccaatgagaaactgtgtattgtttttaacatttcgttttattttcgtttgttttgtctgctgtttaattgaatttgttgccttttgagagttttttgacttttctgaaattaattaattgttttttcacaaaatatccaaaaaagcaacaaattccgccaattaattttcgtcattttatgagtgaggcaatgcactcacagatttgttaagatgaaacataaataacaaaacataaatattattatttttattttattttctctgatatattttcgtttaaatttgtttttcaccaaatatttaatcacgaattgtttttcttttgtgaacgaataaaaatgagaagaaggattttgtttgagtgaccacaaacaaatcgaattccattccttccctccctcccaaaagaatttgtggcacggcacgtgccttctcaaaaaataaattttaattttaatgacaattttttgatttatgccgttcaaatacaaaaatgcaaattgatcagctgattgtccctaattgcctcttttttctccgtttctcagtttctccgcaattcctttgaactgagtgaccagcgaaaaggaaaaaaattgaattttgtcgtgcaattttttgaacattggcgcactgtccgtaagtgccgcaacagccgacggggaacaaatgagcataatttgagagaaataattaatgtaaaaatccaaattcacaagcatttcactgttttgcaaattttcagggcgtggaaaaattaatattttgctaataatattctaaaaataattaataaattaaaacattttgtttttccgtttgcattttccttttccttcacttttcacctcaatttggtccaccacttcgattgccattgtcaaatgctttttgtccgactcctcaaatcgttttcgtatcgctttaattgtctctttgattaaatctttggccggcttttttatttccaaaatggcaaatgccaatgaagcgaatttctgcaccacaaaattggccattccctcgtgctttccttgcgcattgtgccaaacattggcaaacggacaaaaggcaatttcgatgccaagaagtgccgtgtccaatgctttggcggcggagaaaacactcagttttttcaggctaaacttgaagcgacacaattagccaaacccaaaaaaggcactcaattttaacagatcacacaaaaagggggcggggtgggaatttggcactttttcacctaaattgcacaatttttgcgtttgccattgtttggtccgaaatcgtttgcaattccgccttttcacgctgtgattgtgcccgaatgatgcgattcatcagttccattcgttgcaatcgaaactcagcaaagtcaccaataattcggtcgattttgcccgggtcgtgcggcaaaatttcaatttcatttttattcgaatttccttctccgattatattttcttctttgaccgtttttagaaatttgtgattttgttgcgtttctttgtgaatgaataatcaaaaattatttatttacttataaatatttattataattaaatctttaaattatattttcttttttaaattacctccgttttggtccttttttcgctttgtgctcactttattctcttgaccattttcattaattttgccatttaaaaaattaaactgaaaataaatttaaaaataattaaattaatttatatttttaaatataaatgccatacattttgttcaatgcttttcaaccattcttcttctttttgcatttcctctgctgatttaaatgggaaatcgtcgcgtgaaaagtcaaaaagtgaattcgaatggtcggaaattccccgggaaaaacggggaaaggcaaaaagagaaggaaaaacgaaaagcagaagaagaagaagcgcaaaagcaatattcatttaaagtgtgaacaataataataaaaaaaaaatttaaggaaaagccaaggaatggaattttcataattaaaagccgagggttttctccttttattgtgttgatgagtgtaggcaaatttgacagtaaaatgaaagcgtggataaaaatgaagacacagaagaaggggcgagagagtaggaaaaggagagagagtgcgaaagaaagagaggaaaagtgaaataaaataataattaaaaatattattttcaaatccatttggcatcgtcatcatcattcaccatcttcatccatcactagatcatggcatgccaaaaggaccgccctcgccatccccaaaagatgttagccaaccgtcagccgaaaaattagatttgcaatattttggcatacaaatcattgaaaaaatatatttttgtattaaatattgcgaaaataaatttagaaaaagtttttctgttaaaatgttactcgataaaa

SEQ ID NO: 1234 - DNA, 3577 bp, Heterodera glycines
aactttgaacaattattaaattaacaattattaaattcattattattttatttaatttgctaaaataaaggctctatgttaattgaggcaaaaattaaaacaaatttttaaatttaaacaaaaagaaacttaattaaattaaatttttatcatttttgaaggtttgcgaaggaattaaaaagggcgaaaatccaaataaaattgcggaaaaaatggcgccgcgactgaaaagaacggtggacgaaatggacaaaagcaaatcggttcagaaagagctgaggaaaatctctgccgaagtgattgatttttgaattttaataaataattaatatttattatttaggaaatgccaaaacgaagccgaaggacaaaacgggcaatttggacgagaaaaaggaagcgaaggggcggcagagggagaagcagcagaaggagggaaaagctgaccatcggaatgcgcagtttcatgaagctcagaccgtacgcggagcattattgtgcgtttttaaatcaaaaagacaaaatgaaaacaatggaaaagaccccgaggggaaataatttgaggaaacttaattaggacaatagtaattaataataatgacatatggtcaaaattaggacaattagaacccttataatttattttgggaattcgtcataattggaacacaaataattttttggttttgtaaattccgaaagaaaatatgggaatgaatgccatgccaatgtaaagtggtgacaataaatgtcatgccaatgccaatggaatgctgcgttttgtttagtgtccgcaaggccgggcagactgaacgcgcgttcgccgggcgcgcgagtgcgcgccaatcggcggaacccgcgaaggcacaaacgcggaagtgcgggtcatttcatctcgtgcacattcttctttctgctggccatgttcttcgccatcaacaccatgtcggcctttttcgccatcttttcgcccgcttttattttcgcaattgtcgccactgttgtgctcggactgatcactggtgagtggggccaatggctgatcagcgtgactcattgggcatttgagtattgttgattagacacacaaaaagggcagacgatggcccaatggttgaactgccaatgggaagaatttgccgattgggttcgattcccatccgccgccggtgcctgacacttacatatttaatcaaaatgattaatctctgttcatcaacaaccactaatttctaatgatccttgtcaattatgacttcttctgtttaggagtggtcacaagtgcgtttatgggcaaatgttccgggcccggcacaatgggaggagcatatgccggctattatcaacaaggtcgagcaagttgaaaacattgattagtgccaccaaattcgtatttgttcccgttaggtcacggagtgccctattctgctcacaatcagaatatcgtcggttttagcggcggacacggtgacggctttggcggcggctttaaatttaaaacgcccaaatccaatcacggatattcctccgcttggggaattccttctcagcacggtaattagtggcaatcacaaacggataaaccgattaacaaaattatatcaatttgatttgcctcacttttatgctatcatcacaatgccccaccgcccgaagtgtatttgctggaggaggagtatgagatgaaacgcggacgcggcttctcctcctccgcttcgtattccgcttcttactcagagtccgacgagtacagcggcggaaggtcagtggagcgcagaaaataccgacggggaggaggaaaacagtacaaaagtcacttcagggagaggagttacggtaaggagggagacacatacggtagactaacaaaacaaatgaacaaaaggaagaacatattaataatggaatactatagtgggaaaataacaaattttaaattaaataatgaaaaaataccgtagggtatggggggagggtaaatccaatggttaaatttggcaaaatgccattccaaatattttcagatgattccggcggggcggaaaaacgcgtggaggaaagtgaggaggagaaaaaagttaggcgaagaacggtgaccacttattcacgtgtacagtactgacaaaagagaagagaaacggtgtcacataagcaaatttactacctttagagagttcaaaggcattttcatccattttattcatttttcccattttatcataaatttgttttaaattttaaatcttaaaaattaaaaaggaaaatgcctaaaaataaataaattcaataaaaacaaataaaatattcagttttagtttcaaaaaattaggtaatagtccaattagcatcattagctacaccattattatcaatcactatgatttaataggttcatttgtttgttttttgtttgtttttttcgcccttttgctccttcttttaatcaaatacgggttttccaattacataatccaaatgaaaaaacagaggtcgcacttttttacaaattttttctccattttacgctaataatgcgcacaattgttcgcacgttccgccgcttcgtccgcacttccccgctcaaattgcgcagaacgaaactgcttggcttgctggctaatccgcattcgacgcattccccggggacggaaggcggcggggggaagggggagcaaatcggggtggggcaaaaagcaaattgcgcgcatagtcgccccagggcatgcccaaaggccttcaaaaggagcgcctcctcggcaagggaaagcgctttccttctcatcgcacaaaggcacaggaagctgaagaaagtcagccagcttctcccgtcacccctctgcaaccgccaattgttatccaaccaccgatttggatttagcgaatagccccctcccaccccctccgcccattcatccatccaacttggtttcctaattccgattgatggtgggtcattatccctcattatccccccccccctccgtcgattgttcccccgcgaaatttgtgggcccactcactcatgggaattgggacaaaagggaggcaaaaaggcagaaatatgctggaacatcgaagcacaaatccaaaaaacagaatcaaactttagggatttacagtaattgggctcatttgtcagggaattgtttttgaaaattcccaaattttgtttaatttaatttctgctgacttttcaatttaccaattatttttttaatcatttaaatcgctttgaccttaccccaccccaaatgaatgaatgtttgttgtgaatgttaacagaattgggctgaatccgtttgttcgttcgttcttttggctggaaccattagcaaaaaagggaggggcaaaaagctgcaataaaagcacaaattggccataattttggccgtttacccttaattagtctgtccccgagcaaataaaaagcggccaaccaaaactcgaaaagtttatttttattttttctgcgtaataacataatgcacctgttaggcagtttaaacatgctaatgcgcgactaaatacaaaatcgcccccttcttttgcaattttggcattttggatttcgaccctc

SEQ ID NO: 1235 - DNA, 4115 bp, Heterodera glycines
  misc_feature (57)..(57): n is a, c, g, or t
  misc_feature (66)..(66): n is a, c, g, or t
  misc_feature (97)..(98): n is a, c, g, or t
  misc_feature (205)..(205): n is a, c, g, or t
ggtcaaataaatgcatacatttttaaatgccaataccttcaatatgtatatttttgnaaaagtgtntcaggcacttaaaatgtatgcaatcggtacnnccttagtaatataattacggcatttgtttgtaattgttgcatgacgaagttgttttttttaaatttttgagttgaccccgccaattgaattgcagggtccccccggncgttcctggcgaagccggcgagcccggacgccccggcaacgaaggacttccgggagctcagggggcaccaggcgccccgggctcagccggatccccgggccaacccggcgaaagtggccaaccgggacatcaggtgaggacgaccaaagcaattcggaaaacaaatcccaaaaatcctttaggggcctcccggcgaacgcggcatttgccccaaatattgtgccttggatggcggagtgtttttcgaagacggcacccgacgttaaaaacaacgaaaaataaaatttatgcgatttgacaattggaaaaaacaaattttaattcacaatagtaaagaatacacataaaagcataatatccattttggtcatcgaagaattaaatatttgccttttgagattgtctccatattggtaaaaacaattcctgaaaataggaatctaatttagaagcgatttcttaattacatttttaggaatttttgaaaatgaatctacccaaaaaaaacttcttaatataattaaatgaattcaaagaatattggtcataaattcgatataaatttttaaaaaccgaaagatgtttgtatttacctagggagcagcccgtttccctctctccctccgagattttctaagatttgttttttaaatttcctcgggtggaactgagccggggggggggggggtacgtagtgcatgcacccatttacccaatttttgtttgttcgtatttgtgcttattcctcccggtcgcggttttttgagtaaaaaccgggaaaaggactaaaatccctgtcaatttcgcttcaaaattccagtctaaaaatgcttgaacaaagacaaattctctggctttttcggcattcccaagtgtttaaataaaagtaaaaaataattctctctcactcggaatcttcgtgccgaaccatcggacaatgagtaatgcaatctaacaaatgcccgtgccatcttcagcctgtgaattttgaccggctgagaaacgtcttccaattctttggtgataaaatctttggccgacaaaaggaaatgggtgtccaaacgagcgtattttatcagacgttcagagaggggcctaaacagagaaaaaccaatcgcaaatcagaaaataaaaatggagaaacttaccgttttgtccaatcgacgcccgcaataaacgatttacttttgtgcaatcgaacgccgcaagaaaaacaaatgagccgatccaaactcagaccattgacatgttcgactgtaaaagaacgatggcattaagaataaaagttggagcaatgctctttttaattgaattgttaccattggcaaggcccacagtgaaagtgtctaaaagtggcacagtcaaaatgccgaaatcgcgcttcatccaatgaacatcattttggccatgggccacctgaaaaagctaatcataaatgctctcatcagcggcgctaataattatcacgaactgtctttcggggctttttcacaaaaatctttcactaattttattaggtattgtcgccccgggagacctcacaaaaataaaggaatggtcaagctctctaagattaagtggaaatgattaaccttcataattccttcgttctcaaaagcctttttcagcaaatgcattctgttgcgcacttgcgggttgagaatgtcaatgataaaatcttcgcgacgtgttgaaatctgtgacaaggaaatttattaaatttatgtaaaattacacgattcagctgaaaatataaatttaattacctgaagaaggcaggtttgttgcgttttatgatttggcaatgtgtgctccaaatcgaaagcaaattcgcgcaccgaattcaaacgaatgccgagtcgctccatttggcgggccgttttgatgtaatggcaaggcacacgggcgagagacgtgtcgacggcatcttccgatgagggagagcgaaactgaaggggaaaagacatgcaaaataaacaaaaatagaccttaaattgggaaagtaaaaataataaacaaaattaaaaattggactttagatttggagacaacggctaattgaggatgagacggtgaaggacaatcggacgaaaaataagaagaaagcattaagtgcttgggagaacattggcaaaacaaagaaggaatggcattgaatcgcaaaaaagttgggcgtctcattaactaaagatttttaaaggaaaagggacaattttggtgcctgagcttaaatttgcaaattaacgaattttattaacgaataaaatgaaatgccaataataataattaaaattcaaatttaactttccaaaagcacaaactttaattagtttctgacgatagcagaaatccttttaaattttaaatgatgttaattgctactaataactaaattttagctttttctctgtatgttaatcgacaaaaatcgcctgcggagtgccttttggcgagtgggctttttcaaacgcatttctcgggacgtggccaaatgtttgctgtgccatcagaaaatttcgacaacgaatgggaacaccaccggactgaaaaaccatttgaagagacggcacgcggaatatgagcattttgtggaacgtgtcaaagaagagccgaatgtgtggcttaatggggccgatggtcagttgcataatttattcccttttattcaatataaaattcttgacatttaatcctgtttcttgatcatattttcgcaaaataaaaaattataattgccgtttttataatttagttgggctaaagtcctttaaatactcgccaaaataattttgtcaagacattcaatcaagtgtaaaagtgggaacaattttcctcgaccttacagccatctcaaaaaatcataaaaatgaattaattaataattaacctttgagtaaaattaaacagttccaaaactcagattttcccctggccaatgggtcggatggaaaggattcttcgcaatttgtcgctggctgtgagtcgtcctctgtgaagcaaacagtcacggaagactgctatattggcaccgcatatactgagcaggaattggccacactttgccacgaacattgcctccgggcaccgcccaatggcacaattgagggcttaaaggtgggctaaccccccacttttaattcctaatcctccatcattttgtttacgatttagcgtgtccatttggtttgctcgtataactctcggccatggctttgcccgtgtcttgcggaatgggtggcggacacgggggcactttacatgcgcggagaacacaacgaacacccaacagaagccaaacccacgggagaagaggaggagaaagagaaagcagagaacaatgaaaacggaaaggaggaaaaggaacggcaccgaagaggagagggggaaagaaagaaatggggcaaaagaacactgaaaaaagagaggagcagcagcagagaggacgaggaacagacagagggacaatgcacggaggagagagcgcgagggaggagagagaaaaacaaacgacaaaattatggggtgaagaaagagcgggtaaagaaagagaggaatgagggcactgctgacaatgaacagatgggacaacacaatgaccagcagagaaatggtaagtcggctggaggatgggccatggcataaggggcacagggaaatttacactttttgtgggggggggggtaaaaagaggtcgcatcgaaaagattttgaggtaaaaaataaacacattttcttaaaagttaaccaaggcctaattcaatataattaaggttatccgaattaattttaagcaatcctaacatctgttttaagggctattcttgaagcgattttaaaaaataattaaaatttggtccggctttcccgacatgcgccgccgggcaaattttgtaaaatgtttggatttctt

SEQ ID NO: 1236 - DNA, 1430 bp, Heterodera glycines
ggggaaagggaagcgaatgcgccgcttttcacatctctctcaaggtcaaaacacggaaatgcctatggcagcagaaggcatttccgtccaatctttgtgccattctccgttcaataaattctgctgtggaaataccccaaaagggagggtcagattttcggtcactcactttcttttatcccattattctttcatttttaattgtcccattttgcatttgctccttttagtgtctttgccgtgccacttggctgtcttcgcaaaattccctctttcaacacggcacccataaccatcccatcaaaatggacaccgaaaatactacaccgattgcccgcagtttggcaccgaaaactttttccgtctcattgtcagagcgtcgtcttgcgccgcattcctccgctgtccgtccgctgctcaacaacggcacttccttctcctcctccgccacatcccaaatttgtcctcctcagttccttaaagcgcataacggtccttgttggcaattgagcgccgttttgccgccttcgttcagtgaaaaaatgatgaccgaaatggcacttccgttgcgctttgtcaacgaaaagaatgtcggccgcgcgtattacaaggcgattgactattgagaaaataacactctcaatgttaattgttggtgttttgctattttcagtgtacaaattccgaatgcaaaacgactggcgttttccttcgctccattcgcgcattttacacacgcggcaagcactcgtgccaaccatcgcatttgaatggtctgtcattgacaaatgttcacaatagtgacattctattgaaacaaaacagttcattgactcttgttcttcgaaacctttacttattctcacatatgttgtttaaaagtggtataattaaattatctgttcttatgtttttacccgtgtaatatgtctgtcccgtatttgcgcctatgttaaaattttcaatggattttattcctttgacgcattagtgaattattaatttaatttgtgcgttaggcaatgagtggcctttcctcgttatttgctttttgggtaaatgccactttttcaacatttggcgtctaaatggaaattcaataacgacgcttccccccatccttcgcttccctccacactcgtcccccttcccaaaggaaggaatgcgggcagtgagtgttgaaagtgtttgggtgtcccttccaatacgtttgtcttgtcatccctctgttgttgctgtgcggtgctaatcctatcatctttttcatttataatcaaaattttatttgctcggttttgattatttttaaccccgaaaattcttattccataatatgcaaatgtatgctatataatcttcaaaatgtgcttattgtgaccccgaattatattttaggaaatgggatgttttggaaagttttcggtacttgt

SEQ ID NO: 1237 - DNA, 3380 bp, Heterodera glycines
aattgggcacttttgctgggcctctgaaaaaaaaattcaagggctcaaccaattacaaatccttacaaaaaagcccccctttggaattttctctcgtgggcctccaacaacagccaaagtgccataatttatttacccaaaatgttctaggcccgttatattgcggcatgcattgacgagatcaaagtggagctacgccaggactccatttttgtgaaggcaaatgccatcgaaaagttggcatatgtaagttttgaaatggattttttatatccattaacacaaaacggagtcgggaggggtggggcagtgaaatttcgagggaggaacgagtgaaattatgaaaaaaatttttttttaaatttcctcatttgttagtaaatcaaaaaaaaggtgcatttttttagttgcaaatgctcggctacgacatttcatgggcagcatttaacatcattgaagtgatgtcgagcacgcgttacagcgaaaaacgcattggttatttggccgcggtgcaagcattcaatgacgaaaccgatgtctgtgtttagggccctgggtttttccaaaaaattaaaaaaaattttttagaaacatacgacacataatgcaagggggtagccagactttttggtgcaaatccgttcagaatttttaccaaaattatcaaattgtttcctggcagcgtctgccggacccctcctttcttgagtttttttttagaggccgaaaagcaaaaaaaaaaaaaaaaaatcgccacccaggacggcctacctccccctccaaagctagggccaaccccctcctcttttgcttttttcacccttttaatttttttaatacgaaaaacccaaaatttaaaaattatgtagggtgcctaatacatacatatccattgtacctcaccttcacccctggaattttcctttgttggccagctcatttcccctcgtatcgccccccccttctccaaatttttgtttttttaatttcaaaatattattttaataaaaaattttttttgcaatttttcccacaacaattctatcgcagtgtcaacaatgtcaccgccgttttggacgcaatgttacgcatcaaattgtccgttgtgcccggcccgttgctcagcgtgttcgtgcaaaacattgccaagctgtacaccttccaactgtgcaaattggaggcggacgacgattgggacagaattgaaacgttggacaatttgctcacctccaaattgcccgagtagttttgcatgatttttggtgtgtgaccccaaggaaattatcttttgggaggtccatgttttaaaacgaaaatcagtggcctaattaaaaaattactattataattctttcagaacaaaaaacccaacccgtcatgcagaatttgtagcaattgacgaagccgatgaatggtgcaaattgcacaacaaaaatttcactcaagtgagtttttgtagagtaaacaacaaaaattggccttgaatttcgctgtaatttgtgagggtaatttgggagattaaaatcagtggcctaattaaaaaatcattgatttttttcatttggatcatgaggcaagcaactgttttcgtgaatcttgagccgtgtgtcatgtgtgccagcgctttgtatcagcttggaatacagcggttggtgtttggcgcaaaaaacccgcgtttcggtggcatttacagcgtggcaagcaacacggactatggccatgaacaccaaattgatgtgcggatttgcttattttcaaaaaaaaattaacacccaataaatttttttacatttttttttgaatttcaagaggagtaccataggctctattttacagtttacacgacatacaaaaatttaaacgattatttcgatagctctgtgagttttttagtctatgaaggtgaaagaatcacccaagaaataaaaaaagtgcgaaaaagcgaattaattttcattttttaaattttctatgatgtccaatttgtttatttgctgtttaagataatttccgaggttgacaaagaccgatgcatcgcattgttgaggacattttacgaccgggaaaatccatttgcgccggaagagaaaagaaagacaaaaaacggcggccaaaatttcgtgacaaattattgatgaatattaattatttttaatggttcaaattattctgaattgattgatgcaaaaatggattaaataggaattgttatacatattcatttatatatttttaataattatcaaattttaattttgtagtgcttaccatcattttattttttttgaccaatggccaccaaaaaaagacaacaaaaaatgtcggaggaaaagcaaattgggcgcaaaaaaccaaggagtttggaggtaattcaatcctttttctcttttgtatttcttaccgaaaaaaactgaatagtgatcacaaattccttatttttaaaatccattaaatttagaaggaaaatgtcgaaacaaaaattgacgacgacgaaacattgttgaaacggttggacaatgtgttcatggtaaagcatccgccggaattgctccatttttggcgacacgcggtcaaactgaaccccaaaaagccattgggtaaatatttttttacaaaaattttaaaaaaatgtaaattttcaaccctttttgtagcggggttggaaaaaaaattttttttttttgttttctattttgttgcatttctccattcttgggataccattggcctacacatatttccccctacacagatgccttttcggaattggactcgttggaattggtcggcccatttttgcttcttgccgccgcccacagcgaacggcacgccaaaaataccaaaaatggcgccacagcaacagcggacgaagacgcacagcaacagaaccaccttttattgggttcacgctttgtcaccgatttgcccgagatggaaactctgctggtgcaccggggcggacgcttttgctattggcgcgatgtgccggaggaaatgccgaacattttggtgcatgtcgccggtggagggggaggggagggacatgtaccggcgatgaccatttgcggagagcgcgacctttttgcggcactccaatttgtgttgaacaacttggtggacacgggtacaacgacgacggcaaaggcgaagagacaacagtccaacaacaccggcaccaccaccaccagcaatactgggtaataatgaagcaactaattgcccaattagaaagggtccgaaattcaatgaaaatttcaacaaaagtttttttagtgttttttcaaagaattatactggtatctctttcaaaaaaaatttcccaattttttttttgtatagaaattttgtgtactttcactaatgaccaagttttatttact

SEQ ID NO: 1238 - DNA, 5721 bp, Heterodera glycines
tgatggtggtcgtcctttgttatcccgcgccggtgccctccaccccgcgacggctcttcttcagatggttgtgccatttctgcttcggtgttgggctgggcagcggctaaaaactgaaaaattatggattttatgaaaaagcaatagaaaaactcacttttctttaccagacgagcttctgtcgccttggccgtttgcgctttcctctcctcccgcttcttttgacgctctttcactccgtttttgccgtgaattttaggtaataattttctttttcccatctaaaatttaaaaaataagaattttagaagagaaaccgttataactttttagttaaccctttttttgctcttaaaaacccttacattttgttcctaatttctttgtctatcgatatgcaaaatgtactgacatttcgcctactcgacatctcgcctaccgacatttcgcctactaagccaaaaacattcatttcgcctactaagccaaaaacattcatttcgcctactaattagtaggcgaaatgaaagtaggcgaaatgtcagtaggcgaaatgaccgattttgggttaccgtatatactctttttatatgccagtctccattaatctgccggcctccaattatatacccccttctgaggaggttgaaaaataatataccagtctccatttatgtgccaggggggataaatagaattttttaaataatttttttggcacattttccaaaaaaaaaattaaactcaattcaacagtaaaaggggctaataaatgaacaattcgttcccatctccgactccatccagccctgcatcatcatcagagtagggtcgctacttttagtgacggaaaatctcgaaatagttaactaaaaaaaaaaattgtgggaagaattttaaagaaaattttccaattcttaggggtgcaggtcgttcgttggcagtcgtgcgattctccattcaaaatctattggccgttgtccatcgctctttcattttgaacgtcttttgtgaccacgagtcgctgcagtgtgaattttggtgaaaaataaattttcgatttttgttcgaatttgggtccggggttcgaaatgggtcgaaacggatgccggattcgtgatcagtggccccaaaaaccccaggagagatgttttaagagatttaaaatttttttattttttttgaataggggggggacaaaccaaagtattaccaaaatgtttaggtcgtttcttaggggtgtattttttgattttattgcatttttgttaaggaatttcctaaatgtcgaaatagtaaattttcactatcgagaccgaaaatttcccgagactcgagaccaattttttatggctctaattttttgactcattttacgaacaaaatctgtacacaaaaataaaaaaggcttcttcgtgatcgttcgaaccctaggggtgtatgtttcgttttagtgcattttgttaataagaaaattagaacttttaggtcttaaaaataaacaagaaaatggttatattataactcgaaaattttattttcgtttgaacgatgagaagtatggaatatgcaaattcttggcaccacaatttctagacaattccattgctttcgccgtctatttcaatgttttttttttgttttatcgataataaaaaaatttgatgaataatatatgaacaaaaataagtttattcgtctctatatcacagctcagcaaactcattcaaaacagtttcctgaaatttcttaaactcagatgccagctttgcatgctcctcgcccaatgtcgccattgcattgtgcaaatatctgaagtcagctcgtaattgcattgcctcggcgtttaatcgttcgttttgggcaattattttttggttgtcatttcgattacgccaaatgctttcgccgatttgcaaaatggtcgccgaaaaagttacagcaagaccaaaagcgcccagaaaaagggcggcacagcccacaaagaaagtcatgcttatactttgcatgtcattttttatcttcgcttcaagtagcaagtcctgggaaggtgtaaaattaaaattgaaaattgctaatctttaccctttctgtaaattccacaccatcaacgacgttgagaagtgcaatcttaaacggcaaaaattgtaatgaagatattacaaagaattctttggtttgtttatagaccgaccaaatacattaaatttcagtttttatttcttatcgcaaaaaggcacattcagtcctatagtttttgtagctgattattgtacccatctttaaatgaagtaaaatattattttgtttacaaaattgaccaaaaaaagaaatccggtgaacaacgccttgacggaaagaagtcgagccgattttggagcagcacggaaacgggttggctgtttcggcacatccatgggcagttgaccagcgtccgacgctcccataatgtaatgcgactcatcagtgaagcgctaaacaacggcaaagtgtcaaatggggttttgttgtcctcttggcactgcttgaactccacctgggccaggctgatacaaatcagtcggtcgccgtgtccatcttcgttcttgaacagtcgccaaatgtcaattttgtcgagcggaatgtcgcgcagtctctcttcagcggatggctcatcatcgtcgtcctcatcggatgaccgtttcgtctttgcgtcgttgaatttttgcgaaaattcctcctgttgaaaaaggggatgggaattaattacatataatcattattaaaattagaaaaataaaaaatccaccaatttaattaaattttggggccccgcttttttagcaatcgtttttcaaatcaaaatatttcggcacttttccattttgcggccatgatgtcatgaaattctgtgccttcaaaatggactcaaaaaaacggacaaaatctcaacaaaaatttgtgccgaaaattgaattggtttggtgatggctgtacattgtagtctttgttgttcttgttgagcgtgatgaacatggctttgctgacgctgatgtaagctcgtctgcagatgatcttcttcactttgctcagtttcatggcgagtggaaggcgtatttcatgggacgaacatttgatggggtctccttctcgggagatgactgaaaaagggggagaaattttatttgaaaatgccaatgtttgtttgtttttgcatgccgttgaatgtaattgcggtgttctccggaattgggatttgcaacgacagcattgtgaacagctcgaacgtcttggacgaatatgtacactctgtgcatctgagctcggagacggactgtccggcgaacaaattgaaaatctgaaaaataaatgccattgtttaaaatgccgtcagaatcgagtggtgctcctcttccttaccacgctgcctttctttggtgcgagcacttcacttctccaatgctgttgcatcatgtcgattgcattgcgccaattctggtcgtcccgttgagcagcaccaccacccgcgccgtcatttttgcgcagaacgcccttcatcgtctcgtgcagtgcgtccacgaagaattggatgaactcctgacagtcatgttggaacgaatcagcgaacaaattggtacggctggagatgacttcctgaaaaaacagcgagtcatgaaacgcaacatcaccatcaccaacggcacactgtgttcaccacaccttcagttcgaatggcgccgccggttgtcgcaacaccaaaatgcttttgatcatttgcacatattccatgacgagtttgatgttggccagtcggttttcgctgaaaaaagaggggtgaaaacataaattgatggcatcggcatttgacaatggcattatttattggcacccacttttgtaacagaaaattgaaaatataacgcggagttgttgggggataaattatacctaattagggcccggatttataagtttttactgattttttctgcgaccttttaatttaaaaattaagcgttttaaaacagagccatagaggcaataaacaaaaacagaattgaaagtataaggaaacattctgctttactgcttaggatataaatgatcaatatcttttgtcttttaaacaaaaatttcacaccaaaactgacagggcagccaacttttgttacacattttcactacataataaaattctttcaatttttgcaaattcggtagatataatactttgtatatttggttaccccaaattctgaagggttctcggggggcgctaaccagggatctgacatccattatatccaattttgaatgtctaacctaaattcaagcaaaaaagcaaactccgaaaaacttagttttctatttcactcgagttcgggtaagagatttgtcaaaattggtataagattcgtgattagctactcccgaaaacccataaaacaagttttcacgaaaaaaagggccctcaccctgtggtttttttcggagtgccccaacagcaaaaaatgcagatatgaattcccagggaaagaacaaattgaaaaattttttaatgggtatttttaaattaaatttgtcacttttttaatctggcataatgttaatagttaaaaaatttgaacgaaatatgactacttctggtagataaaaatcagtgctatcacttcaaaatcacaaattccttttcaaaaatacagacagaccagaaatattcttttgaactttcctttttgataattgtaatggttaagatgcaattggtccctgatggcacttttcgcaaagtccgtaacaacattgaccgattgtttgacaaaaatttgaccgatttaatccgcggcattcggaacaacaaggaaaatgaggtgatgattgattgactgaatgcaaaagccatttgtacatttacaatttgggcacttttgctgggcctctgaaaaaaaaaattcaagggctcaaccaattacaaatccttacaaaaaagcccccctttggaattttctctcgtgggcctccaacaacagccaaagtgccataatttatttacccaaaatgttctaggcccgttatattgcggcatgcattgacgaaatcaaagtggagctacgccaagactctatttttgtgaaggcaaatgccatcgaaaagttggcatatgtaagtttttaaatggacttttttatatccattaacacaaaacggagtcgggaggggtggggcagtgaaatttcgagggaggaacgagtgaaattatgaaaaaattttttttttaaatttcctcatttgttagtaaatcaaaaaaaaggtgcatttttttagttgcaaatgctcggctacgacatttcttgggcagcatttaacatcattgaagtgatgtcgagcacgcgttacagcgaaaaacgcattggttatttggcggcggtgcaagcattcaatgacgaaaccgatgtctgtgtttagggccctgtttttttccaaaaaatttaaattttttagaaatataccacacataatgcaagggggtagccagactttttggtgcaaatccgttcagaatttttaccaaaattatcaaattttttcctggcaatatctgccggacccctactttctcgagttttttttgttagaggcccaaaaagcaaaaaaaaaaaaaaaaaagtttcgtcgccagggcggcctaaaccccggtcccaagatatgactaacctcctcctcttttgcttttttcccctt

SEQ ID NO: 1239 - DNA, 3706 bp, Heterodera glycines
  misc_feature (44)..(44): n is a, c, g, or t
  misc_feature (48)..(48): n is a, c, g, or t
  misc_feature (125)..(125): n is a, c, g, or t
ttttttttttttggcctcgaaattccaaccctgggtacataccncagnaaatttgtcaatttttcttaggggtacaaagtgcggctgtcaatgttgtgtgtgagttggccagaaaaaatccgcgncaattatctcggcctgcaaagcgtgtttttcaaattgttgaacacttcctccaacaattggatgctcatcaaaatcatcaaattgttcggctcactggtaacaaaacaataatgggaacaaattatgagttcgatagtgtcggattgattatttgccgattagaattattttttttttttggaatttttgtctcgtaaaaaattcaaaatttcggccccttaaagtccataaatgatgaactttttgtgtttaggtaccccatgaaccaaaacttggtcgaaaattgttggaaccgttgaccaatttgatcaactccacctcggccatgtcattgctgtacgaagttcgtttgttcattggatcaaatttgcatttgggaattccaaataatttattttttaattttagtgcattaacactgtgatcgccattctcataagcatttcatcagaagggcccggtgattatactccaagtattcaggtagatttttgcataattttttcaacccctacgggaattttcaaaaaaaaaatccaagaaatttcccaattactctcaatttctcaaaagtttcccattttccttgaaccgcaaaaaattgcatatagcaaaaacattgtgcagttttaattatgcatcaaggaaaatcaagaaaaaatttttattacccaattaacacaccaaacatttgacaaagtgtgaaatggttggtccaaaattggggcacaaaatgattgaacaaaaattggaattactcctgtttttgttacccttacttgtgagaaaatgttcgaaaagtgattagcaccactccccctaaaaaaaacttgaaaattctaactttcttacaaattagaggttttttcatattgtgagatttttcaaatgaatttcttccaaaaaaaaaaaaaatttctacatttttttataaaaaatcctacagggattttttgaatttgtttttaattgtctctcctttcagctctgtgtgcaaaagcttggcattttgattgacgattcggaccaaaatttggtgaattcatcattccgttttttttaaatttttcctacttttttccagaaatatttgggtctgctggcgatgggcaaaattttgttgacccatccaaaagcggtgcaagcacataaggacattgtgttgcgctgcttggacgacaaggacgagagcatccgtttgcgtgcgcttgacctgctgtacgggatggtgtccaagaaaaacatcatggaaattgtgcgccgtttgatggaccacgtggacgcggccgaggcatggcacggaagggaagggggagagggcccaaattttttggggttttgaaaaaaaaattgcatatttttcccataaaatttgcttttgaatggtggtggcccaaatttttttttttttttttaaattttgtccggcatttttttttcattggacaaatttttttgtaaaaatgaatattctttcggtaaatttcgatttttgattgctaataactcgaattttgggaaaaattgataggttttttttttgggacggggactggtttttattgttatttgctcgattgaattgagcaaaaattatgtaaattttgtgtcgaaaaaaaaaattttttttttcaaaatttacgctttgccatattttaaagggctcattttatcgggacgaactgctccgacggatcatcgcaatttgttcgcatgacaactacaaatacatcacaaattttgaatggtctaacaacaccgttttgaaagaaaatttacccatttccccatctcattttttgtcaggtacatttccgtgttggtcgaactcaccaaggtggagggcaccaaacatggcattctaattgctgaacaggttgaccattcattcacaatttttcattttcgttcaccatatatacatgcacacagatccaagatgtcactgtccgtgtgcagtcaatccggcacttttccgtctcccaaatggcacttttggtggagaatgcccagccgttgttgaagggcaatggcggccagcgcaacaatgtggccgaagtgttgttggccgctgcgtggatttgtggcgaatttgctcaacagttgcgttttgaaattggcaaatttcggggaccggtggtgacagggcggtcccaaaaatttcggtttggacggcggagggaggggggggggggtaccaaccaaaaaattatgcagggagatgcttagcccagggattttccatgtgaaagcagctcgtttcacttgtatcttttattttcaaatattatttaccatatttatggggcgaggaaacgtactgctcccgtcctcggggtgggacgaattaaccggtcaaaattcattttccccacatttctaccccagtgtcaacaatgtcaccgctgttttggacgcaatgttacgcatcaaattgtccgttgtgcccggcccgttgctcagcgtgttcgtgcaaaacattgccaagctgtacaccttccaactgtgcaaattggaggcggacgacgattgggacggaattgaaacgttggacaatttgctcacctccaaattgcccgagtaccaatacactgaccatttggaggcgcaagaacgggtcagcaacaaattaccgactaattactaggcctataattaggcaaacaaaaatggggcaaattagccaattttccgcatttctttcgctttgaataagtgccattgaggaaattttgataaactcatttccagacatgcaatctgattgccatgctcaaatttgcgtccaaaatgcacacgacaaatgtgaaaattggtgaagcgctcaccaaacattttgacggcgaactgaacccggtggcggcaaaagcgcaacggaaagtgccggtgccggacggactcaatttggacgagtgcatcaatgaaattgatgactcatcagtggaggatgagatggatgaggaggaatacgatgaggaggaagaggaacatgaacaaaaaaaacaccatgatggcattatgccaacatcgacggcacaccgtcaaaatgatcatcaacaacagcattatgccattggtaattcgtcttcgtccattggacgtgccaaaggccagcaaatgaagcaccgtgaacagtctccggatgacgcgtaccatggtggtggtggtggtggcgctccgcgagttgcctcagaataaagggcgagttcatatcgttctcaagaaaaatcgaacacctagtagatttagaagatcccttaccaccaaaatgtacatatgcctatgcatcatagtttagaagatgtacactccatttaacaaaacaatttaacgggtcaattctatccatactacacctttttaaatgccggagaccgtctccacaaatttcgcactccttaatttctcccaaacataaagaacaagtagatcgtgcaataataaaaatggcttgatgaatagtctcctttttcattgaacattcatccagaatcaaattcgcctaaatcataaagtcttatttttacacctaaaaaacacttagcgtacattccaaatcataagctgactatcctatatg

SEQ ID NO: 1240 - DNA, 1520 bp, Heterodera glycines
cctcccctctcgcaacgcgaaaacggcccattttttaaaaaatttgagaccctcttaatattaaataatttttcaccgtttttgtaccattcaaattctttcttttctgcgtcaatctctttttacaatttgtagaaaatgtcaatgcttgcctggtgagatggaaattaatgccagaaattgcgctgataatgaatggatgagtgattaataaaacctcctcaaattatttgaatctgatcagagagttcacttttctgcaatttccatccgcaagtactcccgtggacaagcttttctctaatcaccaaaagagtcagtcagtcattctcgtcatgccatgcttttacgcaattatatgttcaaattatcctaatttcgagaacctaattaattttttgttgttgtctattgcacatctcaattttcaatacattccgaaaatgcaacattttattaattataaataatttgaaattcataaatacaaaaaaataataataataaaacagataagaattaatgatgagtcatcattgatgacgaattggagtaaacccaaaaaaagtaatgtttctgcagctctgttatcagatatcaggcttatcacagttgtccattccaacgtttttcttttctgtccattgctttttcccttttcactcatttctcttcctctttctcctcctccttttcatcataatctgcattcatccatctcatcagtctcttcttcctcctcctcctcctcctcaatgacatcatcatttttctcttccttttcctcctcttcctcctcctcttttcctccttcctccccaattgttgtcactgttgtgatttgtctcgccaaatatccccctcctccaacataattattgttttcaccaccattgttgttcttgatcagttttgccgtcatttcatctcttccaccgccgctgccgatggcaccggcgcccacaccgttccgccatattacggtgtccttttgctgtttctgctgtacaatcaggcccatggttgcggtggaggaggacgtcttccgtgccatcatactcgtgctgctccgttccgcctcctcacttcttcgcgcaccgcttcccacgcgcggtcggacgcctccgccacaaccgcttcccattgcgatgccggaacccaattttccatacgaaaagtggtggaacaacattttccgcttggccaacatttgcttgacaaccttaaaatgaatgaatattttaaactttgttcgaatcagttttacagagttttcgaaattgggttcgaaacggatgccataatcgtggatatcaattccgagaatccctctatttaccccaaaatcccggctttttaaactgctttggaccagaaatttgggcgaaattcggtttcgaaaatttcgggggtttttgtttcgggtttctcggcagatttgattttgctttatccaaaaattccggctttttaacattaagttgacttgtcttacctcacgaaattgggccgacatgccg

SEQ ID NO: 1241 - DNA, 837 bp, Heterodera glycines
tcacttatgcgccaattggacacatctgttgccatctgtgcgttaatccaatttggcacagaatgccaacaaaaaaatattttataccttttgcccccgggcatttctgaggttaatttattaaatcagaaaaagtgcgacatcgaattacattgtgagggagaaacaattatttaaaattgaatgggagtttaaaataattacaaagggtattttgggaaggaactttggttttagtcgaaattcgcaagaaattctcggaaaaccgaaggaaggctaagcccatcgttaggcggcaattcaaatgagaaaaggctcgaattttctggcctaaaaccaacaaaattttcctttttttttcgtttttttggacggaatttctgttgttgtttttgtgagaaagactggtaaatgcgttgtgacttgtgggcccgtcttttgctgtttgttgcgttgtttttgcatcagcccattctgtgccgatgacctttgccgccctcggcgactttgacgaatgaatggaagggaagggaagtgtcgccgttggcattggcattattttggtgatggatgattagtgattaccccaggggggggggaggcgcatccgtaatcattatgatttatagcgcgcctccattctgtgagttatggccgaaagcgcactctgaccacagtcgaactgagcgatcaatcgcccaccctatccatgctgatcagcagcaaatgcacaatagaggacgtggaggcgagaacgcccaacacgcattatatgtaccaatgaaaaaacgggcaaatgccaatgcagcgaatctatctgaagcccaaagagggggg

SEQ ID NO: 1242 - DNA, 1735 bp, Heterodera glycines
ggcaaaatcggcgacaaattgtgacttttcccccgcagttccgtttttgaaatccgaattttcctcggtcgagtcactggaagacaacgattttcgcttttggcggcgttttttgcgagttgttgttcatcttcttttaaagtgtgctcttctaagtgcttctcaacttcaaccaataataaatcccatttgcgaaacagaaaagaaacggaacgtcggaatttctgtcgtcctcttaatttttgtttaaaagttaaaacaaattaattgagccacaccttcgtttgataaagtgaaattgaagccaatgcgaacgaatgaatgagtctaacagcagaaagacggtgtgaaatgtccacaagatcaaacagagaaatagacgaattgtgctcaaatttattttgcttaagtgacgcaaatcctttaaagcatgagagaaaggctttgacacaatgtacgcacgaagaaacagcgaaagtgcatgctccaaatgattttccttcagcagctatgccaactgatcgaacggatgtccgtttttggggtccaatctcatcgcttttttgtaacattcggcagctgctgttaaacatttgtatattttgctcaacaattgtagaggaatatctgtggaggtctcccaaataggtgcagagtcgcgcgaatgtccacgaattgatcgagaagcaaggaatcgacgaaatgctcgctgatataagctgcttaagtaaacggtcctcttcatccaagtcaccgacgatttgtacagacgaatgggttcataaaaacagttgatccaggtgtgtggacatctcgccaactgacacttcgccaactggacatctcgccaactgacacttcgccaaatccggacgtttcgccaactaagccaaatccggacgtttcgccaactcagctaaaaaatgacatttcgccaactgacattttgccaacttaacatctcgccaactgacatctcgccaactgaacatctcaccaactaagccaaattcggacgtttcgccaactcacccaaaaaatgacatttcgccaactaatttcgccaactggactaaaacctatttttaattgtggaaacaataataaaaattcaatataaaagtgcataaatgaatggaaatctttatattataaaaaaataacaaaaaacgtaaaataaaaaatttcaaaagaaatttcattatataaaaaacgtttaataaaaattttaaaatcaatttccatcgccatcatctgtttcttcgccactatcttcatttccacggacgtgaagcccctccacaaagccttgcatgacgagaccaagcagatttaatgtatttgccaatccttcttctgattcaaagtcggcctcggcaagaatccatccgcaccacattctgttcctttatgatgtaccgttgcggacgttttctgcttttctgaagatgttctgcgcgtccgatgtccagctgtttgtcgatgtcccttgtgaatgcagtaatgaagtcactcaatgatgggtgatggttgagctcacgctgaaataccaaaattaatgtttttctaaagtatatgttgtacagcgaagttgaaaaagcgcgccgaacgtaaagtggcggaatgagtgctcaagagagaactgatctgattttgaaaaactaataaatacacataagctaatgaaagacacctggatgctgtgtgaacggatttcctttgaatcggtccttcg

SEQ ID NO: 1243 - DNA, 5999 bp, Heterodera glycines
agttggcgaaatgttcttgtgccgttgatccacattatgtcgaaacagccggttggcggtaaaggcgcgcgaattatctatttttttttggacaaggcgtcggagacaagaaattggacgagttgaaggaggaaggaaaatttgatggttcgaacaacatccaaccgatcaaccaacaacgaacgtcccccccccgccccctttatgcgtgtcacacctcccccattccctcccgccgtactattgttacatggagatggctataaaaatgcgtttgtattcttgtcaatttataattcagtggtgggtccattagtgcccggaatttcgcaagaattttcccgggatcacggccgctttttgcacgacgccttttttcttgtcctttaataattattttttaatttcaaaaatgattaatgcgaaatcactgaaattgagtgaacgctgaatgaatgatgtgacggccaacgaaccaaaaaaaaaagagaaaaaatcagttatacaaaaaaatagtaaagaaaagacaaaatacgggcaaaaggatccttttgaaaaaaatattggcggaggacaaaagaacaaaaaataagaacacggattggcgttatgacaattgtgtttccgtgctccgacttccctcgaatatgtaaaggttgtttgtggcagccaaagcgatgatctgagaaaaagggaaaaataaatggcaaaacggcaaaaaaaaatgtgaacggaatgccaaggaacacacgcacttctgttgtggggtgccaagcgcagtggagaatctgcaaaagggaaaaacgaaagtgaaattaataaaagccagagtaaaagttgtgacatttaaacgctcaaatagggggagggggcttaaactccatttcgattctataaaaaaattccatttcaatactgattttttgtggtagatattgttataagtacaattaaaaagataaatcgtcaactataaattgctcgatttgtaattagtggtgatccattgtgcatcgaaatggggcaaaatcaaaaggcgggaatagacacacaaattgaattttattgaatacttccttaaaacattgatttggaaagagagatttgttctgaaagccctttccgtaaggaatccctccccccttttcacaaaaaatgcgtgccctccccccccttttccgtcacctttttgttaaagtccaaatagtccgcgctgatttcctcccttcgctttttccccggtggcatatttgtgctgctgctgccgtgctgctgctttttgttgccgcctggcgacgaaccgccgctggccatcgccgccgccaattccatccgttcgtggtgcagcaacggccttccgccatagccgcccattctgtacggcttgcacaggtcgaggctggcctcgtacgtggactccaccgaagtgttgcgtttgaaggtgcggaaataattgttgtaggagccggtgatcacatgtctaatgaattaacaaaatatatgttgaaatcacagattgattgagtggggatagaaagaaagcctttggggcccgacgacgccgacagaaaattgcatattttttagaataaaaaagcacaaatttttagggagaaagctcaaaaattttatgaatgctgctcaaaaatggagtgaaaacaaaaacaaaaaatgttgatttatttaactggaagaagtccttcttcaaaacttgattttctttttttgaaattggccatttctgtactttcagttaaggaaaggattaccctttacaaattatttccgaatcaattgttttctatttgaaaagaagataaattgaaaatttaaaaaaactttttaaattttcatattttcccctaatttttggttattatgtcattttctcaccaatcgaaaaaaattttccacagcggcgcctatcggcagcgtcggactacccgccctttccccaaaaattttatgaaaaaggtgcaccgcaaaaaacaacttgaaaagcaaaaggtcgccgatttatatggatgggccggcccccttcgcaaatgttcgccactcaccggtcgtcgccgctccaacagcactcgaatttgtcaaaaattgagtcgttctcgtaaagtgtgcacagctttgagcgcaaatagtcgtgcacatggtacgactcgacaggacgcgactccatgttcaggtcccagaccttaaaaagacgaacaatgaatgaatgaaatgtattgtatgtgattgccctcgcaaatagttaaatccaaatccctcctcaaatgaataatatccgtgtgccattaattacccaaccacggggactaaactcacagattaacagggccatgtgccccaccagtatttaagtaatgcctgaaaactctaatgaacgtacattcactgtcaaatagtcgcgggtcagcaaaaagcggccgttgtgcgaaaatttgacgtccgacacagaagaaatgatttcggagaaaaaggacttcgaagcggggtcctccttctcctcgaatgctcaaatggaagcataaattaaaaccaaatcctaattaatagtgtttaattaattacttttggctggtccgtcacaaagtgccgagtcgcgcatgtcgcacagcctaatgatgcccttggaagagcctaaaaatggatggatacggcatttaatggaaattggattggatttgattgtgtattttttaattcactgtatgcaaaaacatggcacaacgacggatggaactctgccgcagtgatcacctgacaaagtgagaaaaaatgaaagaaaaaataaaaatggaagaagccaacctcggtgagttcctccatgttggcaggtttaatgtccacaatatctgcaaaaaatataatttcgtagggatcttgggaaaaaagaaccagttttaaaaatcattaaaacggacactttccaatgtcacgccaaatgcccattttgacttaaaacattgtgccaaatgtttgtttttgaattccgttctctctgcccactcactgaaactctgattggtgatttcgtggtgccacaaattgatgcgcaaatcgtccgccgagatgaacgtctcctggtccgagttgatgcttatcgaattgatgtggtaagtgtgcgcgttggcgtacacgcggcggggcgacgcttcgacgattaattccatgggcaccaatttgggcagtttcaaaggcatggcacggttgaggaacctcaaaaggcaacataagcacttgaaaacagacagtttaatactgatctaactaatttctcccttcgattaaattttacctccgcgatccgtcgtcacaccgcaaattgtacccgccttccgtcatttttcgttcacgctcagaaatcttccacaattttaccgttttatctgcggaaaaagaaaataattttgaggtgaaaaaatgcgtgggatttgaaacatttgaaagggaaatatgtcaaaatattaaagggcattaaaaatgtctcagccgaataaaattcaaaattaaaaaaacaccattggttgagatgatgaaattggccgcgttctttttcttcatccatttgatttggttgattttctcctcgatttccagcgacttcaaataatcaaattcgggctcatgtgattggaaagttgagtacacattgtactcggaagtgcggacgccgttcagaaacactccctgaaaaggggacaaatcagaagcaaattgaaatggaattgacaaacgctttggtcccgttgaaagatcaccactcgtccgcctttgtcaccggtagcgagcagttcaccatctgtgcgagaaaaacgcaaaagtttttgtatttatttaaaacaaaacaaagaaaacgaaccgtgagaaaactcaacgcacgaaattatgtcagctgaaattaataatgcttttattaatctgttaaaacgtttaaaactaaaagacaattggggggataaagccaaagataaagcaaaaatagaaaaaagtaaacggaaatgaatgaaaagtgaaaagaaaagaaacacgaacagcatggatttacaacttttgttttggatttaccaatccaatcgtattgaaaagttaatttattcactaaaaattgtaaaaaaaaccgtcggttggcgcctcgcccgtctcaatgtttccctttatttgggagaagcgccagtggagttcgtcgccgccaccgctgctgacttcgaaggcggtgccgcaaaacggcggtggagttgccgaggaagaagctggcacatccattttcacaaaatgtagaaattccgcagaatttataacaagtggcgcgccttttttagttcaagccaaatttaggtgcactttttaaaaatttgcgaatagctgacaaaacaaatgaaattagaaaagaccgaaaatatgtaaatggaaattaataaacaaaaaattcgaaatcgatgccggaatcaaatccaccaattgaaaaacttattatttggaacactaaaattaacttatgggtttatgagtcatgcccaattctccatacttaattcatccacagctttgtgggattctggcatttactatgttgcacaacccgtgtcgtgacatttttgtgtaagaattacctagttgggtaagatgttcgaaaacttaggaacattacctaacaaatgacaattaaatacatatatgaaagtaggtacattcgaatttaaaaaaaaagttaagatgatgaaaactgtctctgtctgtgaattttttgcgatgttttcggtgttcgccgctgcgttttgcggaccaaatgtaaaaatgacgccgtccataaattacctaattagaggaggaacaaaaatcaatatgcttttattacgcaattcattgcaaaagtgaaagtgtccaaattttaataagaaagccgaaattcatctttttgagtgtattcaagaacaattttttgtttattacttttagttcagaatttagttatataaaaacttctataaacttcaagctttcgttagataccaagaatataggcattaacaaaataagaaaaagttatggcctaagaaactggagacggacattgattggacagttttgccatggttttccttacaaagggcgcgactttcccccgatgagaatggcctaacaaataaatgccgtcctcttacagaaacataaacatgttcttgaaaatttttttatcagttgaagtttgataaaaaaaaaaagttcccaaattttggcattgtgtgttaattgcttaaatggcgcgaaaacttcagacagaaaccgacgaaatctcatccagaaagaaatgggtactgtaaaaacccgtacattttgttattgcaatcctttaacacggttgtttagagcggtaattacacggcaaatttcccgtgttaacattagacagtaaattacaaacagcggcatattaactcatcaaatgggacaaccaaaaatgtacaaaatgtaattgactgggtgctaattgccaagccaccgtcccctccttcccgctcatttgttgtgatcgataaaaatattaaatggtgatgagagatggcgggggggggggataatccgtgcgtggtccatgttacgagcgttgttagcacgaacagcggtgaaaacaacgccccccgccggggggaagagcggaaggacaggggaaggaggacaccgacgaagacaacgacgacgacggagaccgagtagagacccccacggcacggcacaaaacagcgcagaaatatttgaaagcacaaagtgcgaaggaggcggggggcgaaggcagcagccgctaataaatggccgcttaaagtgtcccctccccccccccccccgctcccccacttttttttgtgtgcgcttaagccccgtcgcgtagtcagagagagagagagacccacagagtcgtcaggatgttgagaaaaacgagcgggaagcgaagatggcggggagagggagaagagccccgggggggggggggg

SEQ ID NO: 1244 - DNA, 1185 bp, Heterodera glycines
cgatggtggaagagaaaatgcgacgggaagggaaaggagggaaaacgaaggtgggaagaggggggggggggaggagagaaagagggaggggaaaattggggagacaaaatcaaaaaatgtgggagaaaaagtacaaagaaaagcgacaacaaaataagcgtggaacagcaaaacaaagggctttcatttgtactaatgtctcgaaagaaggccaatttcgataaatacgcgaaactaaaaattcgcttcattattaatttttcaaatattctaacaaaatctgagcctctccaaatccttcagcgtcttttcaggccaaaggcaagaaatgttaacaatttgcacaattttggcaataaattatttaatctgaaaataagcaaaaatcattttatcaaaatcaaagaaataaaataatcaaaaaaattcggtttaaattcgcactaaaactcccttaccgtaaaacagagggcgaaaaatttaaatttgctgttactgtagcgggatggaactaaaaattttcccaggcaagcaaaacttaataatcctgtagaaattgagtcaaaaactgcgtcatttggtcaattttagacaaaatctgttaacaaatcgcattaaatttcataaaatttctcgcagatgtcgataggcaccaggtatggcacggaaagacttccgatttccgacatttttggggtcggaattccgacttccgaaatttttgatgaaaagtcggaaattttttgaatttaattgaaattttttcgaattttccaaaatcccgcaatcccgcacagggtcccgcaaattttaaatgcgggattaatcccgcgggatcccgtcccgcaaaaaattttgagttccagtcccgcagcgggatccgcaaatttgaaatttccggtctctaataaagaccttcgtaatttggccagggttacccttgaaaatttcccgaaataagaacatcgctggtcaaaaataagattttagggtaaaaaataagtactttttttaaacacgcttccaaaactttaaatcgcatttttatacaacaatgcattttagcaattttgtggaagacatatgcaatttgtaaattatttcagttcatccgggatcaaaaaatcagatttttaaggatttttttgcggcgtatttttccgaaaaaattgaggaatgggcata

SEQ ID NO: 1245 - DNA, 2354 bp, Heterodera glycines
  misc_feature (21)..(21): n is a, c, g, or t
  misc_feature (47)..(47): n is a, c, g, or t
  misc_feature (114)..(114): n is a, c, g, or t
ggtaattagtgatgttttganggtactaaatgagtacataattaaanatatggtaccataattaggcattttaatcattttttattattattaaatgaaacttttttctcaatntagcgtttttgagtttcggttgaaagataagagcaaaaagcatttttggtgtgaatactttctcatgagaaatggcataaaaatgggaccaaaaatggaaatggcaaaacgccaaacaaaaaaaaagtgtgagaatggaattagttaattgttcacactttcttggaaggaattatttgttttattctcccaaaatgccatttcatttggccgatgaatgggcccaaaagttgaccaattttgcctcaaatttgtatgatttttttaattgttcaccattttttggcatttccatattaatttttcattttctcctttttaagcctctattctcttctctctctaattgttttttgttttgttttttttacatttttaaattaattttctgttttttcacgtttaatcgttgattaattagttcttataacttttttctccattttctcattaattttgttattttgcactttgccattaattttgtctttgttttgtatttttcatggcatatttgccattgccattctgcgaatgaatgggtttccccccccccaattcactttcttctcattttctgtcataatatttttgtctttggcattgacaaccgttcattttacaaaaatttatggtaaatgccttttttgaaaattccgcgtggcattgaaaatgttgtcattcgatttgattaaaattaaattaaattaatcgattagcttcgaaaatgaaaaatcatttcttaaaattaattcccatttgcgtttattttcatttatttgttcgtaataatttacggttatttattcatttttttcttttcttttttgaccatattttgggctatttttgtctttaatcatttgctttattttttgaattttctctcctttattaatgccattttgcatatttgtgtttattaatgccatcatcgatcacattagccttttaatcttctccaattagccatttgccattcacaatcagagagatcgtcatgaatacaaattcaccataatttattaaaaaaaaaatataatatggacaaaaagtggtcaaaatatgtacataaatatgaaagaaaaatctcgaaatatgtacaaaaaaccccaaatatgtaccaaatatataaataaaatttttaaaatgattattttttggaaaaaaaattcttcggaaagggtgaaatgggcacaaaatgccataaaaatgacctaaataagcctagaatcacattttagtattttaaaaattagtttggttaatttttatttttcacaagaaattttataaattttcaaaaaacctcaaaatatgcaataaaaatttgaaattatgtacgaaaaatttgccgaaattttgattttttttttgagaatttccgaaaatttctgtaaaaaatccacaaaatatgtaaaaaatgtatgaaaaagtccgaaaaagtccaaaatatgtaccaaatatgtataaaatcccgaaatatgtaaaaatatgtaaataaaagtccaaacttttgttcgcaaacacaaaaaagaaagtgtttttcctactaattaggctatggagaatccagaaaaaatatgtatttacataaaattgacatccccaataataaatatgtgtttaattaataatagatttatttttaattaattaatttatttttaaatttattaagtgagataaataaaaaacagtgatctcatctcattttcactttccgagaaacgaaatggcaattaaaaatgcccaaatgccatttttatcatcgcttttctcttctaattttgtgcaattaccaaacttcttcaagagggattattcagaacaaaaatagaagcgatttttttgataaattaacaaaaaaaattaaaaaattataaaacgttatttattatgcatccaaaaggcaataagcataaaataatacccaaaaaaagcattcaaaactcgagaaaattgaaagccataaataattatcttccagaataagtaaaacctcgagtttcatcttatcaattagtcgaaattaagtaatttaattttaaaaatatttttcccatattttttttaatggtttaacgcggcatgggcccgacagttggccaaattgcggtaattggacaaattgcgatgcatttgacatggaaagtctgcaccatcccactcaatattgtccatgtgtttttgacagcgaatttttatgatttttttttgtttaatgacgtaaaataccg

SEQ ID NO: 1246 - DNA, 879 bp, Heterodera glycines
ttagaactggagtccggttggtgtggccttggaacagcttttgatccttgatgtgagccagttttaaaaaaacgaatggatgggaatgcaatattttcaaatttcaattccacgccgacaaatgatgtcgttgcgccaaaagcgcttcacagggggcggggggtgggcagcgaatgcaacaaagcagcacatgaacaacagaagatagaggaagcggcggagacgggtgcgatgaagtataggcacggggaataccatgggctctgcattttgggtgggacagactaggaaataatcgaagtgttttctcgagactaaaatagctaaatattcatgtcttctccattccttcctttatgagttgatctagttacagtcagcaattaaatctctcttttttcttgtcatatttcccccataaaaataaattcctcataattttccgccacagcgatttttttcacattttctgaataaaattccataaattgtgttatgtgccggatctgaaattcttggcattcagaggaaacgcttggccaaattgggcctgattttatgatcaaagaaaaaccatcgaattgaaactaaaaagaaaactagtggaggggggggggggaggtttggcgttaacggcaaaaaacttcgttgtgatttaatttaatttgtttaattattttttcattaattttccgccaaatactaattgacctttcaacaacattaaatgcataaaaaagataaaagattaagtcataatttcgttcgtttgaattgaactattcagagaatatcccccggtttttccctatttttgtctttggttgccaatgaaaattaaataaaaaataatacaattttaaattaatgctttaaatg

SEQ ID NO: 1247 - DNA, 9269 bp, Heterodera glycines
ttgttgggagagatttggccaaggaggcttttgttttactcccaattaatccccgggtttactcctaagtttgccaagaaatggaaaagaagtttatttaagtaggatgggaaaggtatgaagaaattaaaggtgaaagtgtataagtggtaggattggataggaaaaggaagacaaaaaaaaagccaagagtcaatgggtacaacagagtttaaataggcaaggacaagaagagaggatgccgacataattcttatcagacggggaattcaaagggagagagcaaaggcacacattaaaagggggaaaaattacataataaatttgctgggtcaagagtcgggagtgatcatcaaaggaaacggcaaattggtcaaaaattgcagattggggaacagtccaatccttccctctttttgaaatctgcggctgtttctcagcgcggagcatacggacggaagcggcgtccaaagtggtggttcggcggctgacaatcatggcatcggcaatgtcctggggcaggatgacggtggttgtggtgctggtggtgcgctcgatgtccctggcgcatgttgaaataatggcgcgcatgggcggctgccccagtagcggtcccacggccatgtcccccacgccctctgatgaatgcgcgcccatggccggtgcctcgcccccgctcacgggcggattgctcctgcggcaatgagatgcctttcggtcccgggtggggttctccctgctcattctccccctcagtcgggctctcgggttctttcccggtttctccggcctcaacgctcaccgcttccaactccgggtcatcgagcgacatttgttccatttcttcccgcgctcggctcgcatcaagagcattagccatttggttgatggccgcggtaaagccttccattccccggttaaccgtactcatagcctcgccaatgtattttgaaacggcggaaaggatttcctcctttgcgttgcccagctccgtttggatctcggccatattggccggtgagactttaggcttattcgagcccttcgttttcgaggcttttgctcccgcttcgggatcggcattctccttaggtccgagaatggcatcaattggagaagacattgggagggaacagaaattacaaaaacaggaaattgggtggaggacaaaatctaaattagatagaaaagacaatgcttacaaaatgaggatggaaccaagaaaagaaatgccaaaatgtaaattacggaaagaataaaacttttttttttttttaacgatatcgtatctcctccccttccgggttactgtattccctcctcttcctcgggaggggtggacacaacatcctcggggggttggttcagagtaatgccttgctgccctctggcgagtgccggtctccgcggctttaaatagtggagatggaccggccgatcgggtgattcgtccccttcgacgctaaccacatagataacatcaccctttttccccaccaccattcctggcctccaagttttattaatgtttgcccaaacatagtctcccaattcgaattgcttatctctgattttcggcacttctttttgagccatttgtttacgtttttcctccgttctgacccaaattcggtccaacggggtgcgtatttcccttttgaacatacgctgggcgggcgactccatggtcgaaatacacggatatgatcggtattctctcaaaaatatttgcaaggcttctttaatccttccctcccctctttcggctaatatttttttaactccttttttaaatgtttggacaaatttttccgcttctccgtttgaggacggggtatacggagggcttttcagatgcttagttccgttctcccataaaaatttctcaatttcttccgacacaaactgtggcccattgtcacttacaaaagtgatcggagctccaaattctgaaaaaatgttacctaatgccattataattgcatgggaattcgttgaattcatttggtacacccatggatatttcgaaaaagaatccaccacaattaaaaaattcgtattccatatgggccctgctaagtcagcatgtattctttccatacataattttgcttcgggccattttcttcctttatcagtgatcggtggcaaatcggcatttcgttgacaaatctcacacccattgataaattcctcgatatccttactcattccaggccaccaaaacaattttcgggctttgctttttgttttcaccatcccaaaatgggcggtgtgtaagccctttaaaatgggaatttttagatttccggggactacgatctgtgttggggttttccgaattatatttccctctaagtatagctcgctccggattttgtgatatggctcaatttcttttgttgttgattgccaactatcctttatctctctgatcactttagcaagattctcgtctcgaactgtttcattctcaattatgtttttatcaattacaaaaggttcggttgtcaaaatgtaagggatttcctcccggaaatgcttttccataaccaggtcccattttattccctcggtgctcacaactctcgacaaagcatcagccaccacattattcttcccttccacataattaatttttgggttgatatcctggaaaattagaagccatctgttcaatttgggattggtctttcctttggataacaggaaagtcaaaggtttgtgatcggtataaatggtaatgtcacatccgtaaaaaattggatggaaaacaccaatcgcgtgaacaattgccgccagctccccatgggttggtgggtaacgtgcctcagtttggcttaatattttgctgcaatatgcaactgcgtacagtgtcccttcgttatctttttgcatcaaagcccctccccaagcgatttgtgaagcgtcagtaaataaatgaaactcttttttataatttgggggtcgtaagcttggggactttgtcagctcagtttttagagccaaaaatgctttttgttgttctgtctcccacttaaaattcgcatcgttttcctttcctcttaacaataatgtcaatggggcagcttttgcagcgtaatttggtatgaattttctaaaaaatccaaccagtccaagaaatctttttatttccttaacatttcctggttctgggaaatgctgtatgacttctttgttgctgatggacggctcgtaccccttacagtttagtttatgccccaaataaacaatttcgctcttacaaaattcacatttttgaggcttcaatttcaatttaaagttacgtattcggtcaaaaattttctccaaaataaacatgtgctcttcaaatgtgtccgtatacacaatgatatcgtctatataggcacatgtatgtccaatgtccgacaaaacttcattcataattcgctgaaaaatggcggggctgtttttaagcccaaatggtagctttctcattgtgtagactcccttttctgttattattccacatttatgtgctgtatgtttgtcaaggggtatttgccaaaatccggccgccaaatccaacgtactataaaatgcttttcccgctactttatgcaaaactgtctccatttttgggattgggtaggggtcggttacagtaactctgttcagcgctcgaaagtcaacacacggtcttaaattaccatctgatttctgcactattaccacgggagaaacccatggagtgtttgattctgccaaaactccagttttcaacattttctctaaatgggcatccaattctgtttggtatttttcgggcactcggtatggccgactgtagactggcgtctccgttgtagttaaaataggtggagctgaaatagtgcattcacccaaatcgtaatcatgtttcgagaaaatatcttcatttcgttgcagaagtccaaaaaatttgcttaactcagctttggtttgcaaatcagttttgtgccggctcatcagatttgactttcgaggttcttccactttttcggaaataaaacattccctcgtaattttgtctttttttattaattggcccgtttctaagtccaagaggaggggtaattgtcgcatcgtttttcttcccaaaatcacttgataaagccctcttttgcttacttcatttgggattataatcgccgtggtttcgaactgacacccggctatacataaagttacgactgcctggccaagtgccggaatgactcccggcccaattcccgtgactcccgcaacttccggcgggtaaaattttgttatgcctaaccttttggcactttccagaccaattagtgtaacatgcgcacccgaatcaagcaaaaatataacttttttcccgtttattattcctcctattcgggagtcttcatcacatcttccgagttcaattaccgcaacttcagcgatttgggtctccccgtttgtgaatgccccattacaatttgtccacctttgggttaaaggaatggcactttgccgggccaattgtaactggtcattttcctttgctacacgttttaattccctttttcttctttttgttgtctgaagtgtccgtgtaactcgaactagggactccccaacatttaattggtttgccaattcagccaagaatgggggtaataggaaacgcatcaccgctccaattgtaacatagcagcaaacacaaaaaacccaaatttggtttgctgaaaaaattccacctttcagaaaggagaaaagcccatttgacactatatttccggccaaaaattcgggcttcgctgaattctcgctccaagcgccacttggctttgtcaatctgacaatttcatgatgaatctctgcggcctccagtgtctcggtgaaatgttccggcgaataaagctcactcaaatttgccatcaccttatttttgaacacagtaaaccctatttctggcaaatcaatgtttccataacgggcaattttatgaattgtttcccatggcacttccttgatatctccgttcacttggtcatattgtgttaattttttctctccctgaatgtacaaccatcttcctgactggcaatcaatttcccttgcctcagggtatatgataagggttaccgtatccaaaaacccatgccgttgtgccccgtatatcataaatgtcactggtaatcgattgaaacaaaaccccgatttccaattgtaatgcatctcattcacattcactccaaaacatgggcgaatttccaaggatttctctgtaactaatcgcgcagttattagttgattactcaagaaaaatctggctaatagggttggatttgcgatggctaacgtagccgtttgatccgcgattgattgcaaacttgtgcaaatttgtctaattgcctctgaaaaaagccgttgagtggtatgggttaatcgggcgcttaaggcagttaattgagccgataattgagaagagtatatgagtccaacgggacttttgtccctcgcttgagtcgcttcctgcgttatttcatctaattgtcttctcaatctcactgtttctcggctagccaaatcccttctccttaccaattcttgatactcttctaagggaacagaaaatccttggtccgagattgcaaattctttatttttgcagttttgccgaacagttatgttttcaaatgttagagcaaaatcatttgagcccgaaatccacacctttgttgcgtattcacctgcccatttagctacccacacaaaaggacattgttgtgttgggtccggactccaaatcatactattttgctggcaacgacatgcaccggatttgtactgacaccctgggcaattatttaagggagtactgactccttcaactccgtacctggtgaaaacaaccgtatcataggtataacaatttaagacttccgtcatatgccaaaacattcctacgggccatactcgccatccgacttccaatgagtgattagtggaccggagggttccatttttactgagctctcccgctggggaatggtctaaatccctcattctgtggcaagttgaggtagggatatccaaattctcagtttccacctcctctaatggggctccaaaaactccgactctgcggtgaattttggatttaacacatttacatgcagtagccggtgttttatattggagtgtatttggccggtaaatcgttaattccatcgggatcggactttcagtcggttgccacgtggggcagattggctcctctggcaatttccataaactcgacggagcgtccggtaaacagatcatcggctgccgttttggaacatttgcaaggattgaggttggagagaacaatgccaaaatagcgattattgccaaaaagtaggggctcgccactcgggcacctgctattctgcctcccctagggtttactcttggtgtgggtgttcttgggaaacgattttcttgatcgcattcccgtctagtaccactttggtctctgtatcgccgatagttctgatttgaccgactattttgttggctatttccgcttctccacgtctctcggttcctttcatatccctgtccgaatggccgagaataattcccattgcgttccgttctacggctgttttcatctcttcgccaatttggcccattgtttgcttcccttcttctcgccgcacaatctcttatcacatgccccgcttttttacaataaaaacaaacccggtgatcgcgctgatcagaaaaatttggggcatgtctcacattttgcatggccaacgcctcgactttttcaataagttcattcatggccacatttgaagtcgacttgcgcgacgcctggagaagctcataatgttgagctaattcgtaagccctgctatagtccgttggcctctccgatttcacttcgtattgtagctcgggaattaaccgatccaaaaattcttccaacagtcttttcctaatgtttccctccgtttcccctgccaaagcagtcctaactgcctcacttaaacgagtggcaaaatcaaaaactttttctcccgggtattgtctgcagatcgcgaggttttgtctcgctatactctttgtgttctcattttcgaatctgctctgtaaatgccctagagcagcatccaaagtgacagggggtaaatccattgagtctaattcggcacgggctggccctgatagacaaaagcgcaaacgacttattttctgttcctctgtgagctgagccgtataaagcgataataagtctttaaatttctgtgcccaacgagaaaaggaaatgcttggattgccatcatactgggacaaatgactgccggagagcagaaatgggtcacttatcattacttcacattctcccgttagcccctgattttgctcgtcctcaacattttggtttatgctaaaattattctccccatccacattgtcatgaccattccaaaaatattcttcgttttcatccaaaactttttgttctaggaatgtaatccgttcacgattttcttttacaattccgtctatctccacaactttgcttctcattgccgcgaccttaatttcggtcacatttggtcgtcccatttccgtctgagactcatcccctttgtccaatcttcgggaaatctgatcgactgtcaactccaggtcggtcaatttcgattgagccaaatttaagtcggtttcgattcccactagttgttcacctattcctttatccatttgtctcatcatttcgccaaaaagttccagttttccttcgaggacaatacaattaccgaccttgccatttcctttctctatgtcttcaactttctcgattaattttctcaccgtttcgcaaacggtggcttcaaataggcgcagttgaaccaataaaggggaccaatttcggttttgggacgtagtgaaatgattaggattaaagtcggaccctttgtgatcgtccatggagaattttggattaatttgacaaaaaaaaggtcaaagagaattcggcacacagccacaccaaggagcacacagcttcgactcggcttttcagagggcacacagccgcaccaaggagcacacagcttcgactcggcttttcagagggcacacagccgcaccaaggagcacacagcttcgactcggcttttcagagggcacacagccgcaccaaggagcacacagcttcgacttggctcttttttcgatggcacacagccgccgaggagcacacagctacgactcgacaatcttaggcgttcagcctattgggattttgcctggtttggcaaaatgcgaatgaggaatagtcccgggtcgtggcaccaactgcactgtccgtgcacaatttgttgggagagatttggccaaggaggcttttgttttactcccaattaatccccgggtttactcctaagtttgccaagaaatggaaaagaagtttatttaagtaggatgggaaaggtatgaagaaattaaaggtgaaagtgtataagtggtaggattggataggaaaaggaagacaaaaaaagccaagagtcaatggggacagagtttaaataggcaaggacaagaagagaggatgccgacataattcttatcagacggggaattcaaagggagagagcaaaggcacacattaaaaggggaaaaattacataataaatttgctgggtcaagagtcgggagtgatcatcaaaggaaacggcaaattggtcaaaaattgcagattggggaacagtccaaaatggatgtcagggttcgtaatcagtgatctcgaaagccatcggataaaagtttgtgtttcgaactttttccaacggaaaactttttcacaccttactttgtttgtttacgatccaaattttcaaaaaggaggctttgtttgacactcaaaaaactttttggtataatttttcaaaaaaaaatttacgaaaaaattattttccaataaatcgccaagaagggagaaagcgtgtcactaatcattcaaagcaaaagaaccacgcaaacaaacaaacaagcacatacttaacggtggagagcacatcgccgacgggccatgcccagccttgttgaggaataatgaaccaaaccaagtcactgaaaaatgaaaaatttgataggcctcgaaaaaaatggtttttttaagtaaacgcactcaagcggttgtctgggcacaatgtcatgaatgatggtgagcagcaaaaagttgaggaagacggacacggccaggcacagaaaggcaaccaccgtct

SEQ ID NO: 1248 - DNA, 9519 bp, Heterodera glycines
ataaaataaagaattatttattagtgaaaactatttttttttattaaagttatgtatttgaaaaattctaaaaattgttagttttgtgtcaatttaacatagtattttaaacacataaatattattaaaatatcagtctttctaacaatttgtttacattcaaagcaattactttgccatggaaatcggttcggtgatgagaataacctttaaccctctcggccctccaattgtggtgtgggtcatttctgataaaaatatttggcaaacaaataaaaaggaatgaagagaaggcaaccagcggtcattcttatgattactcccttcattttcctaataaaatgcaagaaaataactcatcatccgacgaagagggtcaattgctttcatcttcatctgggaatgaagaagcggctaaccaagaattaattcaattcatcgaatttaagtcaaagcgtggtgcctcacttcttgcacgtaatgggtttgagtaccaatttgaacgcaattcggccttagttgataatgttgaatattggaagtgtgttaaagtgagtaacaaaataaaatcgaatggatttttctttggtcagaggccaccctactgcgcgggtcgcatacatgtccatgctccttggcaagagcaaaatggcattcggtttaaatttggactgctaaaaaatgatcaacactctcacattgccgaacccgacaaagaatatgtcaaatagttgccaatttctttttgaatttcttaatctcagattcgttccgccatcgaacagttgaaacaatctgcaagagccaataacccaatacagacaagagacgcggttgatgctgcgagggctgcattgagtgaagaagttcgagttaatgctccttctggcagtgccatggccaaagtctttcgttccgcaaggcgcagcgcccaagaacaacacggagacagaggaaaggattagtggggttcatttaggcgctcgcgtttgtacgctggggtcgtatgggcacaataaatgtcttttttcatgacatttccaaaatttttgatattcatagtgattttggagtgtctgatcagtgatcaccgtaaaaaatttttaatggacgtcaaaatttctcgtttcccaaacatgagtgcctaaatgtaattccccaaatgctattttcaaggactggacagcataaatccacttgaaatggtcattcctcaacatttggaggcaaatgtgataacaaatgaaaatgtcaacattggtggccaaatgcgtaaaatcatagttttttcaacacaaagtgcaattgaaatgcttgatcgttaccgtaacgagatagcaattgatgggacttttaaggttaaaaggatcaaatgaattaaaattaaagcttaattggttatttcagaatgcaccgaggggttttgggcagctttttaccattcatgtcgtggttgatgcatgcgctgttccatgtgtgtttgcttgtttacctaccaaacatatgcaggggtatattcgtgtgttcgagtcgattcgcaacagaattcaaaattggtctccgggaagagtaatgtgtgattttgaagcctccgaactctctgctatccggcaaatatttccccaggcaataattacaggttccggtaataaaaaatcatttaatagaccaattttacaagggtgctcctttcacctcggaaatgcaattcataaacacatccaaactctccctgggttgtacaaccgttacagaaataacagggatgaccgacatttatttcgatcacttcaatcgctggcttttgtaccaatcaatgaagtgtacacctttttgtgcattttgatggacaatttgattggccctcccgaaattgaaattttgggtatgaaagggtttttattatttttttttcacctgattttagaattacttaaatattttgtgttaacctacattggtccttcctatgttgttgctcatccccaaataattgctggtgaacaggaagcgaattatggacagggatgtgatggatggttgcgtgcctggatagctcatgagaatttggcacatcgaaatgccttgtttccaatagcggtaaaaaattcttgactatctacttttacatatttctgtaatttagctatggaatctgactcatcgcctcgaaattggtctttcaagaagcaacaattcgttagaagcgtggcataacatttggggggcccttcttgaaccaaacccactgttcagcaaatttgttaagcgaatgcttaaagaatttgaacgttggcagcacattgttgccgattttcacaatgcaccggcaaatgggataaggggaaagggccttaagagaaagtccatttatctacaacaagacaacaatttgcggcaactcttcgctgaattccaacaacgagcgggtcaagacccattgcaatatttaagagcgatttcatatcacttggctcaaatttaatgcttttttattcaaaaaataaaaaaaatatttggcgtattgtttaattttttaaaattttatttcagtgacgaaaggttcagtgacgaaaggttcagtgacgaaacatcagggagcctttttatctgtctccctttaaaatttatacaatacttttaataagcactcatatattcgtaaatttattttaaggaatcatatatataaagaataaaatttaaataatcctaagtatagcattattttatttttatttgtaaaaagttcattgttcagttgtggtatacgatgaatcgttaatacttttctaaatttatacgatttaaaaatacatcttcaatttctacaagattagaaaaagacgcctaagaatgtgttgtgttcttccacttagaacacacaaagaaaaagaaataaataaataattttattgattcggtcggagggcaaattggaaatataaataaatgaatgatgaaagggaagaacaaaaagtgggaggaggtgtccacttttatggacgagggaaggggcggatggacatagaaataacaaataaagtcaataagtcagatcgccataaattcaaattattcactatccaaaagaatgagaatttaaaactcaattaatttcgtagaattcaaaaattataaaaaaaaattatttttttaatcgaaaccgagattatttcctactgaaaaatatttgaaaaataaccatcataaagaatttgaaattattgcaaattatttttttaaatacaagattaattttaaaattagattttaattttataagctagattaaaaaaattattgttatataaacaatctattttataaaaaatactacaatgcattattggtcttctgcagtgaactaattttcacattatcagctttttaagatattttgcaatttatattactgtcgccaaaattttgtccatctgtgtccaatgttccctgtccctatcaaattaaatttgtcattttaagtttttaaaataaagttttaagataaacctttacttctttaaagtatactcaagaaatcggctttcttttattttattctcggtgcttttttttattacttgagaatttgtaatgaatttattttgctaaaactaattatgatatttcgtactttaagccaaatattataatataacatatttttaaaattttattgtatttattattcttttttatgaaattgattgtagttatattttattattaaaacaagaaatatccaaaggtatttatttatttatctttaaaataaaaatctaccgtttaaatgcgtacagtaataaattattgaaaaacacagatggaaaaaagtgcaatttaagggaatttagaaaaaaggtgaaaaatcaattgtcatataagcgcaaatttttttctcgttagaaatatccattaatttccgctcattttggtgacaataatataaattgcaaaatatcttaaaaagctgataatgtgaaaatcttagttcactgcagaagatcaataatgcatgtaaaattaaatctactaaaaaatataatataccattatattatcgtagatcataaaaacaaaaataaataaattatatcagataatcaatagaaaataacagtgagatgtaaattgacaaataaatgttaattttagaatgaaaaataaataatttaagtttttcttaattgaaaacgtttattaattccttaaagtacttaaaagtagagatcatactggtcggtattttattcgttttttcattcagaaaaaatagtatttatttatatataatttttttattactttggctaatgttttttttgagttttaaattaaattttagatgagtttttgaaatttatttcgtatatgtaattatttcttcccgcctcttccctcattggtagcaccggatggttctgttgtctgcccattcagataattaatgcagtgttttaatttcttattctcaaaaaattagctgcgataataagatctcttgtgccttatatttaaaatttaatagtcataaactttctagaaacaataatttattataaattttaatttttattacatttatccacaatgtataaaataatttttatagcctttaagattaatgaatttaattccaaacttaatgttagtgaatttagatttaaattaattactttttaagagtccaaagagatccaaactttttcaatgttaaaacactgcttcaatttttagctttttagattgtagcacattttcaatattttattgctacactatttaacattaatgatgaactactattaattttttattgtaatcattagcattatacatgtaattaataatatttataatttttatattccagtttgaggaaatttaatcgttgtgaaatatgaaaacataataagtttcacattttaaatcgcagtaaaatatgaaaaacataataaatttcaaattcttcgcgtttaaataatgatatcgacttcatcatctgttgagttattgcattgtccaattccactgtaagttgcagaggctgagatcgtaattcgcgccccttgtctactgccactgcacattcttcttaagcgtggctcagttcctgtttttgatttaagttagagaaagattttcacgttaaacctgaaaatttgctatccacctccctaaaaaaaagccgggctggtaaaagtgatgctgacgatcatgatatatgattcagcatgatttattgtacggtgttggtcgacttcaaaaaggtgaaaaaatgaacgattgatactattttaatccatatgtcatcataaaacttcaaaatttacgaaattttctgcattgtgtttcgacatacatagttggtgagaatttcttctgatgctccccgatttgctatctccagtggcgaatcggtaatgagttgccgaatgagttgcagtgaacgcgcgaagtaatttggcggacaaaattgaagcgtccctatttttctgacaatgcgttggaattcagtgttcttctggtatcgattagtcccatcctttgaatgctattgagcgcctattacacgtgaaaaacacactattcgcctgcatcaagagcacacgtagttgcaccttctacgtcggggttggaaaagtcggagttcggggtgaaaattccccgactaaatttgttggggttggctggagaaaattaaaaaatgtcggagcagacaccttttccgggggcaaattttcataaaaagtcggaaaaaagataaaagaaaaagttccttaacaaaaagtcttaaaaactcatttaaagacaattacatctcatttcaagtgcaattatcaactttcgtaaaaccccaaaaatgtcggggtgcaaccctacattatacccctgaaatttcataatttgcggatcccgctttatttattgttatttcttttttttatcataaatattttgatatagaattaaattttcaaaaaatttatgaatttccaacaaattcttgtttcttttcgatattttgtcaaatatttcttgaaatatatttaattttcatgatttattcaatgaaaattaattttttaattttatttgctcacaaaaattaaaaaattattttggctgaggatttaaagtccggttggccttttccttcagttaataagcaaatcattcaagtcatttgtttattataatttacttaaatcataattagaagagagccgtaaaagcatttatctgcttaacaaaaatgcaataaaaacgaaaagatacccacccctaagaaatgaaaaattctcaaaatttatttatttattttcataaccataagattttaaattatttgaattgattatccatgtaatttcggttttctcttagtttattttacttttataataatattatttatattttttataaattttacgctataaattcctaatgaattttttatgagattttttgtaataaaatataaaattaaatcattatttataacttaaattttttttagggaaaaattaatattttttcaacatttttttctaaagggatgtcaatgaattttataatagtatttttactaattttgctaaagcttaaagtcgtaaaatatttttattgcattaatttccaaaaaaatttacgttgcacctatcggcagaaagaccaaaaagataaaaattttaataaaatttatttgatattataaactaggttcagccccgacatgtttcgggaaatgaaattacgaaagtcgtaaattgcacttgaaataagatggaagtatctttaaatgagtttttaagacttttttgttctggattttttatttttgtttttttagactttttatgaaaatttcctccccgacgaaggtgttgctccccgacattttttaaatttctacagccatctccgacaaattatttcggggaatttactccccgttccccgacattttgctccccgaaagcttggggctgaaccctattataaacaatctgatcaatgagcatctattaattttattattaattaaaagaattaattcaaataaaaattaaaattaagaaaaattaaaataataaataagattaaaaattaaattaaaataaataaatgtaattaaaaataaataaaacccaaagccaaatcctattggagaagggaaagggaggcgaaggggagggagtcagctgtcgtgcccatgggggaggggaaggaacgccaggccatctgagcgctcgcgtgtgcaatttgagcacacgcaggggccatttgagagcccgcttgtgataatttgagcgattaaaattcaggttaatttaatgttgaaataaaatttcaaattaatccaaataaaaaataacttaagaaaattaaaatcaaaataggattataattaaaattaaataaaattaattaaaaagattaaaattaaataaaattcaaaataggattaattaaaataatattaaaataagattaaaattatggtaggatttaaactaaataaaagattaataaaaataaaatataaagataaatctcagagaaataaacaattaaaacaatcaaaatttttgaaaatggtgcgggtataatgcaaaggctaaacggtgcacggttaaactgtccttttgtgccgcgttgacaggtaaaatggcctttaggagaggagctggacatttccaacggaaattagagggacaacaaaggacggaccttttatttaactaatatttatcctatcaattcaattattctcttccccaaagggtggaacagttccgatccatatgaattggatagagtttctgataaactccgtaggtttgaacatctttgatcataccccacattgtcacaaggaaattaaattaaataaaattaaaaattaaattcaaatacaaatgaaaataaagtagaaaacaaggtttattgagttcatatagccataacgtttttgaaacttaatgaaattttctgagattttgttgtaaacttgtagagcatatttagtgctatcgaattatatgaataataaaaaattggttgcttttaagccaagttataaataatttatcataaaatcataatgatggttttttaaataacgacctagcaccctttgaaacttcaaatttaaataatgtaataaaaaatcattatatccaaataaaaacttcaattttctttattaaaacagcacaaaaaagtgagatggtttaaaaaatgtatgttttttagaatttaaaagtatcttaaccattaattttactccttttccaattcattcaaaattatgtttctttaatttatataaattatccgaattaaaataaaatgctattaatagaaaagaaatttaattaaattaatattagatatatagaaaaaatgaacaaaattctttagaataaaaataaaacattcaaaactataatttagagaagaaacaaataagataattatgaatatatgtccaaaatatataaaaaatagataaattttaaccaagaatattatttatgtattttacccattatatcaacattaaacgccaaatataatttttatgaaaatgttgaaaaatataatttaaattattagatttaaaagcaatttatctgcttatataaagcaataataaaaaattattttaaaaaatagaaggagtaatctcacgactaagtttaattcatataaaggaattttgtaataaaaatttaaaatatttcatcaattatattttttaaatcaccagttgaattttctagattataaaccacaataatgtttaggataaagtattagcgctgttatttactaaaattaaataaaaaaatcaatcctttctaaattatatgaatatgaaagttattcattttttattcattatctaaataattaaattttgtacatgagtaaaaaatgttcttctttagtttctttgttctagacaatacaatattttaaaacataaaatactacaaaagcaatttaaaattataaaaaaaataataaaattaattcttctaggttcataatttttaaaaccatttaaatgttgtttaaaaattattatttatatttatgtaaatcgtataaattaccaaaattgaacacgaaaaatatctatttgcaaaatagtcgattttcatataaatccaaactgctgtgaaaacagcgtttgtggaaatttattgtttttcaaattgagcgccagtcaactgagagccatgaaactacgctaatagcaaaactaattttattatattaacttttttaataaaaatgattgtattttttctaaatgatttctaacttaaatttagtaatttcattataaacatatgcaatcaagtgtttgattcactttttatgaatcaatgccacgaatgatgcagtaactaaaaagaataaaaatttttcaaaaattaataaaaataattatataattttattttcaaaagaatgaagtgaagcgatatataatcaaaa

SEQ ID NO: 1249 - DNA, 4133 bp, Heterodera glycines
aaaaggcaaatattacactcattaattgaatagtttttgaatttttaattggaaatcgattggtggtgcaaaaagtggtaatttgtatgacataatcgaccgatgaataatgaaatcttatataataaagttgagtgtgtgtgggaatcggtcgttttggcgccgccgttttggcgccgccgttttggcgacagggtcgttttggcgccaaaaaatcagagacgcagaaataagcggcagacaagcgcctcttcaatttggtgcagaattacattccgtgaacccgaacaatgataacgatcacaattaccacattaacccaaatcaaaatcatcatatcattttggaatttcttcgtggcgtttcgcgcaattatcatatgaacccatgaattttcttatttgtcttctttttgtttgttattgttagggccccgacttttagtgacgaaaaatcccaaaatagttaactaaaatagtgacgaaaaagtgccaaatagtgacataatttttagccaaaaattgagtaaaattaatttttattcactgatttcagttgcaaatgaggtacataagtactcaacatttttaaatcaaaatttgcaaagaaaaaaaaattttgggggaaaattttaagaaaattttccaattcttagtggattttttgaaaaaaaattttaggtcgattcttaagggtgtattttttgtttttattgcatttttgttaaggaattttgccaaaaaatgtcgaaaaagtgaattttcactattttaagtgacaaaacgccaaaatagtgatttttagtgacgaaaaatgacgtccaactgaaaaaattttttacgcggaaatgcgttttttgagctcctttcttcaaaacaattgagcaaaaaaaaagttttttcactaaaagtcggggccctagttattgttatttacatttttatgaaaagttttaatttttaaaaattgaaatcgatcttggattcacaattttttaattttggcttggcgccaaaacggcagcgccaaaacgaccctgtcgccaaaacggcgtcgccaaaacagcggcgccaaaacggcggcgccaaaacgatacagactcagtgtgtgggtaacatgtgatttcgtcagaagtgatttcgtcagtaagtgatttcgtcagtaagggatttcgtcatgataaggaatttttttacaaaaaaaacttaaataattcataaattcgttgaaatttattaaacaaatatgtaaattcaatataattttatttgctcaattgtaaaccttggttttttcggccggtcaattatattttaaataattatatgcgtgcctcgtctttgctacttttatttcatttgcatatttttatttctagatgatggccacccattatcattctgcactaacctcaaaatttcttttaaattttttaccagggatggagcgcgatagcgggattttttctgcgacccgtgatttgcgactgcggcaatttttagtccgcgcttcaccccctgtttcttagtaataattttatattatgagttgttgttattggtcttacaattagtcagttttgtccgcgaatcgaatcgttttgcgtcgtcagccgatcacttgtggaggctacttgtacctttttagtagttgaatttcacgcagcccagcagctgacagaataagcgggtaacattaaaagagtaaatcaacattctttggacaagaccaatttggtaatacttgtagattttgcaaatcgtgatctctttagaatatttacaggcttgtatcactcgaatttttgatttttaaataatatttggataggtatacgtatttaagaataaattttcactgacgaaatcactcactgacgaaatcacttactgacgaaatcacttactgacgaaatcactcactgacgaaatcactcactgacgaaatcaccgggaaccagtgtgtgtatgtgtccgtttttgaatttgtgtggcgatttgtttagtttttgcgttaaaaatgatttgaaaaaagaaatgtttggttttgctttttcattttcgttttgtcagtttttgcaaaaagcacagttaaaataaatttctcttttttttgtttttaatgacaaaatagtttttgtatgtttattaatgataatgaaatcgcaatgaatgctttctattgcatttcttaagagaaaaagtttttgtttttgttattatcaaaaagcgtttggaaatgaatgctcttaacacttttgtaaagaaaaagaattgtttttgtatatgcaaagtcaatggaaatgatcttacacttagttttgatattgtattgaaaaagttttggttcgagaaattgtttgaccttgaaatggagttcttttgtttttgtaattaaagcggatgtcaattatgcctcctttaatggatacggttttaattggatggatttatcgcacttattgtttgttttgacaaaaataagtttcttttaacgatataaggtcagtttatttgttctttttttgtatgtagatgtttatgtaaaaggaattattaaaatgtaagagaacaagtatttataatgaaaaggattttctacgcaaattgtatttcataatagaaatacgtttttaaaattccaaaattatgctgaacaggtctgaattaagtcccgtgattgacatgccgatgaatccgtaaaattgagttcattgtttggaatagtgaaggattgagtcctcggtgattggaatggcggagaactgagtcctcggttattacgatgccgaagaatccgtgaaaagtgaaggattgagtcccagtgattggaatgctggtgggattgagtcccgggaataggaatgatggagaattgagtcccggtgattggaatatcgcagaattgagtctcgatgattgcgatgccgaaggaccaggtgaggttaggtcccagtgattggaatgcaagagaattgagtcccagtgattgaaatgctggagggttgagtcccagtgattgaaatgcaggagaatgagtcacggtgattggaatgcataaaaactgagtccgggtgattgaaacgcaggagaatagagtcccagtgattgaagtcctggagatttgagtccctgtgattgaaatgcaagagaattgagtcccagtgattggaatgcaggggaattgagtctcggtggttgcgataccgaagaatcaggtgaggttcggtcccagcgattggaatgatggtgagttgagtcccggtgattggaatgctggagaattgagtcccagtgactggaatgttggagagctgagtcccggtgattggaatgcaggagaacagagtcccagtgactggaatgctggtgggattgagtcccgggaattggaatgatggagaattgagtcccagtgattggaatgtcgcagaattgagttccggtgattggaatttcgcagaattgagtctcgatgattgcgatgccgaaggaccaggtgaggttaggtcccagtgattggaatgcaagagaattgaccagtgattgaaatgcaggagaatgagtcccggtgattggaatgcataaaaactgagtccgggtgattgaaacgcaggagaatagagtcccagtgattgaagtcctggagaattgagtcccggtgattgaaatgctggtgtcttgagtccctgtgattgaaatgcataaaaactgagtcccagtgattgaagtcctggagaattaagtcccggtgattgaaatgctggtgtgttgagtcccagtgattgaaatgcaagagaattgagtcccagtgattgaaatgctggagggttgagtcccagtgattgaaatgcaggagaattgagtcccagtgattggaatgccgaaggaccaggtgaggttaggtcccagtgattggaatgcaagagaattgagtcccagtgattgaaatgctggagggttgagtcccagtgattgaaatgcaggagaattgagtcccagtgattggaatgccgaaggaccaggtgaggttaggtcccagtgattggaatgcaagagaattgagtaccagtgattgaaatgctggtgtgttgagtccccagtgattgaaatgcaagagaattgagtcccagt

SEQ ID NO: 1250 - DNA, 6022 bp, Heterodera glycines
cccccccccctgtcccacaaaattttttgcaaaagcgcggcgcaaaaaaatgcgtttttaaagcagaaaaaagtcgtcgcaaatgaggaaaatgatcagccgaaacaaaaaaaggttggaaaaatccattccgatgacaaatacaagccattaaataaatattaactatttttcattgtatataataaaaaattttaaatgtccttgggtttcatgaatttttcccattatgtccttgcaaatcggcaacccgtccttgaaacggagcatggacgatggcagccctgcattaatttattcacgggagaagatcataagaaaaatgcccaattggaataatgagtcagcatctccattatcaaatcagcagcagattatttggccattcttcgaccaccaccaaatcgcaaatgttttcatgcatttttggttttacatttttgaaaaaatcgaatttcgtttgtcttctttcggttaaacaaatccgggccatattgatgataattggtattttaaagtgagtgactgagagtgaaatcgaattgaatcgggccaagaaaaccgggaaattcaagttttaataaggcaaaatcaagagtcacgacttcggcaatgattaaaatgactaggaaatgtcggctctaatcaatagtatggtgtcagaatgtgtgccgttcttaccagtcgcggctttcgcatcacgtccacggggacgccgcgaaaagcggccaactatttaacatttttgaaaaaaaaactcgaatttgtttatttctggggccctactgatgctaatttacgactccaaactcaaattttcgctatccgaagaactgattcctacatattttgaacaaaaaagtcacaaaatttcaggagagctctctctgtacacattgaaaaacgaaaaccattagtcttacattgtttattcacccacacacacacacatcgacatacaaatacatacattcaaatatgcaattaattgaaatgacaacagtttttgggggattgatcatgtgaacgggggtataatacaatacaacaattggggggtcagacgatccgatttctgcacacgcatcgttcttcgggctggctcttctgctgctgatgacatgttgcactagttctgcgatcctttcgcctgtcgcttcagccagtcgtacaccgcgcccatggagtatcggttgttgcgctccgggtcccagatgtgctgcatgacgaactcgacgaacttcggaggcgcgtcgtggggaaattccagccggaatccgtttgtcacctgcaaaaggggggaaacgattaaaaatggagtttttttggatttaactcacctctgccatgatctcgctcccttgcaagtgtgcgaacggcgtctcgccattgttgaagacttcccagcacagcacgccgaaggcccacgtgtcgtccttcatggtgaagcggtggtccctcagagaattcggcgacatccatttgacgggcagttttgcgcctctctcgatttgctttgaaagtgccttggtcgccaggccgaagtccgagattttcacctgtggggaaaaatgaacaaatttagaagtttcatgacaaaaaaaatttttttttgatgcttttcacccaccactccgttcgtgtagaggcagttcctggcagcgacgtcgcaatggatgatgcccttcgagtggatgtggtccagtccgccagctgcgccgagacacatgtagagtttgacccgcgcgctccgccgctgctgcttcaagtagttggtgaggctgccgtccgacgccagctccatgacgatcatcaggggctcctggccaaccgcgacgccgtagaactggatgacattggggtgtctgagctgccgcatgactcgcgcctcgttcatgaattccaagatcttttaaaaaacggagcaatgtttaatatggacacagcttccccccccttcctcacttgctctttggtgctcgtctgagacacctctttgatggccaccgtcgctcgagtcccctgctgatccacgtagacgccactcttgacgatcccgaacgtgccgcggccaagttcattgttcaggatgattgaagtgtgcgacagctcccagtgcgcgcggggcacggccctgatgagagcgacgtgttgtttctgaaaaaagggaaaatgaaaaaataataagattcaagctgtttgattacggtggtgacggaagctccggtgcgcaggtagtggtcgacgaatcgttcgattgttcggaagcccttgtcgcagttgtccaaggtgtacatcccgttgtgacggcggaagatgacgtggttgaccagtcctccgacgttcacagacaatgcaaagacgcgctctgtgcccgaagtttcttctgtcatgcgcaccaggaagtccccgtcgttcggcagcagctccactacgtcctcgcgcggcagcttaatgttgaaaacaaaaattaaaatgtggagtgggggggggggggggacgtgctcctaccagtccgtggtagtagacttccattgaagtccgcttcgtgtgtgatgaagtgttgtagacgatggacgataataataataataatataatatgagggcgatgaagaattatgtgaggaaaagtgaggaaatgtcgcccttttatacaactttttttcccttaatttcgaaatttttttgcttgtctatataaagggagggattgcaaaatttgctttcattcattgcgcccgtcaaattttaattcttctattatgcgaaagatcgtctacttcaaactgttgcaaattgtgctcagtttggccttcatgtggcaacttctttcccttcaccaattctgcggcacttttgtctctccaaaggtgttgcttttgctttgacaattcatttgaatttaatttattgttccatgcttttcaggccttcctccatgacatctcaggtggccattgcaaacgcttcacgttcatcggaaaggactcaaagacgggcgaattcggcgcagtgttcgacgagcgcaagtggcacaaccaactgttcatgatcagcaccaatggccaaccaatcgaggaacagcaacagaaattcatggacgaattggccgagaaattgccccccgctggacgccactgtattccgataaccgtaagcaaaagctaatcacaacaaatacatgcaaaaataatcccattttgttctttcagctctcgccttttttctggactgagaaagacagaaatgtgctcgactacgttatggaccttttttccggccaactgctcatcgcaatgtgctcgctgctcactcttggcgtcggcttcatccgagtgttacgctctgcggcagaatatgaagtgagttcgatgcgtgaacacagacagcacatcagcccgacaaaaacgtgaccaaattgcttttcagtcgaaatccgagcaattttttgatcaaactgtgatcagtttttcttttgcgtgaccaaattgcttttcagctgaaatccgagcgattttttgatcaaactgtgatcagtttttgtcgtgttgcatgttgtcaaaattgctttgtttgccattgtgtctgtttctaatttgtttttcatttttaagttctacgactgttgcactgccttctattccgtcttctgctggagtgcctctgcttggttctcgtcgtgtttgctgctctattggacgccttcttggtcttgcatcaacttccgtgcggatgacacaaatgtgccgttggtcactttggtgagttttgccgtgcttttcccatttgattctacgtttttcaattgctgtctttcaggtgttcagcatcgtcatggtgtgtacgttcgtcttcgagattttcttcaacaattcgttgctgaaaaaccggcccgtgaatgcttcagtcgccgcagccgatcagaaattgcgcaatgatgtcgccaaggaatgtgccaatgtcgtcattcatcgacagcagcagaagaacggaagtgccatcatgcagacttaagcagaggacgagtggactgaagaatgatgctggtgccaacaaaacagtcaatgcgatgaaacgatatatgtaaagcataatatgtatttctctgctgtattccattgtatattccattatatcgctacatgtgaatgcattgtcttttatgcataaactcacacaggattcggatttatcaatgtttttttgtcagatttggaccatccaaatcagaatatttctgaaattcaaaacatattgcacactgttgcttttttgtatactgaatttttgctggctttctctagcttttaagtgccgtttaggcccgtataaatgtggcaaatgtttgctctgactaatacctatgcattattttattcgtccaagtggatgattaaatgaaaactaaaattaatttaacaatattattgtagaatttgtcaattaaattttgtattcacgggagaaaatacataagaaatgtccgtttgaccaccaaactgcaaactcccgctctttcattctccgatcagttttatttggttctagagcctctctgatcagtgatcatcgccgatcggagagtgaccggcggtcatccccctttggtcggacattgttgattgttgttgtccctctcctcctccgccgttttgctgctcatattttctaatgaattccatcgcttccctttcggctgcttgtgcgtcttcaactgtctgaaatttatcaaaatggatcgattgtcttttcatatgccgaaagtgtctttttgccataaaactggcgccacatatattcgtcaacatatccaggcagtaaattgcgctgcgtgcctgacatggctttgttcttcattttcaagttcttccaaaaattttccacgtggtttgtatgtgcaccggttattgggtccacaaaattctgcacatggttgacagactggtgaaatcggagtgagtgacgaccctctgatcagagtgagtgtcgtagatcaaccgacccacccatgtgctgtgctcaatagccatcagcagcacggagtagtcgatgtgctcgccgatcagattcactcggcccgggcatctgatcagccattgcgggtcgcagttgtcaaaccgttggcggaacagacggacaacggcggacgatgggccgtcgtcgatgcattttgaccgggcaacggaagaccatttttattggaagggacaaatcgattggcaaaaaataaaatgcccacaatttgatggaagtttggaaaagagtgatcagaaaagggcagtgttataatcagaatgtctgtctttgaaagagaggcattggacaaggacgggaattcggcacggcatttcccgggtcactcaaagccccgcaagtgatttgaaaacctaaagcccaatctgccgatttaattgaatgaaattgatgtcaaaatttccttttttctcgtattttcagtgccaatttctcacaaattcccgactttccaacgctttgaacgacacataattaaccttcgaaattaaggaattatttattggaatttaaataagaataaattatggttttcggtgcaaattggatgatttttcttctcccacaaatggaaatttggtgaatcgatttgtcaacaaaaggtccttcactttcgtttccctccgccctttccttctccgtaattattaattaatttaattgcagtgagtaactaaaaggcaaatattacactcattaattgaatagtttttgaatttttaattggaaatcgattggtggtgcaaaaagtggtaatttgtatgacataatcgaccgatgaataatgaaatcttatataataaagttgagtgtgtgtgggaatcggtcgttttggcgccgccgttttggcgacgccgttttggcgccgccgttttggcgacagggtcgttttggcgccaaaaaatcagagacgcagaaataagcggcagacaagcgcctcttcaatttggtgcagaattacattccgtgaacccgaacaatgataa

SEQ ID NO: 1251 - DNA, 1084 bp, Heterodera glycines
cagtactccctttcactgtgtcccctttttacctcctcctcttagtgccttcgtccgctttttcttcttcgtccatttccattggctgcatttcgtcgtcctcttcatcaatgatgaaatggaaagaatgttcgccacgattatcaatggtcactccactttcgctgcgctcattttcacaatctgtaactgatatctgaaaaaagtaaaaattaaaaatttaaataattaaaaataatgccataattaaaataattaattaattttctaaaatttaggcaaattaacaaaatgatcatattctcgagaaagataaaacttagttttttgcttaaaaataatatttcaagaaaaattgaaatgaaaataaattttaaaattaaaaaataaattcaatataataattttaaaaaatatttcccctcacaaattaattttaaaaatattttgatttgaagttaaattttatttaatacataaaatttttgcttcctttaagtgatataaaatactaataaattttctccccatataaatcaaaataccttatttaatttaaaatttaaaattttttttttacaaacacacattttaattatttaaatgattttcaaaattaataaaaataatcccccctttttttacaaaaacatttttaattatttaattaatttaaaaataatattaaaaataattcctcccggccccccgtgtttacccattttttacaaaaactattttgatttaattaattaattaattaaaaattaataattataaaaatcccccccccttacatccgccgcatctgtcgcgtccatttgcatcaccaaaatgtcgtatttcgtgctctcctcctccgtttcggcggccaacaaaattagtgcgctgtgcgcagtgaatgtgcgaaatgttttcgccgcggcttccgtttggtcggcatggccatgccgttgaacttcaacgtaatatacttggccatcctctgccctcgggccaatgaacagcgtgaaaaaggtggggaatctcagctcgtactgctccccattccggatggccaccttccccaccagctcgggctggt

SEQ ID NO: 1252 - DNA, 4050 bp, Heterodera glycines
cccagaaaatgtgtcaggaatacagtagtacataaaataaagtacagcagcattatgtattgtattacaaacagtcaaaaccgtataaaaagttcgttctgaatttgtttttttaagcttcaaaaaagaattggaaaaaatttatgaaatttaccgaattcctaaaaataagtgtactgtaaatggcttcttgtaagcttattcgcataccaatccacgatcatgatttccgctaataacaaaataataatactaccgtatctcttttttcaagaaattctggttcactgacgcattttccgatcacgaaagttttgtgcaaaaattaccatagactaaaaaataaggacaatggactaaaataaggacgacgcatctgagaaataaggacaaattgcatcccctaaaaaacacctcctggttgtcgtctgcgcaatacacgtcgacccggtacaacacttcggccttcttccggtcgctggtgaatgaaaatgccgccgcggccggagccaaattcggcaaaatgaccaatttgaaataattggcaaacgtaatactgaacttttgcatggtacggccaaccaagtttgctggcgagtgggtagtgaacggcttctgtgaaaaagtgccacaaaatgatccgtgataaaaaaaggggttgtgtgccaaaacggaccgggtcaaaacaggacaataaccaaacaaattgtgccaaaagggaaaactgtgccaacgcggtaaaaaatgacagaatggaaagctgtgctaaaacgggaaagctgtgctaaaatgagaaaactgtgccaaaaccggaaaactgtgccaaaacgagaaaactatggcataataggaaaactatgccaaagaagggaaactgtgccaaaacaggaaaaatgtggaacatgggaaaactatgccaaaataggaaaactgtgccaaaatgggacagtagcaaaatgactcatgctacgccaaatcagtaggtaccatttattgggatgccacccgtggctcagtcgttcgagattttagcacggcttacaaagaaagatccgtgggttcgactcccaccgggcgccgccgcatttttttatttttcttatcaacaaatcaaaacacacagccttttcctcacccatgtgtaatagagatgtttactgtccgccacttttgtctgctcattgtgtacaatggaaatggcaattttgtacggtcgccggcacttttccgcgtccgtgccaacattgataatgtactgaccatcgcccattaattccgcaccacgtgtagtgaagagcggcttttcattggagttgggagcaggacagctggtctcaaactgtgaaaaaaggtgcgggagggaattttggttatttttaatttaaaaattttggaaaaatgccggcagagatatatttttaatttttaatgaaaatttttgagaaatttatgtggcaatagagtcaaaaatgcttcttttctttttttgcctggcatttctaccaggtatggcattccggggccccaaaaattttccggaagtcggaaatcggaattccgaccccaaaaacctcggaaatcggaactcagaattctgtgccatccctgatttctaccaaaaaggacattttttcatccgattaacagtaaaccgcggcattcggtaattgccggctactgtaagataaaaattcgtaaaattttgctttaaaatttactgggcagatcaggctcagaggagaccatacaaaaaaaaaatcccgtgtcaaaaaactaatcaaaactaattttgtttatatatttcgattgttttaaagtttttttcgaataaggacaaatttttaaaccaaaaacttttatcaagaaaaaatgattaaattttggggaccaattttgtgaacattttttgtttcaattcttaggcgtgtattttatgaaattttttcagctcttctcaggggtatatttttcgttttaattgcatttttgttaaggatttttccaaaaatcctaaaaaaaggcgccaaaaatggcgaaataggcacaaaaacaggcatttcggcattaagcacaaaaagtccaaaataggcaaagtttggcattataaaagtcatcgtagacaccccaaagcggaaaatgcgtttttcgtgcttttctgtgcgtattaattgcgctgaaattttaggcatttgcctaaaaaacgaagccctaattatttttattattaaaaagaattttacaatgtattcgagttggtcatctccagcaagggacggagtcatcttaattttcaaataatttgatgggctgtcagcaccagcagaacggcagaagaagaatgtggcgattggcacaagacaaaggagaacaacaaaagccgtcatcatttagcaattaattaaagaattcaattaaacttttaaaaaggcaaaactcattagtgaaaattaattgcttctttggaaaatgagactgttttgctctgctttttatgtgtttgtagagagtatttaatgaaaattttcgatcaagtttaaagttttttatgaacttttatcctacatacgattgggcatgtctccgcttcggagcggatacacccgcatatgatttgcacaagggaaggggtgtcatatgtgacggcatatacgtagaaaagggagttaattgaaacgcgcatatgattaatcataggaaaagtcgtatgccgcgtatgacggcgtcgcagatatgatatcatatcggcgatatgatatcatatcggcgatatgataccatggcacaattgaaacacgcctatgacactatgacacgtcatatcatacgccgcatatgacttttggggtggtttaattgaaatagaaattttgtgtatgatatgacaccgtgtcatagagtcatatcgcagatatgacccgaattgaaataggccccaggaaacggagaacgagaccggaagcgaaaaaccgggaaatttcctgagttcgaaaaccgggaaccccgcgcatccttcgcatctatgaaaaagataaaataatacgatagtggtgttcgagagggtcatcggtctaagaacccgactcgagaaaactgtcacggcttttgtcggtctcgagtcgcaagtttttggccttaaaacatcactcagataatagttgctgagtgtaaaaagtcagtctgttttgtgactggttactgtacgctaacagttttggactcaaaaagtggtaaattttgctaaatttagacattttaaaaggtaattgggcgcaaaaaaaggagattattttatagcttttttacgaaaaaaagccagtgaaaattaattttgaacttttaaaaaatgcgcaaaatttcataattttttaaacccgattttttaatcgtaaaaagggaataaaccattttctacccatcttttaaaataaattttattaaaaaaaaattcagattcattgaaatattataatttagtggcgacattgtatgtgtatgtgcgcgttggcaatggattttttgatgacgaaattaatattaaaaattcgcaaaaatcaatagaagttgtaaatttgtatttgttgacaagcctaaaaattattcaattatatatttatgttatattatataatttcgaatattataatttatataattaaacaaacaatggcatgaaaaaagagttcctcgaatgtaattgaaatttattgtaataaacccatcttctacaaagctatgggagaactgtgttaattaacttcaaacttaaaacatgtgaagcaaactttaataaaaacagagaatttttctgaatcagattggcttttaataagaaccgagttttctgagctttttttcttcacaaatttaagcctctcaaaagcaatggttttgtaggcgcattttgtaggcaaaacgattaggaaatattaaggctaataggaataggcacgtacaatggctttgttttgaaaccaattccttcaaaattttggtgagggttctgagaataagaaagctaattcccaaatgggcgcgcaaaagttatgtagg

SEQ ID NO: 1253 - DNA, 1460 bp, Heterodera glycines
  misc_feature (50)..(51): n is a, c, g, or t
gggtccgggttcggaatttagcaaatccgagttaaggtttgtaatcagcnncctcggaaaaccccctaaaactgttttgagcccaaaataaaaaaaaaaattaaaaattagggacacccattcttcaggattgccctaaattgtacatcaaacccacaaatacatacatatataaaccagacatggtaatgaactacttgcatttatgccctcattttttgttgctattttcctccattttgttttctctgttcttttccatccaaaaatgaatgtacctattatgcattttgtgctatttcccctcttttcctcttctgtgagcacttttctcgtaaggatttttggttggaaaattgacgcattttcttttacagaaaatttagtaaaaaattttttattctgaaaatgactcttatccctcgtcagtggatctgccaaggcgcaggctgcaacgacacaagcgaagaatacattccggacgtacagcaatggatgaatggtcggtgttgatgtgatcaattgattcgaatttcttttttcgaatcggatacggaatttataaaaataggcctcgaattacgcacgcattcaaaaagaattcctatttttaaaagttggaacaactttccctgctgatcacgcgaataatgccaacccatttcgacttattcaaaaacccggatccgaattcgaagtaaaagtcgtccatttcgactaattcaaagccccgaattcgaatgaaatgagttggtaattcaaatttcctcccattttcagcgattggtgacatttcgctgtggatgctgaccggcgctgctgcaatgaccggccttgtcatctgcttaagcctactccatctgattttcgtcagcactttgatcagtgacgagaaaatacgctccgaactctattgggtggtgctaatgcctccggtgtgtgcaattaattaaataatttgtctaattagtaattaataccacccccccccccctctcttcaggtgatcgtcgtttgtggcttcaccggcatggttttgccgagggcggcacttttcctatacgcaattgcgctcgtctattacatgatctgcatttttgtgctcgtctgtttgatgaacacggtcaattcaactcattaatgctaattggttttcaatttggtgccaatttcagctgcacggttctcgcaaatcgatgtgcgaaaaactgatggccaaaggcgagcgaatttcgatcagaatttatccgtttgcttgttggttgatctgcttcgaggattttctgccgacagagtgcgttttacatggacattgagagagaaaactgatcagagaatagaccaaatgttttgaaagtgatcggaactgatcaaagaatggttgaaattgatcagaaaagtgctcccattgtttctctgatctaagattcccctcgggaatgaaaaaaactaattttttt

SEQ ID NO: 1254 - DNA, 2095 bp, Heterodera glycines
acggatgcgtcagcgatgtgaagccggaagtggtgccgaggacgggggatgaactgtgggatgacgacgacgttcagcagcagcagcatttgagaagtgatgaatcagagtgataagcaaaatgttgtgatcgaggaaaagtgatcgaaatttgttttattttttcgccaaatttactcataattaaaaagaccattatttaaaaaaagaatgtggatgctgtttttcgatattctcgtagttaaggctatgtgttcgattgactaaaaccctgaacaaatcgccagtcaaattttctatcacttaacttgaagtggctaaaaatgggcgttttatgtattctgagtagtactcggagttttcgaagatcctgaacacgattcttacatctatttcgaatatcgaacccgtactcgaacaaaaattcgatttcaatttcaaaatatttcacaataatgcactaagtaaaatctgacaatgtttattgtgcaaaagattgacggattgtgaaattttaggaaagatggaccatccaacaatgggtggccgacggtgtttgggaaatttgaatttttgactttttgttcggatcctggattcggaattggtcgaaatggataccgaattcgtgatcagtgacccctaaaaccgttgaaaattgaaaaaataaaaatgctcgtttttgggatataatcttttaaagaaattgaaccaattgtaaaatttccccggatttttctgtcggcaccgccggatcgcatttctttgtttaatttgggtctaaatatgcttcaaaaagtggcattcatttttttggccaattccgaacctcggacccgaattcgaacaaagtcgagaattcaaattttccagaatttacttttatgcttgagtctctaaagtaatgatcctttttaaatatttcaatgatttgtgactacatttagacaagtgttattatgacttaaaaattgcaattattaaaaaaaacgtgtggtaccatctaaacacggcgattcaattttgggctcccagtgcaaataagtttattatttatttagtaatcagaacgccaaaactttgcaaaacttgaatttatttgagacaagagccgatctcgagttaaaaacataactttcataaaataaacagggatccgatagagggggtcaaaatattggcctatgcaaaatttcaaaaagttaccaatagggaaaatttttttccaagggcaaacatttcaataattttaattcttttttagccaagtccacaatttaaggtcaaaccaaataaaatttacaatattctccagaattttcccttcaaaatgagcataaaatggttttatttgctctagtattcaccaagttataagctaagaaaatttcataaaattgtcgatgttgtacgtacaacttttttctgagatgtaaaattgcttagcattcgcttagaaaaagattccccttttcaaaatctttttttagataccaaatttgttcagtttagttgggaatgaagcgagttatggcagatcaaaataaaaaatacaattacgccaaatgcgctatttggcgttatgagtaattttgtctaacactgggcttgacccatagtgcacaaataattctgcctcgccgtgtaaactatcctttgaccgggaattcccgtcccggtcccgctctattctatttttaccgtctatgcatggacaggaaaataatacttgattaatttgattgaaacagcagccaaaatggggcctccccatccccgccctttttgactaaataatccgtaaaccaatttttgcgttaaaaaaatctgaccggcgatttatgacacatatgagatattgaaaaacaatccacagcttttttaataattgccttctaaattacgagctttggcgaaaaataaacaaaacgaaatttcgatcactttttcccgatcaccatctgtatgttcttcaaccgctacacttgaatatgatgaatgtccaatccctgcaaaaaataaaataactttaatatgatggtgcaaaataatagcatagaaagcctcaattaaatcatcctgacaactaactaaa

SEQ ID NO: 1255 - DNA, 1402 bp, Heterodera glycines
atcaattatactatctaattggaatgatgtgccattcaaacaacaaaaaaagcccaatttattgttatccgccggactctttttggttcggaatgagcggattccggacattttaaaaaaagccgaaccgaaatagtcgacgaagggggggggggggtcgtaacgaaaaggaaaaagaggaaaacaatcaaattttgaacaaatttacatggacggacggatccttttcaaaaagtaggcgtcgatcccccctttatttgacatatgattgaagacacctttaatagaatgggaaaatcgcttccatttcaatgggttaattagtagtaaataccccctccccctggcactgtccgctctcaccaagttgatgtaaacgcgcgggtggcccaactcgcggtggcccccgtcgcagcgcaccacgcgctcctcgctgggcacgggcgccagctcggcgatcaaatgggccgcattatgcggattcacttgcttcggcgtatactcgaaacgggcattgcgccagtcggttttgtcccaggtctggaaaatgggtgcggttttaaagtgaaatggtggattacttaaagcccgactaagaacgcgttcgccctggtaccaaccggttttgccaagcaaatgctaccaacattcgatagccccaataaatctctattcaaaatttcagattccgttacatttcaaaaaaaaaaagccaggaatatttaatttgggtgcttgtagaaaaaagtacggctctaatgcactttatgagtccaaacaattgacaatgccgggtttttatacaataacttttctatctttttggtatcattcgaaagcacaaagtctgaataatgtaataatacgagaaaacaagagaattctaacatttcaagaaagttacaaacgaaaataatcagcaattacttaattaattaaatcttttcaaagcaatttttggttcaagcaattatacaaaaacgtttgtttttaatagggcgcttgaacggcatcccctcggattacaggaaaaaatgtcgaaaaaataaaaccgaaagcgtagatagagatgctggccattttttaaatttcggcaggaccacattcccgaaaagttattaatagttgtcacattgactcctcccccgtccgcctcaccatcggtgtggtcgcctgcacgtccatgtacaagggacgggcggtggcggcactgctggcatgacgacaactcgccgcaatctccgagggcgtccaatggcaccgcaaaaacagctgtgacaagcgacgcatgagaagagatccgtccgtcggctttcagatacaaatttaattaaaaccgcgctggcaaaacaaacaattcaggggggaacaaaaaatggggcataaatttcaaatagtatga

SEQ ID NO: 1256 - DNA, 2037 bp, Heterodera glycines
  misc_feature (1993)..(1993): n is a, c, g, or t
  misc_feature (2018)..(2018): n is a, c, g, or t
aaaattccagtttatgattctttcttaaaagttttaaattttgttattaatgcccagaaagttttattcatccattgaaattagtaccgatcggaaatgacgaaatgcgtgcacttttctgcaaagaatcaaggggtgtactcctttaaaaaaatgccaagcacgtggcactgtatggttagaaatattcggcgaaatacacttgataaaaaaatgtaattacattgagctaggggcagtacaaatacagtaggatttcatttgtgggggttgcttttcattaaaaaattccagtttatgattttttcctaaagtgttttaaattttatttaatgcccagaaagttttaattcatccattgaaattagtaccgatcggaaatgacgaaatgcgtgcacttttctgcaaagaatcagggggtgtactcctttaaaaaaaatgccaagcacgtggcactgtatggttagaaatattcggcgaaatacacttgataaaaaaatgtaattacattgaactaggggcagtacaaatacagtaggatttaatttgtgggtgttgcttttcgttaaaaaattccagtttatgattcttttcttaaaatgttttaaattttgttatttaatgcccagaaagttttaattcatccattgaaattagtaccgatcggaaatgacgaaatgcgtgcacttttctgcaaagaatcaaggggtgtactcctttaaaaaaaatgccaagcacgtggcactgtatggttagaaatattcggcgaaatacacttgataaaaaaatgtaattacattgaactaggggcagtacaaatacagtaggatttaatttgtgggggttgcttttcgttaaaaaattccagtttatgattcttttcttaaaatgttttaaattttgttatttaatgcccagaaagttttgtttcatccattgaaattagtaccgatcggaaatgacgaaatgcgtgcacttttctgcaaagaatcagggggtgtactcctttaaaaaaaatgccaagcacgtggcactgtatggttagaaatattcggcgaaatacacttaataaaaaaatgtaattacattgaactaggggcagtacaaatacagtaggatttaatttgtgggggttgccgcaaatgtcgggcattcccttacatccaagtgaaaaaggggaaataaaattaaaggaaaacggatggaaaatgggagagaaaagggcggggggggggggaagagagaaaagaaaagaatgaaaagggaaaaaatgggaaaaagaaaaaaggtagaaaaagggatacaaggaaaagaaaaagaggaaaagggagaaaaaggaaaaaggtaaaggaaaagagataaaaagaaaagaatgaaaagggaaaagagaaaagagaggaaagtaatcactagggctgccaaaaatatgtacaaaaagtggtccaaatatgtacataaatatgtaagaaaaaaccccaaatatgtaaataaattttttttaatggtattttttgggaaagaaaatccccgtaaagtatgaaatagccacaaaatgacataaaaattactttttgtggtatttttaggcaacattttcaaacttattttttctttataaattttcaaaatatgtaaaaaaatgaaaatatgtacaaaaatatttgccgaaattttggatttttttttgaggatttccaaaaatttccgtaaaaaatactcaaaatatgtaaaaaatgaaaatatatatgaaaaaaatccaaaatatgtacaaatatgtaagaaaatcccgaaatatgtgaaaaatgggtggttgaggagcaaaaaacttttttcccgctgctgggtaaaaactgcacattttcactaaaaactacccaattttggccgttttaaggcaaaaaacttgcaaaaatagtggaaaatggaggttcggcggtgccgataggcgccgccgggaaacatttttggaaatttgagtgctatttgttacganaattgcctattaaattttcgtttgngggggggggaattcgaaaa

SEQ ID NO: 1257 - DNA, 1471 bp, Heterodera glycines
  misc_feature (30)..(30): n is a, c, g, or t
  misc_feature (36)..(37): n is a, c, g, or t
  misc_feature (58)..(59): n is a, c, g, or t
  misc_feature (68)..(68): n is a, c, g, or t
  misc_feature (80)..(80): n is a, c, g, or t
aaaaatgaaactgatcagattcgatcaganaattannagtgaaaggaagacaattgannagcataganaatgaaattatntaattaaaaaaacccgtctaattacacggcaattaattagcaaaaagccaattagtgaatgcattttttaatccactttttttttattcgattcataaatgagacatttcctaatcaaaatattttacacaacgattcatatttatagtgcaaatcactgaaaaacagcgcaacatttctgtatgaccgacgaatgaatgaccgctacacttgaatatgatgaatgtccaattcctgcaaaataaaattttaattagatggtgcaattatagcttagaaaccctcaatagaagccaaaccccactttgcttcgggcgggagaggggctaacatccggtcggggtcgttttcgtacgagcacaagtttttggctataacttttttctttgccaagcaaatccaacaatctttttatcattcaatagtcccaagagtcctttattaatctgcaaaattttgaaaaatttcgttaggttcaaaaaagttatgctcagaaaatttcaaaaaactgggtttctaaacatttttgaaccgtaacagaatttttcgaaagttggcaaattaatagaggactcttagagctatcgaatgataccaagattgttggatttggttgctaaagaaaaaaattataacaaaaaattgagctcgtatgaaacggcttggtccgctaacaaccccgaccctcaggcaaatattttaatatgctctgtaaaattcagccccgtttttcaattccatgccattcgttctgttcgccctgctcacctcggcctttgtcatgtgcacattgtaaaagcgttggccacagtaaccacaagcatgcgtgcccggcttgtccttaaaaagcacccaaaatgattatttagcaatgtataactttttggaatgatttgagtgccatccaaaaatcttaatttattgttaggagggacaaaacggcgccgcaaaaaaaatttatacataaaattaagaaaaaatatcaaaaaatttcagccagcctaattcgatttttttttgttctgcggcagcgttatgtcccagcattccaagtttccggactctttttgttcggaatgagcggattctggacataaaaaaagataaaccgaattatttaattttatttaccaaaattgcaatttcaatgacttaagaggcttttagagtagaaaatttcgttccggtttcaatgggttaattagtagtaaataccccctccccctggcactgtccgctctcaccaagttgatgtaaacgcgcgggtggcccaactcgcggtggcccccgtcacagcgcaccacgcgctcctcgctgggcacgggcgccagctcggcgatcaaatgggccgcaatgttcgggttcacttgcttcggcatgtactcgaaacg

SEQ ID NO: 1258 - DNA, 7263 bp, Heterodera glycines
tgttgtttttatgtgcacgcacccacttttgttcagaaggaacccaatgcgtcaaaacgaacgccttttgttttggcggcggccgctgctgctggtgttgacagtgaggggccaacagttgattgtaagttgccggtccgccgttttttattcttttttatgttgtttgttgacgatgacgacgacgacgacgacttgcgtttgttgttgttgttgttattcacaatctttcgataacgtttaaagtcaaacaggcctccaccacgaccacctctgccggcgcccccgtgattggtagtggcagcggctgcggtggaacgctgcctgctcagattgtccgccgccttgtccagcaagttcttaagtccggcacgtccctcctccgtcatagcctccttcacatttcgcccctcaagcatctgtgagagcacacgtgatccggtctccagtccctggcgaccaatcgccgcgcccgcctgtctaccaattggtaccaagaagcgaaggaagctgcgaaacattgagccaatcccgcccgctccgcgttgatagggaagtccggtgaagacggggtaagacgacgccgatccaccaccaccgccgccacccattgaactccctccaccactcatcaacatggtgtccatgcgcggcggcggttccgcaaagtgggaccagtccaccgccaatgggtcaaaatccacatgcatgtgtgtttctgtatgtgtcacagcaaattgcttcttttccacatctttcgtctatttatgtttttcgttttttggctctctttccaccatcaaaggtcaccaaacacgtgtgtgcggacaaaggcgctgacgagacggtcgggctcggtcctttgcgtctcaatgtgctgaatgatctggtgtagtgtccagccccggcaacggtgatgcaggaagtagatcacatgctttccgcagctggccgacctctcagactgcaggcagcgagcattgtgctgaacggtggtgaagtgtcggtccaagaagtgacgtatgtgctccgatgcgggtggccagtccgcaaaggagtcaaagtagtcagcactgtatggtgactgaacatagatggccacccagtgggtccccccaccggaagccttgtccatgttcaccaccatacagtgtggcatcggagaggaatgggacgggattcgatcacaagggaagcagccaacatactggtggcgagtgacatgacaacgtgacaaaattttgttaatctcatcgctgttcatttttattggacgcgcaaaaacaaataaatgtggtgtgaatgcaaaaaacagacaaacaatatatatgtgtgggtgttcaaaaatatggagttttccgaaaatgaagggtcaacgtgcaggtgccgtattgaaagggcatcagtgcgccggttggggttctgatctcaataaaaatttcggcaatctcttttgtgatcagctgatgatattgaacagcggtgtatgcctcttcaaccatgtcgtccggttgggcactccgaatgcaaaccattcgcagcactggcacgcacacgtcaccgatgatcaccggctcgatgagtccgggtgcgtacacgtagaaggatgagacgccgcccttcatgtccggctggtaacgagccacactcatcggtgcagacaggtggcgcatgtggaagccgagtatgtaggcaagttgctcggacagctccacccgtttgatccgtgccgggtcaatctgcagtcggaaccgttgctgctccacgtcgaagctgaagcggcaggacaggcgtgccttgcgatacgactgcacccacagctctagacccaagggtaaatgtttgttcaacaaattgcgctccgcctcttccattcgttgggcgacaagcgagtccaatgtgtgacgataatgggcattgaactgtgtccgtttccattcctctttctgttcattctgctgcatctgctgtaacatttcatcagattttggttgttgcatttgttgttcatcttcttcattacgtttggtctgatttcttggttgttgttgttgttgttcctccaacgaaagaagacgttccaccttctttttggcgcttgtctctgcctctgcggtaagctgatggtagctgagctggatttgacgcaagcggctggccagctcctcactgccctcacccagtgcgtggtgcaagctgttcagcagctgtgtaggatttcgcacattgctggccggcaccgggatgcgcacctgctcgccggtttgccattcgacgtggacaaactggtcttccgttgtgcccagtgagggccatgaatgcgggtacaacaacaccgccaaacccacactccattgtgagccgaactgaagtttgcgtggcaggcgtacccgaaaggagtttgtacggttgccctccacctgcgtgttagacggtaacacaatgtagaaggaggaggaggaagaggaggtcatttatacttgtaatccgtaccatttgacgtcgttctgctccgcttattatatgattgatgtggccggaatccagctgttatgcgcagctgaatagcccttccatttgacgaagcagtgctccgcaccgtcgcgccccctccgccttctcagcacacgttcaatgtcgtacacaggccccacggtagtagaagcagcagctcccgctttatcagcaatgggttcatctctttttgactgtagcggaggtggaggcggaagaacaaggcacaaatcctgcgcatagaaccagccggtgagcagttcaccgtcgtcatcccgtagcttgtaggtgatcggcagtcgtgaggtgcgtacttctgccaccgtgaacagttcgtcagtgaagcgaggcaggtagccctttttgaacacgtgcttgtgcttttcaatacgcacacggtttcccacacggaaagggggtcgggcgcgtgggctttgtcgctgctgttggccggcagctaatcgctccagctggttgcgtcgtacgcgctccgcgttgccaaaattaatgtcgttgggcctgagaccgaacaatgcacggttcggcgacccgttcagtgcagtcacaatgtgctgtatgacgcctgtccaacactttgcgccgcgatgtgtaaagtagcggtacagcctttccttaaatgtttgttacacatgatggacaacgaaagggaaaaaattgtcatttcgggtaaaccttgatgcttctgatggcacgctccgcaattccggcatgccactggggtgaggtgtgcatgcaatggtgttgcacctcttgatcgaccaaaaagcgttgcactggggcggcggtgaactctttgccctggtccgtcatcagcttccatggcacatagccaacccggcggaatattttctcaaaagcttgaacaatgtccgaggagcgcttgctcttcaacggctccacaaacagctgacggctcaatgtgtccgcgcacaccaacaggtacgcgtggccgcgattgtgccgcttcagcgctgtgaaatcggccagatccgcttgccaatcggtatgcagacctgacgcaagcgtcggcagacgacggaaacgacggacagcccgacggtgcagggtgtacacgcgctggcgggccaaataacggcgcacctcggcccgtctgatgtgtcgcccggggtgttgtcgacgtgcctcaagcagcagcggctccacactggtgaacgcggcattggaccgcgtgtccttgtacagctcatccaacaccttttcaaccaacagctcacgtttttgggcctgcagtgctgcattcttgttgttgctgttgactttgtttgtgcttttcacgcgtagttttctcattgtgcgagtgagtgttgtgtgtcaccaaagttggggcttgaacaaaagagcactaccgatccgcttctttccaaacgccgcctttttaaatgtgtgcagcagtagcgcggaagaggcgccgccgcttccgcgaattttccttccccttgatcttcttgtagcagtaatagcaacagcagcggcattactgcctttgcgtttggtcaatatgcccccacgtccaccaccaccaccaccaccaccaccatgtccctcaccactgatgctgctagtgctagaggtggggaacagcaggtgtgacagctgtgggtgctgcttagcgttagcgatgaacgtttggtagccgggcgggggcttctgccgatggtgttgtggttgttggacagatgtaaaatggtaggtgagtacggcttgcaaactgctgtttttgatcggacggtatgaaccatgcatgaacttgtacacctgctgaccatcaccgatgcccagcgtgcccgcgtgacgtgacgtgtagtcaagggcctgctgttttcgtcgctgctccgcctcacccaggcccttagctccggcaacaacgacggcgcctgttgatgatgatgtagatgcagctgctggctgttgttgttgttcttcttctttttctgctccagaagcggctgacgtatacgatgaggcggtggtggttcgtttccttttccctttttgtccagtaatgccggatttgtctttgtcttgccgccgctctggatgttgaggtgctgcggctgctgcagggggctatggggatactggcggagtcgaatgaacaccagcccgggcagggaccaccgctgttgtacgcctgcgatgctttgtcaaggagggaggtgaatgttgcagttgctgcggtagttgttgttgcaatgttttggccgcctccgtcagcgcatcacgcaacactcctttggaggccggatcattcggcagctgattgaggcggacaggtgccggtcgttcctgctcatctgccaacagctttttgaaccgtttgaactcctgctggtagtggatcaggcgttcatcgtcgttcatcaatgcacgcgttgctggctgctgtgcagtgcgcgccacgcgcgccatgcgtttcgcaacgtgttcaatcggtgttgtggtggtggtgggtgtaatacccaaagcatcggtagcagcagcacctggcgccttttgacacagggagcggtacatttcttccggcaccaacaacattcgggttgagtgcttcattctggtcatgagtgctgttagttgtggttgtgtccttcttgtcgaggttgatgtattgctactgctgctggtttttgatcagcttatcaaccactaggggcagaacgacgctggccaggaggccagccaacgctggcacacccctgcccgtttgttgtcttaacagcactcggcgcgccccgtgtccactccgggttcggacgagcgcacgcacgtgctgggcctgggcacgcagtccgtccaaatgctttccacgaagcggcacccgggagcgtaggatgttcaatgcactttccaccaggcacagcagttgctcaccagtcgcacttctgaccagctttcgataggcccgtccgcgtgccgatcgacacttgctcaacagtttgaagaaggcaagattgcgcgaaatgtatttgctcggccttggccctttgtgtttttgtggtgtttgttgttgtttttgtaatcgatctgttttgctgctgctgttgttgtggcgcctgacgcccctagtgttcttccgcattgaacatgcttgtcgttgctaccgtggctgctgatgcacgtggtgcgtacaccacggtcagctccccggggtatatatgcgttttgagacgcatcagaggtcgtgtggtggggtgcatgtcgatcaacagatagccaaacgggtccgctgttgcgtcatcataggcctccagaaaatggtgcagtgcacccgggcccgggaacagctgtatgcccagggagcgaacctgtagcgcccctgccgggttcctcagcaacaccaaatagtgcgcgttgttgcgcgcgatgcgcagctctcgtgtgaacagatgctgtgtgatcaacacaacgctgacgccccaattgtgggagccacgggtgaacaacagatcaaggaacggggcacgcatgccgaccatcaggtcatccaacaccaatagcagtctgccgccgcacgctttggctgcccgcttcaccgcctcctcatcgggaagcgcgtggcaggggcggacccagcgccgccgcggttgaccccccttgtactcctcctcctcctcctcccccgtctcagtttccagttgttgtagtcgcagcacgtcttcattcacttccccataacagtagagcacacccgaaatgtgtgcggggccaaccagggtgtccaggttggccaacattcgcaatacccatttcgttttgccactgcccgtacacccggacacacacattgtgaacggatgcttgaaaacagggggcacttgttgatggcggagaggttgctcttttgtctgctgctgcttcattatgccgtttagctcttgccccaaaataaaaacaaaagacatttgacacattatatatatatatatatatatatatacatatatacatattaaaaagcaactttacccccccccccccctcccgcacatctcgcatattaacatatataaaaaagtttttagcttccgagtttttgaataatcattcaatggacatgttccggttcaaagttcataacgctgtcaaagacaccgacgacgccgccgccgactctgctgcacacgatcaatgtcaacaacgccaacagcgcgaggttgcgtctcctcgcacaatgccgttgtcgttgttggttgaagagcaagctcatgtgtcagcagcagctgaggctgctgccgaggcagcgagtgctgttgaccaaaagatgtcggcagcgccaaatgacactcccgccatcactgacacgaaaattgattttatgactgatgaacaaacagtggcggcagcgccgccgcctctattcagtgagattgaaccgacgcagcagcagcagcagaaacaacaacaggtttgctctaaattggtgtcggttatttaattttttatcaagaagattcagtggcgtacagcggaaatcatcgcaccgaaagtggagctgtccgccgaggacaatggtgatgatgatgatgatgatgatgatgaggctggacaacaggtcaaacaggaggcggacagaaacggcatggatgcacatcattcaaattgtgcaaaagggccccttttgttcattgatgaacaggagaatgaggaggaggagagtgaggaagatgaggacatttcaacaacgcatcgaaggcaaggcatgactca

SEQ ID NO: 1259 - DNA, 6224 bp, Heterodera glycines
gttttcacatttttaccttaaggatcaatcttgaatttttttcgacatttacagcaagtttttggcatcttttcgacaaccgttggaagtcttcacaaaattaaaccacaggtaaaaaatgacatgcccagaaataaattattaatatttttgctttttaaatttgttgtttatgtgcattaccctcggcttcattagcatcaattccaaaaactctcacataattccataacggctcattaaacagttccatctcaattcgtgggttcaattcccaccacaggctgaccttttacacctccgccatccaccaaattcctacatgaggaacaaataaaattacaataatgagactgaatttttgaaaaaacccggagcctgaaccaggcccaagactatcgggatggtcaaggacagataggtctaaaataatgcagtttgaagagatggcaagtacatgagaattcagattcggatattgtgaactaaatcatctaaatgcttaaatataattaatgtttgaatagttttaattgaaacaaaaaagttataaaaattattttttgttaattaaaaagcaagttacccccccccccccctcccgcacatctcgcatattaacatatataaaaaagtttttagcttccgagtttttgaataatcattcaatggacatgttccggttcaaagttcataacgctgtcaaagacaccgacgacgccgccaccgactctgctgcaccacatgatcaatgtcaacaacgccaacagcgcgaggcgcctccccgcacaatgccgttgtccttgttggctgaagagcaaactcatgcgtcagcagcagctgaggctgctgccgaggcagcgagtgttgttgaccaacagatgtcggtagcgccaaatgacactcccgccattgctggcacgaaaattgattttatgactgatgaacaaacagtggcggcagcgccgccgcctctattcagtgagattgaaccgacgcaccagcagcagcaaaaacaacaacaggtttgctctaaattgatgtcggcaatttaattttttatcaagaagattcaggggggtacagcggaaatcaccacaccgaaagtggagctgtccgccgaggacaatggtgatgatgatgatgaggctggacaacaggtcaaacaagaggcggacaggaacagcatggatgcgcatcattcaaattgtgcaaaggggccccttttgttcattgatgaacaggagaatgaggaggaggatagtgaggaagatgagcacatttcaacaacgcatcgaaggcaaggcatggactcgtcatttgactacgaagacgacgatgatgatgatgacaatgacgatgatgatgatgatgaaatggaatcagtcagcggatgtgcggaatcagacaaatgtggtcactgtcaccacccacatcagctaccacgaaatgctttggaggtgctcaaaatgccgctcattgactacctgtgtgcgctgaaccatggatgcagcgtgggagagctgcaggccttgttcctgtctaagggcgcacatggtcgcatggtcacccatctgcagaagcgctgcctactgcgcactgtccatttgcgccccaccgagcgcaacatcacactacatgcacacaattttagtgcacgaagcgccagtctgacctttgcctgcggtgggtatctgaacctaacggtgagtctcatccgtttatcgcttaaacaatggacaaataaatataatgatggtccatcttcggcttcaggtacgtcaatattttttcgcaaaacatggcgttcggctgcgccatccaagtctgcccactctggtggaatttggaggtggaatgcatgcttcatactacccgcttgagtgcatccaggtgcacgtcgcggtgactgcaccggaggacgctgccagcaccacctccaccaccactaccaccaccaccgcatcaccaactgcgtgtgtccgcctcacaaactaagcacgggcacaatgaccgcaatcaatcaatcaatcaatcacattttttaaaagcccgttatttacgtcttttattgagaagataaacgcattattgtgaaatgccagagcaattagtgatcgtaaacagcacggctacgtttgctgtgtggcgcttaaacggaaacaatcactcaccgtcccagcagcaacagcagtgcttttcccttgcacagtttttggctttggcacgcaacggggtgtgcaccgagtacgcaccccaccgcttccacgccattgttatgcgcatgcgtagcggccctaggcagcaaagtagcgccaccaccgcgaccaccacccaccaccaccaccaccactgcactcatctttcgcagtggtcgcgtggtgctgaccggcattaggggtgtcccgcccaatcaaatccacgccctctgtggcaagcaagccaaaagggtttgccgacgagttggtgcggcactcaaatggggcggatttcccgcactggcgctctcactgagcgtcaacggggtggagatgcgcaatctggtcaccaccctgcacttgccctaccgactgaacattgaacagatggcacaacacttgtcatctcttggccaaaacggtgagagacgggtagggggaggggagggagcgaaagcaagactttggctgttcagatgtgaaacgggtgtgcctcgacttgtgcaccttccccggccttcgctgtacactggtgatacgcaggcattcaaatggtagggggacggcgaaaaaataaccaaaaagaagaaacaaaaaacaggggaaaacacactggcaacatgtctcttcttcatcaccggcactgttattgtgactggtgtgcgacaaccggaagaactggagcaagcagttgcgtcagttcgagcactatgtcaagagcatcaaagaaaatcataattttttaaaattttattgacacatgttaaatggtggaaaattaaaaattatttctacaaatatgttttgtgtgccgtgtggtctgatcccaagtggagcagccggccaccggctccggctctgcatccggctcgcgaagcggtgactgtggtggtgagggcggtggcgccacgcactgttcgaccctggcacgcttccgttccggccctggctcatcatcatcatcttcatcatcaccaatgtcgttcggccaaacatgctcccgccactggtcttcctcctggtcagctgcagagggagccatttgcatgggctcttcctcctcctcgttcatcactgtgctgtcgggtgatgccccgccaccggcacaacagctccatccaaatgggcgagtgcgtatggactgcggcggcacttcatctgaaaaatttaaattgttgctgtgtgtgtgtgtgtgtgtgtggtcatcatagttgctattgtccctattgttttttctgttttattttgtgactcaccaacacactctgctgcaccccgccgaagcacgcgcccctttgtgtacacgggccggtacacgcgggtggagcggcgcgtgaagatgtccgcctggcggttgcgcacaaaccgctggcatggcacagagatggtgcgctcctcctggccatcgcttccgtcagcagcatcagccgcgtgacccctctgttgttgttgttgttgttgttgatgctgctgcctgaaaatcatcaaaattaattgtatggtgtgatcagagtgcctcggtgtcctccccccattcgccccaacatgggggagtggtggcgtatttacccgctgccaaagtggttgatgaccagctggcgcatgcgctcatactgcagctgctggtccgccgcatagttgagctcaaaagagcgcaccttgcgctccgccttcaggtcgccgcccgtgcacgcgtccacgtgttggaacccatagttctttgggccggcggcgaagaagtcgatgatgcgacggccgggcagctcccgcttcatgtcacccaacgcgttgccctcgcgcacaccttcagcgccacgctgcttcacgtacagcacactgtccgtgtcgcagtacagagatcgaccgcccacccgtcggacctcctccaaccagtcgtacaggtacagccgagcatgggacgtcacaaaacatgcgacgcgtgctaaataatgcttttcgggtcgggctaatacactgcttctcctccacaaatatttccaagacggagacaaatcactttatttaaaaccgcaacaataaaatgggagaagagtcggaggaaaataagaacaaaatacaaatatgaaagtgcactgccaacagaatgaattgaagggaagacgggggggggggaacattttctgctgggaagggagtggcaaaatatagattaggcgagagactacaatgacaggcaatgagacaaaaattaagaagggacaacataattactaaataaaatgccaataatcaaacattaacacatcccgaccctccgagaaaaggcgtcccctgccttttgaatccattcggcatccgattggtggtggcgagttaagcctgtgccggcgtccgtctcctaacattccacggtcgggctcttttcggtgcttttctcggcgataaaaaactctttggccaagttttgcgtcattctcgccgcgatggaatggcgattgggaacgacaatcggggtggcggtcgcatagacccaacctacaatttgacgacgaagccatttttgggttcatcttccccctacccaaattttcagttgtccctaactgaatttggcccaaattttgccttttccaaacacacttcatcgccttttcgtttggcacgcccactttcatttgaaccgaattcaatggctgtttgtttgccgcactttttccaaaattttcagaatttttgatcggaatttctttggttttcagttggggcacgaatgttttgttgaataatgggctccttttattgtccacagcatttcgatttgatttcttctccaccactttacctttcttggtaccagtgtcgttttttgggtccgacctatgtttattcccctttttctgcccttctctgttggtactggtgttgccatggcacacgaaggttttgaaagtgatcagaggcgaattttcgggcttcgaagctggcgaaaagtctacaatgcggcagttcactgcgtcaagcattttgaaacctaattggtccatggcatttgtgccgaaaagcaaatcatagccaaatgtagattgggccacaaaaacacggattttcgcttctaatggtcctctctgaattggcaaagcaacaattccaaaagatttcacttcctttccatttatgtcgattatccggctttcagagcgggtgacgatgtccttttggcttactttgtccatgatttctaagaagaatttggccgaaatcaaagaaatttgggagccgccgtcgagcattgcatccaatttacgcccaaacaccgaaactttggctgccaaaattttaccaaccgccgggctttcttcccaaaatctacccttttccgacaaattcgttgtttttccgaagaattgttcgatttcagaccggtgttccaaatttacggctcctataaacaaattttcccttttcggcggttcatcattttgttgaaagtgagaattttggttcctgaatgattctgatggctggaaattgctgcttgggttgtcctggtgcgtctgttgtgtcgactgtgaatagcaattccgagaagtgtgtccgactcggccacaattatagcaaacaacgtgccttcgctgattttgggatgttccatggcttgacaatttagtcattcgccacgtatttcgcgcggcattttgaattgcctctgcccgtgccgcttgtgcgatgaattcgtcgaacgtcgctccaggtttacgtgtcatttccaaaatggtagccaattctgggttagggagggccctaatgaagtgcatggccgaatattcgtcgtacagctgttcagtgaggccgggatatgcacaacggaccattgccgagacacgttctccaagctgatcaatgctttcattcggcaaaagccaaactcctttcatcggttggccaaacgccgtcaattgttttgcatccgtatcgtctaattgccgtatgatcgctgttctgatcagttggtaatcgtggcgattttgatcaatcgcggaattgaaagctctctcagctttgcca

SEQ ID NO: 1260 - DNA, 2816 bp, Heterodera glycines
ctgaaacctgccgctgaaacctacgcctttgagggccttcctggcaagtttccgaaaattctgtttcggtccaacaccctgcgttcagatgtcaaagtccaacagtatttctacataaaacaccggattcgcctactgtaccctcagctcaagtgcattgttgagtaccacaacaagggccattgcaaatactacccattgggtacaaatttttgtccgaaaaaaataaaataaaataaataaataaacccccttaagagttgttggccattgaggagggctgtgagagtgcacccatcgaaaaacctgccgctgaaacggactatctggactacttgaactttcgcagtgggtggcaatcagcactctactgatcaatgaagcgtgcgagacaatcggaaaagttgggcgccttccctgagattgagttcgccgtcaacacaatgggcgtcacggtgtattgcccaaggcacctgcaaacgcctcggtttgtgccatgggaccagcccgggcggtgctcgagctgcagaagcggaactgttgagctggactacatcatccagcccgagggggtgaccatcttttcgaatcggctaaagacggacggcgagaactttgtgccatttgacgcaattggtaagcttctgcatgtgtttgccaaaaacctaacccttttcttaagtggattttgccgatcgtgctaaattccgcataagggcacgaaataaggtgttcactttgccgctgcgacacccggaggtccatgccgcaggcccgagcttggaagaagccgtaaaaggacagaaggaaatgacgcagatgccataagcacttgtccattttttccattgtttttgttcttgttctgatggattacccaagaataatcgaaagtgaactcgcttttcccatcccttcggggattattgtcagcgggccttcctcatcaggcaagacccagctggtccttcgccggttacggcacgccaacgtattgtttgatccccgccaaaggcaataggcatgtgtaaaagggttttatgtgcagtcatttttgtgtctagtgtgggcatacggtgagtactccacgcagattcccgagctagagcggcaggaagttgtccctcacgcaggtgcgccgtctgacgaaatgttgaaaaaaaaaagctgccaaagccttgtctgattgtgtacgatgaccttatgggtgacattgaggccaagaagcaggccgacctgtacacgaaaaaaaaaattgtaccacaacaatttttctgtgattttcctcacccaaaatttgttcgataaggcactacgggtgccaagatccaacgcccagtacatcttcctgatgcagccgcccaacgccatgttgagcacacgtaatttggccagtcaaatgttccctcgggagcagggcattctgatcgatacttaccgacatatgtgtgctctaccgtacggctacctgttcgtgaaccttcactgagccaaaaatgtacggcctttggctaagcgacaacgccaccggtaaggacgagtacaagatcaagctgcgagggaacacccaggacttggggtgatcaggaataaccgacaaagaaatttgtatgatgaatacccctggcgcatgtatttgtctgtacaaccctgacctcgatatgaacctgctctcagaagaagagcacgaccccgaaattattccataatttaatttttatttttcaattcatttcattaattttgtaatattttaacataattcctacttttgtcacctaatttttcccaaaatacaataatttcattaatattttttttttgaactctctctcgttctttgtacttcttttcattttggtatcgtatttgcatcaccttgtacgtagtttaattctggcaaataaaatttccgtttcagctttgaccaattggtgcaggggattggtttagtgggccccattcatggtgtacacgtgatcagattaattttggatatggtatacccttaaaattcaaaaaaaaaatttttttaacagaaaatgttaagactacagtacccttctcaaaaatgtgcttatgctagggaacccacacaattttcaggctaagcttttgtatcatattcgttttgttgagtatttcaccgtagaccccgtttaacacctccctcgcacaggggtttcagcagtcagactaagatcagtcgtgcgacagatctaatcctttagggtatttaaatctttggcagcaaattcggtggctttgatacaaaatcctgctcccaattgggtaacagtcagccggtaaaaaaagactgatcgtacacttgtataaacgaaacacgtgcaaagtgaaaattttttcaatataaagccaatacctaagcatgtctaagcctaaacataaagcagttctaagcctatgcctaagcaagcctaaagctgaagcctatacctaagcaagcctaaaagctaaagcctatacataagctagtctaaaaagctgaagcctaaagctgaatcctatacctaagcaagcctaaagctgaagcttataccaaagcaagcctaaagctgaagcctatacctaagcaagcctaaagctgaagcctaaagctgaagcctatacctaagaaagcctaaagctgaagcctatacctaagcaagcctaaaaagctgaagcctaaagctgaagcctatacccaagcaagcctaaaagctgaagcctatacctaactaagcctaaaagctaaagcctatacataagctagtctaaaaagctgaagcctaaagctgaagcctatacccaagcaa

SEQ ID NO: 1261 - DNA, 2740 bp, Heterodera glycines
gtataggattcagctttaggcttcagctttttagactagcttatgtataggctttagcttttagacttagttaggtataggcttcagctttaggcttcagctttaggcttgcttaggtataggcttcagctttaggcttcagctttttagactagcttatgtataggctttagcttttaggcttagttaggtataggcttcagcttttaggcttgcttgggtataggattcagctttaggcttcagctttttagactagcttatgtataggctttagcttttagacttagttaggtataggcttcagctttaggcttcagctttaggcttgcttaggtataggcttcagctttaggcttcagctttttagactagcttatgtataggctttagcttttaggcttagttaggtataggcttcagcttttaggcttcagctttaggcttgcttaggtataggcttcagctttaggcttcagctttttagactagcttatgtataggctttagcttttagacttagttaggtataggcttcagctttaggcttcagctttaggcttgcttaggtataggcttcagctttaggcttcagctttttagactagcttatgtataggctttagcttttaggcttagttaggtttaggcttcagctttttagactagcttatgtataggctttagcttttagacttagttaggtataggcttcagctttaggcttcagctttaggcttgcttaggtataggcttcagctttaggcttcagctttttagactagcttatgtataggctttagcttttaggcttagttaggtataggcttcagcttttaggcttgcttgggtataggcttcagctttaggcttcagctttttaggcttgcttaggtataggcttcagctttaggctttcttaggtataggcttcagctttaggcttcagctttttaggcttgcttaggtataggcttcagctttaggctttcttaggtataggcttcagctttaggcttgcttaggcataggcttagaactgctttatgtttaggcttagacatgcttaggtattggctttatattgaaaaaattttcactttgcacgtgtttcgtttatacaagtgtacgatcagtctttttttaccggctgactcgttacccaattgggagcaggattttgtatcaaagccaccgaatttgctgccaaagatttaaataccctaaaggattagatctgtcgcacgactgatcttagtctgactggctgaaacccctgtgcgagggaggtgttaaacggggtctacggtgaaatactcaacaaaacgaatatgatacaaaagcttagcctgaaaattgtgtgggttccctagcataagcacatttttgagaagggtactgtagtcttaacattttctgttaaaaaaattttttttttttgaattttaagggtataccatatccaaaattaatctgatcacgtgtacaccatgaatggggcccactaaaccaatcccctgcaccaattggtcaaagctgaaacggaaattttatttgccagaattaaactacgtacaaggggatgcaaatacgataccaaaatgaaaagaagtacaaagaacgagagagagttcaaaaaaaaatattaatgaaattattgtattttgggaaaaattaggtgacaaaagtaggaattatgttaaaatattacaaaattaatgaaatgaattgaaaaataaaaattaaattatggaataatttcggggtcgtgctcttcttctgagagcaggttcatatcgaggtcagggttgtacagacaaatacatgcgccaggggtattcatcatacaaatttctttgtcagttattcctgatcaccccaagtcctgggtgttccctcgcagcttgatcttgtactcgtccttaccggtggcgttgtcgcttagccacaggccgtacatttttggctcagtgaaggttcacgaacaggtagccgtacggtagagcacacatatgtcggtaagtatcgatcagaatgccctgctcccgagggaacatttgactggccaaattacgtgtactcaacatggcgttgggcggctgcatcaggaagatgtactgggcgttggatcttggcacccgtagtgccttatcgaacaaattttgggtgaggaaaatcacagaaaaattgttgtggtacaatttttttcgtgtacaggtcggcctgcttcttggcctcaatgtcacccataaggtcatcgtacacaatcagacaaggctttggcagctttttttcaacatttcgtcagacggcgcacctgcgtgagggacaacttcctgccgctctagctcgggaatctgcgtcgagtactcaccgtatgcccacactagacacaaaaatgactgcacataaaacccttttacacatgccttgcctttggcggggatcaaacaatacgttggcgtgccgtaacaggcgaaggaccagctgggtcttgcctgatgaggaaggcccgctgacaataatccccgaagggatgggaaaagcgagttcactttcgattattcttgggtaatccatcagaacaagaacaaaaataatggaaaaatggacaagtgcttatggcatctgcgtcatttccttctgttcttttacggcttcttccaagctcgggcctgtggcgtggacctccgggtgtcgcagcggcaaagtgaacaccttatttcgtgcccttatgcgg

SEQ ID NO: 1262 - DNA, 2784 bp, Heterodera glycines
  misc_feature (50)..(50): n is a, c, g, or t
tttgagtttttgccacacaggtaggcgttcgctttgttcaccgctcgggnggtgttcaatatttctgctaatttttcgggtttacagcttagcaatttggatagggcggcagtcagagggagtaccatagtctgtaaaaatcaataagttggcttggggttacagtgtgtgtttaacttagtgccctttggtatctttctctaaccactactctatagtccatgtgtttctggatgggcgtggcctatcgattaagaagggactgcccgtctggaggtcgctgcgcgctaacacactcacacgatcaatcaataattatgtgttctttcgcaggtccattttatgtttttttaacaattataatcataaactatttcctaatcgtaatggccccgagaaaaatcaatgatcaattggtgtttgagaacaaaagtaatctttttttttgagtttcttataataataattaaatttgaagaattgcatatggatgagctgaaaaaagaaaaattttcccctcaaaatggtgatgacgtcagcatcattggagacaacaacaacaacaacatcacccaaacactgcttgacctacaaccgggcccctcaaaaaggggacggaagcctcgcctggacaaaatccatgaggaaattgcttctgcagtgaagaaagccaaggccatggaaattgaaggtggttagctttttctgttaatttgctcaaattcgcaaaatttagtggatgaatcgcccaaaaaacaaccgaaaaatgtgtttgattacccttccatattttggaaattgggtcgcccaaaggtttttaacaaaattttgttaaaaattagcaaaatgtttagtatggtgtgttcacgttcatgtgcgatgagtgtcgtggcgaaaatttccggcagggaaagagcagtttcaaactcatcaatcagaatggcgagcaacagcagcgacttgtgttcgcccaatcgttttgccaagactgtgcaaagctgaactttgactgcaccgatctgatcatgaagcacaaaaagaaggatgaatcggcaacgacaacgatggcaaagagtttccgatggaccaaggatgcagaaaaatgaaccgagttggcacaccacatataaggacttttttgaaaattttatacttgttgatcaaatgacaaactttttctttgtaattctgccgagcaatacgccaggctttgttggaaataaaacaaacaaattcaaagtacacttgactaagaagttggtgttcgatagggccgggtagatcgttggactgtcaggcataatttgcccaaacaggctggggaaaaacatgactttggggtcctttttgtgttaagttggctacatggaacccacaatatgtaatagttcacctatacagcagcaggaaatacggtttccgtgtaccaaaaggtaagctttctgtcgccacaattgcatgagaggggcaaactgacacaagaagagtgaaggctaaatgaagagcagcagagaaaactaagagaaaatgaacgtaaacagctcgaggaatatgagaagtggcgcatggcagaataggacattgaaggcagaagaaaaaacggcaagggaaaagaaggcatgggatgagaagttggcaaggcaaaagacggcaggggatgaggctagggaaaagaaggcaggggatgagaaatttggctagggaaaagaaggcaggggatgagaaattggctagtgaaaagaaggaagtgagaaagaagccttgggaaaaagcctgaggttgcgagaatggcaaaggttgaagagtagagagtggcaaaggcagatgaaaaagcacaattaatgtgacacatttttttaaaaataattttcatttatttgtttttccccaaacttaatgatgaaaaacggctcgaaaagggtttggacagtttctcaaatgtgggcgaaaaaactcagcgaaggttagaatgaagtaaaaaatcagcgagcgtccgtcatttttctgtctaacgatggttgtccccaaggccgcggagaaggcacaactgttcgttggtgttgacaaagtggtgtcggttcttctcgcgcagggccccaagcttcgcgatggggtcaagaaagtggatgccctggaaaatttgaggaaaatataattaaatagcaagggtacgaataaatgaaatatagtcaaaccgtggggtttgttggacaacaaaccggaacagcttacccaattttacatgcattattattcactgttaggtgaaaaaaaaattttttgtgtgggtgggaagattcagcctttttaggccggaagcaaaaacgcgcaacggaaagcaaaaatttttttgtagtgcctgttaaggacaaaatttttaaaaaaaggccggcccgggctgattattttagaagtaaaacaacatggtcgacgaatgagcgtgaaaggcgatccatgaccgcctcgggcattcggaacgtgtccacaaacagctcgggcaaccgcagcgaacatgtgtacgcaaacgcagccaaatggagggatacggcggcaacaacggaaggtgggatgtgggccagcgcgtagcagaccatgacaacttcgctgacgaattcgcaaatgcccacacactctttgacggcgaagtgtagaagcgatagcgatgccgaaactgcacagcgtacggcatgctgaggttgaacttgagcccggacaacacctttataatgcgcacacaaagttatgactaattttttgaatttcaagaaaaatcgtgaaaaacat

SEQ ID NO: 1263 - DNA, 2607 bp, Heterodera glycines
actcacacgatcaatcaataattatgtgttctttcgccgttaacagttttatgtttttttaacaattataatcataaactatttcctaatcgtaatgtccccgagaaaaatcaatgatcaattggtgtttgagaacaaaagtaatctttttttttttttttttgagtttcttataataataattaaatttgaagaattgcatatggatgagctgaaaaaagaaaaattttcccctcaaaatggtgatgacgtcagtatcattggagacaacagcaacaacagcatcacccaaacactgcttgacctacaaccgggcccctcaaaaaggggacggaagcctcgcctggacaaaatccatgaggaaatggcttctgcagtgaagaaagccaaggccatggaaattgaaggtggttagctttttctgttaatttgctcaaattcgcaaaatttagtggatgaatcgcccaaaaaacaaccgaaaaatgtgtttgactacccttccatattttggaaattgggtcgcccaaaggtttttaacaaaattttgttaaaaattggtaaaatgtttagtatggtgtgttcacgttcatgtgcgatgagtgtcgtggcgaaaatttccggcagggaaaaagcagtttcaaactcatcaatcagaatggcgagcaacagcagcgacttgtgttcgcccaatcgttttgccaagactgtgcaaagctgaactttgactgcaccgatctgatcatgaagcacaaaaagaaggatgagtcggcaacgacaacgatggcaaagagtttccgatggaccaaggatgaagaaaaatgaaccgagttggcacaccccatataaggacttttttgaaaaattatatttgttggtcaaatgacaaattttctttgtaattctgccgagcaatacgtcaggctttgttggaaataaaacaaacaaaatcaaagtacacttgacaaagaagttggtgttcgatagggccgggtagatggttggactgtcaggcataatttgcccaaacaggctggggaaaaacatggctttggggtcctttttgtgttaagttggctacatggaacccacaatatgtaatagttcacctatacagcagcaggaaataccgtttccgtgtaccaaaaggtaagctttctgtcgccacaattgcatgagaggggcaaacagacacaagaagagtgaaggcaaaatgaagagcagcagagaaaactaagagaaaatgaacgtaaacgctcgaggaatatgagaagtggcgcatggcagaataggacattgaaggcaaaagaaaaaaatgcaaggcaaaagaaggcatgggataagaagttggcaaggcaaaagacggcaggggatgaggctagggaaaagaaggcaggggatgagaaattggctagggaaaagaaggcaggggatgagaaattggctaggaaaagaaggaagtgagaaagaagccttggggaaaaagcctgcggttgcgagaatggcaaaggttgaagagtagagagtggcaaaggcagatgaaaaagtacaattaatgtgacacattttcatttgcgccgaatctctgcggatcagacataatgatggccaacaggtggtccttcttctcgatcaatttttgctgttttgctgctttcttattggtcctgggtgatcgattgcttccctgcgtctggcttgttggggttaaaaactttggcacttcaatttcttcatcttcatcttcgtcggtaaccatcacggacttgtccttcggttcgtccggaccaggccgtacctgcacacccgtctccactgttttatttagcagttgagcgccgttgctgagctgtactcggacgggccgctccttatgttccttgcgcatcttcaggtaccggcgcaggtgctggttgtacattgcgttccgttcgctgacgtttcccttccgcttctgtactgcagcggtcacctgtcgtttgacaaagcccaagtttgtccgctcagcaatgtcgtcggcgtcgtcattctttgtctccctcgctgcaaccagccccttgtagtgctcgtacggcagcagaataagtttattggccattattgctgcgcgaaagcaggtatcgggcagcctcaatcagaatgggggccaacaaaggggcaaaaagtgatccgcctgactgctgcactagttttcgcgctcccctctcacttcgcacacgtgccaactgtctgatgtctttggcaaatggctcaagtctctgcttttgtttcctgctcagacagaaactcccgttcaaaacgttgaaacgaatctcgacaagcgataacagtacctcacaaccggcactgttcaacaaatgacggcgcttcttctccgacgttgtctttcccaacttcttcaaataatcgtagttgtgcacaacccgctcaccgatcttctgttcccgcttaaccatttttgagggaaaaaatgattctctcctcgtcgtctgggaaaatgtttgccattatacgcaaaacgatgcctctgatatcgcgtagagacaccatcaggtatgcgaacaatagggcacatgcctgtcattaggcatccatcaagaatccctgctc

SEQ ID NO: 1264 - DNA, 5413 bp, Heterodera glycines
gttttgctgtgagggttataagactgggaaaatgactcattttaatttgctcttttatcattaatattctaaaaatcatatttttcaaattctttttacaaacatcggctttagggttcaacaccggaatttttgattcatttctgctgtgtactgtcaatgcttttcgaattcggttcatttgttttggtgggttaagtgttgatgatcacccgaaaatggcaaagaataaagaaccttattgacttgaaaaaaaaatagggaaatgaataaggttgttagatgagaacgacggactgccaatgaaaacaaggaaaaatcgaataaacaatgagaaaatttttcaaaataaataataaaatcgtacaaaagtaatcatgtaggtaaataactgttataaaaaaaaatttttatgagaaaaataaataatttatttgtaaatttaaaataaaaaatataattattatttcagaaataacaataatttgataaatctttttaattacttaatttaatttataaatattattttaattatttggtcaaccatttcctttaactttaaagtttggaaaattccgttaattatttgtttattggctcccatcccttttgataatttatttatttatttagttggctcgcttaaggagtactgtaattaattttaacgaatagaaataaaaatttaattatgatgttgagaaaagttcttcaaccataaataaattaatttgttttaataaaatcaaaagttaaactggaggcagtaaattaaattgtattaaaaataaattttattaagaaaaaaaataattttttttaaattatttataagaataaatgaatattttattattaattttagaataataattaattaatcaattttaaattaaatttagtttattaatttttattttacagtccctcaattcgttccattcaaagcgaaatttagtcaaaaataatgttaattgatttgtttatttgacgcccttccagcaccatgcccttttgataattgaaaataaattgtgcatgatattataatatttaattgagaaagaaaaaatatatttgcgaattcaaaatggaatttttttaattaattttagaataattatttataattttatttgtgaattaaaattaaattattatgttgtttagaaataccaatttgataattcttttaattaattaggaaaattccgttaattgatttctttattgggtactcttttctggaaatttttaaaattaattttagaataattaattatttatttaaaatttttttatttgtgaattaaaaattataattattgtttgagaaaaaacaatttaataaaacctattaataaattaggaaaaatccattaattgttttctttattgggtaccattcccccacccttcccttttgataatttatttatttggcgcgcttaaggagtactgtaattaatttgagcgaatagaaatacaaatttgatgatcttgagaaaatttatttaacaataaaccaaataaactgcttttaataaaatgaaatgctaaaaagggacagtataaaatatgtatcaaaaataacattttattaagaaaaaataaataattttagagattttcgagattttataaaatatcattattagttttacaatttaaaatattaattaatcttttaataattaatttaataataataaaatataattttaattatacggacccccattcttttttcattcaaaccaaaattagtcaaaaatccgttaattgatttgtttattggtcacccttcccgcattcgttccatttgaaattgattgtttgttttagccctttttatgggtactggaattaatttgcactgatagaaaattttgataagaaaattcataataaataaatttatttgattgttaataagaacttcaaaagctaaaggcttacggtggctacattgtattaaaaataaaattttattaagaaatataaataatttttaattatttccaaatttaaattgaaattattttattattaattttagaataataattaattaattaaacgtttttaataataaatttaattaataatttttttaattatacggcccccatttcttttttccattttaaaatcgaaaattgtgaaaattcgttaagtgatttgtttatttgacactgttgcagcactcttccctttcttcattgatttgtttattttttcatctttaagggctactgtaattattttggattaaaataatgatgcaaaaaattattcaaaaatcataaattacatttggataaaaaaaaaacattcaaaagccaaagggttagaaaaaataaatgtgcatcaaagtataaacattcattgagtaaataaataattttaattatttgcaaattaattagaacattttttaaaatttaataaataaatattatttaaatatacggccccccatttctttttcgctttaagtcaaaaattgggaaattccgttaattgatttgtttatttgacccccttcccttctcgccacccgaactcgcaatttcccttatccctcgctgcaacccttcctcgccactctcgctgccgagcaatttctcgccatttttctcgttgcaatgtactctcgccacactctcgcccccctgccactcgctgctgcctactctcgcccccctgccactcgctgctgcctgctctcgccccccctttccccgctgatgacgtcattttttccctttatgagagcaaattaatgtttatcatccattgccaatgtggccgagtggttagtgcgtcaggctggccgccccctctggggttcggatccgcttggtgcggggaatttttggagaattttaaatgaatttaaattcaacgtctttgacctttaagacgtttaaaataatttaaaattaaataaatttaattaaaataatttgcataaagtcgcgcagtcaaaaaagtcgcgcacccccctgcaataggtttgggtttgcaagaaaaaagtcgcgcaataggtttgggtttgcaagaaaaactcgcgcaataggtttgggtttgcaaaaaaaagtcgcgcaataggttttggcttcagtactgaaaagtctggcgctcagatggcccgcgctcacttggcggcgctcaaatggctggcgctcagttggccatgcacccctcccacacctatggggggctaccgtaatccggtgaaaaagtgatgtgtaactactgaggcttccaaagagaacggagcgagccaaaagaaaaagaagaaattcttcagaaaagacggacgtggcaaaaagaagaatttcttcgctgtgggagcgaatgtgatcgccagcttgggtgatgagccatggcgtgccggacgtgtgatcagccgaaaagaaggcacttacgacgttcaatttttggacggcacgactggagaattcccggcaaaaggtgtacaaccgtacaagccggatgaagatgaaaatttgaattttcttcttgacgggtttggtctgaagagagcctcatccgtggatctatcgggaagcacggcagcgatggccgacgagatcaaacgaaagatgatcttcgagaagcttccgactgtggacacaaggcataagaacgccgatctgaggatgcggatgatggacggaggcccggcacttttcaagggggagatgttagggttgggacccaattgtccggtgcccattttgaccctttgtttcatttgtatttcccttctcccttcgttaagtcacgcccacttttccgcccataaatacccgcgatgttgacccttccccatcattcttttgcttcttctccatttatttgttccctttgctcccaatcgatatttgaccccgttcgccctgtcccttctttttgaataaatatttattttattcctcttcggactttggggcgtaacacaaataccgttccctctacagtaggttctttctatgaactaactcacccttcttttttggcggtatactttcggaatgtaccgtatgcaaatggttgtttagtgcggtcagccgtctgaagcgcatttggcacccgaagaacacacagacatgcgtttctgcttttggcaaatggcaaacaaagacgtggttgagaagccaatcgatctgagcgcagaaaatcaataaataaaatattaaataaaaaatgtatattaatatttatatcagaattattaacgaaaaattttccaaaataagcaaatcactggtcaaaaataagctaatttttgatttaatataattcaaaaaaaaccagtgttaatacaagaatgtttttcatcaattttcaataagcttagcaattaataaggcatcgagaaggaagtcagaaattttgactctgcttgtaacaaattttacaaaaaaatgaccatttgtggggattttcaacagaataaattttttgatacagttttaaaagatttgaaaattcgttaaaacatactgtagattactgtttactgtaagtttattcccataccaattaacgcttttacgatttggcatggcaaaatatatattaattattcaaaataaataaatttgtgtaacctttctttgagtgttcctccgccgggcaggcaaatcgcagtccttccatttacaagcaaatttttcttcgtcatcagtgttcttcaaattcggaagatcattatcatccattttttctttgtttttttcaattagttcgtcaatatgtgtcttaattttaattgtttaaaattaatttttttttaattaaatttcctttttaaaaaactaaactgttttgaggtgatcatacaatttgttgtcattttcaaatttcaattcacattcagcccattcacactttcttataatattttgtacaacaatttttttgtttctgttaaattttttgttttctttggcaccgttttcattttcatcgttggcactttttattttttcattttccttggcattctgatcattttccaccatttgatcaaactccgaaacttcttctttgatccaaatttgttctttacaacttttgttttctatttgcttgttttcgaccatttcaacttttatcccaccgcttttcttccaattagcaaaatcctcccaatcattgtccaaatgatcaattttggttgatattttgtccattattgccgattcttctgtttctccattcgcattctgaccacaatgatcaaatgatgatgatgatgccgactcattgtcagcactttcgtaaattgaccgctcaaaacttgatgatgttccgacactttctgaattaatcacatttaaacactgacgtcgatcattccaatttggttgaattcgataacaaataatctttttga

SEQ ID NO: 1265 - DNA, 1727 bp, Heterodera glycines
  misc_feature (1716)..(1716): n is a, c, g, or t
atcaattaaacaacacaaatacaatagtgaatatctgcctggatattattatattatttttcatttacattttcacttttatttgttttgtttatttagttaattataaataaataattaaagtataaataataaaagaatagataattaattctaaaattaaaatagattaataaacgaattaatttatgaaaaaatggaacatagtaaaaaattaaataaaaattaccctaccgtattttggaatttttttcctgctataattttttttcttactgtaataaaaatttaacgataagaaaattactcaaatttattttgcaaaaatacaatcaattaaaagcgactattagcattccttgaaaatacacataacatttactatttgcatctataaagttgaatttatgtagtaaaaatcatattaaaagtaaacaatgaaatcaaaatataagagctcaaaaatccgaaatttaatttgaaattaaattaattttatcaaaaaaattgttagccattttaacagtaatataattatttttaaataatttcataatattttaaatacatatattttttttaatttttaaaaattacaaatatacgaaaagtaaatattaattttgacatttccatttaaaagaattactataaatttataaatgtttcattaaataaaagccggcattggttcgtctgaaataacgacaaaaatgtaattattttttgcttgatttaattttcatagaaattaatcgtaataaattaatttaattatttataaagcctgatataagcagcacattaaaataaatcttataatacattaaatgtaaatgaaaataaattaaatcgaaatagaattgtaaagataaatattattaaaaattatgtttttgaaaattacttatttgaatggccagacaagaagatccacatcatcgagctttcaacgagtttaaaaaaaatgaaaaaaatatcaaagacagataaaaatatatgatgatgatgatgatgagtaattatttaaatcaattttattcaaggaaaaatattttcactaggaaaaatagaacattgaaaaaatctaaaattaaaacaaggactaattatttgaaaatttaactaattgtttgctttaaaagttaaacaatctaaaatgaatcaatgaaaaagttaaaatatttagtcaaattatttaaaattaatatgaataagctaagagtaaaaataaaattacaataatttaaccatacattttttaaataactctacatttataatttggtatccaacttaaaaattctgaagaaatcaaataaaaatccctgataaaaaattttaaaaaagtgcattcatttatttttagacaaaaattcagaaactattgccataattaattaaaattttcttttataaataaaaatattcaagagtttcaaaaatagatattccatagataagggatttacaaggtgtaacaaatcctgaaaaactctgtctaaaattttaaaattaaatctttaatttaaaaaatttaaatgtaattccttaggttggttttaaaggcttaaggaaattaagtttaaatatattgaatgagcaataatggattttataaaatttttacaaaataaagaaatatttctaaacaataatataaaattgtattatgtttttatattttccgtggtatcttttaagctgcactattgnagaaatcatcg

SEQ ID NO: 1266 - DNA, 6023 bp, Heterodera glycines
  misc_feature (5979)..(5979): n is a, c, g, or t
aaatttttattttttgtttctaatatgtttaatacaaataaaaacgaaattaagaaaataaatttataaaaatttctctggtggtgccgcaattattgctccgccggtacctcatttaaaaaacgaaagaaaagttgtggcaattttaaaaatataatttttctaatagtaaatagctagaataaaaaatgacgtataattaaatatattttatttctaacaataagtaattattattgaataaaaatattcatgaacaattaattagactaagcagtgaagtgattgtaataattttggttatgtaaaattcagtcgcgagtaaagtcgagcttcaaaaaagaatttacattttatttaattaaagcataatgagcgattctgtaaaaattaaaaaaacaaaagataataattaaaaatataatgaaacggtaaatgaattaaaattcatcttttattattttcataagctaaccgcgacgcagacgaagagtttaacgatctacgacaataataatttatttaaataatattgtatttattaatttaaatcaaattaaatatacactgtgtaacattagaatagggacaccctattttttgggagtttgaccacttcccatgagccgatcgagctgaaattttaactgtacgtagcaattctgaaaatatcaagattccgaaagtgagaaaccgaaatgatgacggaaaaatattttacgaattttttttccaattagttcaggttaattttgattattttagaagattttatcaaatgactctagtaaactttttaccttcgttttttctgagcactaattttttaaataattgatgatttcttaaaatagataatattcatctgacttattaaattatattgtaatatatgtacttcgtttaattaaattcatatcactttctccacaaattccatttccacgcaatggcctttgaatgaggtctctacgtcgcgtctccgcgaaggcgcgtcttgttgaaaatggatgtctcaaaaatgaggaaaaatggcttgaattgagccattttttggatagtcggtatttaacaaggcacccctcagcgaatacttgctatagagcaatcattcaaaggccattttgtagagaattttgtgctctttctcttcgtcataatcatcctctacggaaaatttttcccaaccccctagaatttttttttcgaatttactcagattttcgtattttttcaccgcaaaaattttgtgtttaatgccttttttatggcataaaatgaataaaaaatgcttaaaggatgtctgtacgttatcttagtgctgattgctgttagtttgattcggttgggcaaatgtttgaggtgatttaagccttttggcccttaatttctcctgaaaacttagaaaattcaacataactctgcctaaaagacatatttctgttcgcaaaataaacagaaatgtgaaaaaagatttgttctttcttatttacatagtttgttttatctgtttatttttggtagttgttgagattttgttcgtttttatcaagtgtctctattttaaattaacacccctttttcgggaaaaaattcataaaatttttttccgtcgtcatttcgccttctcctttttagaatcttaatattttcagaattgctacgtacagttaaaaattcagctcgatcggttcatgggaagtggtcaaactcccaaaaaacagggtgtctttattttaaattaacacagtgtacaaaatcagaaatctaaaccctctcgttgttttatcatctgttgagaagcagtccttctcttatcacttatcatttccatctccttagaattgttttccgtcaattccctgtttatgtccgtcttttttactatcttgaaaaaataaattttctcgacagaaattaaattaattgttatttattttccatttttaaattgtgacaaatgcctccatttttgggccatattttatttaccctttcacttatttcttcctttattcccattaccattccaatccaagtttcttcctctcattatgtcaatgctaccaatcacaacgtgaacatcgattcgtttttcacttttttcatcattttgaaaatgttcagactgtgtcatcaccatcttcggcattaccatcaccgcaacaatcggtagccccagaagcggtcgttcttccccctgtctttgaggcggtgaccatccaaatccgtcctcaaatctccggtgttcgtgtcgaggcgccactccattcaaatgctttccacacttacgagtaaggaaagggggtcattagtttgcacatttttggaaattattcattaccagggaataaaactttatttattccgactgatatttttcaatgttttggctttgtttgctgttcgattcgtctttttcgtcctaaaggtcttcaggtatttccgtcgttgagcccaatgttcccgtccgtgtggtcgtttttggtctctttttggaccgtatcgctttggttgcctttacaacggataactgcttgaactccggtcttttttcaaaaatttctgtcaatgagctaacaacatggtttttttgtatttagttttcaacatttcgcacaatgaatttttgtctcattcggagaaaatgatcgaaatgagtgcccaattcaaagagttggcgcaacatttaacaattttgaaaaaataattgaaacaacagagacgaagacgcgtaccgaatgtgtttgttggagaaaatagacgaactcggcgaaggcgaggaagaccttattttggtgggtgtttcaccctttttgagttttttcagagttttttcttggcctgaggggctgtattcaaaaattcggtttttatggagtatggttttcgtatgttagaaatggtttcttcatctcctccccttccatttcctagattgacgaaatgcgcacttggatccgtgccacttcggaccccccggtgcattacatgcctgaggaaattcaggtagttttgttcttgtcattgtttttgcagctttttcaaaatttcagcttctgttcatcgtatgccatttttcttttttttggttttcatttgccaattctttcccttcagttcactttgtttcttctgtccgctttgttctccggtctaaacctcggccttatggctttgtccccccaggagctcactctcatcctaaattctcggtgatttttcccccaaaatgatattttattttccccattatccatccgaccgtttgctttaaggctctgaacgcgaacgaaaatatgccaaggtgattttgcctgtccgcaaagcggggaacatgctgctgtgtacgatactcatcgtaatgcacacaattcgattcttatttgatgcccttctcattgtaagatgaatgtcatcgtcaactcggccatctccattctgatggaggacctcacttccggcatcgtcgcctttgtactcgcctcattgggaattgtcgtttttggtgaaattgtgccccaaagtgtgtgcattaagtgagaaggggaaatgttgtaaattactttggcacgtaaattttgttaattttagaaagggtcttcaagttggtgccaaaactatttggctgactcggtattcattgagtttttcaattaattttttccataattagacaatttgtataagtttcttcatgttgatcacacttccactcgcttggcccatcggaaagcttttggattgtattttgggcgaagatttggttggcatggatcacgaaaagttgttggaaatgctgcgaatggcacaccaacacagcgaacaccacgaagaactcgcggaagatttgaaaattgctgttggagcgatggaaattgcggagaaaattgtgcgcgaagtgatgacaccaattgaggtgtggttaattggacaaaaagccaacagtctgttgaatgtgtaatgatttggtccgtaggatgtgttcatgctttccgacgaggccgtgttggactcggattgtgtggcggacgtagttcggcgaggctacagtcgtatccccgtgttcacgaacaacgaccgtaaccaaatcaccgggtgattctttgacccaaataattctaaatttctatggtttattgtcttcatggctttattcggtttcagtttgcttttcatcaaagatttggcccttttaaagcccaacgaacgactgaccgtttccaccatttgcgacttttatgcacgcactttgcgtttcgtcaccgacgacacaccgttgcaaacgatgctcgaggagttcaaggaggtcgaaacgctaaactgactcaaaatggagctaatattcaccattcccagggtgaatatcacttggccattgttttgtcggagaatcacaatcgcgtggtgggcatcatcacattggaggacattgtggaggaaattctgcagtcggaaattgtcgacgaaagtgacgttgtgtacgacaacaaataccgcaccaagcgcctcaccaaatggcttacggtaattaatgatggactaataactacaaaaaactaattacatttaatgacttccagaagggaaagctccgacggattaccgattctgaggacagagagggagacaaatgcaaatggttgtccgagtcactggccaaagtcactgcgcaatggctgagtgccatgcgaccggcactttttggggacaaagctatggacacgaaggctctccatttgctcatccgtctgaatgcgcgcaaagtgggattttggaatcttaaataaattcaaatttctacttttaaaaataccaactttgcagataaaagtaggccaacgctgctcaaaattggacagtgaactgaatttggcaccccaagagcctaaatacctttacaggtaaatacaaaagtacctttttctaagttccatttaatttaaagagctggtcgaccttctgaccattttattcttctcatcgaaggaaatgctgtcgcccatttcccgaaggttcactttcgatttcgtctggtaaattataccctttcagaatcagatgaaatttgacgttggagcatgggaatgtttcggtactgaaattctcgaccaaatggaggcacagatggttaacaattatcagatggacaaaaacatcgggaaaatgcaccaccaaaagacagtggccacaaatggactgttagtccatcgacacagtgcgttcaaaaattcatttttaattttgtccgtttcgacaaatgagtcaggtgcattcgttgaactgagtgagggcattgagtttatttctgactttgacctgctggtgaggaaagattgccgcttcatcgaactcactccctcgtcctatgccaccgcttctcgactttcgactttgcttcgcgctattaggtggggaaagcaattagtaaatactatctaaagcatttttcgctttctatctatgaccatgttttaaaaaatgttttttgcagagatctacgtaaaacggatgggtctcggtttgagcggcgccgaaaactgacaaagcaagactcagtaaagactttggatttggtgaccgaggtagaaacggctcatcataattaattggtggtcattggcatagagtaacgagcgattgctttttggaacgtatataatatttgtgaagcctctcgttacctctactgatcatcagcagataaattaattttccgatccgttcaaacagggctctccgagggtgcagaagcaaaagcgatgcatctcaaccgtcgaaatgccactgctgaagagattaatatagtcatcggcagaaatgacatcggaagaatatttgcaaaataacattttgttattaccatccacttttctttcattgccaacataaaaatgtttatatcattttcaggctctattgcatttaggcgtccaatcaaattttatgcatcagcagattaattattattttttttanattttattcttcgtgtaaaacatattagggcaaatgttaatcgg

SEQ ID NO: 1267 - DNA, 3076 bp, Heterodera glycines
agctcctttatttgttatttaaagcaattgtgacaataaaaaagtaaaaaaaaatgaaaaatgcaaaaaaaaaaaaaagcggacacaaagtccatgagtaccaatgaaacatcacgaagtaaattcggcagtttttctttgttaacaaagataaagaaatagtacgtcaaaatgagagatgcatttttctcttcattctattttttcgttaatccctcgttttttgggacgaatttttcaataattaacgcttaattattgcagttgcagcaaattttctcagattggcagtactaatacgtatcaatgatgttaattttaaacaattgcatttcctagagataaagaaattggagtttgaaatgccaccagatattactccgccgccaactttggaggacaatttggacgacaaatttcagatgaagtgcttggaaaacaaattgagaattatctgtgtttaattttcaggcttgaagacaggacaaaagtcagtggtggtgaaacaagcgaagatgaaattgctgacttttctggcaatgaaatatcttcccgctcctccgaggatccaatgttttggacagcggacgacgaatgcaacttttttaagacattgagtgcattaaaagaacgcgacccaaaaatttacgagcaaaatgcgaacttttttgatgaggaaaatcagaatacaaaaacttacaggtttaagactccggtaaattatttatgccttttgtttcagcgatgcattccaagacattgaggcaaaaaaggggcggaaaacccaacaaaaaatgactcttcgggattacgaacggaaattggtggttgaacgcggcggagagtttagcgaaagtgacgaagaaatgaacatgccaggtccgtcctcttcgccctcgtattttgaccagcaacagcagcttaagaaagcgtaagtcgactttaagaatagtttattcttttccattcatttaatcgtaaaatttagtttcaaaagtgcactcgccgactctgatgacagcggaacggaagaattgctaaggaaacgcgagaaaagtgaacaggaaaaagtgagattgttccaacccaatttacggtgtcatttcgatttttaggtaaaagagcgggaagacttttacgaatggctcaggaacgaaggggcggaggaaagcggggcgatcatcgacaaggatttggtcagttctcactcatttttttgttgttgttaaagtttcctttttaggtcaaattgaaaaaacgatggtccgccagcggaggaaatcaattggacgaagaagaaaagtttttgagggattatctgttgaaccgaaattatgaaaacgatgaggaggaggaagaagaagagggcatcggaggggaaaggtaagggaaaaagccgaattctgttcaatatcaatctgcgaatttctcaacctgacagagtgcccacctatgaacaaatcattcaggaggaggaggacgaagaaatggccgaccaattcgaacgcaaatacaatttccgttttgaggacccggaccaggaatttgtaagtcttataccatatgcctaatgaccgtatgttaattttatgattttgtttagcttaaacaatacccgcgaactgtgcgcgaatcattgcgaacgaacgaatcgaaacggaaacggcggagagaacggcagaaagaacagcgcaaagaggaagaacagcagcagcggggggtgaaggtggaggaggtggacattccattccgatatcgcactgtgctcccaaattcatttgggctgtcaacggaagaggtcagttagaccaaatccaaagccacgaaatcaatttaaaaaaggatggataatggcacctttataaactaaaagtcgtgccagtgcatacttaaacaaggggtgcgccagggcgaggcccatacgacggacgattggcgcaggggcgtgtgccaggaccaatttgtcgtacgaaggcccccaattttctccggcggcgacattttttttcctttttttgctattcaaatcatttttttgcgaccatttttttttgctattcaaaccaccttttttgaggcgcgctttttaaaaaaattatggggaaccggaaccgtggcgccgctgggaaaatttattgattttggaaatttaaatactggcccggttttttgacgactccaacccctccccctccatccgtctctcgtttatccttggcatggatctatggcattaaattttcccatctctcagattatgaacaccgatgacagaaggctgaatgcttgggctccaattaaaaagctgaatcaataccaatcagaggaggaggaacacaagcaattgatgttcttccaacgaaagtcgcaacacattgaaaaaaagcggaaacttttggaagaaattgatttcgcattgtaagataagataaatagaaatatttacaaaataattaaattaaattgcttaaaatttgcaggccgaaaaaggcgcaaaagtcaaaagcaaaaacagaggaacaaaaagaagacaatgcaaagagagaagaagcaactgaatcaaaagatgaagaagaaaaagcatcaaaaagaaaaattaaacagaaaaagacaaaagttgaaaagaagacgaagaaaaggggccgagtggaggaggacggaacggttgacatcgccgagttgggcatggataggctgagggcgtacggagtgagcacgaagaagttgaaaagagctcacttcagcaagaaaaaggcagcagcagcggagagaaatcaaggggaaaagcagcagaagaaatcagaaagaacttaccaaaatgggacggattgacctaatttccaacagtatcatgttctgtttggccactgccatcattgaaacagttacaattttgataaaatattttggtgcttaaaatgacgattcatttatataaagtgctttttcattttttgtcaacatgtgacaatttcttatcattagggcttcgatttttaggtttttacatatttttttcctgagctccccgtggcctgaaacgcacgaaaaacatgtttttttgggctgttgttaa

SEQ ID NO: 1268 - DNA, 3501 bp, Heterodera glycines
aggtttttatttttagcacctaaaaaacctaaaaaaattttaaaaaacttattttcacctattttggcattttgcccaaaatttgttaacaaaaatgcaataaaaaggaaaaacagacccctaagaatcgaccgaaaatttttttcaaaaaatatacccctaagaatcgactcgaaaattttcaaaaatatacctatgaaaaaagaaaaatttctcaaaaatcatctccaaaatttatttgtttattttcttggcgagaattttttattttgaaaattatctatctcattaatgatttggcataatatttttgctttttgaagaaaattttcgattttacaccccaaattcggaactttttggcacctattttcccatttttagcacctattttgggggttttttagaacctaaaacctacttattttggcagtttttagcacctaaaaatcgaagccctacttatcatacctaaattattatttactttttggataaaagaaatttgggaaattatgaaatcattttgcaaatgtttatatatttttgccaaattttcgcaaatcaatctacaattacaatacctatttttaacttgcactaaaatttacgcaatatgtcgttgaacacggcgaatacgccggacggacgtggggttatcatttacagtggtgaaatgtaatgcttttttatatttctttgttccattgtttttctttattttttccgcttaggattttgcttttcgttcgcgaggttaatctttcttttgacaaattcactaacgccgagttcaaaggcacaaagaagggcaacctttacctaaccacgcacagagtttgttttgctataaacaatttgatagtgttaattcatccatttcaactgcggataaaaaatcaaattctttattttaacattgtcagatcattttcaataacactgaaacttcgtctcgcggcaatttcaagtcgttgtcaatgcctttcggatgcattcgaaatgtgaagttggaacagcccatctttggcgccaattatttggctggcgaattggtcgcacagccggacggaaattgggaaggagaagtgaattggaaattgacgttcaatcggggcggatgcatcgaattcggccaagctttgctgaaaaccagcgaaatgggtcggttcaatactttaaagcttttccgtaacgtttgataattggcactcattaagccaataacttttgtcctcggcccgcaaatgcgccgccgccgtacgctccgccgcctggcgcttattactcaccaccacccgcttattattggagcggaggccaattcaacggataccaggcgccggtccacgcgtttccagaccaaccgccgcgtaaatccatctattttgagttatgataaatgtccccttttcaagcggaaagtgtgttcatgtacgagcaaccacctccatatgcggggattgggccaattcgtggtcaaaatccggttccatacccgtcgaatacgcccatgtatccgccacaacagcaagttcagagcgaagttggtagttttttttctaatggatttttttccttatttcattagcctctaccaaccaacactccttccgctccaccagcgttttatccgtcttccagtggcaatggcatcgccaattttgctccctacccggctgctccattgccgtcgtacaaccaggcaaccgaattgccacagaaaccaaaggtcgagtgaaatgaacaagaaaggacagctttggcgtgaaatttatgatgttttttacaatttttggcattccaaaaacgactgtataatacaaaattatatagagggaaacgattttccaaccaactgtaatttcatttgcatatcctttgctctttttgtcatcttaccgtatgacataaataaattggaaattacaatttaagtgttaaaatcgtggttcattggtagcacttatcctttccgacacaattcggggaattcgaaatgtcgtcgattgcactcaaaatcggatgagagtgtctctaattgaatttctatgacttatctgtttgagtagaaaaattgcagttatcttttttttaattttctcgagccttccccgattcatcaaacactcgtgttgtttgttgtaaatttatttttgagttgctcctttttggcattatgttctcaaattaaatgttgctctttcttttcggttttcgcttcgcgaattccattttaaagagaaaaatggaaagaaccgaataaaaggggagggggtaggagaatatgaaaactaaaacaatgcacgtacggtgctaattgcagtcattagttgcttgccttcccataatgattatacaatctttggttgcctttgccgttttttaagtttttaaattttgattttaattaccgagtttgttttttattgattcaaaattcgatttaacatttttaaaagtttagacgttttcttttatatccagaagcggacatgttacggcttttttattgaatggtttgccgtttttagccgaccaattcactgtcccattttcacctgttccatccattcaccgcccttttattaattccattttatttcttattcatttgttttgctcggtttcggcatgtactaagtcattaatttgttggattcatttgtcaacggcaatctcttcagcctcaccatggcgcagcaccaactgcctatgaacagtttgtgtgccgagcgtggaggagcgccggtggacgaagaggcgggcggaaacaattttctcggtccttccccttccgggacgtacgacggtgactcggccaacagaaacaaccatcaccaacgcattcgctctcatgctaatggcaattttcatggccatcagcagtcggtctctttcacgtcgacgccttcctataaaacccatcaccaaactcaggtttaaataattttgcaagtactgtcaactttttttgttgtaatttttgttttcagtaattctgttttatgattttattttggttttacaaaaatactcccagggattatgatcaaaattggccaaattactactaggtcgttgcataaaaaagggcgctttttcaaaatgactttttttaagacttgattaacgtttgttatgtcttttttgtgtgtaattcttttatctgaatgttctcgtcatgtttttgccaaaaattttgattttgtccttttatatctaaagttacagtccaaaaaattgggtaaggtcaaacaaaatttggctaccattttacaccaacgtccataactttgagttaaaattgtcaaaacgacttaaaaacttggtcagattatgaaatttgatgagcttaaccaagaaaaaagcctgaaaaaaaattttttctggaaaaaaaaaaacaaaaattttttggcccatggtttattttggcccaagtttccaaatctatgggcaaaccgaaaagtcaaaacaaaatccaaaaaaattccctcgggg

SEQ ID NO: 1269 - DNA, 1491 bp, Heterodera glycines
tttttaaaaaaggggaaaaacttggggattttttgggcattaactttttttaaaatttgtttgagtgcattaaaaattgccgacatccaattcatctcgttattctgcatcagatgatattaaatttattagaatgtgttacacttttaataaagttacactcaattttctggttatggccaagtccctaattttggcaccaaatttcattggcccatggctgacaggagaacaacttataggacatgctacgtcacccgtcttattccctggaccctatagacttaatttatggctaaattatttctctcaaaaattccttatagggtaggctctttaaagaatatggcaaggtcgtggatccagtgaaaattacctaggttcaaagaatggcacagaattttacaaaaagggcattgttaaactcccatctcggcggcaaaaggttgtagacagtcagggcaattactttgttaagtagctttttgatcggctttgttatgattgttatttttcattttttgttcataaatttttttccttcaaaaagcgcccttttttatgcaacgacctagtaaccttggcaatatttttatcttttcagttgtattcctttgaccttcatttacatatttaaattaatgtattttatttttaggtttttatattccccccttaaaattcacacccattccttttgttcaggacgaccattgctttgtcggttcgaatgctgcctcgggcagtggtgagcatccgccgtccgtctgcactcctccgcccctctccgggtctcttccgccgattacctcacttgggaagcgcccattgcacccgcacaataattcctcacagcatcaaatgcaaaaactgtcctgtcttggagactttaacacacaacaacaaaaccagcagcacaacaatgcttctgtttcgtctctgatgtacaacagtaactaccaccaacagcagcaacatcagaactcgagcggcgccagcagtggcgtgtgttcgcccgcgtcgccgtttccgcctgccggaaggacgccgatgcaatcgcaacaacaacagttgcgaatgaacccgcagcaacaaagcaacgggggcaatgagttcactccgttggtccgaatgggcagcggaaacggtgctgttggacaacatccgtactcctttcggcaacaacatggtggtgggggtacagcggcagcagcgacaaatgcgatggttgcagcatcgtccccaatgatggccgaaaatcaccaccattctcaattggttattaaatgcacatctccgtgttacttactggtttaccataaaataatttaagcaaaaacaattgccgtcacctgcctactcagtccatgggatgaacaacagcaacatgaacaaccatgccaattcggtgatgtcctccaacccaggctcgatcatttccgcgttgcccgagtcgccgctgtccactcattccgtcaataatatcaacaa

SEQ ID NO: 1270 - DNA, 1779 bp, Heterodera glycines
  misc_feature (1765)..(1765): n is a, c, g, or t
atggtcattattcggcggtaggcccttcgccttgatcatttccacacagcgtgccctcctcctcttctgccgtgtgcggtgccggtggtgaactccaacaacaacttttaatttccgccgcacctccccttccttcggcgtccaaaacgctctcagccgagtcgctgtcttccccaacaaaacgcggtggtcgttcgagggcggttgggtcgacaaggacaaaaatgacggcgacaaattcatcaacagcgcgagtggccggcgccagcacttcagcaccgggcgggtcgtctgctgacactttagccagcacaattgcgtaagggcatgttaaatgaatgactgcgtgtgtaataattgttttgtttattaatgcttttaaatcgatcctttgtttaggtctgtggcttccggaggtggcagttttgaatttgagaaggccattggcacttcgccccttccgtcgtctctgccaaccgccggcgattcctccgccgctttattgacaccgactgttggccctgctgttggtccgagtacttctgcccaaccgcaacagttgacctcttcgcccggtgtgaagagacgaaagaaccaacaaataacgcagacggtcacagccattgtaaatgcattggaacagccgccgattgccgtggagcagcagcagtctcttcccgcttatggcggcggtgcgttgtcccatcctttacaacagcaaacatcacttggcatgcaacagcacgaacaaatggttagttgcacatggatgatgatgattaatgtcaacaagcaacaccattgctgcttcgggagggctaaattcaagggcgtagccaaacccttggcttcgggggggattaaaaaaatccgtttttagaagtgtttttttcttttgttagaaatcccgaattaggaggtgtatttacaggaatttataaccgttttttcgcaaaaaaatgactattttcataataaataattttagaaaataaaagttttttcaagactgtcccatcacaatgtcggatccatgtgcaaaacccgccccaaacgcacggcgattttccgcccacaggcaccaaaatccaagtggtgcacatgcaaccgccagcagccgccatttcacaccatcttcaacagcaaatgtccgacaatctttctcctcaacaacaggttttttgccatttgaactgcttgagtttcgactttccttcccccagatttccgtcgctcgaccgatttcaacgcgtctttcgacattacaacctgaccacaatttgaattcgtcctcctcttctgctctgtgcgattaccatgtggccaatgccaacaacaacgactccattaatggtgttcaccaaattgggccaccatcaattgccgaactgtcgtcctctgccgaaatgagccatcactccacgccgagagttgctgctgcaccgccttactcgccatatcatcaccaacagcaagtcgctgccgcgtttgtttctcctgcgccacaaaatcaacaccatttttatggaagcacaatgccgcaacagttgtcaccatcatcagcatacaaatataataatcaacagcagttgcaacaccattcttatcatgtaatgttggcaatattttcgagtaatgaactttattatattgaatgttgttaatgaattttggaaaatgattttcatttgtctgtttagccgtcagtcaccggctttaagcatcctccgcagccttcacgtggccatttttcaccgggtggcanactttatcgttgga

SEQ ID NO: 1271 - DNA, 1482 bp, Heterodera glycines
  misc_feature (1227)..(1227): n is a, c, g, or t
ttcgtttgttgtttgactcctgccctcccaataaaacctaaaggaaaacataggcgaaatgaatccctctcctgtatagctcgcctcaacggtaacatgtagcacggttgtaacccttcctataggcgtcccggttcccgagtcgtaaaaaaatcttaaatttctctcaatcatgcagaaacagaagagtggggtgcggcgataggtggcaatataatcagaatagcggctttcgtagtccctgtgtattataattttataatttgatgcctcaattaacaatgcctccacttctgctctgtttttctgccagaaaaactcttctttttcgagagcctcctcaaaatatttttgaaaagagtacattttaactgaaaaattaataaagaaaaaactcgaatagataacgattgtaatcaacaaaaaataaagaaatttaaaaaatttaaaaattatttaacaggaaaggaataagtggcaataattatcgaaattctctggtctaacaaattcacttccccaaatgattgctgtctgtgcatgaactcattgaaaacaatgtctgggttcgaatgttggaaggggcgggcagggatgatcactgggtccgacagggcactgcaatacagatcgactgaaattttctcaattttccagcccggctcagcttcacggttcatcgcatccgtcattaattttttcaggatttttttaaacatttgttcggggtcttcgttttctgggcacttaaaatagaaagtagtcacatgttcttttatcccaaattttttattttcgtttgtgtgactttccacttcttcaaaacattttcccaaattagaactgttcttgaaataattttttgtatttttcgagcggcgaatttcttttgaagtttcttggaaatttttctttgacattctaaaaataggaaacaagtttgattaatttaaaatattaaatgttataaacatgagacaaaattatccaaaaacaaaaattaataatatccaaatggtaaaacattaaagtgatcgtcaataattccttttttctgcactggcgtatattctttttgtacatcttttgagagaacccggaagtcgtttgtcggcccgatcttctccgggtagtgaaaaacttttttgacccctttcttgtaatccagcaccatctctttgaacaaatcatatttaaattcgtttcgcttatccaatgtcatccctnctgatttttggttttgtgccaaataacaccatccttctttcttctgagtttcaaggcgtactgcttcggacccgcggacacaaactccaaaatttcgctgtcggcatactctcgagtcatctcccttaaacccgcattttaatgcgtttcaaaaattatgttttaccccaaaaatttcccctccaccaacggacagcgccccttccgatgagcaaaagctagagaatctaaattttttggtggttattttctttt

SEQ ID NO: 1272 - DNA, 13553 bp, Heterodera glycines
  misc_feature (52)..(52): n is a, c, g, or t
  misc_feature (71)..(71): n is a, c, g, or t
cacctgtgtcacaatagagcagtttacacccctcctttcctgtagactgctnccatgtactcgtacagctntagcctcgcagcactcgtggtccacaatgacaaaacaatatttcgacactttatgctccctgatgaactcctcctttttccggtacacgactctgattaactcttcgcttatttttactgggcgcccaactcaaattgtattgtctctccccaattccatccaacgttccatgctgcccacaatttccgtacttgaaagggtgttgcgcatcgaaaattttccccacaaactgtttaatcccttaaattcgaacattttttagagattttttataatttctcaccaattttgcaatcattcttagtccgggattaaacccaatcttatcataatccaaaccgatgtcatactttgccttgtacatttcgatgaatgctcttttttcatcttcacttttcacctccgccggccaccccgacgcttccacctttatcttcaaaaacatccggacatatcctttgaacagttgactgtcaaactgttcaaaatgatacgctcgatagaatcccacaattctatatcctagctctaaagccttccgcaactcaattgatgtgaatgtccccaaaaatgctctttgcgtgggacgatggttacattttttcacatcttttgtcatcacaaattcattcttggcccttctcgcacaagaccaacaattagggaagaggagcatttcatcgatgtgcacagggaggagggggtacaaaagatttttcggtgggatcacttttactttcaaaagtccatcatagggtacgtcgtcgggtgctgtccaattcacattaaaattcctgctcactacaattttcgggactccaacggggtatggggtgtcttaagcgaaaggaaactaacaaaaattaagcagatttttaccataattaacaaaggggtacaaactaatgatgtcgaacattgatatctcaatttcttccgtagcctttgcgtacaaacaaaatggcatcgttcttcccccggcataagcatccctcggattgatcggtcccttgtccggcacactttcaaagaactttttcatctccttatttttcttcaattcctctctgacatcacactcctaaaactaacaattaataaatatttctaaatgttttattctacccaaacttctccgattgaaaaatttttgcacttttccctcaaaatttccatgcgaatttcggttctactttgattctcttccattgtccgtccgtttggcgctatagtccaaggtaaaaaacatctcggacacccgtgaaatgcacaccccttaagtattgtttaaaaagaaaatattttttcttttacctgaaactcaattatttttttctctgccccaatcacacagtccaccttcagcccaccaaattccacttctcctccgttacacgcatgccgcacttttactccctttttttgggccagccattcgaaatatttcactgcaattttgctctgattctcagctttctcataccctccctcaggcatgatcggaatatgcctgtccttcaaaaattttgccctaaatatctttatcacaacaccagcgattgtcacgctgtccttcatcacatccaaatctcctgttatccccaaaaataactgccgaaacttcaaaattgattccatcaaaatttcaacatcgttttcgcaatacgtcttgagttgttccccttaaattttattttcaaagaaaaaaatgttattttccctacctagttcaaattccgtttgaaaattctcattgtgccatgcttccaattttacggcttcttcctccttcatattgtccgggcagtagtctcccaaagaaggcaggttgggtaatctcttcccaaaattctcattcttattgtatttgtgtggaaaatacaatttagctgcagtttttaaccccaaggtttttggaaggtccgccaatttattctgactaagcatccaaaaatcccgaaagtacactcttcccgcctttatttgataaattttcaaatcagccatcatcaactccgtcgcaatttccttctttgttagctcggacaagacaaagtgtgaatcgaacctcccagcataatgcgcgaaagcaatcgtttcaaatcgttgaaaacccattatccaaacgataaactcgctcattggctcaaaaccatccgctactgaccatgtgattttcttgggtccttcacaaatttcacatttccgctcttctcccgcacaaatgctgcatgttagtgccacactaacaagattaggccgatgttctcccccctctacagtcgtctccaggtcgtatgccacaattctatatgctttctgcggccgcacttgaatttttttgatgaaacattgccgtcctgggtggaaaactttgcaaagtctacaaaacttttccccgcagacgtgtttcgaacgtgtttggtagacttctccacatttttcacattttttgtactcattacaagctcccttcttgtgcgcttcaaaacattccgggttgtagaacttgcgattacattcgccgcagtaaatctattcacagacatccgcgcatggaaagccgaaccccatccggcagcacttcttacatctttctttacattctattctgtgccgttcctttgtttgataattcacttcgcaagccgcgcaaaagttgcgaacgcagaaaaaccaggacaccgattttaacccatcccagtggtccccctctcttatcacgttgatttcatttcttcgaacaccttcccccttgaaaattggcttaagtcgggtcttctaaaaatatgtaacgggatatttttttatgcgaataattaccatttcaaaagcgacgatgcgaaagttgtccgggtattccctgtcccagtatttttgtacggcctcaaggtgttggataccaaaagttttgtcatctgtgctaattcctgccttttccattaattcgatggccaattccctttgtttcttttccgttttcatgagataacgaaaagttttttccgttataccttcgcctataagttggtagcttcgagcaatttccaaagcataaaaaagacctaaacacaagtaaaagtttctaaatttatgcggaatttacgggatttgaaactcactaattttcccctttggtgtgttaagccggcccgattcattgatttgggtgataggacaaaagcgagacattttatgaagggagtaaaaaaaaagccgatgagttgttactgtgagaaaggtcttttttgaaaaatacaatttgtttaattatcaaaaaatattgatcgaaattaatcaaataagaaataaaaaattataattttatttaaatgttattattggtagagtggaaaataaatggggggagtactaacatcgaaaaagaaataaattccggttcttcgggccattggtattgatatatgatctgggcgaaacaatcttctcatcatggaataaaaccgacatttaacaaagtatgccaaaacaaaatttacgcgcaaaagccgatgtgtttttggagggggaagagcatcaattatttccttgatcaattccgcgggaagcgggcagggcatggggacgtgaaatgttttaaaatgaagagaaaaaaccaattaattcattcgacaatatcttactagcaccaaaataatgcacatgaaaaaaaatccatatataataaaaagaaggaacattccaaaaatttcgtcatttcttttcattttttcataatctttgtcaaaggttaggtttagcatctaatttcttaaaattttatgattttcaaacaatttaggtaacgggatttaacccttatcaattcaaaaaattaaaaaacaacaaattttatcaaaatcaaaaattccattcattcattgaggcggacgtcttgggtcccttggtcttcctctccactcacccagccgtcggatcacttccaacactctcggggggttgggatgtatttgcttaagaaaagatgtttcggtgctaggtaaaagacagggtctgaaattaccggtccgtttggcagcgggtggtcgaatagtggcacgtctctcagctgccgcggtcgttgccatggttggattgcctgaatatgcatccgaaaatatgagaaacgcacgaaaaacaagacccaacattaccggaacgttttctggtggatgatacggcacgtttggcggcggatgggcaaattgcggtacggcgtattcacgttgaatttgtcgaacatgaattccctgaagaaacacccagagactgagaaaaagcaaacacaatttgatccaaattgaagtcacatttcgcggtggatggtgaatttgcggcatgtctctcagcggcaacggttgaggcatcggttggacacgaattacctaaaaaatgcattcaggatcttgaaaaaaagtaacaaaagcgagccaaaattaccggcacatttggtggtgggttgacaaatagcggcacgtctctcagtggtatcggttgttgcactggttggacacgaacggcctgaaaaaagcactcggaaatttgagaaaaagcaacgaaaagcgagcccaaattaccggtaaatttagtggccgatgcgcaatttgcggcaaaactctcagcggcatcggttgttgcccatcatgaattggtcccacaccaatttcctgaaaaacaatgcactcgggattttgaaaaagcaaccgaaaacgagactcaagattaccggcgcatttggcggagggttagggaattgtggcacggctcccattggtacgggttgctgcattggttgaacacgaattgcctgaaaaatacactcggaaattgagaaaaagcaatcgaaagaaagacccaaaattaccggcacatttggtggagggttagggaattgtggcacggctcccattggtacgggttgctgcattggttgaacacgaattgcctgaaaaatacactcggaaattgagaaaaagcaatcgaaagaaagacccaaaattaccggcacatttggtggagggtggaaaatttgtggcaggtctctcagcggcaatggttgttgcatcggttggacccgaacagcctgaaaaaaagcacgcagaaatttgagaaaacgcagcgaaaatcgactcaaaattaccggcacattttgcggatggtcctcgaattgtggcaagtctctcagcggcagccgctgctgcccaacatgcattggctgaacacgaacagcctgaaaaaagcactcggaaatttagaaaaagcaacgaaaagcgagaccgaaattaccggcacatttggcggagggtggccaagttgcggggggatcggcggaggtggcaagagaatttcatcatcttccgattcgtacccatcgtcatcggggaacatctgccgccctaaaatggaaaaaatcagacaagatatttgtggaaaaccaaacaattttcatcctgtggacgatttcctgcaaacggaatatttgcaaaatccaaaaaaaaactgaaatttaaactaccaacgatgaccgggattgggaagctgcgcgatggtgaacggggtgtggaaggaggacttggttgcttggatccgtatcggcatccagaaaatcttttctccatttcctacaaagaaaaaaatcaagattggaaaaaatgaatgccattacgaaagttgtccgagtgaatttgggtcgtatgctctgtttgggtcaaaatgcccagtcgaaaattccccatagtcttttgaaaggaacgcgaaagtgccgggggcaataaaaggcatgatgaaagtggatgaaaatggcaactggtgaaaagtgaatttgggatgcgtctccgctgctgacaaattaaaaaagtgggcgaaagtggcaaatgatgagaagagaacttggggatggtgccgctgctgactcctcccactaccatgccgttctgccgtgctgcggtgacagatccagatgatcgatggaaaatttgaatatttgggggcaagcgccccgaggggcaagaatggcccccgaccccccgccttaagcgaaatggaattgaaatgaagtcgcttcggccttcccttcatttatatgattgacagttcccgtgtataaaaactgcggtttgtgtgacgcaattatttttgcatctccgccgcgctttaaattttctagcccaaagaatttgattgacaggtcacgaacataaaaactgcggtaaagtggccgcaattatttttgcatctccgcagcgttttaagttttctcgcccaaagaatttgattgacaggtcgcgaacataaaaactattttgaccttgatgcgtggatggcaccatttttggtgcgccccgcacaaaaatttcgcaacaaacgaaaatgtgaataatcttatctgatcgaaatatgcggggagggaatcgcggtaggggggtcagatgaaagggagggtggggggatcttgggaccaaatttgggccggaatttgaaaagcagaaagaaagggtaggaaaaggcggaggggatggggccaaatttggggtggaatttggcgggggggggggaatttggggcggaataatgggtttggggcggaataatgtgtctgatactacttatgtttattcatcaaaatacataatagccccgagggagtgttaagaaagaccaaaagggggcgggcggggagagaaaacattggcaaacaaacccaagggcaaatgattcatccaaccgtatctttggatcattattttatttttaaaattttttatttttctcattaattaaactaattatttctaaatctgatagggcaaaaagtttttaggcttagttttgatttatttaattattattttcaagaatgaatgaggacggccttacgccgtttgaccaaattccggaattacgggaattacgggactgctttattaaagtcggttttttaatttattattttttaaatattttcattttagttacttcacacccaaattgatatgtggaataagttggagaaggtagtaaatgaccgagagaacatggccaacgagtacaaacaataatgtggagaagcagatgacaaagtcgcgcaattgcaggcgcagctcaatgcggccgagcattgtaagttgacagaaatatttttaattgagaagaatttttttaattttttcaactatcaaaggtcgggacctagcagtaaaacgggaagcggaagagcacttgatgaaaatggaggaggtggtaaagtttttactttaaaagttgctcatttcctgggccaagaatattatattgtaagggcttaagccggcttgctcattatgaaatttttacaagtaacaaaaaaacatttcttatcaaaattcgaaaagtaatcaatatttaaaagtccctgatcagtccgcattgatcactgtttatgctatcaaatccagcttccaaatatgttttattttattttaattttatttattcatagagagagggacgcaatgaaacggaatcggtcagccgaattgcattcaaaggcgccggcggagagcgggcggaagcggagcggccaacctatttccacatttttcgcggcgaggtccaattggcgacggagactgtggcacgggcggactacgaaccgaagggccgcggtgatcgcttcccggacaagaagcacgtggaagcgggtgagtgttgtgtgtttgttttgtgcaattgctaatagccgggacagagtccgcgactgaactgggcggtagcgattaaatttcccaaatatttttatgaccgagcgaggcctgagggtctgggattaaattcctgaaaatttggagccggaacaacataacatttcttgaaatatgttgtcgtgattgagctttggactgactgggacgaacagcaattcaaattagcaaataaaaaatataggattgaattttttagacgtaggcctggcctgagcgaggtccgggcttaaattcaccgaaaaaatttgctaaaattgttataggaaccaattctaaaatttagttgattctcagaaatgactaagtactaccgtatctagtttttaaaaatatagtgtactcctgcattttgcgctcatgatgggatcggacctaccaaattcccggcagattccgtttccatctgggatattcatgaaattcaaggagagtcggtcttgacactcactcaagaacaggataagatgtttagagctgttgcgtcgcgatggaacaattcgtgctgaagggacagttaaccgaagcgactatgccaatgatggaaagcggggggaagggcacgagatcagctgggtcaatggccgcgaagcgtcggcaccgctgtttggtaaagcagctaatattcgaaaataaaactcccatgctgtgtatatatcattaatgttcattagtgagctaatgatcgaaattcggcttttatattgctcatttctcgggtcaataatttttctagattatgggttaattagttgatttgatcacctttaattgcccccctttcagccggacctagatccaattcagcaccatgccgacaacattcatcgtgctgaatttgtcgcgcacgaaagtgggaagcgcaaagtgccgacggaggagggtgctgagcatactccggcgaagagatttatggcaataatttaaataattgtggcaaaaattgtgaaaatacaaaaaggcaaattaaggccacggccacaactaaaaacgccctgaatcaccagcaccaacgccggagccaatccaagctttattgtcccaacgtttgatctacacgatcgcgtatattaatggacgcgtgtgctttgtcttggtggacaccggtagaaacaataattattttttgatttttgttgttcaaggcttcgttggctctctgttgagcgacgaattctacctgggagtcaattatacgccgcgctttggtgcgacattcgacgcgaatgtcgtacgaatttttttttaatcatttttgggacgacgcgcgcgttgtcgggtcggtaagttattggattttaaaaatccaatggcattggacactgaaaatttgtgatggtgatttaaggtttggaacggattttttttcttcattttggtgtcaacgtttgttacgataacaggctgcttcgttttggagaggatcaatttccatttttgttggtaataaccccaattgcgcattgcttgaatgatgataattggagattttttagcaaactcaggcaatggccgctcttggccaagcacatggagaccccaatgtacaacaagcataaagacgtaaaaaaatcataattgtaatttcaatgaaatttttgcagattgtattttgctttttctgctacaattaccatcaatatttgatcattcagtaaaataaagattttttcgtaagtttttgttgcaaaagcaaatacatataacgaaaaaatattaatacgttttagcattcggttttccatattcatcaattgtgcccaaatcggtcggttgccaacgcaataaaatgccaaatatttctttgaattcgtagtcaatattttggtaccactgcgcactttcaccgcttttcaagtccaattggagtccgcgcatctcttgcacgcggcccttgttgaaagaatgccaaatttgagaatttggacccgcaggctatttttgacgaatccgaattttaggaatggaccaaatttttggatcgagaatttcggctttattttttcttttttacatttcgagtattgatttcgggtttatgatttcgctgtccatttgaaaacttaaaaccaacaccataagaaatatttataaaaattatagcttgatattctcatttagaattaaaaaaaacgatatgcctgcatactatttattattattttttttaatctcagaattttaaaagtatttttttggttctggtcggttttatgcgtctcatgccatattatgcgtcccatcacatattatgtgtcccaagaatgatcattcttagtttcttagtttatatccttttttcttacttggtcaatacctatattttggtatcaatcgatagcttaatgactatagaagcttttgtataaatttattttttaactaaaggcaataaaaaaaaattatactcggaaaagttgaattcatatattctcattgtaattttcctttttaatgcctgttattattttttcttgcattataaaatcccgagactttcgtcttcgattgataccaagaatttaggtattgaccaagtaacaaaaaagttatggcctggcctaagaaactaaggattaagatcatcttcttttattacggtccctaatcggattttgtctagacttttttttgagaatgcactcggaccagcagaagaaatccaaaaaaattttagttggttcgtttccttaatccatatatccacataatatggatcagaagaaactctgctgatccgtcctgatcagagttcagaaaaatgtgtaaattttccgagtccaattttaaatgtcatcatttttcaattttattgactcactcgccactcaatgtgaccgttatattatggaaaacagctgaagtgtagtaattaatgggtcccagcagtgtcggctttttgacaccacgggaaaagtgaacggcgaaacgccactcataccgtacccatcaacggatgctttgatttggatactgtaaaccataaaaatattattttaaccaaaatcatgttcggattcggacccgtaatggttaattaaataaattcttttcaatcagaatgcgtacccctattttttccaattatgtaaatataaaatataatctattttattatgaacaaatatgttatacatatttatggtatgctctcccaattttatccaataaatccgtatttataaaagtttcatttaatattcatctatttttggatttttgcaccttactaattcatcctaattatttaaagttttgaatttttccaatttatgtgccttcaaaaactgatttttgattgagtacaatccgtaattaacgacctaaaatcatgaaaatcgttaatcaaaacacagttacattcatcaacttatggatattaattaaatttctacgatattttgcgtgacatcaatcataattatggattgtccttaatcgaaatcaattgtgcccattcattctgggaattgcaacccaacaaaaacgtaattatgtaaaaattaattaaaattcaagatttcccgacttacgtgcccttaaaagctgttcggcgcctttctccccaaaaacatttggacaattgaaaaatctcttcgtaatcaattttcacatttgccgtacagtttttgcttaccccagtgaaacatccgtcaaaaagtgcgagagtgccgaaaatgggaacaaaaatttggcacaaaaaatattcattaattacggcgttttttcggaggatcttctttagggtttttgtccgggtcattttcataaaaataaacctaagaatttcaaaaaattagcagaggcatttttatattttttacaaatgcaattttttgcaaatccctcagacaaatcctccgacttcaattgaatgtgccaaaaacaatgccaaacttctcgttcggcacttgacctttgtactgaaagaaggcacagcttaacagttttgccgtatcaaatgcctaccgtacacgcacagtactcttcccccggtgccatgtcattgctcgcttttgtccccttataacatgcgtagcacgtgttttctccgttgttccgttcattgtcaatgaaaagcggcgaattaagccatggcgggcgcaaatggcgcggcacgaaacccttctgtttgaccaccgccgagtgccggcactgctcgtggaacggagtgccatcgatgggacggcacaattcgtcggcgccatcaatgcattaaattacgaggaataattaaaaatttcaatttcaatgaatttttaattttaatgaccatttgttgtgttgtttttggatgtaaccgcaaaataaatgaacattctgatggccatggcaaagatggaaaaattcggatagaacattttgatgagcaaatatttatttattaaattaattatttacaaattcgagtttgtttaaatcgaaataagaattataattatttacctttactatttattaatttgattttaaaaatctttgaaaatctcatgtccttgaaatttcctcgaaactctaattaattattcaattaccaataaactgagagatttgtcatgtgtaatgatatgcttctgtgaattattttgtttttcaaataattattcatcatcactaatcaaaataattttactgacagctgaaaagtcgatttttttttctgtagtgaaatgaatgagtcaccagatgctgagaaccacaaaaattttttgcttttatttaaacaaaccataatcattctcattcagttgtccatcttttagccaatttcatccgatcattttcattttaattgtaaaatttccaaaataaatattttctttttttttgaacagtaactttttctgatgttgtcgaaccaactcaaactttttattcttattcttgcaacattttccatcacctctgtggagggcgactttttggcttttttttataaaaaagtaatccaaccaatcgtgagttgaagcattttatttgttgaaatttgtaaaaaaaaatatttaaggaaaatgaagttgggaaagccgtggtgacagtcgtgagttgaagagcattttattttttcaaatttgtaaaaaaaatattaaagggaaaagaagttgtcaaagttgccgacaaaatcatcgatcacatccctcttcttgcccaggcgcgcgcgattgcgagagttgccgccaaccgaatattgggcaacaaagaaaaatgggaatgcggacctgaccatgaaattaaagtggttgacgaactgttgcacgtgagtttattttaatttattcctaattatttaccgttttaagcttgatacggagtatttgatttccctgcaaaccagctgctgggaaaaatggggtcatttttgattaagcattattgctcacggccacattgaaaatttaacaaaaaaatggcataagtttgcttaaaagcaatcaaattttacattgttgggtattatttgatagcccagcttttactctattatcttggaaaaattcatataaaatttacaaatttaacataagttatggcatcaaaatagtacttatcttgttttcatataaattttctaaagttcaccaaatttgtttttttaacttttccatactaatagagaaaaagctgggccatcgaatgctaccaagaatgtataatttgattgctttaaataaacatatgccatgttttgtcagaaaaatctttaaaatggcggattttatgaaacgaactagcacctgcaat

SEQ ID NO: 1273 - DNA, 7670 bp, Heterodera glycines
  misc_feature (126)..(126): n is a, c, g, or t
aaaataattttacaccaaattttaccgcatataaccaatggctgcatttgattgtattgtctccaaaattgaataccaatcgtaacagaacatcgcccacttaagcggaaagaatcccaaataatntaataaataaaaagataaaatgtagaaaattgtatatatattatttaattttgaatttaattaactcatttcggtgaattgcgccacttcatgaaacaaataaattttgattactgtggcattacgatccactcgtccttcaattttcactaattctccataattaagcaaagaatacagttccattgaaatgccatcttcggattcgcactgaattaaaaaatattttcaaatttaatctgttgcttgctttaagccccaccccgcccctttttaatggcatttattaatgaaaccaaaactcatctctcattagtacaataaaaatgctaatattattttggagaatgaatatccggtccctttaattacttccgtgaaattcactgatggctcttcgagtagattcacattgccttccaccttttcaataaaagtgttaattgcccaattagtacgttaattacccggacaaaatttattgcccaagccggcgtaatgcttgtgttctgttcgtaaaacaaaattctattcacatagaatttatatgtgtcattgaaaatgagtgtaaactcatattctctctgatcgtcgacattaaaggtaaagtttttgtgcaaagatgttttctttccaaacttaattaatctcattaatgaatagaaaaaaattaattgtaaaaaaatcatacatgctgattggtaaaagtgaactggttctgttttctgcatgggttcactttcatttcaagcagtgtcgaaccaactgaaatttttttaaggtcgttttaaaaaatgccactatggcgtttcgtaaaagtgcctacctaatttacacattttcaagaaaaacatccaacaaaataaataatcttggtatctcatacgacagcccttgggttgctctattagtttaaaaaatttcagaaacattcattgagatttttttaagaaatttgtgatcaaaaattcaaaaaattgccatactttctgaacgcattttcataaaaaaaaaagatttagctgcggtgccgatagacgcagccgcgatttttaaatttttaatgcaatttgttagtaaattttgtccaaaaatgacctgtttttgcgaatttgagccaatttttttttaatagaaataaggattttagggccggcgttacaaataggcgccgccgtactgatttgtcagtgaacttttctaaaattttccatgctaatagagcaacccaagagctatcgaatgactacaagattgtttaatttgatgtattaagaaaagttatgaccacgcacctccgggaaaaaaaagtaaaattttaaagagaaaaaaataaaaccgaagtaattttcttaacaaatctaacaaatatttcaaaaaaatttctgcgtgacccacctttatcgtatcagacttttcctttattttctcaaaaaatttgggccaaaattatttaaggagtaaacaaaaggcaatttttgcttcggcaaggcgccttcgaaatttaaatagaatttacaaaatattatttttgttatgccaagaaaccattttaattccgactatcagtgattagattttcattcatatgaaaaacacctctgatgtgctgttctggtcggttgtgcaacaaactgattgcaaaattgttttcgtttttgcaatttttggcgttgttttccaacaattggacacggaacaaaaattttgttccgatacaaatttgttggtagaatttgctgtaattgagcttcactgggttcataagcttaattcaatttttaattttttaacaaattatgttttcttacatcaatttcaacggttgtcggctcctcaagtaaaagcatttgaccactcaactaaaaagtggaaaattcaaggattaattaaggttcaagccccgcctccggggacgggactgcttttttggcctcacccccgcccccgcgaccttcaccctcgcaggggcgcgggtgataataatacaccgttaagaattaagtttttagattgggtccatctaatgatctggggccttatgctcgtctcgcggtttagtaaaccacggttaacgcattaaccacggtttcgttaaccgtggttaacgaccgaccttaaccggtatgctcgtctttaaccatggttaactcaaccgtggttaagagaatttatcttgaaattgaaaaataattaatattaaaaaaatataattaaattattataataattattttttgtttatattatcaatattagcatagattttattaaaaaaccccgaaaaaactattaaatcaagaattggttttctaaaaatttttggccataacttttttaaacacagcaatttttttttttaattttgcaaattaatagaggactcttggggctatagaatgataccaagaatgtttaatttggatgcttcaagaaaaagtttgctgcattaaaattgtcaaattatttttttatggccgtgtgaactgcaatggagccaacatttcttggtaatagtgcattacaaacaattacgttgttatgcaacatgctacaaacagcagcaattgagtcggggtcgttttggcgcccacgttttggcgccgacgttttggcgccaaggtcgttttggcgccgacgttttggcgcccacgttttggcgccagggtcaggtttttaaattttgtctatgtttgaataaatgaaaatatgtattcgtcagttttctgagtcgctaatcacgaatattgtattcatcttgacaattgcgaagcccggactcgatttaaatgaaatacaatttttgaacatattagatcaggccttctatctgttttgttttatcaaatgttttaatatggtgggtccaaatctgagaaaatgatttaccagattcaaaaccgtagttgtacctgtttcaaaaaatggcctgtacctaaattttgtcaccttttttaaaaagctattttagcggtttgggcgtgtgcaaattttttgatgaaataacactaatccgtcaataatttatatcatagacaaaaataaaagtcagattctttttctgaatgtaaaattaccctagaaaaaatttatttatttattttactatttaaattattaaataaatttacgttaaccacaactcgagttgtggttaagattccttaagaaagattaaaccacggttagatgagcataccggttggaaataaaccacggttaactcaaccgtggtttagccttaaccacggggaagaagggaaggacgagcataccgcggttaaggatttttaaccacggttaacgccgttaaccgtggtttagctctaaaccgcgagacgagcataaggccccagctgtgtcttcgataaatcgtgatccgtgtccaggggcttttcaatggggaaatcaagaaaacatatgcttaacatgccaaacctacacgacaaatgattttcatccctgaaaaaacaaataaaatcagaataaaaatatgaaaaatgttcacaaaatgggcaaattgttgcgaaaatataagcaatgaaagccggaaaattggaccaaattttttacttttatttttttaatatatgaactaaattatttattaatacttttttatgctcttttttgtacatttttttacattcttttgaatgtgttaaagctgtgccacaaacttaaaaataacaaaatggatttgaatttgaattgaaattgtcaaaatttccccttttcggcaattaaaacttacaccaaacggccctttcgccgtaaaacacgcggaagacatccgtttcgctggccaacccttcgtccaatgcaaagccggacattcagcgcccgaaatttgtctgtctgaacaaacttttccatcccatcgtggcctccgatttcctcgtctcaaattgggaaaaaaattcattgccaatttttttcggcattttttgtttctgttacccggcccgaacaaaacgtgcacagtgcgcaggaagggcttgtgcccgttggcattgagaagcaatcgcaatgcctcaatgtattggacaccaacgcttttcatatcctcaacaatttaattcaagaaattaattaaattaatacaaaaaaaataataaaaattacaaaaagacgcgctttacctgtgcccccgggcgtaaatatttccctgcgcgtctttgtgcgcggaatacggcggatgggtccatttgctctaattattttatcaaataaataaattctaattttaaatttaaatatcatgacagtacagcagcagagagggcaaatttggctcagagccggcaaaagtcattccaacaaatgttttgccgggaacgcacttaaaaatacaaagttagtttaatttatataattttaaatattcctacctcatattcccaagcgtttaggccgatttcagcggcgtatttaagcaaaaagtcgcgatttttctctaaataatttggcaatgccaagcagaagacggcataacaaacaaatgattttagccaataattttaataattaaaatagtatttctaccaaaatatttctgttatttcttacgataatcggggttcggctgctccgtatttattcgcaaatattcgcgaaatctcgtgacagccaacggctcctcattcgactaaattttgttattttaaatataaattttaagaaatatttccatttaaaaattgggttaagatcaaaattattttccagcatattcttactcttcattcaccttctgctgctcctctttcttctgcttgttcttccaacttccaattgcgttccaaaatgtttttcgttcttccaattcacttttattttcgattctgtcctttttattggctttccaaaattgtcttaatttaaataatttattgctaattaaatttaactaattaaatatattaattatcatttttggtggcctgaattatttgtgcgctttttgaacgctttgccaaatctgtggcagcaaaagttgcgctgtctttccatggcattttaatgtttttcaactgattttgctcgacgactcccaaaaacggcgtaattatctttgaaaattttctttaattttttcccatcctatataataaagttgagtgtctgtatgtatgtacggatttttgaatttgtgtggcgttttgttattattttgcgttaaaaaatgatttgaaaatgaaaatgtttttgttttgttttgcgttaaaaaagcatttgaaaaatgaaaatgtttgttttttttttgcgttaaaaaatgatttgaaaaatggaaatgtttgattttgatttttcagtttgttttgcaaaaaacattcttagtcatttattcgcttttttgtgtatgttaaatataacgccaaaatcgtccacacctccattcatcattttaattttttgtttttgtctttcattgtttaatttaaaggtttaatattgcttatttttttaaattcaaagtctgtttgtcgtaaaattttatggttatgtattggttagaaaaagtatttatttttgttgtatacacattatttcatatattactttaatttttgttttattttagaattgttaaacaattagagaattgtttttctgccgatacggctcattttttctaccagttttgtcaaaaatctggtgactaaacaatttatcgttgtttttctgccgctacggctcattttttctaccggttcggttttttcaaatctggtgccagcctgttgccatgcttacgactctggaagagctcaaagccacaccatgtggcactcagcttgcgtaagtgcttgaattagtaatttgttttaagtaaaattgttaaggtctttttgtgggcagattgtaagcattttaccgtctgagaagaagttgacggctttgttggcgtgtgcttctgggaagaatgttgttctcacagaatttaagagcgtgtcgtccaaattttcaaaaatttgttcccttggaattgtaagtttgctgtttctatttacagatgcttaccttactaaatacaggtcgtcaaattttacatgctgaaagctcaacgctttcaagagcgtttcgatggaaagacaatttacgttacgccactggattatgaatttgtggtgatgactttcacaagaatggagctgattcaatgtgccattgcgactgcggattcatttgagaaattgacttcgggttgcatttattgtgagttttaatttttttattaatttataatatattacttggtttgtaaaagtgtttataaagcaataatatactcttcgtgcttttgataaacattactgtttgttctgtgactttcgtgtgagacacaaatgtgtgtcatgcttttgataaagcataagtggtttgttctgtgactttcgtgtaagtcactaatgtgtgtcatgcttttgataaaacattagtggtttgttctgtgactttcgtgtaagacactaatgtgcgtcatgtttttgataaacattagtggtttgttctgtgactttcgtgtaagacactaatgtgcgtcatgtttttgataaacattagtgtttgttgtgtgactttcgtgtgagagataaataaatgtttttgacttttaattttttaaagcaatgaattgtgctctcgcttcatcgttttcgccagtcgggaaacatttcgctgcagtcgttgcggacaagaaaggaatgagggctgatttgtacgtcaatggcgaagaattggtagaacgtcttggttcatgcgttaagaacacacagatcgaacttcaaaatttttttgtgaaagttgaaggtaattgtaattgtgtcggcattacctttggttttaatttgagttttcaagtttttttttattatcatagatgaatgccttcagctccattgcgagatttcatccgttaaaattggtgctgggcgcgttaatcttgaggcgattttgacgacaccaattaaacgtcgtagttcggaaactttggagccaattaagaagtcgcaaaaaaatgggtagtatttcgtttgttgtccgttgcttagatttgatttgtgactcataccttttcgattacgtattttatgtttgattcttgatattttgttcgttattgttattaaattatatttgtgatcctcacacattatcaaatacggatataattttcattttgtaattgcgctttaaaattgttgatttgtcagaaaagtgttgaatttattaaatgaattatttgttattatgtattggttagaaaattcattagtgtggtgtgtggcttatgttagtcaatcacattacctgttatatgtaattattagaattgttttgagatccacactaatgtgcctaccaagttttagaaacccacagagtgtgaacttttgtcaaaagaattctttgttagtgaattgttttgcgatgtacactaaaagttttgtaaacccacagaagtgtgaaattttgtccaagttttaaaaatatattgtttgagatgtacactattgtcctctcatccatgagacacagaa

SEQ ID NO: 1274 - DNA, 6838 bp, Heterodera glycines
tttgagtcccagtgtttggaatgccggagatttgactctttgtgtttggaatgccggagatttgagtcccagtgtttggaatgccggagatttgagtcccagtgtttggaatgccgcagatttgagtcccagtgtttagaatgccgcagatttgagtcccagtgtttggaatgccggagatttgagtcccagtgtttggaatgccgcagatttgagtcccagtgtttagaatgccgcagatttgagtcccagtgtttggaatgccggagatttgagtcccagtgtttggaatgccggagatttgagtcccagtgtttggaatgccggagaattgagtcccaaagattgaattgcttgtgggttgagtcccagagattggagaaaaagccaagaaaatgatgcgaggccgcgaagcggccgagccagtcgattttatcattcataattctataacacaatcgtactgcctagcgggggatgcgccgaaggcgctgaccccgctagttattataaataacactttgtggatgaatttgatggcttacaccagtggcgaaagttttcgttccaaaattgacgcaaaaagagcagataaaaattaaggaaatcattttgcgaattttcgaattatttttttccgtcggataataaaaagaaataaataaatttattaattcacatgaaaatattccctttttcattacaaataaaataaaattgaatttttattgttaaaaataactaagaaagaaatggtgtaatatgaattaattactgtaacttttctcggacttttgtaagaattttaatgacataaatccaaaagaaatccctctcaatcggtctcactgaatctgaatttcaagcctcagagtcgtttaaagataaacgaaaactaaattcaaattcatatttacgcaattttgctgaacaacttcccacagaaaaaaactttcaactaatttatttatcaaatatcattctcttgattatagcctttcaaatggtttaataatttcatgatgtaaaagtttcaaaaatttaataaacaatcaacttttgcaatttggctttatccatctctaagtgtcatacataggtatcagtgctaatgattgaattattttcattttccattaagaagcttttcttcttgacagagtgaaaaattaatttggaatttgcggctaagacaatttaatttacacatacctatttattaatgaaataaaaagccagagaaaaatttttcggtcgtacaaagtcctaataaatttaattaatagtaattcggagaatggagcatttgtgccgtccctttttcggcatcagttcgctcctaatcaaacaaatttaattattggacaacgaatatatgcaaagcatttggcgaaacacttcatttccaaggtgattaggtggggcgtgtattctcaatttcacgtaaaatgtggggtctttgctgtgttgtgatgctcctcgagaccgagcgagacagcaaaatcgagagattctcgacttaaggccggcctttgttttattgaacaccaaacttagatcataatttctcttgcctttgttcatctcattgttttcccgttgattatcttcagctgagacggcgaaactttgaacttcgactgttaagccgatcttcgcccgtccttgcttcagttcactcaatggcttcttctccttcttccccctctccgttgttctacgttttgtccgttttggccaattccaatttgttcccttttttcttcgccctttccattggcattccgtctgctttgctgtactgcttggagttggtggtaatcgtcgccaattttgctgatttcaattccgctttttttgttctcgtcgcttttagggtggtttcggtaaatatttaaaaatgaaatgccaataatcaatccgttcactttagagtttgatcaattttgttttttcattttttgcccaacgcttcggcgaaattggcctctttttggcgctttatcttaatttgccccgctttgtgttggcttcgtttttcttctttttttattacacattttatattgaaaatttgctgaccacttttttgctgcttaatcgtttcacggccattttattcccaacaaaatatgaaaaggtaaactaaattaaatgattatttagaataatttctttttcagttatggcgccatggattgccactttttttggctgtcacttttattttgccgttgcccttaacaatcccaattttaaacaagggcacatatatccatgtgcaagatgacaatgccacatttacattggacaattataaaacagacaatgttcgctaattagcctaattagaaaatgatttttaattgttgattaatcattcgtttagaaatttgattctagtgaaattgccacttcgttttccttttttgttggcgtcgtttgtcttctgttaaatttggcctcaattgtagcttataaattgaggaaagttggtcatcaaaatgcaaccattgaacacaaattgactattttcacaatgattacattttttggccatttcatcgccacaatttcttgggtaggaattttaaaattatttaattttccttttaaattctttaattgcaggttttggtttccctgacttcaataaatgaagtggatgagcaaaacaaaccttcttcatatgtccaaatgtggtttggcctcactttcgaggaaaacgaaaccctttttcaagcaaatttcaatcagtttccctgggtcaatgatttgtccatgttggccatcccggcatggtaaaaacaatggcaacttttcaaataatttattaatttaaaaatattttacactgtctttcattttaggcttttgctttgggcatcgtcaaaaatgagggaaattattgccaaaaaatttaattggataagaagaaatggacaacaaaaaaacattgcaattgtaacagtgaaaaggaatgttgtgccaatgtctgccaaagttcagccccaaaagcatttattgaccaaccaacggaattaatgttgtaatttaaacgtatcccaggaatattaagatgaaatccattcaaaaagagcaaatcttttcctaaaattacataaataaattttattttttcattctattgttccgttcattaaaaatttcaatttcagtgattttgtgagaccaaaattaattggctataataatgaagataatttacttcaaatataaagcataagtagtaattcatttttaaaaccaaaaatttgttttacgcaggtggatttttgtaaattatttcatacagattattatttttcaaaataaatgtaaaatgattagaaaaaatttgttgtcaaattactgcattaatttgctttcgcttttctcaacggcaccgtgcaaatgtttttgttggtgtcacgggcatctttctttgcgatttctttggcaacaggcgacgagaatttgcgcgttggtcggtcagccttttccatgcttcttaaatttggcactgatcagctggtttttcaacacaaaagcattgcaaataaatgccggattaattttgaacttttacaaaagttccgatcactcacagactcgccgatcgcactcggccgatgcccggcgtttcgaccgcactcagtgcgccaagtcccttgcagaaaaggatcagcgaccgggccacgcgatcgggctaaagaaatgttttaaaaaagtgcattttttaaattgaatttactgcttcgatcaaaacgtccattttgtcgtcaatgacgagcaaagtgctcttttctcggcgcatattctcgaacatatgtctgacattctgggaaaagccatttttccactggttttgccaatcatttgccttttttacctcaatgtgggaggctcgggaaccggtgacgagaagaatgtcaatgctgaaaagcaaatgagtcaatttaaaaaagaaatttaattcctttttgactttgccaatttttcgccgattgctccgcaaatgtccgtccgtttgttgtacgcgtagagataacggctcaaatttttcgtattcagcacggaactcagctcggcaatgaacgcttctttcaacgttttttcgtgctaaattttgaggaaatattttaaaagaattaattaattattttcaatttttatttcgcattaaattttagacattgaccaatccaaatttgtgcaagaaaaggtaatcccacgcggcattgttcatgttcccgtcctccactcgcaaatttaagaactaaatttgcaaattaatagctattttaattgccaccattcattgattctgtcattgtgtcaatggcaaacgaacaatttgcttgaggctttcgatgattccgtgcgaagtggccaaacaatggatcagaaccagcccaaggacacggtttggccaagccatctgggattaattagccattcgatttttagaaaaagattttgttttttaaattttttatttacagcaaaacggcaaagaatgtccgcgccagcgccctcgccaatgccaacgcaattctgcacatccatggcattcagaacgtgcaccaaatgctcacccatttgctccattgatgggaagctcaaaaaaagaggaataaaggcatttaaattgaaaaattaaccaattatttaattaatttaaaaaatcaaatattagcaaaacgcactccccgtccagcggaggagcgtcctcttcctggcccggcacacaaacatgcaagaacatggcatgatttttgacgctgttcatgggcgaactgttcacaaattcgatgaacgattgggaggtggagccgacgtcatggacagtgagaaaaacctttaaataatatttaatattaattctaattaaattatgccagtttatatagttacagttttgccctccaaattctctctcggtttctgcacataaacagtgaaatgacaattcggtggcacatccacagtgaccagctaaaatgatcaaaatattattaggggcataaaacagtttaaaattacattaatttcgtcagtattcgccatttcctcaaaaatgttgtggaataaaaaagcttaatttacgtattttatcttttcatttgattaatttttatttgtgtttgtatttgaacgttttgtggcttttgaatttagtcgttgatatttaaaaataaaaattcaaaacaaattctctgtttcgggaatgaggttattccatagtcgaccaaaaatgaagaaaaacaatgagtgacgagaggcacttttagcaccaaagccattcccaacgaccgctcgaaggtggttgttgtttacgcggatgttgcctcattttaactcaattctctctctcccatgaaactcataacatttgtgtgtccctttcccgtcgccgcccctccccccggggggaggggtgcacatttatatttgtacaaatattccatttaaataatttaaataaataaaattaataccatcattgttaaaagttaaatagcgaattatttatttgttagtattgattaaataattcaaagtgattgggccaaagatgaagagagtgaacgaacagtaatgactgagactttggggggagaagggaatttggtgcaaattttatgagttttaaaggctcccgactcaaagtactgacaaaatttaaaacaagaaatgagagaagatagaaatggaaaaaagaaaaacataaattattgagagtttaacagcaaatgagcaattaaggaataattgaaacatttttgtatgcctttgaatttgaatggataagtttgataaataaaaaataaaacaaaaatcaaatttagatattcgaatgctctatttaagaaaagacaaaacataaaattgcaaaaaataaataaagaaaaaagctaaataatttttaattcattaaaaaaacgataacaagaaaactaattgtaagataaccaataaaattttaaaaaattttcattaataggcttttcataaggagtttataaagaggagtgagatttagttgtttttacgttttttgtagataacatttaaaagagaagcactaaaaacacattttacactaaattttgtattaaaaataattttggggtttgacacataaaaaaatctgagttatagaaaatatttttcttatggccaagaaatttgctaagaaaatttcataaaacattatttaatagtttaaaattccgaattcttctagacgataaaaataaaatattttaaatattaaaaaaaatatttgaataataccttattcaatcccgattaatatggttacggtttttaaaaagaaaatcccaatcaaatcgtgtcccggctcccggccgtggcattcttgacgagttaacctaggcccgatattttccttacaagcatcctaattgagataattgaacgtttgaaaaaaccgataaagtgattttgtgaagactaatttccgagtctctaatagagactcaatactgttaccatatcgttgatttatttcacttttaaatttagaaataacattatgccaaattcatattaaaaaatcacttttagaaacacttcacactatgggtcaactccactgtgcagagaaaagcctagtactatctcgtcgttactctttttctttataatttctctcactttggcgtactatctcttcattttaatggtgtaaaaaacaacatttacttttctatgtctagctttttttctctatgttaaatccgcaccaaattttgcatagcgatagagaaaaaaattaggaacaaaatgtaagggtttttaagagcaaaaa

SEQ ID NO: 1275 - DNA, 916 bp, Heterodera glycines
ttaatgccttcgttctctttattgctagatgacgctatttcatcaagatcgtcgaacagagaaggcctttgtttttttataggcggcggcgcacagtcaagctcatcaatttccgtaattggtgggctaatgaacacgtcattttcttcccttatccatgataaaatttttgccagaaagatgtttcttcgttcgagcaaaaatttgtctttaaaccgaacgtcaaaaaatgttgatagacaatgaacactaaaacataaaaaatggaattaactaaataaatatgtgtttatgaaccgtttttcgcgtagaccaaagaaatatttttcgatctcattgaccagcgaacaccgaacactgtcaatttctttgttgattaattttgcactaaagagcttgctgtggagtgttacagcaatgggaatttgagctgaaatatgcgacttaacttaaaattaaatcttttgttaacccgacaaaggcgatttcatgagcatttttgaagcttcctcaattggctggagcaaagaaattaattcttcaataagcttccactcttcttcggttaaggtcaaatcaaaactccgattttcgaaagcatattggtaaatagcttctttttgttctaacaaacgcgaaatcattgccaacgccgaattccaacgcacagggatttcctaaacataaatattagatgcaaaaagtttttagaaaaacttgtaaaagtgaatgttcaggaaggtcaagaattgactgaatgttctgcagcatccccaatgctttgttagaatgtttaaaatgcgacaccacttttcgacactgtttgagcaaattagcgattttttcaaccctaatactcttctgaacgacaagattgagtaaatgtgcgccacagctaacattgcaaatgtaaaag

SEQ ID NO: 1276 - DNA, 3163 bp, Heterodera glycines
  misc_feature (8)..(9): n is a, c, g, or t
tgcaggtnnctttcttttctgggaattttaaattgtaattcgtaaattaccacccatccatttgtgtataaatttaatattctgtttaatttatgaaaaataaacacgtattttaacattataccaactttcgtagtcgtacgacccatgcactctttgttttcggtatgctgcttgcgctttgataccttcctcaatgcttttctaaatgtttcccttctaattcaaaattagtccaaacaaacttgaagggctgcaacgttgctttgttcttggaaaaattgcattgatacattctgaatagatgttatttaaaaaaaacaacaaatcaaatcttaacccacaagttcagtttcataaagcttccggtcgggccaaatctattcaaaaaacaaataaatgaggaaaccccaaatttatgaactttgcttatgaggaaatcgaagttcgggtcgggtcttagcgagcgcttggagacaattttcttgcgacatgtcggacattctttgttccctcgcatcaatgccgttgttatgcattcggagcaaaaccgatgcagacattcctatgaatttgaaaagaatatttctatcatacaatgaaattaaagaccctttttttggtcatttttggcgctataaattacgaaattaaaaaggcataaaattttgcgttttttatttcgaaccttagtcgtcattgtacaggtcagcaagtctagacaaatcgggcaacacagctccgttgacaatgtccttacagtcactttgattttggtatcatcgctaatcattttatgtggccttcgaacctaagaaaatttaaattttgaattcgtaaatatccgatagagcactttgtcatatttgcttagctccaacgtttttccaccagttattgtgtccgttgtgtttggtcccggcaatccattgttcattttatttatgaagaggaatgtgcttttatttaatgaatacttaaatcctggtgctacttacataaatgaaacaaaataaaaaaggaaacaaatttgacggatcaaatgtaaaaaaacaaatgcacatggttcttccaataggtaatttagggtgttgacgttataagaattaagcgggtcctttctttgtctcctttcttttgtaattcgttttgccaggcttcttctgccgcctctcccattgattcattcacatcatttcactgtcctccaaattcattcgtcgccttcgctattcgtctcgttgctttcgacaacaagcgacgcacgcacacattcaaacgacatttgtcgttgcttggttagatggaaagggatgaagacgatggtcgggtgggtgtgtccctttgccgctcccttccattgctcccttccttcctttgtgttgtttgtgtgcatcgattcctcccttcaatttctccactcgcccttcgagggctcttaccatcggtaccaacattcggtcttcgttctcactcctactccaccatttccaccttttcagcgccccgaaacgcaagttccacatacatacaacggctgaagccgtttcttttaacttgcaattcatacttcattcagaatccaagtccgcattcaccgagattaattttttaagaataaaaaactatacaacagttgaactaaattaaaacgaagaaatttactgaattatcgctgaattcatgttgagatgacaaggcatggactccgacctcacccaacagacgacttctcatattcattccaccattggttcctccatttctctttcacactgcacccaatattttcacccatacttctgttttctatttgcctccacacacgcacacctatcacaccaatttcaccatcataaaattccactctcctcttttgcatctccatttcgatattttttgcttatacagccattttgttttgcaattgattccctcagaagaaattcaacatcatttacctgcataattatgaaaagtcttaaaatattttcatttaaaaattaagcacttacattattttacttattgcataaaaaaggccagccaagacaacgacagacattcggcaatgtatagccagggccaaggtgtgatgacgccgcagatattaaacatgcagcgtttgatgggtagtcggcctcatagggtcgggtcagccttctacggacctggcgatgtggaaatggtaggtttgacagaattatttttgtaccggacgaggaaaaaggactatgaaatggtattcactcatgtagactagttcttctatggaactcaacgaacagtaccccgtggggatgacacaacacaattttggcacatttggacagacaaaccacatgatggcaggcttccaaaatcgttcttccgacatgggtaaccttcctgctgcgatgggacattctgcggcgacaaatggagggttcaccagcggtttgggaactcggatgccgatcttcaaatgtccggagtgtggcatcgtgaaaaattcaaacgaagagttggaagtgtgtcgaatattacattccattggaaagcaacttcattgatcacaccattttcaggtccatattaaaactgaacaccttggttggcttcccttccaatgtccaatttgcaccgctttgcgtgcttcagaccttcagatgcgcgagcatattcactcccaccacaagaaaagtgagaacaaggtcagttgcgcattgctttggctttgtcggtttaatttgttgcttttttacaattagtacatttacgtggacaacccgcaggccaaggcattgctgcaggaaatgaccgaccgagctttgttcggtgctgcgcaatatgtccagcagcaaatggtccgtaggggaggcggagcagcgggaggttggccaacagaaagggcattttgaagacaatgcatgaaatttagctcaatcaggagtgccacaacaccaaatgcccaagagagctcgtttggacacccaaaacaatggcgcggagcgtcgattcaactcacaatcagttttggcagctaaaaggtgcgattgtgtttacaataacgtttatttgttagctagattttatcctttagaattggtgacgagatggcaccgccacgaaaccaaactcaaaatcgactgctttggcctcaaaggaggcattcaaatggagg

SEQ ID NO: 1277 - DNA, 7768 bp, Heterodera glycines
ttttcttgctttaaaaccgggaaaaactaatttggtgttggacacaacactttttggtgccacgacccgggaccccaaattacatttgttgaaaatttgggggtgaaggctaaaagccacaaataaaagcaggaatttttgagctggtcaaagctgtgtgcttccagccgggctgttgtgccaaaaataacaaagaaaggagaagctggtctaagtgtgttctttccagctaagctgagtgctgtaatctgaataaaggcattaaaaaaaaaaaatggagagcactagccaaaatgctgtctcattgagtggttccgattttgaccccatctatttttcgcccgaggaaaatcagagatggggcaaactgttggacaggatgagaacctttgaacaggccgtgtgtcgtcaattccgaagaattgaacacacatttgtccaaataacaaaccagacccaaattcaagacactgtggagagagtcaaaaatttggagagttctataaaggagctcgagaatgccaccgaattggacacattcgagacaaaggaaaaattgattgatgccgaagaagaggtagaacgggtgaaaatgagaattgatggttacgaaagatttacaaaggtacggtttgggaaaataatagaaaaaatgaaaagtgaagttggacgaattactgaaaatttggacacattgcaaggcagagtgcagctgttggagtatgaacaagacgagtatggaagagatgccgaatggatggaagacgagaattttagaggacaggcactaatttctccggagcaaaatgacaaaagagatgacatttcggtcggagagtgtgaaataatggtctcggacccatttttgggaggaattgccccattagaaggctatgatgggaatccgagtgtttctttttcccgttgggttgcccgattggaggatatgttgtctttgtacccgcaattgacggagccccagaaattaagccggttaaggatccttttgagagggcaagctagagcggaatttgaatcgatagagcctgctccggaaacgttagtggtggccttagaacacttaaaaatgaaattcgaaaacgaaaacacccgatcgatagctcgtcagacaatggtaagttgccggcaggcgcctggcgaaagggtttatgagttcgctaataggcttaatgaggtagtccgaactgccttatcgggggaaagcgaaggaataatcagaaaaagactttttgaggaatttttggaaaaattgacccctgaacttcaatttgaagtgaaagcagggagacccacgagttactcaaatgcttatgaaatcgcccagcattttgaacttcttttggccgccaagaggccttcacaaatctcggtcgcagactcggttgcggagttgtcccaaagggtggaggccttagctgttcatcaacaaacaacaactaagtctggcgctgaccgaagagcatgctattactgtaggcggcctggacatttggttaaggattgtcgggagaaaagaagggacgaagaaaggggaggtcacagagatcaaaggggtggccgatttttcagagaggaaagaagatggagtagagaaagaaatgaaagggaaaaccggcatttcacgccgaggggcggaggacaaaggaatcaccgtttaaatcatcgatctccaaccccctatggggagggcgagggaaataatcccaaccgttgggggcctcaagggagaagggtgaactttcggggccgagtaggcgctgctcgagtggcaagccccatatttttggcattgatggttattttatcaatttttggcaatggaagtgcggttaaccaggctacaaatccaatgatatgtcaccccgagtcaccttcaagtttatggtccataccagtggacccaatttgtccaaattgggcaccaacggagttgcccgtggctatgaatttgccagtttttcgtctaaatacggtaaaatataaaacgaaggcaaccgcatgcagatgcatacagacaaaaatagcgagaagaattggaattgttggagggcgatatgaagaggtggcaacaaatactgttgaagtacctacagcaacttgtcgaagaatgaaagaatttgatgattcgcccgcgggaaaattgtttcaaattaatggtactttcaaagccacccaaaattccttagagcctggatggagaagttggccaatgggaattttctggaaaaccatggaaattctaaattgctatctttatgaaacgattgtttttgctcgtcacggtgcctcagggctgagtaccccactaaatgattgtccagcctgctcttatcaagccggaaaattgctgctgtgcgcaattaagctaatttggagaccagaccatactcactgtgtaattatgtgaaagtcgcagactggaagggggagtactccactgatatttggacagcaaattcgggggattttgctctaacatttgtaaacaggactgacaaggctgattgcgatggaaaatggtttgttgcctctgatcagtcatttgcaattccaagagaaagttatttggaaatgatcgataaaagtgagtgggcaaattcgaagaatcgtaaaaaaagagaaattgacaatgaagactcagtgggcttagtttactcatctcagctggcagcgcagttaaccgcattaagtgcaaaagttacgcaaaatacccaaaaattgttcgcggagaccgttaggaaaatatgtaccagtttaagatttttagctgatcaaacgcttacattagcagaagccaacccgactcttttggcccgtttttacttagataatccgcttttatccgcgaggctagtaacaaaggatgtgttggaaataaagccatgttttggggtaaattacagggaagtacattttcagtggcaaaatggtccctgttttgaaagagtgccagtgatctttactttgtacgggagatatgagcgacaaaaacatggatttttggacccaaagactttaatcatacaccccaatgcgcgggaggcgaattgcaaggaatttcgctatttgtatactcaaacacggggaatagtcacacaatatgaccaagtgacaggggaaatgcacgaattaccacctgattctgtgcattatctctccagacacgggaagattgacttcccagaaataccaatacatttttttagaaataaagtacttgccaatttatccgagctatattccccggaaaattttgaagaaacgatcgaagtggcgaaggttgtgcaggaaattgcaagactctcgcggccaaacgcctgggaaattgtctcagagaaaaatgatcaaatggccacaaatatagtctcgaatggcttattttcatttttaagagggggaataatttcagctaatcaattatgggtttttctttgttgctgctatataacggtgacagtattaattcagtgcttcctaccagcaccaattgcacaggccatacagtatttgggcttaggtggtcttattttaaatggcttaagaatggtgcaaaactttacgggtgagagagtcagaaataatgcagcaatctctcaggaggctgtggaagcgcagctggtcaagtgtaatcccaaaccagtgctgaaaaataagtgcagtatggctggggcaaggccaaatgtgattgaaatggaaaagcacttcgcatgtaacataccgcttactgagaggtggctatcggtcgattcaattccgaccacctcaaaacggagaaaaaacgaaccagccgagcccggaccgtcagaaaatagaaaaatcgttacaatcgcaatgatgcgtgtgaattcatgcgatgaaaagtttagagttatggccagagttaatggatatgaaattaaaatgttgttggacacgggtgcacatgtttcgctgtgtaatgtagaaactgcacgaaaattgggtatcaagcaattaagcccatcagatattgtgggcgttgtcggcataagtgacaaaatgatacccataatcggaaggagtacaataaatttggaagttgcgggctgtcaggtgttaagtacggtttatgttgtgaattctaaaattgggtccacagggtcttacgaaatgatcctaggccgacgaggtttcagacaactgccactatttttagaccttcaaactggcgaattggtaagaaagagcgatggtaaaatatttgtgtgtgaaaaagtggaaacggataaaaacttggtgaaacccatggacaataatttgggaaagcctgtggaattggtcaaatgccttgacagatacagtgacattttttcaaaacacgattatgacttaggaggatgtacaataaaagcacctccaatcataaccacctctgcgacgccggagagagttagaccatatccggtgcccgaaaaatacgagaaagagttaaaagggcacattgaaaaaatgttggaggctggggttataaaggaaagttttacgccatgggcgcataatgttgtgttggtgaagaaatcaaatggccaattgcgtccgtgcgttgattttagaccgctaaataaagtgacagtccctgatccctatcctataccaaggatggacaaaaccatttatcgtgttgctggccgaaaattttactcaactttggatttggcctctggtttttggcaaattcccttggatggaaatagctcctataaatgtggcattgtcaccccttgggggttataccaaatgttaaaactcccatttggtctcagaaatgcaccaagtatattccaaaggacaatggacaaagttttggagggagttagaaacgtcaccgtatacatagatgatatactaattcatacgaatacggtagaagaacacatagaagtgttggggaaggtgttcgatcgactgaggaagagcgggttaaaattaaaaatgaataaatgctctttcctaaaaaagcagtgcacctatttgggccatattttgaatgaaaagggatatcgtccttccctgagtaatcaggaggtaattgaagcttttcccgcaccaaaaaatgccaaggaagttaaacgtttcctaggaatgatgtctttttttcgaaaatttatacctaattttgctgaaattgcaaatccgttacaacaattaacaaaggaaagagcggaatttgtgtggaattccctggagaaaatggcttttgaggagctaaaagggaaattaattgaggccccgtgccttagggccccgaactataaattgcccttttatttatttacagacgcttcatcaattgcgtacgctggcgctttaatgcagtcagaacatgaacaagaaatgtacgcagtcggttattggtcgcggaccttaagcattgcagaaagcaaactgcccgccacgcatggagaattagccgcaattgttaatgccgtccagaattttaggccaataatttatggggccgatttaaccatattgactgaccataggccgctcacattcttattttctaaggcaagtagcaacccaaaaattaaccgatggctgatggcattgcaagaatttgagccccaggttatttacctggagggtaaagctaaccgagttgccgatgctttatcacgggtccctattaagtgggaacaaattgaaatgaagagtaaagaagaaattcccttccttttggttgcggaggaggagacggaagttaataggagcataattgaaaaagaatcggaaaaggacccaattgtctcccaagtaattgcaaaaatccaggaaaattggcaggaacccatccctgaggaattgatgcagtattttagagaaagagataaattgtcgtttgatgggaaaattgtgtggaaaaaccccgggaggcaaatggtgatcccggagaaactgcgtggccaaattctccaaatgcttcatcgagcacattttggaattgtaagaagcaaggcgcgggcaagaagtcttgtttggtggccacaaatgtcggaagaaatcgaaaattttgtcaaagagtgtaatatttgccaaatgaatgcccccagtgtgcccaaaaatgacccggagcataaatggcctgaagcaaaactgccgttcgagagggtgcatgcagaccttgccggacccgtatggggaacaaattttcttgtaattgtagacgcttactcaaaatacccgtttgtagcccaaatgcagtcaactcattcgacagccatcataacttacctcagagagttatttggaatgtttgggtccccaaaaaccctggtaacagataatggccctcaatttgtatcattggaaacggagacatttctgtcaaatgaaggtgtaaaacacttaacttcaccggcatatcacccctcctcaaatggggaggcagaaagatttgtgaggacattcaaagaaggaatgacaaaattgctgcaggagggaaagagcctaaaggttgcgcaatttttactgctgcaggagtaccgggcaacgcagtgccaggcaaacggcggagatactccatcacaaaaattttttggcaggcaaataaggacagcactggaaaaaataaaaatgccgaaaaaagtgcccgaggcaaatgagggggacgaccccccgggtcggacaaatgagaataaagaacgaagtcaaaggcgggacaatccttttagcccaggagatatgatttggttcagagcagcagaaggacagtgggcaccagggatccttttacagccaatgggagaacgaatgtgggaaatagaattggaaggaagtaatgtcccaaggtccgcccatgtggaccagttaaaaggacgaagattgggctcagttcgccataactgaacgcagtttatgtgactaatattttgtacatttgtaaatgcctcgtcctaaattaaataaaaaaaaaaaaaaaatctttacattaaacattttggttgattgggcccatccacaaattagtaaaaccttactttcctcttttagaatttttttttccaattgataaaacattaatttcgccatggatgccgagaatgttccgccccaaaatgagttggagaaattagaaagagaagcgttggactcaaaaaagtcgaagtcgcgcggtcacgaagagagactgaagaatgaaattgcccaaatgatgggccagctgcgggaggccatgaaagaggaagtgcgcggggcagtggaaggactgtgggcaaaaactgagcctttgttggtggcacaaaagcgctcaacggacgcgctcacggaggcgtttgacgaattcacgtcacaagtgcacatcggcggcaaaaacattgacgagtatgaattcacgtcccaagtgtacgtcgctggtaaaagcgtggacgaggagcgatgtgacaatccgcaaccagcggatgacccgtcggaaaagggcggagaaacggacccaccagtgggtggaggggctaacccacccgtgagtggagagcctgtccaggcttcgtcgttgccgccagagcagccaactgtgaatgtgagagcgccccagagagggggcaggggccaatggggcccttcgggatataaaggacaatggaaggcccaaggccaaggctcaggcccaaagcatcagaaacgagttggttatctgatgagacaattggagagggagttgagggaagagcaagcaccggaagggtgcatgtgctggagttgccgtcgtggaaagtggaacggggaccgt

SEQ ID NO: 1278 - DNA, 3229 bp, Heterodera glycines
aaaagtcggaagaaatcgaaaattttgtcaaagagtgtaatatttgccaaatgactgtccccagtgtgcccaaaaatgacccggagcataaatggcctgaagcaaaactgccgttcgagagggtgcatgcagaccttgccggacccgtatggggaacaaattttcttgtaattgtagacgcttactcaaaatacccgtttgtagcccaaatacagtcaactcattcgacagccatcataacttacctcagagagttatttggaatgtttgggtccccaaaaaccctggtaacagataatggccctcaatttgtatcattggaaacggagacatttctgtcaaatgaaggtgtaaaacacttaacttcaccggcatatcacccctcctcaaatggggaggcagaaagatttgtgaggacattcaaagaaggaatgacaaaattgctgcaggagggaaagagcctaaaggttgcgcaatttttactgctgcaggagtaccgggcaacgcagtgccaggcaaacggcggagatactccatcacaaaaattttttggcaggcaaataaggacagcactggaaaaaataaaaatgccgaaaaaagtgcccgaggcaaatgagggggacgaccccccgggtcggacaaatgagaataaagagcgaagtcaaaggcgggacaatccttttagcccaggagatatgatttggttcagagcagcagaaggacagtgggcaccagggatccttttacagccaatgggagaacgaatgtgggaaatagaattggaaggaagtaatgtcccaaggtccgcccatgtggaccagttaaaaggacgaagattgggctcagttcgccataactgaacgcagtttatgtgactaatattttgtacatttgtaaatgcctcgtcctaaattaaattaaaaaaaaaaaaaaaaaaatctttacattaaacatttttgttgattgggaccgtccacaaattagtaaaaccttactttcctcttttagatttttttcaatttgataaaacattaatttcgccatggatgccgagaatgttccgccccaaaatgagttggagaaattagaaagagaagcgttggactcaaaaaagtcgaagtcgcgcagtcacgaagagagactgaagaatgaaattgcccaaatgatgggccagctgcgggaggccatgaaagaggaagtgcgcggggcagtggaaggactgtgggcaaaaactgagcctttgttggtggcacaaaagcgctcaacggacgcgcttacggaggcgtttgacgaattcacgtcacaagtgcacatcggcggcaaaaacatggacgagtatgaattcacgtcccaagtgtacgtcgctggtaaaagcgtggacgaggagcgatgtgacaatccgcaaccagcggatgacccgtcggaaaagggcggagaaacggacccaccagtgggtggaggggctaacccacccgtgagtggagagcctgtccaggcttcgtcgttgccgcccgagcagccaactgtgaatgtgagagcgccccagagagggggcaggggccaatggtgcccttcgggatataagggacaatggaaggcccaaggctcaggcccaaagcatcagaaacgagttggttatctgatgagacaattggagagggagttgagggaagagcaagcaccggaagggtgcatgtgctggagttgccgtcgtggaaagtggaacggggaccgtggtggtcgcggaggaggcatgggacgtggacaccggggagcatatggacgagggcgcacgaattaccagcagcacgcgggcccatcgcaccgtggacactgaggctggcatggaagcatgaaacggtccaggactttgcggaagggggaaggaatgttgcatccacaattttgaataataataattttcttattatatataatcattcttttgctttatttatttgtttttgccttaagtccctctgtttctgtccatcctaaagatcccccaatgatgacctattttccacaactcaacaatttatgtaatgttttgttgtccatctgttcgtctcctcccctttactcatgtcagtatttaagcgatgcctttgccctcacattcaggactttcctttaccatttcttaaacctcaggttccctgcctgaagctttcttatttttgcttaataaacttttggtctttaacaaataagagttttgcttttcttgctttaaaaccgggaaaaactaatttggtgttggacacaacacaaccatgaacatgaaagcggctgaacccaagcccaaatgtgcaaagtccaaacagtgaagctgttcgaagtcccgggaggcaagactctcaacgaaggagctgaagcgtcgtcccggtcgggtaaccgctcgtcgtggcgttgcttccgactcggcccattcaaccggagtctgaaatcaatcctttttcaaaatattttcggcaatttaccaattacctcactcagccaagggcgacgctcctccgagttgattacgttttggggctgattcgtcagaccggcgcttaacaaaaggagacaaatatgttcctccttgagcggactctgcgcgaaaaggcccatgtgttcagcccacgatacacagaagaacatcagtggggcaagacctttgaaaatggcaaaagctccgttgtcaaaatcctgaaaattcaccttcatgtcgaagcacgtaacggttcagcaactgtttgatcgcgcaactgtccgaatggtcccccgtctccgtcccatcagttactgtccgatcagtgccaaaacaacgggcactgaatccttccaactgcgtccgtcgtgcagaaacaaaacgttcaatgtgttcggagatacgttcgccgaacgagtcgaacattgcgctgaacatacgggagcagcttccggtggtggcggtgccaggctggccaagcgcggacatcatgcgcgaacgacgcacggcatcgagcacatcccaactggcaacccacgggaaggaaaggaacttgcgggaaagcgaacctgaaaaagaagagaacgaatgaaaattaacgaagcaaattctattaagtcaaattaaaatgtttaatttcctaaaaacatacagtatccaattgtgtaataagcacacgctagcagtttaagctgatcggacggctccctgcaaatgccctcgtcgtccgtcagagtttccatgtcccctcca

SEQ ID NO: 1279 - DNA, 8847 bp, Heterodera glycines
  misc_feature (24)..(24): n is a, c, g, or t
agacttaattcgaaatataaactnaggcaaaaaatttatacctgttgcagggcgagtaactaaaatttggaaccaactcgataaaaagcttattgaaataaactcattaaatcaatttaaaaataaaactaaaactatttcattcctgtaaaatagaccggaaaaattaaagtcgaatttttaatccattcaaactaaaagtgatttggtcgctatttatttattggtattgatttcatattatattttattttggcggtgatctcgttttaattgttttgcgctttcttgaggacatttttaattaatgttttgtcctcaatgtaagcggattttcccttttgtggactctttttctttactgacaataaaacaataaacagatcgggtagcgtcaacgtaacagagatctttataattttttttttcaattttactcatacattaaaaagacaatagatcttgcctgacattgcgattgtcatacgagacgatgtcctctttggaatgacaaaggccacgttgaaacttcagccccgttcaaagtcggcggttgtttgatggttgtcaaaatttgtaactgcgtttgattcgacaaactccactcccaaatcgtgctctttgtcagttggatttgaaatggtacacttttgaaaaataggatttatgttacttttattttgacttgaatgttttgtgatctgcctcacctaattttgtcctctcaccgtacaaatgcacgagaccgatacgtttgaaaggcttcatcagtcgctgatcgcctcacttctgccaaaagtcgagtgggaaacagtcgcagcttgtctgacaaataacgcttcttccgacttttttttgcagactttcaagtttattcgaatcatttgttcaatcaatgaataacaaaatctgaaacaaaaaacagcatatattttaaccgaattttgagattttcttattcggatgggtctagggttaggtaaggggcaatataaatgtcgtattcgtattcagcgaccctgaaaaccccatagaaaagtgttttacacggcttttttaaaaattttaatttttttcgaaaaatggggggggggataaacttcagtatcagggctggagcgcgaccgcgattcgcggcattttttttttgcgcgatgcgcggtcgctccgcggcaaatttgaatgcgcggtgcgcggccgcgggatttttttgtgcgcggcgcgccgcgcatttttaagcactggtaagaatgggggtctggtgagaaaagagaagggaattggtgaggaatgagaaatttttgagaaaaaaaaattattatttatttcatttaaagcatttttactaatatttgggctagtggctaaaccttctgaccttcagtgtttgctcttgggttcaattccacaacggaacagaaagtttttcatattttctttacattattttaattgaaatttaattaataaagaaaatattccaacttttatttttctttaatttttaaacagcctaaaatcacaaattaaccttggtcattttttgacaaattatgttaactaatctcgctgaaaatatcaaaatattccggcggcgcctatcggcaccgccgccccccccccccccacaatgttcccaaaaagttttttggaaccgcccacaaaaacgcgatttaaaaaattaatagattgttaatttattcaaaaaaaatccagaattttgggactcagaaaatccaagattcccccccccccgcatgaaaatttaaaaaaaaatttctatataatggaaaaattcttcgaatgcctcccccaatgagtacatattttaatataggcaattttcgtaacaaagtgcagtcaaattttttttcaaaaaaactttcacttgggaaaattttattgattaaattgaaaattttgaaaattttgtttttaaatgcgtggtccgcggccgcggcaatttgaatgcgcgatgcgcggtgcgcggccgcggttttttttttgcgcgatgcgcggtcgcggccgcggcaatttgaatgcgcgatgcgcgatgcgcggccgcggtttttttctgtgcgcgctccagccctgccccacagtccccagttttttgaaaaaagcacaccgcgaaaaaaactattttgggattttcacctcaaaaaaacaagcagatattctgatcagaaattaatcttaacaatttttagattggattttttaaatttaaaaattttttaaatttagaaaattttttgaaaattacggattacgccaaattacggcctttttggacctccgtaatgacggattacggatggccgtaactgaaaaaattgccgtaattacggattacggatttccgtaattgaaaatcagttacgtccagccctgatcctaatagaggaatcttagggtttttgaatgataccaacattgttgaatttggttaacaaagaaaaaagttatagctgaagagaggggaaaggagagatacagaaagagatgagaggatgggaaagagagtgaaagaaaaggacagaagaaaagagataaagaggcaaacaaagagagagaaaggaggaaaggtgagagagtgtgaatgaaaaaaagagagaacagagggagatgagatggagagaacgagagcgagagcgaaaaggaacaaaagagagagagaactaaatcgagagatgagagagagaagagagagataaaaagagagcagccttataagtgagagagacgagagtgtgaaaaagagggagagagaggagagggaggggagagaggagaaagggagagagacaaataaattaaaaaatgataagtatatgaagaaagaagaccgaacgtaagaataagagagagggggagagaaagagagaggaagggagagagaaagaaggggagagagagagagaaggggaaagagagagaggagagagaaaaagagaaaaaacgaaagatacaaaaataagtagagcgcaggaaagggagaggagaaggagagaaggtactaaaattgttccctagcaagagtctttttcgtgcaattttgaattttagcgcgtaaaaactaatgtaaatacgctatttggcgaaatcgagaaagatagcgatagagcagagtgaaaagagagaataagataatttcaaaaaaaattttaattaaaaaattccaaaaaaactagttgtgtacctaactaattttgaaatttttaggggctggcagcacatatgaaaagtgatcagggaaagaatttaaaagggtgtctgtccactgatttttaataaaattcaaaacagggtacttgtgggttttgctaccccctacccccccccccataaaaatctttcatggtcccgacaaagcaatgcacttttctagggtacttttagacgctgatcaagaatctaatgtctagcgccactatcatttattaattaatacattcagatattttataatctattaattttatacatttcttatatggaatccatcgctaattctcctcaaattttccatcaaaaacacacccaagtgaccaaattctttgtttccgcgcactcagccgacaacaatccaaaaacagcaggtcccttccctattcgcgttgtgattcgacgagaaaaacgatgccacagcgatgtgccatcgccgcccactgattttaggactctttttgatagaaatgcaaacgctaatcgcttgccgagtgaggagagggcatctcttttggatggtcctttgaagcatttggccgatttcgactccaccattcccacttcggcacattcgacgacttccacaatgacaaatagtgacccgagtttggccacttccgcttttctgactacgaatttcgactcaacaatggacccgctgttttctcctcccccggcaccgattgtgccgattttaacggcagaggagggcaacacattaatgagtgcgggcgactcaaatgacccaccggaactgcgccattgggccaacatcggagaaacaaagtggggggatgatgaatggagatggaataacgaccgatttaagtgccttccatttcttgcatcagctggagaatgagttgaggaggtcgcctccccgttcgcttctttcgcctgacaatttcactcctcgtccgtctgatagcaattggtttgactgtacacatttcaatattcattctcttgaaaattgcctcgtttacagccatcagcctaaacatttgtcaactcaaaagaaaacaaatgtcaaacggagggaccgtcgccgttcgtccgcttttgtgccgtccgctcgttccaaagaagaattggagagtttgctcaatggcaacatcgacccgaacaaaccggtggaaatgggggaaaaggcgaaataacggacacagagagttagttggaaagatgaacaaaacaatgcctgttcaggtgcgcaatgtgttggttgaggcgggcattggggcggagtttggacttcgtctaaagtcatcttcgactcttccgacgctattcgagcgaaattttgtgccggcaattgaagtgccaaagtgccggggaaacataagcaaaggacggaggtcgatggaattggcaaaagcaatgggacaggaggagggggagcgatcagggttcgaatctcattggaccaatttagagcttcttttaattcatttatttgaaaggctccgtccactgtcccacccttctgccgccacaattcttcccatttatttcactcccgctgaattaccaacaaatcatttgcccgtttttactaataagccacccagcgacaaaaggtaaaaataaaatttctttattttttaaaaatacaaccgcttcaaaatttgcctctctcaaattaaagatttacctggtcctgacattttcagttgtgtgccaagctctactcatctgctaaacaatttgggaccttcctcatcgatggaagaacagcggacaaagcgaaagaatcggacggaaagtgttcaaaagatggaccagccaatgttgagctcgcaactgttcacccagaagatcccttgttcttacaaaggatgtcaggtgacccaattaatcgggtgaatttggagtcaaatgaattttcatttcagaaaacatttgtgaaacaaagcgcaatgcgaaagcacttgcaaatccatgggccccgtcagcacatttgccaacagtgttcacgctcattcattgagcgttccaaattgaagcgccatttgttggtccattcgggcgagaaacgtttcgtttgtgactttgaggtgactgaccagtggggttgtaaaaaaggattccttttaggactgtggaaagcgtttctcgttggacttcaatcttaggacgcacattcgcacggtgcacaccggcgaacgcccttttcagtgtccattctgtcataaacaattcgcacaatccgccaatttgcgcatccatcgacgttctcacaactgtcgtcccacggtggacggaggaaaggagaaacagaaaaatggagcaaatcggcaaaaagtcacgtcgtgctgacagtggaagacgcaactgggcaatattggaaaatgagcaattaataggtgttttacacatttacatttcatatatttacttgcaattttttatcggtatttaaagtaataaatgctaaaagaataagatatgcactggctgattggttcaagtcgcttttatgcgtcccatgaccaagcaagaaataagttatggccttagaaactgggtatggtcattcatgggacgcataaaaacgactagaaccggctgattttctgagaaggtgtcaatcaaaaatgttcagaattatgagatgtctcatgtgcaattttgtcactgtggtgattttgtcattccacaacactttgttctctcctccgtccctctgctccaacatctaattttgttaaatgttgatgtgttccatgagatggcgaattgaccgcccattcttggacagtggctgaaaaacaaagaagatttggacgtctgacaaaaataaacccgagccgaagaattggaagagaatccccgtgctgaaaagaattgccgccattcccagaaaggaaaattgccacgcggccttggtcccattagccacgacaattccaatgccgtaaggcgagacaacggaggcaatctgtccaagaagacgcgaaaatgatgcaatggacgaagtgtagcgaggggcaatgcaaaccttaaggggatgagaaagtcaaacggaaattttatttggtttggtcgcgtttagttgattcagtcttgggccggtaattcatgattatgccatctccatcttgtttttcgaaccacggaggtgttgtatccggggataaagccagaactgatgccaattgcacacacggctaatgagatggccaaatagggcgtccgacagtcacacaacgacaacaacacaaaacaaaggccggaaccgaagctggcgatgagattaaacagtttggtgactgatgtggatgacatcagacgacggtccttgaagaacggtcaatttgatgaaacaaatgcggatttcccacaaatttgttacctttagccaatcagcaatagcggcaaacaaaatcttagtgaacagttgaacaatgaaaggaagtgccgacatcagcccattctgattgtgagtcagccgttttaaagtgaataaaatgagaaaaaccaactgaagtcaaatccatgccaaggacattgtgataatacgtcggcaaatacaccacaatgccaacattcataaagttttggcctcaaattattaataaaacacaattaattcatccaactgtattatgtaaactcactgaacgagctgaacccggtggaccaaacgaccattgaacatagaatgcgacgccatggcacttcgtttggacttatctgaacaagagaaaattaaaaaagtaaatgaagtccacaaacagtcggactttttgggaaacgttagcatgtcctccattcaattcgatgagtcgaagttcgtcggaccgaatgtatttggactgggagggataatcacgaaccaaaagcatccaaacagcacaaaaagcgacgccaattagcccttaaaatgaaatgattagaccaggaacggtcccaggaacttgctttagaggaggtaccaccgccctaagcgacgaccttttttctgcttttgtaccttttttttttgttgcggttttatgtatttttggaaaaaatatcgatttgtttagaaatttgtttaagggacgtcttggaaagcgtaagtaaaataggaaatgttggtcagaaataaccccttaggggttgaatcgaagaaatacggcagttaaaaggcagtaccataaatgtaaaaagaagccgtccatccgccgatccatcggacgacacaaagttcagcagttacaaacattgcgagcacaacggaaatttgattgccggtcgtcgaaattgcaattgctgaaaaaaagttacaagaaaacccttgataagttaagttacccgtgcttttttcggacaaagggaaccaatgggcaatgagcacattgacacacggcaccaaaatgcccaaaaacaaagaaagtgatacaaaagagaaataatgccgatgatttatttacttggccacaacccatcagaaaacggacgacgatcaaagcgacggagcccaaatgtcgaacaacgaaaggggtgaaaaaagtgccttaatcggacagaaatgacgcatgaaaagtatcctttagacatgaattcatagctcgaataatgtaaaaacggaccaaaaacgttgagtaatgcaccgtaaaagaccaaatgagcggggcccaaccaatcgcacaaaaaactgccgggcaaaatgatcagcaaaccgccaaggtaaaaggaagtgaatatcagcgactgcatctttttgctgataatcaagtcaccgccttcaaactaaaaaatatttatccactcgaagaaataaataattaaaattcacgattttggggtcccccaatttcgttccgtttgtcagttctgtcaaatgcgcgcattcggccaaatgcaccggcgaagggaaagaaaacgaagcatttccaaagatggcattagaatgatcattttgcgctgccattaatgtaattgccgttttattcaccatgcaaaccatagcctaaacggagatgaaaacaaaatcaaaacatccaaagaggaggaccatattaatgttgctgcgcataagcccctcaatggccaaagaaagtgccaaagcaattgcaatactcagtcgaacagaggccaatgaccaaagaggcggagatggagacgcaacagcaccatctgaagaacacccatagtgataagattggaagtggcgaagaaaggggcaaatggtgggagcttatcggtcacacagagaaattgctggatttttgcaatttcagaaagcctaactcggcatacccatgggtttaaatttagctttagtaaaattccttgtatagaatctaatcgaattctacgatatgggaacaataaacttaacacaatcactgtgagggcatttgctaactaacaatttcagtcttttcccaaatgataggctaaaagaacaagcgtcactggatgtcggtgtacccttaatcgtaccgatggcaccccaatttttctccaaacccttccccaatctgttcagcatataccaaatcttttttaacgtacccggaaccatctccagttcctcgccattgcgttcagcaaccgtcaacagctcattttcaacaatttcgctgtgtttcgactgattgttgttgaaggaaaatgtcatctccg

SEQ ID NO: 1280 - DNA, 4160 bp, Heterodera glycines
caccatgcaaaccatagcctaaacggagatgaaaacaacatttaaacatccaaagaggaggaccatattaatgttgctgcgcataagcccctcaatggccaaagaaagtgccaaagcaattgcaatactcagtcgaacagaggccaatgaccaaagaggcggagatggagacgcaacagcaccatctgaagaacacccatagtgataagattggaagtggcgaagaaaggggcaaatggtgggagcttatcggtcacacagagaaattgctggatttttgcaatttcaaaagcctaactcggtcatacccatgggtttaaatttagctttagtaaaattctttgtattctaatcgaattctacgatatgggaacaataaacttaacacaatcactgtgagggcatttgctaactaacaatttcagtcttttcccaaatgataggctaaaagaacaagcgtcactggatgtcggtgtacccttaatcgtaccgatggcaccccaatttttctccaaacccttccccaatctgttcagcatataccaaatcttttttaacgtacccggaaccatctccagttcctcgccattgcgttcagcaaccgtcaacagctcattttcaacaatttcgctgtgtttcgactgattgttgttgaaggaaatgtcatctccgaccgattggtggcggtgcggcatctgaatttaacagaatcgtatgataatgaaagtgcgaatggaatgcttcaaggccataaatatggaagaactcaagcaatggacattcatttgaaggaagtggggattaaagtcgaatctaatcaatgttaatggacagcgtgcaatggcatttaatttgagcactttcctcctttcttcactggctaaaaataatccaacgaatgaaaaaagatggacgagtatcaaagcgatattatcattcagcggatttccgtcaaattaaagttaaatgccaaaaggagtataacaaacaaaatccattaacaaatgaaataaaaagatggaagtctcacaatggaagtgccaaaagggtgtcgtcatccctcgagggaatggaaacgacgcgagcaaaaaaaaaagacatccatttgcattggaatttgccaaaatgatcatttattttatagtttaaaagtataaatagaaactctctcctaaaaatgcctatagtataagttataacgtagtttatctaagcaatagtttagccaattcctcgtcttctttcccaatgtcaattttttcttcaatcgctgaaccatcgtccatttcactaatatcgacttcgtcttcaattaaatagtccaattccgcaaataaagactcgggagaaatcagtgcggttcttaaaaagtcatcatataattaataaataattttttatacttaaaactgtcaaggaatcgccgcgccgtttgtccttcgattgttcgcgcatcgtagcaaagagtggccccaaatttagtaaccaattttggctttttcgtagtttcatctggttcaaagtgccttcttaaagcaccgattgtcaggctgaaaataaactttcgaatttaaaagggtaatcaatggcactttgctgcctgaggcgaattaatgacagcggtaaagtcggacaccgaatcgaatatgtcaaggctcgaaattctttttttaaaaatgtattattattattgagcatcatattctcacgtaaatgtgccctcttgggattcctccgggcgaagctgaccatcgcgcgcctgagccgtcaattcgcgaagtcgagcagaaatttgaagaagcgacaattggtcaacattggtcagaacgggagtgacaaatccatttggggtggccaaagcaacggaaatgtccacggaagaaaggcgatggatggaagtaccatgccaatggacgtttaactcggggacagaccaaaaccgaaattaacaaattaaatatttaacaaaacaaataatacccgcagggacaaggagcacgcttttatgataaaatcatttaacgacagcttaaaatcgaccctttcagaaagcctattgagcaattccaatattttgttggcagaaatttgggccgacgcataagcatggggaattgaattctgaagaaaacattaattttaaaaatgagaaataaaataagcaaagaaagttgtacccttgactgcacaaattgttttgtttgattctgacgcatttccgacaattgaatgtccacatggacatggcgatgagtcggctcggaccgacccgatgattttagcggaatgatcggatgtgatgacgcggagatcacttcgttttcaagagacatttttgatggtggcttagccgaaaatgctttaatcggagacagttttttgtcatttatgtgactcagcacatcgctaaattaaaatagaaacatattgcaattttgggcgaattggggttcaaattaggtaaaacaagtcaccttttgagaatgtttttctttggccccgatgctctgagcacgctcgttttgatgtcgtaatgaccgagcagaaggcgaacagccggtccaaccaaaagcgaagtttttgtctgatgaagcggagattttgagtggaaagtgcggggaaaagaagagaaaggaccccggaggggaaaaagaggaatcatccaggaaaagaaagcgaattgacctgaaaaggaaaaactacaaaaaggaagaataaaaaagttaaacagagttatcatatccttcataaataagactaacaaaagtaataagtaaattcgccagtgccacattcaaacttggtaataggtaatctttatttcactacttataaaacccaaaaaagaataaacaaaataaataattaaattaatatttatatcaaattaacaaaaggtagttcaaattgctcattcctttttctggtgtccacttgcggcttccttttcgtccttgagatttaggttatattatcgtattttaacatttgtttcttttctctcatttgcccaccttgccggcgatgctaaagtcaagacggaaaagaataacagcagccaaaaacaatgcgccaaatgccaccacaataagcaaaggttcgtacagcatggaaaagcggtcgaattcgtagtaaagcttaaaagactataaaaattggttgggttaatatttcgcacagtgaagggctggatatggttgttgataagattctccttttcaagaacaatcacagggcgaccaaaagtgtccaagtacgttttgtgcacctcgtcgggaagacgcttcacagagtaaggggtgaccagcttaatgttcctaaaagaaaattaatcgttaaacgaagcattagcataaggaaagtcagaacacccgctccccatgtcgtaagcccatcaattcgtcgtaagggggggggggttgtaaatgggggaaattgtcaattcctttataaattaagaagaaaaaaccaaaaatttccaataaagttcatatttgtagggtcgtcaatctgattgtgagcaacccttgtgtgtatatgaacaatgttcagttcaccaagaaatatgaaaatacaactggtctcgtttcgtacttgctcgtttcaggcaatatgattttgacacacagtttttccacaacagcattatcgtagagacgatccatcagtttcattttgatcgcaaaattcgagccggaatgacggagaaaggacgtactgaatataatcaaaatttaagctttccagataaaaatcgtaccttggaacgttgtaacccaaaatgtaatttgtacgccacccgccatacaatgggaaacgcgggcggagctcaacctcaacacgatcggcacggggataaacatttgaggtggagatgttgccgatctcatctcgataataaatgtcattggatgcagccggcaaaattgtctaaaatcaaaccaattttcagatttggcatacttttgatacgcgtatcgctcaccaaaaataaaacgaattgttttttaatttcaaattaacaaaaggattatcagcgaaaacgattttagataagttgactagattattattattatttgattttttgtctttaggtgtgacttttacgcaatattatttttttttttatttaaagacgaccttaaagtttttgatga

SEQ ID NO: 1281 - DNA, 2626 bp, Heterodera glycines
aattcagaaaaactttttaggatgaaagtatatcattactggttttctgactgcaaaatgtccttaggagagggcaccaaatattccgtaagagcataatccaccgaaagttagatattggaaccggacattaacaaatcgagaaactcaattttgtggaaaaccatgtccgatgagacccctttgactctaacctaaatgcaaaaatgatgaaatgacatttataataaaatgacaaacacgagaaatccgtaatttgcccgattctttgccgctctcataagcggacatccaagaaagtcttgcagcctcctcagccgacatggcatgtacaaaactgctcaattcctcgtttcttccatttttcaactcaaagtcagttttaacctgaattaatatataaaattttaaatattttttaataacaaaatgccttgacaatttgagtggtcaaatctacgtttcggactgctgacaaaatttgaacatcagaaggcactgaaatttctggcgactgagttgaaatttgcaacgttaaaacgaataaaataatgagttgaagcggcaagcttccatgttccattgatattcgttatatcaaattaggctaaataaagaaagcttccaagggttgcccttaaacatcctatcgactttggcgtccaattaattagatgtaagacaaacaaaacttcatcagaagtttgaagaatttcaaaaatttataatgaaaacacccaggcggctgaaagtagtctgggctagtgctaatattttaggctctaaaaactcccaaataggcactaaaaaatggaaaataggaactaaaaagcctcaaatttagggggtgtaaaatgacggttgtttttattgcatttgcattttcttagcagggcaaaacgccaaatatgtcaaaatatattttttcaaaatttgtataattttaggctctaaaaataataacctagaaaataggccctaattattcgaaaagtagcttaacaaccacaaaaaaaaacctgtttttcgtgcgttttaggccactagtagcccaggaaaagggataccgacaaataaatgctaatccaaataactgtatttaattaaacaattatcattttttcaaaaaaggatttcttttgaattgagatgatggatttcaatgaggaaacggatatacttcacaggcttggaagtaattcatttaaataacttatcggaattaatattacattttagttcttgcttcaaagttggagtgtcctaacaaacaatttccattgtcaaaagcaaaagataaatcgacaagccgagacacaaatccttccttttgttctgtgacagctgctgaagacggtgacggatggggtgctttttcattggacgaattgagtagctcaagtgatgacagtgaatttcttttcgatcgtagggtgggaaacaattaaaattaattcaaacaccgttttgactttaatttaggagctgaatattaacggtaaagtcaaccggcgagtgcgcacccatcgtcagggatatattccacaccaaagcctcccaagaactggaacaccaaatttatggaaactattagcactgctcagtgttgcttcttttgcggtactttagtttttaacgtgtttggattttttagcattgggtagcaaagacttgggaagggaaggggcggtggggaacctttctcctccccggcacgactttttttttttttgcttttcataccacatttttgcagcgctttttccaattggatttgttggttttccttcctttttgacatgcataactgagtccctgttgaaaatggttactcgttttttacatgaaaaatgcaagcgcgcacttaatttgagcaattttgaatttcggtccttaaataaatatttttctgtcccctttagttttataatttttgaaatttactggctttatgtagaccttaatttattgtcacataaatattttttcccttggaccgcaattcttaaaaattgctaaaatttcatctactcttttttagggtttctcaatggttctttcacatggtctactttccctttggtcttcgtctccaactgaccaaaatattccgttgttttatctgatacgcatttgtggttttcatgcgctcgccctctgggtcggctcaatatatggtttctttttcgttaataataaataaacatttaaaaattaatttagcgtattctgttcttctcaaaaccaacccattctccattttcctcactttaatgctaatttttacatttatttgtgctcaaattcgattggatgaaacagtgactgactcgaaagtgattagtcactcggttgtgctttttctgtgcgtttcgcaggcattagttgagggtgccattcagagaggtcttaattagggcgtaaattgagccaaaatgccttgtctttccctcgcactttcttcgttcgctttaggccttctccttctctcccccctttggactgtccgttttcaccgcgttctcttcctttgttacgctgcgtttgctttcagtgctggcggcgcttttcatatgaaacacattcaatcgcaacacaaatgtcgacacaaaatattacctcactt

SEQ ID NO: 1282 - DNA, 7465 bp, Heterodera glycines
  misc_feature (4283)..(4283): n is a, c, g, or t
cagaaaaagagatagccaattttccaaatttttcccaccatacgcgccgagaaacaaattccagaacaattagtatcggcgtaattattctgagaatgcggttgtaatccctattactgttgagcagaaaaagagatagccaattttccaaatttttcccaaacaaacgcgccgagaaacaaattccagaacggcgtaattattctgagaatgcggttggaattcctattactgttgagcagaaaaagagatagccaattttccaaatttttcccaaacaaacgcgccgagaaacaaattccagaacggcgtaattattctgagaatgcggttggaattcctattactgttgagcagaaaaagagatagccaattttccaaatttttcccaaacaaacgcgccgagaaacaaattccagaacaattagtatcggcgtaattgttctgagaatgcggttggaattcctattactgttgagcagaaaaagagatagccaattttccaaatttttcccaaacaaacgcgccgagaaacaaattccagaacggcgtaattattctgagaatgcggttggaattcctattactgttgagcagaaaaagagatagccaattttccaaatttttcccaaacaaacgcgccgagaaacaaattccagaacggcgtaattattctgagaatgcggttggaattcctattactgttgagcagaaaaagagatagccaattttccaaatttttcccaaacaaacgcgccgagatgtcgttctgatgacggcaaaaaagtttgaatgggctgggcggacgtattcagagcgagttgacaaaaattaaagaccaaaggcgccaaaaattcactttattttgtaccctcaaactcaaacttgggtaattaaaccataatcaattaatgaacaaatataatccgacatgataaaatgggcacaaaggggaatggtaaggggaaggcgcagggcacggcacagggaaggcgcagggcacggcacggggaaggagcagggcacggggcaggcgcacgggcacggcacgggaaaggcgcaggggcacggcacggggaaggcgcagggcacggcacgggaaaggcggacgggcacggcacggggaaggcgcagggcacggcacagggaaggcgcagagcacggcacgggcaaggaatggaaacttcggagggaaccaatgagcgatctgaaatcactgaaaacccagccccttttatacggcttttttgaaaccatagtacgctccaatttataatttttaattaaaatctgtttttgttatacccgtttgggttctgccattttcccattaattgtttgttttccactttttcctttgcaattccaattcctttaatatatttaattaattattaataatttgtttacgaacgcaatccttaacagaattcgccatttaataaatgtcgaaccaaataacggcgtcggtggaattgaagtcgaagtcagtgtgacagatatagaactattagactcgtcaccaatgtgtgttaaaattccgggtttcaagtcaacagaataggttaattctggattgatagacaatttaattgtcgcctgaatggtccaagatggacagttaacaacttcgaaaatttcgtcaccaactgattcggcataagttctgtaaaatagacatccatcagttgcgaggaaacattgacaatgccatcctccgcacgatggtacacagtatgaataacctggttgattattagcgtgatcattcacttcgggattccggtctgacatttttactgattgacaagtttggccggtacatttcccagcgcctgagcatcttttttgtgatgtcgaagataattcgtaacctctcgtaaaataatcagatttttcggtgcaaattattgttaaagtttctattgtaatttgtagtgtttccatagtggtgttagtttttgtattgtcgagttttaagcaggttaagtgttcaggtgtaatagagagttgggttgtttggtcataagaacattcaatttttccttcttgggttacagcacagtcatttgttccagcgactaaattcgtcacttcatcacaagcaaaaattattttaaataaaattaaactggaagtgattaaataaatcaatggtctttttaaccttggtcttgaagttctagttcgatttacttttggttttcttttaaaacaattaaaaataaattgtaaaatccaatggataaaacgtgtgagtattcgaataatttggaggcttaatgaaataacatataaaattatcattataattacaagcattaatgcccagtgaatctggtctacacattgtgggtttttaagatattccatacaaaatcgacagttaattaattcacatacgggagatgattgacatgtgatttgtttctcatttgatttatctgggttacttataaatttaattacaggtttatattcaaaggatgtaagttttgggggtaaataaattatttcctctttttgggggttcttttttataattgtataattttcaatggaaatttgtaattcttgtatatcatttattgctttaataataatgcctccttttaaacactcaatggttgattcttcagtgattgaagagttttcttctcttttattccgtctattttcaatgaatggttgatttaaattatttggcaagtaaaatattttttcaatagttccccatgctttgatttgaattaattcttcatcagatttaacaaggtaaattttttcgtatggatcgtaaaagcaaaatttcgttccatatatttgtttgaatgaattatttttaaaacagtcatgttctcgacagtaaattggagtaccaatcgtcagattgccctccccaaaacaacgaaaattgtttatcgagtcaatttgggaaaaaagtaaatttaatgttttcactatgtgaattgaattgtcatgaagaaaaattgaattaaataattttcttttcatgattgggcagttttcagttttatttagtgcgcagatatttggtttgaagaacgaaataatgttttggtaattaattttttcaacggattcatttttgattttattgtaagatgcaaagctacataatttgaatccctctggacatttacatttttcaccacaataaggtgggcgtcgtttaataatatgtttgtctttgcataccaattgtttatagcaaaattcttttgttattttattttgtctgattgtaaaaccgttttcgatgcatagagttgtatatttcgttttccatattttaggttcctttggacattcgtatgaataagatgaacataatgaaattaatgtcaataataatgtaattgttaaagatttttgaatcagcctattcattttggtggagactaagggattatccatcttcctttttctgttgaaataattgggtttttgattaattattagattagagagagtttcttgctctttatcatcatttgaattaatttctaacgggtaaattaattttaagggtcgatttagtactgttttatttggaagttcgatattagcgcctcttgcgataccatctgatccagttatgacatttttgacaatgccagtcttccacattgctctgggagtttgatcatgtattattacgatttcattcaattctggaaaagatttcatacaatttcgtggatttttgttttcgattttataacgttctcttaggcttggtatatattcattagtccaaattttccaatagtcatctaatgattttgttgttttcttccataattcaattgcttggtcatatgaagtattttttgggtaataggttgggtctttggtttcctcattttccaaaataggaggaatacataaatttttatgtggaagtatgaaatcgattggtctaagaatctgataagtgttaatttcatcatatataaaggtaattggtcgtgaatttaccagggcttcaatttcacaagtgagagtttgaaaagaatcaaactcaataaatcttttcccgattacttttctcattgctgttttgacattctggttaaggcgttcaattgctccgttttgccaaggggctaattctatagaaaatgtccaatttatattttcatttaaaaagtacgttttaattgactcatccttgaggatttcttttaattttaacacttcgggtaaaatttttgatgcaagttttatttgtgctgcattatcactccatacgtgtttgngtgtgcctcttcttgatataaatcttctgaatgcattgagaaaatgtgaactgataaggaagtgactaattcgagatgaatacctcgtgttgtgaagcatgtaaataaaattatccagcatttttcattgaaattttttatttgtattggtcccatataatctagtccaacgttttgaaatggttcagttatttcactcgtgatttgggtaatggaggcatttgtggttgttgaaaaggtttagcattatatctcctacaatggtagcattgtctccgtatttgatcaacaattcttcttcctttcggtatccaataagtttttcttatttccgataatgttgtcattgtacctgcgtgtaaatttcgtgtgtgataatccatgattatcaaatgagttccatagtgttttcttggtagaaaaattggattgacaccttgaatttgtgcattttttaatcggccttcacatttgagtatcatatcattatcgagataaattcttaactgtctttcttcttctttatttggttccatttccctctgaataattcgaattagcattttttgtgccatgatttttaattgtaatgcattttcgaatttagagtaaataaatttttctttaaattttttagagttctgtaatttgaaaaatatgaattttaataaagtttgacaaatgcgagttattttaagccatgaactgaatttatcccattcgataattccgttatattcgttttttattaaatttatttgagtgttaattatttcctctgtattatctaaatatggagcctcttcttgatcaggactgtaaaagctgtgaggtggccaattttcctcttccagtttaagccattttggtccattccaccataatttgttgtattttaattcactcatggttgctcctcgtgaagccaaatcagccggattatctgctgattttacataatgaaaagtgatatgtaattccaaggcaatttgttttatctcctcaactctattttttataaaaattggtaaattctttttacattttaaccaactgagtacacattttgagtccgaccaaatataggtattttcaaggttcaatttggattccgtttttataaacttggcggctcttgcggctatcaataaccccaataattcgagtttgggaattgttaggcctttcaatggagtaagccttgtttttgcgaatagtagattcacttggtcgtttgtatgtaaataagctgaagtggcataagccaactcggaagcgtcagaaaaaatgtgtaatattgaatgatttaaatattgacttgtgaaaggcgaacgtggtatggttatcatatctgtgtttgaaatattattccattcaataatttcttgatcatctaatttatcgtcccaatctttgtttaatcgccatagtttttggaaaaatagtttatatttcagtattactggtgaaatccatcccatgggatcgaaatttttggcaatcatcgtcaaaatttgtctttttgttgtgtctttactcattagtggaatttttatttggagttcaagttcatctgaatcgacattccattttatacccaacatttttgttacttttggtatctctgatccttccaatttttgaatttctttattactttgttcatgattagagacaaactctctcagattcattgatgctagtttaaatatttctttactccaataatgtttgaattgtatttccttttcatcatcgcacatcattacgaaattatcaacatatgcattttgtttaagttctacgcaaagatttttaaattcttcttctttatcatttagacataattccttgttaacttgaattgtcttgaatttttcaaacatttcatttatttttgacaagtggagattaactacagcagttaataaaaatggtgaagcgttaactccaaatggtatccgtgtgaatcgtctcaattcgatgtctctcatttcaatttctcgataattttgtcttatttcattcaagtacgatttgtttacccataaaaatcgtgttgtgtctctgtctaattcatttaatccaactcgtaaaaatgctttttccaagtcaccaattaatacgtaatttttgagtctaaatcggagaatcaatccacacaaatctggtagtaattttggtccttggtgaatttcatcatttagtgaattatttcctttaagttttgcggacgcatcaaaaactggtcgtattttagttgtatttgagctctcttttattaccggattatgtgggagataatgaagcaaattatttgatttaaattcagcaatttcatttacgtcagtatccatttgttcttgcaatattctgtcataattttccaattgcttggtttttaattagttgtttaacaacatttcttagtcttcccatggcataacccaaaatttgttggtaaattcgggttctctcttttataaggccaccgaacagggtatctggttatttttaaatggtaacatttttatcaaactggtatcatggccgcatcttcattccgtcataggtggtgagtcgataattccaatgttttctaattcccaaaatttctgaagtatttggttcgtttcgtctttttttcttttttcggtcactgagttacaattggtgtcctcaatagttccttttccagataatatttttcctaattttgtatttattgagtaaaatcctgatggaagtaattgaatttgtgaatttggtagcatgaagtgccagtaatagtcgattccaattaaaatttgaggacgtgaattaatcagtaggatgctgacacaaccctgtatttgattttttggtccaggagttattcattcacttcaacttcagctttttgtcgagtctccaatgcagatggactgggggatgctaccttagattaattaatttgtggggaatataaattaaacaaatgtataatattatgctttaaataaaaatagatacaaattcattttatcaaatttatccttaccatgaaatcgtggcgaaaaataatcccatgagctaattacagatcagaattgcggatagatcccaaaaatcctcaacccgcaatcgcatatgaaagcggtacagaaaccccgcaatttccgaaatcctctatccgcaattgc

SEQ ID NO: 1283 - DNA, 5370 bp, Heterodera glycines
tgagtagttacccactccattttcaccggattacggtagccccccataggtgtgggaggggtgcatggccaactgagcgccagccatttgagcgccgccaagtgagcgcgggccatctgagcgccagacttttcagtactgaagccaaaacctattgcgcgacttttttttgcaaacccaaacctattgcgcgagtttttcttgcaaacccaaacctattgcgcgacttttttcttgcaaacccaaacctattgcaggggggtgcgcgacttttttgactacgcgactttatgcaaattattttaattaaatttatttaattttaaattattttaaacgtcttaaaggtcaaagacgttgaatttaaattcatttaaaattctccaaaaattccccgcaccaagcggatccgaaccccaggggggcggccagactgacgcactaaccactcggccacattggcaatggatgataaacattaatttgctctcataaagggaaaaattgacgtcaccagcggcgggaggggggcgagagcaggcggcgagaagggggagggggtcaaataaacaaatcaattattgaattcacaattttctcttttaaaagcaaaaagaaatgggggaccgtataataaaatataatttagaaattaaaataattaaaagggtaattaattaattattattcctaaaataaattttttattacttctaaaataatataaatatttttcagtgaattaacaaatacatttaagtttaattattgatttgtctgttaattttttatctcctcaaaaataattacagcaccctttcaggtgttgggcgtttgtttatttgaccaataatttttaatttcacatctttacgttgcccctccctcacacctgctcatttgtgtaatttgacaccgtttcttttatcttttcgttaaaaattaaaaagattgtctggaatttgtcttgcgccaaaccgctgtgccattcatttatgtaatttgacaccagtctgataataatttcgccaaaatttatttattatttgtccatttattacgaattattttgcatctatcactccaaattttgttaaaaaaaaattttttattgtcccaatttttaccattttgtgttttttcaacaaaataaatatttgttcaaaatttaaagaattaatttttaaaattttagacacaaaaacaaatcatgagccaaaaccgtgacgaaaactcgcagccacctgtactcgatggaccgtacccgctggcacaagagcgcaatgagtttgtggaagatgaagcaccggtgctgcttgagatgttggatcgtctgtcacaaggagtgggttttgttttgaattatttaaattttttaatttttccattttggcttatgctaattgttgattttgtttagggaatttgccaagccatgggcctgttttcgtttgcacttgccgactgtttggccacatttcatacatttgccatactgttcgactgtgagacacctgtgccatttgacgagcagcacaagcgatacgtgttcgaacacagggacaaaccgcggctaatctacgtttcggaagatggtagcgctatacaggttgacggtgtggtgaagcaaggggaatttgtgatgagcatcgagacgatgtatctcgataagcgaaacggagttgatcacttttgcacattcctgcgcacttttggcatttgtttcttgatgtgccattgaatgtgtttatttgttgcctattcagagcagtaaattgtttgcataattctgtttaattattttttgtttacaaccaaaatattgatccgcatttttatgttataattttaattcatttttgaaatttttatttaaatggcaaacgaagacttccgcttgtccgaatgcatccgttttattgagcgaactgcccaagagtatgattgtgttctgccggttccacggcttgggtttgtcacggaaaattttcttaataatttttttaaaaatagctcaaggcgcgatgagcacctggatgcctgtgttcttatggaatcagtgggctcaggccatcggctctacattttcgagtttgaggattgcctccaggtatttttaaaatatgaggtcaattaattaaataaataaataaaacaaaaccccacaggtgaaaggacacatcgaaaacgaagacggaacaagtacacgcgtgatgattgagcactatgataaatacaatgggttatgtggatttgaatcgtttttggcgtcatgtgcttttaccttttttggattttttgttcccgtttcctatgaagatgatgattgatttaattttaaaataatttttattgtatattgcgtttcacaaattcataaacaaattcatccgaattacttggccttttcaaaaattgcataataaactcaaaatcaaatcctaaggacataaaataaataaaaactaaaacataatgaccacaaacattagagaaaatcgattgaaattttcttcgattaaaataaattttccgaaaattatttgccaaatattttttgatcagatcgtttggcatctcgccataggagtcaaaaaagtaggccacccccggcgaacgcgcccatattgcgcaccaatgggttcccggcattcccgacgggtcctgaagtggcaaaatttattttattgaaaatcttttttggcactcaccaaattgacaattagactgcagggaaatttcgtgcactttggcaatcggtcggccggaaaagtgccaacaaaatattttctcgtcgccgggttctcaaagagagctctgtcgatgaaccgattgtccattcctgcgacgaatccgcctctccctcaaaaacaggtaaaatcccgcagccgcagtacctgctgcaccaaacaggtagatgaggcagagaaaaaagttgattggcgacttctcgatcacatccggaaaacacagtacaatcccttcgtgtgcggcattggaggagggcatttgaacaaaatcggaggaataattctcaccattcatactgtaaggtcactagtgattgatctgttccggtcaatcagaatgagcccgtcagcctcggcataggctattaaagtgaccccctcgttcggaaccgcttcggcaaaccgaatgttcaccgctgtacagccctccttgatcagctcaaagcccggcgagtcctcctgcgcattggtcatttggaagacatagaggcagtaggcagtcttgaacatgctgtagctgatcccgttgctctcagttgtacaggccatgccaaggtgctcctgggtgtcatggtacgcccttgcgtacctgttgttcttgtagtccaagttgtacggaaactgtgggtatgtcctgccagaggcggtcagttcaatatcccgcacctgaacattttttctgccagaaatacatgtcaaagcggcacttacgttgtggtggttgaagtaaaaggggttcttctgattgtgcccaatgtaattttggttgggcaccagcccaatgatgaccctccgtggcacttcctcggtgaacagattggcagaaaaatcgtatcgtccaccggtaatgaacagcgacttcatcagcgttttccggatgccgtatctggcgggctccaggtccaacttctttgcaatgtctaggctgagtccgtccatcagatcaaccgtcttcactatcagcctgcagtcgataatctcaagcgtgtacttgtccctatttgcggcttcctgatgtatcataaaatcgtccgactgcagggcgagctcaatgtcaatctcaacattgctgatcatgtacaagtcctggttgaatatgtcggcgctcagcttgcttatcgcttgaaagcccttgctctcctccaccgcctttttccttcgatcgtttactttggtcgggtcactgtcacggaaatagccagccacgccaaagtatgaatcctttgccgttacagggtagctgagctcggtgtccaggaacaccttgtagctgtacagctggtttgagtcgtacacctcccgctggttgatgtgcactttcaggttccggatgaacgttgcgccgggcatttggataaggccgaccgctgcgtttgccggcacatcaaccacaaccccgtcatctgccacttttttgagcttgaactctgtgcacacaaacaccttgctaaggtctacatagctggtgattgggtggatctgaaccaacggatttgtctgctattgtatgtgaaaaccacctaccttaaaatgaaagggcctagagcttattgggttcagcgtcaggtactccctgtagctagagttggacacagcgcagctcgttgggggtatggtgaagaagtccagccccgcatttgccacctcagcacttgacacatccacttttttatacaacattttgctaataataaccgagtgagtcaaatcttttcttctttaacagagctttttggggaacagtttgtccaacaacgtctgagggtttcaaaatgatttcagcttttttcccgcctcctcttctcttccttcttccgcgccccttttgtagtgatgaagagaccttgtccagcaattttttcgctccctcttttccttccgacaccagcgcgtctttgatgttgccgccctttgacacctcgttgaggaatcgtgcacccgtctcgaggccctctttgccaatctcggcagcaatgtttgccgcatagggtcgtgccgctgtgaccattggacgaaggtagcgccacaggttgcgcagcacagagccaactcctgctcccttctgtcgggggacacccaagaaataaccgtatccccgctgaaacgttggtgccccctcaaaaacgctgatcggtccactgcctccactttgcggataaattttctcgagccgtaaatttgagccgtcaaaaatcacgcgaaccatatctctcagaacgttaacacctttttaaactgaagagtcaaaacaacttggccaaactcaaatggcacctcccttaaataagtgattagaaataattgccctgctgaagagcctaacctcccggtcagagtgcgaatctcaacgtcaagcacatccacctcccttgctatgattttgtgaaacaacggcgcctggaagtccttctctaccacactacccgactttccctcaacggcaatcacttggagcagattgccaaaggtgttgccgacaatcatgctctcaatgacgccactgttcaggtaaatgcacaggtggctcacaccaccacccaaatcaaccgcatattttgcaagctcttcatttctgatctgctgctcttgttcatagcccaacacgtaggccagtgatcag

SEQ ID NO: 1284 - DNA, 3449 bp, Heterodera glycines
  misc_feature (22)..(22): n is a, c, g, or t
  misc_feature (61)..(61): n is a, c, g, or t
aatgcaggtatcatagtatttntagtcttaaggaaagaatttataaattggaaacgttttntagagtctaaggtccgcaaaaaactttatttttcacgatttttataaaatttatttatttctacatcgattttcttcgttcgaaatccttacggatcatttcaaatcctccgatcattcggcccagcaattcgcaccctttccattggttttgttcactttccatcggatttgctttcgcttcggccaactttcgataatcagtcgctaatttgggcaaaactcggaggaattggccgggaagcgatgcttggaattgttgcttttgtcgttttacgatgcgttccaatttatttttgctaaatattttatttctcaatagcattttcatgttttttccaacttggcgaaaacttttggcattgtgtttcctcctccttttccgtttcgctgaatttggcgaaattgctcaaatttgtgcacgtaaagtgcgacccattggtccagaaagtgaatgcgcaagctcgagttgacgctggacaacagaagatgtgccaaatcggaaatgccataccctaaagagttaataaacaaattaattaacctaaaggagttcagtggacaaattttaatattctaaataaatctaatgacattttattacctaaataagccaattcccagccgcgaatgtttggccaattgtcagaagatggcaccccttctctgtgctgtgtttcgccttttgggcagataataatattatcgccacaaaaattgccatggcataaaacaattggcaaatctatgagaataaaaaatattaattattaatatttgattaaaatcttttatttaaattcaatttctttttatctcgcctttttctgcgtttgttttttctttctcatcaatcaattcaaatttgacgttttgaagaaagttgcgcaacggtggttcattttttcgaaaatattcgcaatttggaagtgtcagcagcagattaagaagccaatttttaatggctaattccttgagaaatttccttattaataattaattcgattcacaaaacatttttcatgttttggctgagaaaagtgcggaaggacagaatttggcccgaaaaattgaggcgatcccatggacgaagcatgaagccatgccaatgccgtaattgccttctcaacctaatcaagcaaatgacccttattaacgggcattgattcgcctctgctttgtgccacctgatcaccgctgagtccctcttgctgtcccctctgacttttgttaaattggcgtccataagaaataattgccaaatttaggtcgattggttccgcctcaatttcatcttctaattgagcattaaattgttgattttccattggacgacgttcatttgggctcataaatgtgtagaagtgtctcagaatttcatcttctcggtcacaaagtgcgagacgatgtgccaaaagttcgttccgtgttcgaatgtccaaaaaggacggcgagtgatgagtcattgtcacatacaaatttaaaatttccttaagattatgttaaacgttatgcttagcaactttcccgttgatatattgttaatttaaaaaatttaattattttataattttattatcttttaagacacattaaatatcgaagaaattaagtaacaataaaacaacaattaaatgaaagtgttggcggccattcattcactttgtttggctggcgccatgaaattaaggataattagcgtaaatttaaaagtgacacacaaaagaattgtcaaacaatttttaaagtaaaatatttattatatttacatagtgtaagaaaaaaattacatattattatatgtcaacaaagacattagtaaattattcagcaaaagtaatccaactcatttgatttcaacagagttacacgggacagacttttgggaaaattgcaaaaattttaattaattgttttcccaatttttaaaataatattttcctgcttaaaagttaggaaatacataaacctttttttgccattttcattaattttataaaaataaaacacattccgaaaagtttgttctctgaagaccggggattccgagaatattccggtcccgcgcaaccaaaaaacatattaaaaaaatcagtaacacagcgccttttccgtgaattgctgtgatgatttttgttgtttatgagctgctaataatcgccaaaattatggagaagaaaaggagcactaaaaagaataaattcaattttaaattcactaattatggtatgtttagaattaattgtaaatttgtctattaatgattattttaaaaacatttaaataaaatattctattaaatgataaaaatatttactgattaaaaaaatctttgagttaatgctccacttctttaattggttttcctcacttaaaatgatgaaaaagcacaatggcccagctgcgatcagattggagcagttttggcccggatagtctgtttcgttgcacagatcgccaaaacaaacgtaacaatcggactcgccgccattctctaagcaaattgcctcaaaaaattggcagaacgatgccgcctttgccctggcacaacccttgcgcaaattcaccgtgtcattgtcttcaaaggattaactctcgaattcgaaatgtcgccattacaattcaatagaataatttgaacaaccctaccgtatgcacaacgcacactaaaacaaccgtaaccctccctcggacatttttccaatgggtcactttcattttgcgtgtaacagttcaaattgtgctcttctgctgctgctgatgggacatttaattataaaaacatttaacaattaaccgacccccttttgaagagaataaaaaagggagcaaaactagaaaaataacaaatggaaaaacatgcataataaaaaatgggaatttagggagacgcaattattcaaatgctataataaggtgctaattagtggtaaatgattattatttgagaagagtgccgaaaaggagaaatgattaatgaagaatgacctcagctgttgctgctgctgaagtgcaatggattgataagataaagaagaagaatggtgttgttttgaacataaattttcattttctttgcggtttacttcagttgggccctcacgtttgggccccagtatgtttttggctataacttttttctttgtcatccaaatccaacattgttggtatcattcgaaagcttaacatgtttaaaaagttatttctaagactattgcttctcgatttgacaattagcaaaaaaagttataacatgaaaattgcaaaaaagtcaacatttttgaaattttttcttaataactttttcaaaagccaaaaaatacttttgcttttgtaaggctaataaagcttgttaatagctttcgaatgataccaagattgttggattt

SEQ ID NO: 1285 - DNA, 7479 bp, Heterodera glycines
actaattcaaaatttacactggtaaatgccttttttgtattgaatgatttctcatttctcagttacaaatttcttcattttttgctttctttttgctccttttctctccccattttatttctcaaaaagtgacattttcttcagttaaaaacatttaaatgttctgctgatgactgacacttctcaaaatacaaatgcatttgctttttgtttttcccttttcttttctcttttctcttttctcttatgctcaatttcccatttctccgtcccatcgatttgctaagtgaataaaataaacaacacagccaaagaaaggactttcgactttcgcttttccttattttttaatttaaaatatttttgtagttaaatttcaaacattcttttaataccatgtaaaataattaatgcaaatttcaaattttagctgaataaatattattttagctgcgaaatgccttcaaattcgacgcctttcgatgagggaaaacaaaaaatggcagagaaaaagtaacaaaaagcaattacataaatgttcaaaataacatcctaattaaatatttaattgcttttttgaaattaaagcaaaagcattccgtcgtcgtcgtccatttcgaaatttgcccctttttcttcgtctgctgctgctgaaattccccccgaaattgccgcactttctcaactttcgatcagtgattctccgaaagagccttcggtcgtcgtcgccgccaattggactttgtggcgttacgaatgccgcgatttgccggagcacagatgccaagcgaagccgtgccaattctgcgtataattgggggggggggggagaagcatttaatgaatctatttttgaaaaggctttaggagcaagtgagcaaattgaaaggggtggccaaagggaaactcagcgaaagcaccgaccgatgggacagttatttgaagcgggaaaagagctacgatgacgagcacattctgatcaaagtgatggaaggcttttcgcccagcaaattggcaaaggacgtgtgtaagtcacgtcgtcccattatatcccaccattttagcggctaattggcataattgaatttagtctttaacaaaaaattgggcgtcgcattattccgtggggacattgagccgaaaagtgaaagtgccgaaaacgccaacggcatcgtctttcaattgcttctcctcgccacttccgggcgcagaagtgccgcactcgtcagcaaatttgacacaatcttttcgcaaacgcttcgcctgacgctcgatctgccgagttcagtcgggcgccatgtcaacggcattttcttacggtgatttggcgattaagatattttaaaaataataattcaaaaatataaaacaggtgcgagatgaacccgggcaaaaacttggaaaaagaagcaaatgcctatggaaacctgatggatttgccgttcatggcaaagattgaggtggacgaaatgcatacgatagcattcactttgtgatactgtaccaattgaaggtgtggatcagagacagagccgacaaagcattggtgtgggaaaaactgatcacgaagattcaagcgaaggtggacgaattggcacttccgtccaccgcttgtcgaaacttctttccgatgaatcgactcgaaaattgggcgaagaaaaaaggggtcattattagcaattaattaaaaagcgatagagtaaaaaggcgggttaatgtgttcgtctgctcttttggtgacggacggaggacaaaaagttggaaaatcgggtttcagggaagagacggcggggcacagaatttgtccgcacctcgcggaggcaatggcattttggtatttgggctaaacggagaagcgcgagagttggacgaggaggaggagaacgaatgggcgggagggattttcgaatatccgccgataacggcaccgatcgccggaagaggcaaaaagaaaggcgccaaacagaggaaaaaatggcacttctaacaaattaactccccacaattttggcaatttccacaatcgctatttggcagcctttctcaacattatcaggaaacttaccagcaatcattcattttttgatcaattcaaacccagacttatttccgatcagacttgtaatcagagagggaaacggaatttagagaaaggaaaacttttgactccgatggaccaccaatctcctaagatttttctaagatttaaaacaaaagtcctcataatttagtcattttttggaaaataatattgtaaaaaattgggccgacgagcaaaaaaaaggcccacagattgccaagccgaaattattttcttattacgggtctttccaattcttattttgaaaaaacattctcattttgtcatcatttcttgtttaaaatccgtctttttgctcactttttctcccaattctcaaatgtcccttttctccactgtttgttattaacgtttaattgttttttatttctcttcatctttctccatttcaaaattaatcatttcttcgaattcggtgttcgcaatttttgggtcgtttagaacattttatttattttccctattaattttcgcaacttctcactttatacatatttttaaattcttttttttaatttccagaaattcgttggaactgctcaattcggaatcaaaaagcccttccgaaaggtgtgggaattccaagttcttctgatgggtatttattggacaattcatccattttcagaatcacattgttgaacaccgaaacgaaaactgaactaattattcatttgacagatttaatttatttttaaatgttgaaatttttcttttgaaaattaatattcgtattagagaccggacgagggatctcgcgggattaaattcgggacccgaccttgggagccatctcgagccttttttaaattcattgagattgatcgggatttcatcggcatcctaacttgggtccctctcgaccatcgccaatcccgcggattggagtcaaaattttacgacaattttcattttcttattaagatcttgcaacactaaaataaaaaaaatattaaaaaataatattgtcatttgctaatttccttaacaaattccttaaaaattccgagttttatccgcagcgtctaacggcaccgccgttctccacaccctcccttccgccttacaagggaacatatcgaactgtaagtgtccaaatcactttaaaaatgttaatatttctcgatcaagttgatcaattgtaattcagttgtccggtctctagtcctagcattgattttggggttcgatggcgttgataggcgctgccgcgaaaaatttgaaaattatggcccgatttttaacataatttcgcaatatgccatttttggggtcaaattttgaaaattttaggggaatttttggagtcgccgccggggaaaaagtggcgaaatttgtgaatatttgcaaagtcacttttttaaaaagaaaattcaaaactttattttaaaaatataaattcatagcccgatcaaaaaattacaaaatgagtttagaaactcatatctgacacctctagttaaaaaaatcggaagtgatagttcgcgagtgccaaagttctgcaagaaaaacatttaaattaaaatgaaatttatttaaaatcgtatttctatgaaattcagaatgaaaataatttcacatatgtcaaaaaaaaatatcttaaatgggactgagattggcgagatcagtcgatttcgactggtaggataaagtaaatttccgcaaaaattggaaaaaagggatttttggccgagctactgacaacggacgagcctatccgaccctcggcatgcttttcctcaactaaagacagtcgcgccccggccgaggggttaaaatgccgcccatttggaaaagttaaagcaataattttgctattatcgattccctttcatttgtccattctttcgtttttaatttggtactttgttcacaatcttttgtgtgcaaattcggtcccaattggtggcagtttgtgtttgccctcccccattttccataaaccacccaaatttgtccacgacatctgacattaacggcgttcatttgcctcggcccaatttcgtcgtcccatttctcgatgtcaccgataggttgatcaccactttccaatccttatcagcactgaattcctttctcattagtggaaaaatcataaggccgaagttaattgagttaattgccgttggtcggctcatcagaaagtggggcttatcgtttaattatcgcgtttggatatgttgggcccaagaacagtcaaatgacatcagatgagcaagtatttggcaattttgggcctttttaaggggccgaatggaacgggtggcattcattcactcattttgaaacaaagccacccatttaccaattacacctttcaccttctactcccaccaagtccaaaaaccaaaaacaagtcatggaacgcactttcgtctgcattaaacccgaatccgtccgaaggtgcctcgtaggaaagatcattgaacgctttgaagccaacggctttcggctaattgccataaaaatggtacaaatttatggtgtcttttagctgcttattctcatttttcagatcgttgcaactcgcaaacaagcgatggaccattacgtcgcttgtgccggccaaccctttttccccaaagtgatcagttatatgacctcgggtccggtggtggcaatgatctgggaaggtaataaaaaccaatatgaaaaacaaactcagctgtttttgattgccttttcaggtgtcggtgttgtgagaggaatccgcaaaattttgggtgccacccccgacaaagttcctccgcccggcaccctccgtgccgattaccgtaacaacagcgacgtgggcaaataccatgacacggtttgccacggatcggactccgcggaggacgcacagcgcgagtttggcatttggttcgacaaaagtgagatgccggcacctctctcgagggtatcgggctgatgtgatgggccgaccgatcgaacagaaatggacaaaatatttgcaaattcgaaatgctattcattgtttttttgtaattattttttaaagaatattaaataaaatctaaataattgtcgttttattttcaattctttttctcattttatccctccttttgggcatgtccattcgttcgttcgtccgttcattccgtttttccgtgccattcgaataatgagcgaatgcgcggcccaatttcggtcggcaatttctctcattttacattttcccaacttcccctccccatttttttcttagtgtccgatttttttaatttttttttttacaataataaatgcatttaatgccaaagactttttgtgaatgcctacattaacaacttattccaattccttcattgttatttaaagttagcacttttataattaattaataaaaatcatttgtcattttcattatttctgttgtgcctttgctgctgaatacccaaacaatgccaatgcaaatggacccctccccccccccctttcccctccccccgggggttttctctttaaataaataatgcctttgaagaatggggcacagaaaatgagcacatgccataagtacctaagctggttagctgcctttttcaattccattttcttacactttttctgaatccgtaacacttttttttgtctctctctgagaaaataaaaatccaatttattccattttctgtttttttcggattcgctttcttctcagtcctttttggttttatctattatttattgatgtaagtcactgtcattcgcctcaaagcgctaattcgcgtaattagtgaagcggcggcagttccaagacagaagagaggccgtttcgctcgttggcatttggcaacgcgcaaaacagcgcaaaaattcaacccaattgacaccttcccacgagagaatgttcccattcattttcagtgaaaatggcatttattttcactatatttcaaataataagcaaatatttttaaatagtttttattattttactttttctttattactaaaaataattaaatataaaaaactccaaactttttgtttgcattatgatttaattgtttcttatggtcatccccaatttgcttcagtttccccccgcggggactttgtttgtccgctgtcatcggtccatgggatgggattagtgatacaaattgaattttactaatgccattccccacaccctccccgagcatccgaagaagacattggcacgaaaaagagccaagaatcgtgaattaatgtgccaaacaagaaatgggttaggtggggttggcccaatggcaaatggaatttggcaaggaaaagcaagtccggtcccagcagaagcaagtcgtaataagacagaggagttcacctctttggcatgacaatgagcagcaaaagcagcagcacaaaacggaaaaaaacggcaaaagcgaagagccaaacgcagcagcagcagccgcagcagagcatgtccatgtccaactcgagccggtggagcgggcacagccgggggcacagcggaagacgcaagcaagtccgactgcagaggcaacgctgtgtgacatcaggtgggggcattggagcaagcaataattaagcaaatgactaattgggccataattaaggaaattgcaaatttagggcttgataatgaaagtaattattaaagcctaagtaatgaaataactactaattagggacgaaaatacctaattaagaggaggggtaatttgtagttcttaccaggcaggattatttgggcaatgaatctttttgcacagatgaccagtcaacgtttggcgaagcggggtcaaatagtgccgaagcggacgatggcaattactggattggcgttgctcctttgttggacatgtccggcacagcacgcgtgcttggtaattggcattttctatcctttcgtttgtaagcgtatttaattgcattaattttgtttataatcatatcataataatattatttaatttcattttatttttttaatcccatgggatacgattaattttctttctttcacttccaagtgagtgagctccgcttaattattcgcaagtgttttgttgcccaaattggcagccaaaataacctttcattgccacaatattaattggatttccttcacaatacccggcatatcctcggtttcttttaaccattcattgcctttcaatttttattacatttttttgttcggtttgcttttcaatttatggaaggatttgctacattaaataaataaacttaattattttatttgatttaatgttaactcttaattcacagtaattaacagcattcttttttcatagcttttcatttcttttctgccattttccatgattaattttgggtgttttttctccattttctccaattttcctccgttttttcttttctttttccccgtctcattt

SEQ ID NO: 1286 - DNA, 2890 bp, Heterodera glycines
gagcggtggcgacaaaagaggcggaaattccctgcttggaactgccggacgatttggcgcagacgacggaaatggacgcccgactgctgaggtgattggcagtggaaaagtcatgacaacgagtggtcaaaaatgagaccgaaatgctctcgggttggtaagcaagtagaggagcagcttggaaacgagggaaattatgaaaatcacaattgaaaaaggggtggtgcataagattgagaattacattgcaattttatgaaaattcgaatcttacttcgtgaacaaattatgctcagatttccgttatcacactattgcaaataaaataataatattggaaatacgacagtcgctttcgattccagccgaaatagaggcgctttctcccaatggaaccgttcgaaagtgcagcttccgaatgtcgtcaattgtgccgatgaccaaattttcaccgtcagacacagcaaggcaatcaagatagaattccgagttcaatggtacatgatttgcctcactcgatcgcaggggggacggggaaatgcacttctgcggctgaaacctttcccctcggggcgttcaatttgttggatgttttcggttgtatttgcaactgaatttattcccttacttttccttattttattattttttgcattttattttttattaaattaacatttattagacgctctcttttggcattttttcaaataccaaaagattttaagtgagtttttgcattctttcctcaattccttgcattttttcacctattccccgacactcatttagtgccatcattctccgaattgtgccaatctttcgtaagtaatttttgccgtctttgtccgctgtaatttcggagtttactcgtgcaaggagagggggcgggggagggcggtgaagaaaatttggctagatgaggaaatggccacggcagcgtaatgagtcccatcagaccattgttgggcccgaggcgctgatgggccacacaaataattgcgccctcggcactttggttgggggaggagaacagctaaaattttaactccttatgggaattggttttttttcttacatgaactgaatttaacaaaattaaataatttttcccattagcatgtaaagctgcgaatatttcgtcggccatgttggcccaccgtcgcaaatcctcggcaatggtcgccggtttatccaccgcgacagttccctcatcaatgggtgccgcctcttcagcagcattcggcactcggcacaaaaaaccgtcaacccccagaagctcaacgaccagcccaaaaggggtggcgaagcaggcgagaaatcacaacgcaaattgggagattgccacggaaaaaatgatcacttatagttcattaatgagtgttttacttaattagacctatcatttaaacgttaattaatgagctttacctaattgggcccactctttgaatcgtttccgccgcccccgcgccctctgtaaatcatccaattctcgcgcactttctttccgcaggatgccccatcacaaatgggcgctgctaccgcttcaactccattgccatcatcgccaccaaatgcaacgggggagaaacaacagccgacaaacaaccgacgccaaactgctcgagaatcgatggccgttttgtccgagaattggggcgtgttcagcatggacccctcgggggcaggtgttcagggagaaataacaggcaatcaaccagtaaaccaactctctccgcccctctatttccctcacttaattcccgtcttccgagcattgcttccatcattggctatctttgatgtgtatgaagttttgggatgttttttagtaattttctttaaattcctttttgccatgtaaattttctgagcacaaaattggaaaatacaaagaattcgaaacgaattaatattttaaatttaaatcaaatttaataaaataattgatgtattcgctataattaaaaataaatagcctaataattgaagaataactttggttggttgcaaagaaaaactgcgacttataaagtttggcactgaaccaacgggaactgattggactgttcaattgtgaaattttggaggtgtgtgtttctaattgaggcaaatcatgaatcattttgattgataacaatttcaatcaaaattcatttggccataaattggtgagaaaagaacaaaaactcatccgatatcaaattgatgccaaatgaatttcattgtcacaaatgaaaaaataaaattcgaagaaaaaaacaaacaaaaatctggacaaaaaaacatagcaaaacattattttaaatcaaatgtggtcagaaaaagagctacgccgacaacgtttttgctttatattttggctttcatcttctgttttcctgcaccgattggcgggtaaatgattttaccctttgaaatacgaatttcattctgaaaataattcttttgtatgagaaaataaacttctttttgcccatcacatttcacctgaacttcgcgccaaacgagatgctcgtcgaagtacaggccgtgcagtttcagcattttgacgaggtaatggagcattggcgtgttcgggtagtacttttcgcttagcttggcttgctgctcctgaaatcaaatgaaaattcgcatactcaacttatccaacccgtggctaaatttgaataataatattagataataatctgattttcctttgcttacccatggctcagaggccataatttcagcaacgcgcaacgatttgatatcagtcggtcgtgtgatctgtgagcagcagaattgagtttatttttattgtaaaaatgaatgatcgcagtaacttgcgaaggtaacaatttctacccctggaaattatttttgctggcaactcccccccccc

SEQ ID NO: 1287 - DNA, 1144 bp, Heterodera glycines
cgctgtccaaagaacaactcatcttctaatacgaagcgcgtctccgaaaacgcctacaaaacccagctccgatggcaccggcaactcagctcccacagacaaatgccccgactcccgttgtcgaagatggaccaaaccagaagaagaccagtgatgacattcccaaacaaccggaggtttttgacgaaacaatcctcgtctgttatgaagcactaaactcatttccacccaccgacaaaattgttcaccaaattcaatcgctcaaaaaacaataccctcatcttttcaacaaatagttctaccagacctccaacaatttcttcaaataaaaatatccctcaaaatttctctaaaaattttacccaaaaaaaaaaaaatttttttttcctcttttacaacccctaaaaaaacaacaacaattttccctttgttggaggtctgacttttctaatttctgcttcttcattcaaaatttcaattatcttttatcactacctttcatttcacctcatttccgccaaaagtataagtggcacatgcccttcttttggttatttttattttatttttttattttttttatttttgagattcatttacgagagcaaattgaaggttttttaattaaaaagagagcaacccaatggcaaattgtataagagataatcaagtaacacatgtatttcacttaatttgttattacttacctatattactttttttatgcgagctatagtcatgattagggcgtcaaattatatggatataaaatcgcaaaatatggccataaaatatggacaacaaatcgcaaaatatggacataaaattgcaaaaatctcaaaatatggacataaatttttccaaatttagggtataatttctcaaaatttcttcaaatttattggttgaaattgcatataagatacatttccaaattttgagctgaaaaactcattcgattgtcggcaaatttaaatttattcaatatttttcgtgaaaattttgctaaaaaattattttttggaaaattttccggtttttgaggtcaaaaggccaattttcctgttgggggccgttctattagaggttttttgaaaaaatgccaaaatatggacataaatgccaaaatatggatataaatcgc

SEQ ID NO: 1288 - DNA, 4470 bp, Heterodera glycines
aagcacacagtctaacgaagctaaaatatataaaaccccagcgttcaggcaattaccaaaaaagatttgattaattaagtaattgctgattattttcgtttgtaactttcttgaaatgttagaattctcttgttttctcgtattattacattattcagactttgcgctttcaaatgataccaaaaagatagggtttgttcgaacatgaacaaagtgattgtataaaaccccgggattgtcaattgattggactcataaagtgcattagagcccaattttttaaagcaaaagaacaaacttcgcgtgctttcccgacccactgaactcgtaagtttggggcgctgatttttggcagacaatacattcaacggtgacccgaacggcgtgatgccgaaacaccttgtgtggctcgactttgttcgtttggtgtgccaaaatagatgcgtttgtgcatatgtaatttgtcgacaaatcgctgcacatcgacgcattgtaccactgggataacgaagccgtatccggattgctgctgtcagaggaagtagaacgagaacgggccatttatcggtactaattcagtttgggtcccccttttgggtcgaaatttttcaaaaaattttttggttatcttatttttttattttttttcggtttttgtgcttactttgccattttcatccttatttcttgcttaggtaatttagcattgtttgatgctgaaaaatccggtctctactggtgaaagtgggattggttgatgaaaacgcacatttaaatactccttttggtgctcacaaaaaataagatttttttgtctgttgacagatttttctatttaagtgctgtctcgttgctgcccttttcctcattcctttggcaatttctttgcccattcattactactcccgttccgaattttatttagtcattcattttttcttacaaaatcacttatgctagggtaaaaaaaggcgctgatcacgaatccgagttcgggttttgcaaaatcactgattttgtcaatgatttttcatcataacatttttacagaataatgaccacgggctcggaccgaacacaactccaaatgcaattacattttaacgcaaataattcttccgaggcatcccaatcacaaaattcctccgaacaaatgcaaaattgttcaagtatgcatttcctaatctttcataataatctgttgaccattgtttagccaatgaaagagtcgctggagaagattcggtgccattcatcgacagagagacttttggagacgcggagaatgacataggaaggcgaccgccgcccgatcggtttcgactggtctatctgatcgtgcttctccatggaatgggcatgttgctgccgtggaacactttcattacgatcgcaggggatgtaaggcaaaaaaatttcgaaaaacaaacttcaattaaatgttttaatgggctttaaggcacttttataactgcttttttaagtattatttgcaattcaaattcgctaatgtgagcaatgaagacaattacaaagtgtacttcttcaattatctgacggtttgtgcccaaattcccgtgagtttattcatgtttatctgattgtgagcatttttctgcctttttcctattttagaatttgctgctaacttttctgaatttatttggcgtcataagaggcggcttttaccgtcgcatttacttcactttggccgtcatttttggcatatgtctcgtcacaattgcgatggtttacgttccaaccgataactgtgccttgccattccttatcttttcttttcttagggactttcggctttttcctcttcacaatgctttccgttgtgcttctgaatagcgccagtggtgtttatcaaaacagtatttggggattgttcgctgattttcccggggaattcgccggtgccattattattggcaacaatttgtgcgggattctgatggcagtgctagacatcctcatcattgtgttaggtttgcgattcgtccacttcgcttttgttcggttcgcttttagtcggtgccaatgccgcactcgccgcaacagtttacttcggtctcgctctgtttaccgtcgtcctttgcattttttctttccattttcttcaaaaattggttctattctatttattttcaaactttcatctctttaaacattaagaatttctacaattactatgtccaaaaagcggcgaaagctcgcgcgaacaatggaatgaatattctgcacgaggaaacgggcgaagcgaaggccaatagaaaagtgacgcatccgcccgtaaaaacatacatcgcagttttctctgaggtaagcaccaattaaagcatgatatgctgtgaaaatatcattttggcaacttataggtccgtcgccagttgctcgatttttggcttgtcttttttgtcactttggctctgtttccgaccgttttgttgaaagtgtctttaattagtccgttcaacgaccagaaaacttccggtgacattttacacattaattgctttttgacatttctcttaagaatcgctctacaagcagctgacagttttcctcaatttcaaactgccgatttgcctccgtctgctctttcttccgttgatttggttttgcgattaccaatatgacaatttgactccgcgtcgcttcgtgttcatccacaaccaatgggtgttcactgttctgatcactcttatggcactcagtcacggctattgcagttcgttggcgatggtttacgcgccgaagtaacataattcattttaatacttttctcagaaagaaatttatgcagaaaagtcaatgaatccaagtcccaagttgttggcatgatgtccggctttttcctcgttctcggcattgcatctggcattctgttcactttcgttgagcctagccttgtcgatgcggcggaagactttttcggcattttttattaatgggactttaactagtcgactttccatctaacttttcgtcctctccctaatttcctgtcatttttgtgccattatttttgaaattataaattcgttcatttattcttgtaaaatttattgttttcacatacctaactttaataaaaccgattaattttcttagaaattaccagaattcgtttgtttcgtgcgataagcataaaaatacaattttataaactaaaaaatttttctatttttttaaaaacacccttcctcatcaaaataaacatataaattagtttattccagggctcgcagatctgaggctttagcctcattttgtggttttttgatataggtcaatgaggctaaattttcaaaatgagtcgatttttcatagtcagattttcacaaaatgcttatttcaaataaaaaattgctcaaattgatcatggacagtcaaaaatacaacatttgaacattttaaacgtgttttgaataaatttgtaaaaatgaggctttttgacccaaatgaggcttttttgcttgccgaatgaggcttttgaaaattttcatctgcgagccctgggcatatatatacataattatttacacaatctgttgaatatcgttgttgtatgcataatatcgtccatctgattggtcagtcagttcggcactttcttctcaggccgtcttggtgtggctgccgccctccggtgtccacaattccatgttttccctcatcatgcgcaagttgagcgaggcgtcatcagccaatggcaccgtcaatgtggcaatctccgcctgggccaagtcaattgcctaaaaatccggggagaatttagccacattatacaatgaaagaaaaagcatgatgaaaatcatcaaattggtcccactttttgggccaatttgcgcgcctcgtccaccgattttaagatttcgaagttgaacacggagaagttgagtgcaaggccaagacgagtcggattgatcgctgcaattttggaggtggcgatgtccatggcttcttggtaagcgccctttgcgagttcgacgacacctgcggatcaaaaaaatatacgatataatcggaaaatgtgttaattttcctacattttatgagtccaatcaactaactgacggtacttatgtcgtttacagaccataaaaaaatagtttttaataaatcatatatttaaacatttctaggggttttcggggtcgctgatcatgaatctgacaccctgtacaaaatgttacaatttttggctctaatgcactttgagtccaatcgacttttatgagtccaaaagtattttatgagtccaatcaattgacaatcccgggtttttatacaataactttttccatgttcgaacaaaccctatatttttggtatcattcgaaagcacacagtctaacgaagctaaaatatataaaaccgcagcgttcaggcaattaccaaaaaagatttgattaattaagtaattgctgattattttcgtttgtaactttcttgaaatgt

SEQ ID NO: 1289 - DNA, 5808 bp, Heterodera glycines
  misc_feature (24)..(24): n is a, c, g, or t
  misc_feature (47)..(47): n is a, c, g, or t
  misc_feature (59)..(59): n is a, c, g, or t
  misc_feature (201)..(201): n is a, c, g, or t
  misc_feature (5730)..(5730): n is a, c, g, or t
ggcaatcaagaaggagtttcgccngaaaaaatggagctgatcaacancactctgacaanaatgtacaatgacccatcctccccagtgcgttttcaggtgttacagcactgtgaaagaagcgcggaaaaagattaaacatttacgaaaagaagaagtgcagagatatttggagggacatcgcacctatacattgatgcgccnccgcagggtgcggtttccaagagcaaaaactatagctgccggattcatgaccgatgtccaggtggatttggctgattttcaagccctttctcgtcataatggaggccaccggtatctgctcgtggcggttgatgtcctgtcaaaacgtttgtttgtcgtcccactgaaaaataagagggctgaagagatgttggaggcattcaaggagcttattgagcaaatgcccatgttcccccatcgaatattctccgacaaaggcactgaattcaaaaacaaactggtcaaagaattctttgaggagcacgagattgcgaagcacgagcccgtgcattcatcagtgaaagcctcagttgctgagcgagccatcagaaatgttaagcagcgactatacagatattttgcggaaaagcagactctcaactgggtggatactgtacagcaaattgttgatggaattaacagtgcaccgtctcgtgttcacgggatgcgaccaattgatgtcaattttcggaatgctcaaaaggtgtggaaacgaatgtatggacaacaattacttaaaatttcacaaaggcgagcaccacgtttccgtaaaaatgaatttgtgcgcatgagcagagagaaggggcagttcgagaaggggtacctgcccaattacggcgatgaaattcttgaggttgaccaagtgttgaaggcagtgcgtccaattcggtacaaacttcgtgatgatcgcggcgaaaagttcaggggcactttttatgagcaggagttggcacgcgtacgtaaggatgatgagacaagctaccgaatagagaaggtcttcaggaagagaagaaaacccgatgggtcagttgagatacttgtaaaattcataggctatcccgagagggaatggatcgatgaatctcagcttgtataaaagcattcagtttgttcattattttttacatttggataaatctttttctaatgacatcaaatagcttctttgtgtttttgccaagtaatgtatcagattaccccgacaatcaaccgaacaaatatagggtacgtcttccaaaacctctacattttagtgggtcgtgggtttgtgggctgcatagcatcagttatccctattcctggcactctacaattggtacattggatgaccaatggattgacattcatttcaccaatctccattccgttgatgatgaccgacagcgtgtcatcagagtacctgtcccacaggcgtcacacaaaaaagttgagcaactcagggattttttacaagcaacattgaagagtcaagaaaaagtcagacttaagccgcttgcgcatgaagaagggtacttcgataaaccggtagtgctcggctcgcctccacacgccaagcgccttaagagatcaacaattgatgatctctcttcactgccctctcccccgagatatgatgagacagatgagcaacaatcacagcagcagcagcctcagtctccccccagattcgatgagacagagaaagaggataaaaaagtcaaagaaacaacccctccttctgccgctaagcaaccgataccgccggctccaatacttgctcctccttcacatcctcctaccgaagcgccaaaggcagtcacagcaacgaaacaggcagctccaaaatctgccacagcaccgcccccaaagccaagtgtgacatctactattactgctgccaaaacaaccccgcctcccgctcccattccacccattaagcaagctccatcggccccgaagccttctccgtccaaaacagcggctgtgccgaagccaactccaacacccactccagcatctaaatcaactattccgactcctgcttcatcgaccaaggcgcagaatatccctaaaataccaccacctctggcagctaaaccaaaggagccaaatgtcgcaaagaagtccactgtaccaactaccgtatctacaacatctatttctagtttaacttctcagattgggcctacaccaacaacaccgaaaccaccgccgcctcctattaagcctattcctacttcaattccggcaccatcaccaccaccaccaccaccaccaccaccaccaccaccacagagtatagcaaaggacgctaaacgatcagtcgaagccccaaacgaaagcaataaggaatcaaagagattggatgtggatgataggttttttggcggtttagctgccggagacgagtttcccgacgacgatgacaaagagtccgaatggccatatgatcctttcaaaaacattgtcgatgatgtagaaatacaatatcttgatgactttgagcgattcaaggtggtgttcaaaaatccagtgatcagtcacttgtcattctcacctcagctaggctatgtgcttggatttgaaaacccccaacacgttgggcctcaagaaatctcaaaatacggctgcgacttacggggtggcttctcaagtttcgcagtctactcaaaaggactgaccgagaacatgattgttggtaattcgctgagttcgctgcttcgcgttgtgtcagtgagcggtgccacacccggtgactacaatgagaagatttatgattcgccaatatacgctcgagtgctgccacgggagatcagcgaaattgaaattgagttgcgcacgatggacaagggacgactggtgccattcgcctatggcacgaccatggtggtattaatatttaagaaagtgataaatttttaaaacccactcatttttgtattcattcactcattttacgcaaataaaatggttcatattgtgtttgacccaagcattatcggatatgatgagtacatgcaatacggaagtggcatagaaagcgaggattacttccgagggtccagccccttccaacgagggtatggacaacgaggcgcaggggtgggggatgtgtttcgcggactttggcgctttttccttcccatttttcgtcgtgttggcactacagtaggatcggaggcactgagcacggggcagcgagtgctggagagagtgggaaacgaaggagtgccatttaaggaggcatttgtcagcgagggaaagaaaggaattgatacggtacatgagaagggcggcctgccaaaacagtttggcggtggtcgaagaaagagtataaaaagaaagaaatctcatgcaccaagccatcagaccataattggacggacaatcagcaaaccagtaaacaaacgtattcgttcagacgcatttggactttactaaataaatggctttccataaaattgataatgacagtgcaaactcaatcaccaatgccttagacttttttcgtattccacccaccaatgtgagcgtctcttcatcaaaagtgtttgagctgcttcccagtaacccactgacggacactccctaccacttcaagcttcactccagccaaaactttattgatttgtccaaatgctacttacaaagtgaattccgaattcgcaaagaaaatgagcatggtcagctggttgacctcacagcagacgaagttgctccgatccagatgatcggtcaaactttcatccgaaacatcaaaatgagcataaatggacgtgaagttttcaactccaattcactaatggcctacaaaacatacttctcacatgagctgtcctattccaatacggcaaaggactcgcatttgaatgcggcgggctattaccgtgacattggcggctcgcttgagaccggggacggatgcattgcgcgacgcaacctgtttgcgagaagcagaacagcgcaattcattgccaaaattgacgccgatttgttcaaccaacctctctacttgatcaacttctgtgagttggacattgaaattttacccaacgacaacgagtttgtcctaatcactacgcccattgttgcccagggtgctgcagctgctcctcgttaccgcttcgaggttgtaagtttgaaaatgtatgtgaaaaagtctcattgatggatggactggcgttggacattgcgcgaaaacttgaagtgaaaccggcacgatatgctgtgaggaaaacgctgatgaaatcaatgttcattagtcatggacgtttcgagtttacagccaatttgttcatggatcaaatcccccgccgtatcacaatggggttagtggctaattctgactatattggaacaatttcgcgcagtccgttcaatttcaaccgtttaatgtgcgcgaaatctcaattattgctaatggccgctcctttccccaagcgccatacgacttggactacccaaattggaaatatgttcgccctttcaatgacatgaacgaagcagtgggattcgccaactcattggaaagcaatggaattagctatgaacagttcggaaaaacccactgcatttatgtgttcaatttgaccaacagtggagatgatcaagctgcgctgtttgacctgataaagaacggacaacagcggtgagcattaaattcaaccaggcagtgcccgccggagggataatgctggtggtgatgggcgaatgcgactctcttgtgatgttagacaaaaatcgatcaattagcacagacattactatttaaggctgtcatttttttcgtatgccactatcatttgaataaagatgaattacaaaaatgttggaattattttcttcatacttcgaattaatttcgatgttgtgtcctgtcaaacaaccgaggtatcagcatcatattccgaatatataaaaagactaaaaatgggatggcccaaaagcagccctcaacccagtacaacgcgtgtcccagagtatctaagacgtaaattattgagacgacttcccagtacaacttcgacccggttggttacgacttcaagtccagcaaccaccacaacaacccatccacaaccccctaagcaagagaagctgatagatgaacaagtgtcctcaattttgcctccactgattcaattgtgcaaagactcctcaaaggaaaataatttcttccaacaaatcatttgctgggcactgaaggctctgtatttgatgcttatcattagtttggtcctacaacaattgtgctctgttttttggttgaaacgtaatggacagcacacaaatcaccaaaatattgagagaaaaccaacggacgtcacaaatttttcgaggatgtttcgccagtgaccaattgcctttgccggccaccctacagtatcctgcggcactcattgtgaaccgtgacccccatcacaaaggcggctcccattggtgtgccatttacgccagggacttggacgcgccagtgatttattttgatagccttgcccttcccctaccaccaagtatttcatcatcctttttatataaatttcccaaaggtttacacaaaaacattgaagcctaccagtcccaattgacatcaacatgtgccccacattgtattgtgtttgtttaccacatgtcccatggaaaatcattcgataaatttatacatattctcaaaacttgttcaaaccctgacatgtattcattaataatgttaaataaatgttgaacagntaattatattttcattttattttttttaaattgtgtcttcccctactattatgcattatctacctaaaagtacatttt

SEQ ID NO: 1290 - DNA, 5348 bp, Heterodera glycines
gagtataaaagaaagaaacctcatgccccaagccatcagaccataatcggacgacatcatcagctagccaggaaacaaacgtattcgttcagacgcatttggactttactaaataaatggctttccataaaattgataatgacagtgcaaactcaatcaccaatgccttagacttttttcgtattccacccaccaatgtgagcgtctcttcatcaaaagtgtttgagctgcttcccagtaacccactgacggacactccctaccacttcaagcttcactccagccaaaactttattgatttgtccaaatgctacttacaaagtgaattccgaattcgcaaagaaaatgagcatggtcagctggttgacctcgcagctgacgaagttgctccgatccagatgatcggtcaaactttcatccgaaacatcaaaatgagcataaatggacgtgaagttttcaactccaattcactaatggcctacaaaacatacttctcacatgagctgtcctattccaatacggcaaaggactcgcatttgaatgcggcgggctattaccgtgacatcggcggctcgcttgagacaggggacggatgcattgcgcgacgcaacctgtttgcgagaagcagaacagcgcaattcattgccaaaattgacgccgatttgttcaaccaacctctctacttgatcaacttctgtgagttggacattgaaattttacccaacgacaacgagtttgtcctaatcactacgcccattgttgcccagggtgctgcagctgctcctcgttatcgcttcgaggttgtcggcttgaaaatgtatgtgaaaaaagtctcattgatggatggactggcgttggacattgcgcgaaaacttgaagtaaaaccagcacgatatgctgtgaggaaaacgctgatgaaatcaatgttcattagtcatggacgtttcgagtttacagccaatttgttcatggaccaaattccccgtcgtatcacaatggggttagtggctaattctgactatattggaacaatttcgcgcagtccgttcaattttcaaccgttcaatgtgcgcgaaatctcaattattgctaatggacgctcctttccccaagcgccatacgacttggactaccctaattggaaatatgttcgccctttcaatgacatgaacgaagcagtgggattcgccaactcattggaaagcaatggaattagctatgaacagttcggaaaaacccactgcatttatgtgttcaatttgaccaacagtggagatgatcaagctgcgctgtttgacctgataaagaacgggacaacagcggtgagcattaaattcaaccaggcagtgcccgccggagggataatgctggtggtgatgggcgaatgcgactctcttgtgatgttagacaaaaatcgatcaattagcacagacattactatttaaggctgtcatttttttcgtatgccactatcatttgaataaagatgaattacaaaaatgttggaattattttcttcatacttcgaattaatttcgatgttgtgtcctgtcaaacaaccgaggtatcagcatcatattccgaatatataaaaagactaaaaatgggatggcccaaaagcagccctcaacccagtacaacgcgtgtcccagagtatctaagacgtaaattattgacacgacttcccagtacaacttcgacccggttggttacgacttcaagtccagcaaccaccacaacaacccatcctcaaccccctaagcaagagaaactgatagatgaacaagtgtcctcaattttgcctccactgattcaattgtgcaaagactcctcaaaggaaaataatttcttccaacaaatcatttgctgggcactgttggctctgtatttgatgcttatcgtcagtttggtcctacaccaattgtgctctgttttttggttgaaacgtaatggacagcacacaaatcaccaaaatattgagagaaaaccaacggacgtcacaaatttttcgaggatgtttcgccagtgaccaattgccttcgccggccaccctacagtatcctgcggcactcattgtgaaccgtgacccccatcacaaaggcggctcccattggtgtgccatttacgccagggacttggacgcgccagtgatttattttgatagccttgcccttcccataccaccaagtatttcatcatcctttttaaataaatttcccaaaggtttacacaaaaacattgaagcctaccagtccccattgacatcaacatgtgccccccattgtattgtgtttgtttaccacatgtcccacggaaaatcattcgataaatttatacatattctcaaaacttgttcaaaccctgacatgtattcattaataatgttaaataaaatgttgaacagttaaattatattttcaattttaattttttcaaaattgtgtcttccacctactaattatgcattattctacctaaaagttacattttccaacgcttaattattttcgtaatttattttccattcattaattatgcatgcaataaaataaaaaggggcggagcttatccatttgagttggaacaccggtataaaagccgctcgaatttcttcattcagacataaaaaaatctgaaatggttctcgtcagcgaattttgtgctcaatttctctcctgcccgacaaagtcacttcgtgatcgactgaaccacccagaggaccgagtccgagttttgcagcaattgattgggaaaaaggtccagacaacatacaaggatcggaatggaatgtgcaagtgttttttcgttggtggaatgactgaacgaggcgcggcatttgaaccagcatatggacgtctgcgtaagccgttcaacattaacgtggcagcgcatttttacgctcgccaccgtgtcaaattgcactacccctatgtgccatgcatcattgaaggctttacccgtggtgaggaccgttattatccgatggaactgcttgaaattgtcgacgacaaaaagggagggcgattatttggtcgattgttcactgaaattgaggagcaggaggaggaggacaccaaaagtgattgttcacactcttcaaacacttcctatttacaatttaacggtaaaggattcaaatggtatgaaagcactgacgaaattgccaacactgggcgtggtgagtgcagccaaccatcgtcatcatcaccatcacacacgtattggtgaacacatatacacacaaattccccacaaaatttatattttcgtaaatatattttcaatttcttaattatgcatttttccacctaaaaacatatactcccaatcattaattatgttatgcttaaaaaatgtgtcttctaatccttaatttttttaaaactttattttcaaatcgttaattatgcattttttctacctaaaaattacatcttccaacgcttaattattttcgtattttattttccattcattaattatgcgcacaataaaataaaatacaaaatgaaagtgcaaaaaaattacagagtgtgaccaaagtcgaaaatttgaaagtcggctccgacaatacctttgccgacaaatggtttataaattttttgtagtggacaggagatgactcgcccatctttgatgcttggtcgtaggaaatttggatacatcacattgattggttgtggctcacccgtctcagcaaaccgtagcactttgtccttgaacgtctcgtagcgaagtccttggttctggatgacgtcatagctaagcgtcataccgcgcactttcagcacatattcgttgtctgcgtcggctggtgcgtcttttctgcgcagcttgagtccatactaaaattaaacaattaaaaatctaaattttaaaaatgaaaatttacttgtttggcacctcccgaacagaattccaaaatctcatgttttgggtattcgtcggtgaactgcccgaggtgagggccagtttgaagcggacacagcccaatcggatgggcaaaaatgaggctgtcagtatctgtgtagagcagcacgcagccttgtgttcgcacaactttttgcattgccctcaacagaaggagtcgggcggcagatgttgtccacagcgaaattactaaaaaacttaattttattttaaaagcaaattgatgaatttttaccgatattcgaacaggcatgttcctccacccactcctttttcttttcatagctgatcagcatgtgttcgtcgtcaagttgatcgattgccgtcacatccagtgagcgattgtccaggtattccgcgaaaaccgcaggatcgccggtgatcaaagtttgggacaatccaaagttcctcaaagagaatcgtcccccttaaaattttatcaatgatcaaattccattatgtcactcacataagttgttgaggcacaatttcgcgatggatcgtttccctttgttcggctgcatttttgccttgtcgatggtgatgccgtatttttcgtaacattcccggacgaattgatcctccaagtcggcattgcctttgatgtttgcgtcaaagccggttgcttgtattttttgtgccatgaattcacggatgtacgatttgaagagttgatcatcactgctctcgtactgcaacacccggaacaatttggtgacgtggtacccttcgtcgagtgctgcgttcaactccaatgatgtacatgtcgaaacccatcctctctgctgatcattgtgggtgcagctgtactcgttgtcaacgcctccgtttgggtagtcaacagcacacttgatgcagagagggaaacacagccgatcgcccactttaacaggaagaactggcacatcgcagcgccgcgggggcaccacccacactttgagaagtgacagatcgtacggattgtcggtagcgcaacgccagtccacttgttggttgagaacatggacttttggatggccggttgggtagcgggtctcaaaacttaaatgtcaaattaatgcaaaaatttgcacaaatatggcaacaaacttgacaaaggggtacagtgacgtgaagtcaaagtacgatatcttctcgccctccttcgccttgtggaaaagtttgcgtggccccgttcgcccacccatgaaggacgctcggatctcaagtgggccgtcgtccacatagctgccaaacatttgtcgcatctcagggtctgctgccaacatttggttaatttcacattcccagtacacatccacgcggccaatttgattgcgcagaaagtccagccgcttcgcgagccggtctcgcacttcgccggctgattttccattggtcagaagcatattgtcttccgggaaacatttgatgcaccc

SEQ ID NO: 1291 - DNA, 1258 bp, Heterodera glycines
tgaaagtgtgcgaatttggcactttctgttttcattagtattttcgccacttttcccttttcttcgcgtgacatcgaaaggcacagagtcccgaaattccatgtcacttttgtttttgttttggactaaaaatgtccctgggggattaaaggaagcggcggcacattctgccaaacgacggatcttttggtctgtttgctgcgggtggcaccgatgaaaacagtgataatggccggggaaggcgaacagaacgggaaacaaacattcccggggggggggaaggtttgatggatatgaatgagaaaaagtgagggaggggggggggtattttaaaaataaaaatacaaaaatgaaaagaaagaagcattaaattggatggaaaagatgtaagactaatgctactggattacttagacgatatctacccgagactgaacattcgccgaaaccaatgccaacacaaatgccataaaacactggtcaagtcctacccaatagaactgctgcggcaaggctagccaaaaactaaacgcaaaacataagcattgttagactaaaagtgagaatagggaccaaaagcaattcgaacttgtcgaggccgaagaaccgaaattggcatgaaaaaagaattaatagttttttgattaaacattttctgatctgtgctttttctccgtaacatcgtcactaaaatatgtgatgaatgattttgatttgatgatggtgattagtgtttcctttcctttctttcattctcccgacatcatttccataaattctaaaagggctccaacaaaagtcaacgcaattttttggcaaatgcaccgtcaaaatcgaccgtccccgagcctaaatcagcgtattggatactacaaatgccgacaactttaacccaccgtccgtgtcgatttcggcaatcttaaaatggtgacattttaattgcccattctcccatcatttccctcccccccccccctcccaccatttcgtccaattcgtcttccgttattttgtcgtccaacgcccgcagtatttctcgcaggtcgctcacatttatatagccatttccctaaagcagcttttgcccatttcccttcctttccaactgtttccctccatcgcatttttggtgataaatgctttttcttctgttttcgtccgatcattaaatttggcaaagggacgggggtaccgtatgcgagtgtccccctcgtaccgtatcccatgttgtttgtcagtcactaccgtattccgcccg

SEQ ID NO: 1292 - DNA, 940 bp, Heterodera glycines
  misc_feature (931)..(931): n is a, c, g, or t
ttcggctctaaaggcactttatgagtccaatcaattgacaaaacctggcttcttagacaataactttgttcgtattcgaacaaaccctattaaagaaagttacaaacgaaaataatcagcaattaattaattaatcaaatcttttttggtaattgcctgacttcgttagactttgcattttgttttatgggataatttctgtgttccaagcggaaacaatgccaaaaataccaaaatattggcacatttgacggcattgtttcccatccgtcaaattgtgccacaaaaaggaatccctttttccaaatgcctttccaagtgtctcccccgcccacccatggcacctcaaattcgatttcgcccgacccgtccgagtcgaactcgcggatcagctgcttcaggtcgcgttcctcgaatgcttggcccattgtccgcagaatttggcccacctattcttgacggaatgtttgtcatttgtgttttaatgcgctttttcatttcctatgccaaaatggcatttctaatgttatgctttttttggctttattttcaaaatgccattgcgacccccccaattccatccaatggcattcacttttttcttcacctgagttgctttgatgaaccctttgccctccttgtcgaacatgttgaagtactttcggaactctgtgcgtttttcttttggcttttcgcccttttgtccccccccccatttctcccattttccccctccgtcctcacgttcgatttggtccgatgtgagttgttccaatgcctccgtaactcgagaatccgtctgatagatgaatggaaaactttttgattttccaaggcaattctcaccatttttgagttaaggagagaatttgacagatttattaatgcaaattttgttggaatgtgccaaaaatcacttttaagcactcanaaattttgg

SEQ ID NO: 1293 - DNA, 1581 bp, Heterodera glycines
accctttgccctccttgtcgaacatgttgaagtactttcggaactctgtgcgtttttcttttggcttttcgcccttttgtcccccccccccccccatttctcccattttccccctccgtcctcacgttcgatttggtccgatgtgagttgttccaatgcctccgtaactcgagaatccgtctgatagatgaatggaaaactttttgattttataaggcaattctcaccatttttgagttaaggagagaatttgacagagatttattaatgcaaattttgttggaatgtgccaaaaatcactttaagcactcaaaattttggaacgcttttccctttgatcggagaaaagggagaagaaattcagtggagggaaggaaaagcgaaaacaatggacaaaagtgagggaaatcaaacaaacaaaaacccctcggggattttgacacgcgtcgcccaccgccagcgcacattttgcgcaaacaatgcccgcgggggggaggggcgatcggcgaggatttccgaaccttcgcttctcatccattggcggatcggatcagctttcctccccctcggctgattgtgattttgtactcttttcgtttcagttgatcaatgcatttttatttttgtgtgccgtccattcagaaagaaaattaaaaaattgagaggaaaaacgatgcgtaaaaatgatgttaccgaaaaggagaaagtgaaaaaggaacgattgtaaagagagagcatttgcccaacactgcccataaaagggatgctgttgtatgaatttgcgcctacgtccaaaattggtttcaagttaacattaactatcaaaaaatttcaacgcaactttaattaattttaactaaaaaggcctaaatttataaacccaaaaatgtcattttaaacagaagagtcttttatagccgcggtaacaaccaaacaaaaacaacaatatgatgacataggaacctcatcagtcgctgattttcttcagcacttcctgcaagtcattcttcgcctcttcgtcacgtccgtagtctttgaccaccgccaccgaacagccgacgattttgcgcgcttttccgtctttgtcgtatttgcactggccaaccatttgaccgagttcggccttgtcctccacctccaaaatcggaatggtgtgctctttgcacaatgagcgcaccaatttctcaaaggacgcctcgtcacagcttttggccagcacacaaaagtgcgcttcacgcctgaaatagtgcagaaaaaaagcaattttaaaaaatggtgcagaaggaatttcgtaatacttgtccaaagtctgtgccgcttcgtttagaccccgtgccactccgtcgacaatcagcgcagacttaaggacccgcttcaacacttcgctcgtctcgagtgtttcactgaacaattcaaatttgaaaatgaaaagaaaaataaaatgcccaaactcacatcattttaattaaatacttctgcaagacaatttatgagctaaaaaaataatgaaaatatagatcaaaacggttctaggacgcatcgataaacatttccggagctcttcaggtaattgaccactaa

SEQ ID NO: 1294 - DNA, 2291 bp, Heterodera glycines
aaattcaggtaaacgaccctatggagtgtcacttctctatgccggttgggacacgcaccacggctttcagctctaccaatctgaccccagtggaaattacggtggttggaaggcgacttgcatcggaaagggccaccaaaatgcactttcaattctcaaacaagagtacaaggacgaggacatgacgctggaaaaggccaaggatttggcgatgaaggtggggcgtaaatcattaaaattctatcaaaaagccatcatattggttttttggaccggtcgtcatggatcctgtgtcgcttgcgacccatttcaagccctgtagacgaactcgaacaacaatttaaaaaaataataattttattaacaaaattcacatttattgcccaaaagtccgaaatgggtctgtttgagtaagaaccggaatttgtgcccaaaaatacccaaagtgccatttattgtattcattgttcaaatcgtttttaatacaaaaaaagataatgtgtttcaatccccgaaatttaaggtgctctccaaaacaatcgaagccaaaatgttgcccgagcagttggagatggctcagctcacccttgacgaaaagggcagacccgagttgcgcatactcgaggaggcggaaaggaagcaactgaccgataaatgggaagccagcgaagaggccaaacagccgtgacgggaaaaattgtgttgtgctttggggcacctttggtcggactttggctcggttaatctatatgttttgtttatttgcgccttgatttgataaaaaatgaattctaacatgtcttttttgcccatttaccactcaaaaaaggcatttaatccactgacttacaattaactcggtgttatttgtcgacttatttttggttcatttgttctttcacaaaaccatcttctaattattgcttttgactttgtcacccgccaatgccgacctttccgtggagtaaaaagagaaaggcatccgacgatgaggtggtcgagagtgggatgacggtacgccaaatattggaggagcgggaggagtacgtgaaaaacattggcattgagtatcgattcggctgctacgaggaaaagcgcgccgattcgtgccaatatttgggcgaatatttcgaggccgtccaaaccgacttcaaatccgccttcgacactttccgccaaaattgtgagcagcgaaagttcccccgcagttgcttcaaatacggccaatatttggccgctgggagggcgtgcgaggcgagcttcaaaaaggtcggatggatgaagaggggggtggggggggggggaaggtgatatttgcacaaaaatggccatgagtgttgcagaccttaaattgcaaaattctataaagggtttaattaaggcgatcgaaccgctcagattgtcctgcgatgcgggcatcgccaagggctgtcgcgtgttggcgctgattttgtggaacggggagtcggaccgtccgccggactcagcccaggccgagcagttcatgaaacgggcggccgaactgggcgattacgaggcgagctggacattaagcacttggtggtcaatggagggggctaaataaacatttccaggaggggtgaatcatttttttgtgtaccattcttttccagggcatggattaatcattccaaaaaacaaatttaagttggaattctttctaatgcaattttctttattttaaaatttaaaggtatttgggtgatacaataaaataccaacgtgaaaagtcggcgccctatggtcacaaaatgggggaattgtccagggatatgcaaaaggcgcttatgtacggactcaaagcgtgcgacgagggcgacctttttcaggtcgcataattaaacaaatttagggcatttattttaaaattcttcttttatttcagtcttgtgtaaatgtgtcgctaatgtatcgaaatggagaaggaatcccaaaggacgagaaaaagtaagaaaaggacaaattattttaatatcgggtaataatgtactttgtaccccccccccccttttacgaaaaaaaattttcaaaattttttcgtagtaatgtgtttttttggggccgaaaaattcgattctgatatctatttcggcccattacaaacccctgacccggactcgaacaaaaattcgaaaattcaattttcgaaaaaattttaagttttgcaaccaaatgcatgaaataaaaagtagaatcgattcagaaagcaatatatagtatttagtgcattttaaccggttgtgttgcacatgtagattttttcggaaatt

SEQ ID NO: 1295 - DNA, 5504 bp, Heterodera glycines
aaacaactttacttctaaaagaattttttaattttttctttttcaaaaaggggggtacaaagtacactatagtattacctaatatcgtcgtaaagagaaactttttggcagggcaaaacaataccaagaaagggccaaagaactgaacaatatgctcaagaagggatggaatgcagggtttactgcatgatagtgaccccaaaaagcgctgaccggattaaaagaaaataaaacaagtcataaatatttattcgattataaaaataaaaaaataaataatgtctaggctctattgtgatttttcgaaattgattgcttcgccaatgggaaaatccaattctcaatcttttgggttcgtttttcacatgttgtttggattgaaaatctcaatccaatagccgtccgggtccgtgatgaatgccaagcctctcaagttgtgcggagatttgaaggccaaatacaaacggactttgaccatgcgaaaaaccgtcttatgaatgatactaaaattgcttttgttttaattatgtaattcactcactctgactcaaagagccaaactttgtcttcaaaacggaaggaattcgtgtcgaggaacgccaccaaatttttgtaggagccgtgcaacagtttaggcatctgaaatgatcttttgacaaattcgaatgtatgaaaattatgcacaattgactcaccgccttgtaaacaaaagattgccgaaaagtcggcgccccctcccccgcccaaaagtggctgccacaccttcaaaattcataagtgggaacatttaattaaatttaaataccgtttcctcttccggggtcaggagcggtggcatctgttcacgaggaatgatttcgtgcattcctcgtcgcgcaaccacgctcacctaggaatggatttttggggtctctattatgaaatgcattaaaatttcaaaaatcgcaagttgatgtccctgcaaaaattttggttgcgctcccccttttttacgtgctcacgtccaaccttccgaggcccattgggctcgctggtggctcgcggcgccccaccgtctcgtcgaagcacttcatccactatctcttcttcacgaagccactgttcgcctaggaatagattttatgcattaaaattccacaaattttggttgccccccccacttttttataaactcacgctggaagtcgcggtaggcttccttctcccggcgccgctggttcgcggcggcgcgggccgccgccaagggcacaaacaccttaatttttaaaagttatttttctaattagcaatttataccatgaggattattttaataatccttttcttttgtcctttttgttgcccattgggctcgctggcggctcgcggcgctccatccgtcccgccagaagcgccccctttcccgcccacggggggctgccacaccttaaaaattcatgtgggaagacataattaaatttaaataccgtctccccctccgggggcggggtcggggggcggcgcggcgccccaccgtctcggaggatgatggcatccacaatctcctcctccctcatccattgctcgcctaggaatagattttatgcattaaaattccacaaattttggttgcccccacttttttataaactcacgctggaagtcgcgataggcttctttctcccgccgccgctgtttcgcggcggcgggggcggccgccattggcgttattaccttaatttttaaaagttatttttctaattagcaatttataccattaaaattattttaatgatgttccgcttggtttttttgtttgcgttctgttggtgctgacccgcacagtcaccggtttcaaaaaatcgtaaaatattgaaaacttgacttatctatacattcaatagctcattcgaaagctctttttaggctctgcaggatctgtgtatgagtttttatgccctactaattttcttaaaattttggaaaaaatcaagtagttgatgaaaaatcatagataaaaatcaatgattttcaaaatctgagttcagattcgtgataagcgcattttttaggcctagaaaaaatagctgcgaaatttttaacatttttttcgtctgggcaccaattcttgaccattgccaaaaaaatcgcaaattaaccaaatatttggtcatttttttggcaaattcaaaattttccggtcgcgcctaccggcaccgccggactccctcccccaatgttcccaaaaagttttttgaaaaaacagcgccacaaaaaaagaaaattaaaagcaaaaaaaattaagagttgtcaatttatttttattgtaaaaaattccagaaattttgggactcagaaaattccaaagttttaccggacctttgaaaagattggtacttttttaaaccaataaattcagaaaattaaatttattaactttttttatttttttgtccattaaattaaaaaatactcaataatttacatagagagatattttaaactagtttaaattattattactctacgaattttaatgaaaattttttgaatttttcaaattttttcaaaaaatttttacccagggttgttgtgtgcccgtgggcgggggtggcttttgcgggggcgggatgagcaaatgtctctcccccggggagtattagctcaaaaatctcacaaaaaattaatttttaagaatgatgtgtttggctccatattcatttagtcgatatatcgcctcgattcaattccttttggcataaattgcacagattttgtctaaaaaataaccaaatttagggattttgggttaattttttaagaaaaaatagttttttttggggggggggggggcggcggtgccggttggcgccgctgggcgaattttgaaattttctttattttctaacagttctggcctagtggtctatgccttccattccttttttcttctgaagttcaattcccccaccctgcaaataattgtttttgttttttcctatctaaaatattttttaaactttttagcattaataaatttgttcataatattttttgcataaatttttgcgaatatttaacgatgttttgcatataaaaattcgttccctatttaaattttggctcccagacatttcgacaatgaccgtttcgccaataaaattaaatatatttcttaaaataaaattcaaatttctgctaaatgatatggacgatgcggatttgggatcaatataaaatagtttttttttcgttttgttcaaaatagcattatgagaatggctttagttttcgaattttgcgtttatgatgcatcggctatattcgacatcttcgaccatcgccgagtctttttcaaaagcgtattcgaatccatccgtccctcaagaacaatgaagcgcctttttttgactttactcagcaaattcaataatctcccggtttttagcctataaatggctgaactgtttgaactatgccattcacatcctctggggatcaataattttgccttgggtaaataaggcattacaataatttaaataaatgagtcaattttggatttctattaccgtatttgctctttttatatgccatggtatattatttttcaacctcctcagaaaggggtagataattggagactggtagactaaaggagactgggagattatttttcggctgatttatttagtggaaaatttttgacgccaaaaatgtcattgcgtcaaaaaaataatttttattacatttttgttaaagaacttctgtaaattgaccccaaaatggcaaaaatgtgtcattttcttgcttccgatatgcataaaaattagaaaaacgaatgagactcgacggagctggtcgcccagttcaccgtccggacatcaacactaaacttgtggaaacggtttttatccctggcggctgcactaaattaggtaatcttgcagaattgcggtcccgactaaaaataaatttaaaaatttttgttcttatctttcctggggtaaaagggggtactgattaccaatatgagctcagatttagcaaatctttgatttttgtctatggcttttcatcaagtacttgtttttttcaaaatttttattattaaaaaaatttaagtgccaattttttagtttctaaaaaacccccaaaatagttgctaaaaagctaaaaagtttcaaatttagagatgtaaaatctaaaatgtttccaaaaaggtaacaaattaaaccaaatcagtattgagataaataattttaaaatcaaaaattgttgttaaaaaataaataaataaatttggagatgaatttttgagaaattttaaatttctcaggggtgtatttttgaaaattttcgggtcgattcttaggggtgtattttttgaaaaaattttttaagtcgattcttaggggtttatttttgaaaaaaatttttaagtcgattcttaggggtatatttttcgtttttattgcatttttattagacaaattttgggaaaaacccaaaaatagttgaaaaagtttttatcaaaaattttatagttttttagttgctaaaaataaaaaaactagaaaatagttgctaataactcgaaaagtagcttaacaacagccgaaaaaaacatgtttttcgtgcatttcaggccacggggagctcaggaaaaaaataatgaaaaaactataaatcgtatccctaccgttgaattgattttatttttttgaaaaatgtgccaactaaattattaaaaaattctatttatcccccctggcacataaatggagactgggagattatttttcaacctagttcgaaaggggtatataattggagaccggcagattaatggagactggcacataaaaagagcaaatacggtatgcgtcccgcgccggtctctaccgtcgtgttaggatggctgatattttgctgatctaaaaaattttcaaaaatgtttgtggagcacaagtctctggaatgcagattttttgcacttttcccttaaattggaatacacacaaaacactcattaatagggatgcgatttttaggtaagaaaaatcccagaataggtacttaaataggtaaaaaaaaatctctaaataggtacaaaaattccaaaataggtaccaaaataggtaaataaaatttttattaacgattttttagtggaaaaaagcaaacaaagatggaaaattttggttctacatatctctttgtaaacgaaaatttaaatatattaatattttcttagataatattgacattttaaattaaaaattttgtcaattgaaaaaaatacataaattttgggataaatttttgagaaattttcccaattcttacggtggaattttgaaaatttttttggccgattcttatgggtatattttttgattttattgcatttttgttactaattttttgaaaatccttaaaataggtaacaaaaatgccgaaataggtataaaaataggtacctaggtactacgttgaaaaacccccaaataggtaaaaatagg

SEQ ID NO: 1296 - DNA, 6821 bp, Heterodera glycines
gctaaacccttctgattttattatttctcgcttgggttcaattccccactgggatagaatattcttcatattttctttaccattattttaattgaaattttaatttaaaaaaatattccaactttttttctttcattttaagcatcctaaaaacccaaaaattaatcaattggtctttttttacaaattctgttaacaaatcgcattaaaaaatacaaaagttttcccggcggcgcctatcggcaccgccggccctccttgttccccaaaagtcttgagaaaaacgtgccgcgaaaaaagcggtgttgaaagcaaaaaaggtcattgatttacattaatttacatggtcggagaccccttcgcaaaattggaaaattggccgctgatcccttgtttttcaataatctgaattttgaggtctacatctgaattttagtgttctttattctgaatttgaaaaaaaaacttggtcaccctcaatatacatatacttctgaacaattctaatgctaaaaaacaggcactcgcgcgaaaactgaataaaaattttgtatttgaaaaattttgtccaaaaatttttacgttggaaaattaccggtttttaccggtaccggtaccggtaccggtggaaaaagttggtaccggtaccggtaccggtttttgcattaccggtcagtaccggtaccggttttttagcaattaccgattaccgagcaactctagtcttagagaatcacattttagtattgtggaatctgccattcgtaattttaaaccatttttcccaatttctcttgaattccctttactcacatttcactcacaatttgctatgtaatgtccttctgttcgcccctcccaatttgtgtcactatttaagcttttgcttctctcattctgctggacgacttcttcccctcctcacattcccaactcagaacaatcctaaaagcgatctttttcaactgttaatttatttctttgcattaatcacatttaatcttttctttttacttttgctttctgacttgaataaactcttttccaaaaacctcttgtcaaaagaaaaagggctaaaaaccgagaagtccaagtgtttggacacaacaagtattttataattaatttttgatatctatttaaaaaaaaactgatttaaggggtacgcctccaaaaattttttttaacaataatttctataaattctcaaaaattctcaaaatatgtaaaaaaaaatgaaatatgtatggaaaaattgcgaaattttggatttttgggcatttaataaaaaaatttccttaaaaactcctcaaaaatgaaaaaaatgtaggaaaaaagctaagaaatccgaagggtacgaagattaaaaatcacggaatttgtataggggacgtaacccgtactttttcaggctgattcaagttcttacggattgaggatttttaacccgtaacccgtattaatgtcaagcccgtaactcttacctgtactcatagaattgggaaatcccggcctctgacaattaccgaccaaatcagtcctgccccactcacttacccgattccaatttgccctgaatacaagcgagaaaaagcagcttctgctcgtcaattccctcaacatctgcagtttgcatggcttgcgcttctgctgataaaattgataataacgccaaaatgccaattgaaacaactgctaatttggtagaatttgctgacaatggcattccaaagggacaaatttcgatgcgttaatattaaaaaaaataaaataggagcttttttgttatatttacaaaaaaaaagcaaaacatttaaattgttgttttaattgggttaataataattttttttttaatttccgaagtcacaaaaaatttcggaagtctgaattcggaacccaaaaataaggggaactcggagttcggtaaagtcggaattccgcacaatcccttcaatacatgtaaatgcacaaaattataggcgctttaaatgcgtcccataatggtaaataaaaaaagatccaggcaaaaacaaataaaggttttatgggtcaaacacaagaaatttattacaaaaacaatttcgttaaatcaaccctttcaataaacttttttattaaaaataatggcgcacaaaatgattatgggacacataatattatacatagcaaagaccgcaaaaaaaagtcaccaaaaatcgcgaaaaaggcaaataatagtcaacaaaaaatagaaaaaaaaggcatgaaaaggctggaaaatcccgaaaaaggcatgaaaaaaggcatttaaaattttttatgaaggctttttagggagcaaaacacgtaaaacttaatcaaaaaacttaattttggccatttaaatgattattaaatattttataatgtttttcgaataaggaaaatttttaaacctaaactttttatcaataaaaaaaatgaaattttagcgatcaatttttgagaaaattttttaattcttaggggtgtattttttgaaaatttttcaactaattttttaggggtgtattttcccgatgttattgcatttttaatggaatttttcagaaaaaaggcaccaaaagggcaaaatgccaaaaaggcatttaaggcacgaaaattccgaaataggcaaaaaaaggcataataaaagtcaacgaagaagcctcaaacgaagtggaaacaacgttttttatgcttaatataccgaaactagtgcgcagaaaaaaggcatatgtctcaaaatgcggtctctaattatggcatgggatacagaaaaccgacaagagccaatttggtaaatattcatcatattcatagctcccaaacttaaaactgctctaactgttggaattgattcagtccatttttgagctttgagtttgggagctatgaattaataataatatttaccaaattttcgactaaaaagctataaattttatttttaattaaaaaaaaatttaaagtagtagcacaaataaaattaaataataaatacataaccacaaaatggtctgtctccccatcgcattttggcctttgctcggtcggacgcacccaaccaacaacaacaccaatggattgaatccaaacgcttgtcttttttctatatcgtggcgttctgcccaaccgtctcccccctcgttctttttctgctatttttacgtttgtttgggtggtcttcgccccccttctctcctccctcgtgccagtcgattgtcctcccaccccccttccgctggtgtcagcttccaccgaaaaatggaaaagtgtagtttttgtaatgcaatatattcaattcaattcaattcaattcaatttatacgcaaaagcgtgacaccgacattaaaacaaaataaataaaataaaattggtcactgaatgagatggggcggtttcaaaagtaaaacatcaatatcataggtgtcaagaagtttagcaaactcagtagaattaagtaacctcgcctctttaggcaaactcctatagaggcgagaggtacgaataaaaaacgaatgaaaccgaacattggttgaacaataagcggtttttataatataatcgtttttcagtcctgaatatatttttgaaaaagaatcattatgctgaatatggatctttcccaaaattatatcatggaaaagttttaaatcgatttttgttctgcgttttaaaagggattcttgtttaaagagttgaagaagttcgttatacccgggtatatcatccttattattattacgtctaaaaacaatacgtaaaaatgttttttggacattttcaagagcatcgatgtcttttttcatatatggattaaaaaccggagaaccaaattccaaaatggaccgacaataaatattaaatatatttataagaatttttgggtttttcgttttaagtgacttgagtaaagcaaaagatgttcttattgcttttttggtaataaattctatatgtttttcccattttaagtcatttgaaaaataaatgccaaggtctctaactggttcacctttttcactttttaaaattggaatattatttataaagtaacattcattagggtttttaggcccaatatgtgaaactaagcatttgttaggagcgattttaaggccatttaattcacaataattccgaaatttattaatgaaagaatggagtggagaaatagtattttttgagagtatagaataggccttaagatcgtcagcaaaaagcttaatttcaacattttcagttttacaaaaattaggaagatctgatatgtaaattaaaaataaaagcggacccaaatttgatccctgcggaacaccacttaagcatgggaattcatcagaaaacgcagagccaactctaacgaaaaatgtacgattttgtagataattttgaagccattttagtaaagtaccatttataccaatatttttgagtttagaaactaatctttcgtgcggaacagtatcaaatgccttcgctagatcaaaatatataacatcaattgattttttgttttccaaagccaaactaaagtcatcaatgacttccaaaagttgagttgtaacagagtgttttctcctaaagccatgttggcaattcggaagtacatcatttgtctcaacaaaattagtgattttctgggtaatattttcttctaaaatttttgagatggagcataaaagcgaaattggccgaaagtcaatgggatttattgggttcggtatttttggaacaggacaaataattgattttttccaaatgtttgggacttggccagtcatcattgaaaaacaaaaaatatgaaatagtggataaaccaaattttctttacagtttttgagaaaaatattcgggatgctgtcaatggaagtattattactgttttctagtttattaagagccaaataaatttcattaagtgtcattgtgaaaaagtcaatattttttttaggggtgacttcacatgaaacaggaattttttggtcagtgaagaccgagtaaaattgttcggctaataaattggatttagctttttcggaaaaggcaattttgttttcgctatttttaagagggggaatttttgtgtttttagtttttaaaaaagaaccaatatatcgaaatcgttgtttagggtctaaaccacttaaaaatttattttcacgatttgtaaggtatttctttatttcatattcaagttttttagaggtttctttaaatttttctctaattttatcttttttaaggtctttccaaagttgtcgacgataaatcataatttttttaatatgatctgggaaattatgtttagaatttgatactgttaatggaacatatttcgatattaaaaaatgcaaaaatgctgcgaatttgttataaatttggtcaatttctatacagtccgaaaaaaaggtaacccaatcagtagaagagagcatggcatttatttccaagtaactagcttttttaaagttaaagtgtttaaattttttacaaggaaaaacatttagtcttaaatcaaattttatagtgttgtgatcactaagtgagaatggggggccaattgaaatgtcttttatgagaaatttattatttgttaaaattaaatccaaaaaattgcattccctggtgggttctttaatcatttgatcaagtcgtaaaccttcaacaaaaccaaggaaattactttcataatttgtcaaattatttaggatagagaaagggccattttggttccagtgaatattagtaaaattaaaatctccaagaatgacaaaattttctgtcgagactgctagtgaggaaattaattctagaagttgcataaaattttcgaaagtttcggtagttacaggcctataaaccaaaataagacggatttttgattcggaaatgggcgaaaaaacatcaatacaaagtatatcagaattttgtatattttgagtttttataatttcaaacggtatttcattagaaatgacaaacgctacccctcctccttttttattctttctatcttttcttattaaagagaaaggaaaattttctaaaatttgcgagtcgtttattttattattcaaccaactttcggttatcgcgataattttatacctattttctaaaagtaaaagcttaaactcattcattttgttcactaaacttcttgagttaaaataaagacaattgagaaaattttgtgacctcaaaagttttttcccatgttgcctccacgccgcgtcgtcaccatttcattctttttgctttcttcataattcatccgcctctgttcacgaatctcccgctcagccgccaattcttctttcgtcagagagggcctgacgagaagtcgctgccaaccaacatgctgcttcagttccgtccggttgcgcccccattgtgccaatgcaaaacgttggaacgtcgtcgctggcaagacaactttgaccaaacgcggcccctttcgcttctcatcaatccgccgccccattctatacaccatctgcgggcaaacctccacatccaaagcgtccaacacttccgcaactgtttccgcgtgctctttggcgcgttctgacggctttgcagccacagcctccggcaggccaatcaaaacgaggcttcgtttgcgttctttttcctccgcactggaattgtcgttattgttgctgttgattttgcgctcaatttcgttgaggcgttcagcaatggcgttgaattgttctgccatttgcgttgccaaagtgttgttgttgttgtttgataataacgtttcaattgaagacagtcgatttaagatgtttttaatatcggttgccatt

SEQ ID NO: 1297 - DNA, 2302 bp, Heterodera glycines
ttggaggagttttttatgaaaatttcttaaaattcctaaaatatgcatcaaaaagtactttattaattaaaacatgagaaaaacactaagtgtgttgactaaactaagaataaaccaaaagattagttgctattgcaaaaggccttaatattttaggtcgctgatcctgaatatgcaattaggtttcatttattacatcgataacgctacagattgaagcatcattctgagggaggggggggagggttaggtccggatcaggacgggcgaaacttcgagcttcgtgcttcaagcttcgaaaactttgcgtttttgggcttcgagcttcgggtaatttacccgaagtttcgggaaattacacccctaaagatcgagttttcaaattgaaaatacacccctaattattggcttttgctaagcttagatttatatctatcattagtttttcatgcgtggtcaaattggttgtgctcttggtttccttctctatttttgcgtttgatcagttcacctctaagtaattgtttttcttttaatttttcaaatatattaaaaatatcatttacatcatttttttcaaaatgtaatgatgaatgtatatttttaatatacaggtccaaaattagcactttttcacaccaacgcctaaaactcgtgcttcgaaaaaatgggcttcgccttcggcttcgaaaactacgccgagcttcgaccgtcgaactttgtgcttcggcttcggatattttacccgaagtttcgggaaaaatacacccctaaagattgagttttcaatgagaaaatgcaccactagtgaaaaatatcgatagtcaaatttatgaaccgttaataatttgatttccgatcaactttttaccgtcggatccaatcgaaaaatcttagtcgacccatcagcccctataaatttattttcagcattttttgatttttggaaattttttgaatttaattgaaattttttcgaattttccaaaatcccgcaatcccgcacgggatcccacaaatttaaatgcgggatttgcgggattaattccgcgggatcccgtcccgcaaaaaattttgagttccagtcccgcagcgggatccgcaaatttgaaatttccggtctctactagaaactgcgtcaattgattaaatttgatatctaaccgaaattatgtgatgaaaaaaattttggaattaaaaaaaatttgaaaaaacttcggcttcggcttcgaaaacttcgggttttttgggcttcgagcttcggacttcggcttcgaataaaaattgggcttcgccttcggcttcggcttcgagtgctaagccgagcttcgcccagccctggttcggatcccggtgaattcgatttagtattcattaatttttattaaaatattaaaataaatattttttagaaaaaaaaattgatttatccccctggacgataaatagagacggggagattatttttcaataatggagacgggcgatatatctactcctttgaattttcataatacaattgtttactttgttttggaccgtaggcactgcttacaaaaattagctgcccttttttatacaaaatttgtacaaaattacgatattttggtgtttgttatgctgcattcataacattatccgggttttaaggcatttttattccgcgttcaatctaatagaaaattgacaaattattcaataatcttttggcatcagttttttttcttattttttgtgtgtaatttatgcattggttgtctgctggtgtctgtcctgtcggagtgacggcttttaactggcaattttagccaaaattcatcaatgatgcctaattatggtgcggaaaggaaaaatgcgtaagtgccaaaaattagaaataaaaaaacacagagaaggtgttaatggtgttgatcaagcaaaattggacaatgaaagagatgcgaaagtgagtgatgaaaaaaataattaaattttgtaaatttattattcgagttgaatcaattataaatactagataagcaattgaataaattttggcacaacatggaaaaaattgagtttaagcaaattccgataataccacggaattctgaaaaaatgcatagagattaaccgggaccgaaatttggacgggacggaccctaactcgggatccctctcgattgtttttccaaaatcttcgggattgatcgggattccgactcgggattcccatcattttttgccgaaaaggaaactgaaaacggaaacttttaattcattaaatattttaattttttttacaaactttgataaattactg

SEQ ID NO: 1298 - DNA, 2254 bp, Heterodera glycines
atttgtctttttcttgaatttggacaaatttttgatgggctgtatgtttaatacgttacttatttgtatggcgtcgattcaaaatcaattttatttatttttgtattgcatatttatttaacatatattacaatagaagtataagtgtaaaaatgtatgcgggtcaatcactgaatgtctgatcaatttttcaatcattttttaccgtacccggagccgccgaaaccgccaaatgaaccaccgtaaccgccatacccagatgctgaataaattggatatggatatatgtagacaaacaatttatgaagcgcaaaggcttcaacaattataaattgatatttaatactaaattaatatattatttctaatttttattaaaaactcgattattgttaaattgttatttaagactaaattattattattatttataagaaatggaaattttagcacttacgcccgtaatttctgaaaaacggagcaggcggagggggaaaaagtggcggtgccgcgccaaatgccgaagtgccaaatggcgaaatgccaaaggagccgccgtcgaaaggaccaccagcggaagtggaactgatgaacaacaaaagaatgccaaggccggcggcaagcagtttcggcacgaaatcgaacattttgatgctgtgaaaatgagaaaaaaaaaacaataaagcggttgaccacagcagggcttcaatagaaaaataagaccaaaaatagtaaatctttgcgtttataaaaattcttgatctggtgaagagaatttctgtcctaaaaattgaatgtttttttgagaggaggtgaaagctttggcatttttatttggtttattttgacatcgtttgagaaaattccttgttttgggtgcaataataaaacaaatcatccgtatgatatatggatttataattttttttaaacatgaaaattgactttttgctccattctttttttatttgtcaattttcagtccgtaaatattcgaattttaatttcaagaaacaaaaaaaattatctctggagaaattttttgcaaaataataattataattaaaaaaatattttaggcaattaaatgcaaatgtgtacacattttgaaaaggcactttctatttatgccatcgcctcctcatcggggcacagaattgtaattggcccaattccccccgccctttcgcgtgttgcgcttcttttcgccttttcgctttaccatttcccttcctttttttctgcgctatttttacaccttttatttattgtaaaaaaaggtttattttccctttttaattgggcaaaaaattgccttattcgctgtaaaaataaagggaaaattattttggaattgtaacaaattttgtgagcggaaaatgtgtcaggaatcaaaaattcatgaaaaaaacgagaaatgttagtatgatgattcaaaattttattttaattgggaataaacctacaatggccaattattcacagtatgtttatttttaacagcttttcataaattttctaaattttttataactttggaattaaaaaaactgaaatgataaattcagcaattataatttgtcatgctacagaatgatttttaaaaatattttattactgacgcatttttcctgaagccgcaaattttctctgtttatcgaaaagttaaagattcctgaaaaatatgtatccatgtgaaaatggtgatatagtgaatgaaaatggttttttcgaaattcggcttcaaaatttgcaaagtggttttttggtacaaatatggcaactagggctaatatttttaggttttatttatttttttcttgacaaatgagctctctatggtctgaaatgcacgaaaaaacgtttttttagtggttgttaagctattttctagttataagcacctattttctagctttttatttttagtacctaaaaatctaaaaaaaaatttgtaaaaaaacctaaaaaattttttttttgactagaatttttggtttcaaaaattatatataatatctcaatatattgatttagtttaattttgttcatctctttggataaaattttaggatttacacctctaaatttgaaacttttcgtacctattttccaattttggggtttttagaaccaaaaactaactattttggaagtttttagcacctaaaactcatatccaggttaaaacaattggtagagttcatgtgtaaaatatactattttaaaaatatttttgtaagcttttattttc

SEQ ID NO: 1299 - DNA, 6837 bp, Heterodera glycines
  misc_feature (6738)..(6738): n is a, c, g, or t
gaacgggaattggggtgtctacataaattgggatgggtacgggaatcgggttggggacaaaggagaaatattgacaagcataaaaaataacctatccagactaatcataataatcatttttaaataaagccgaattgtcttttatttttttaaattcaatcaatcggaaaatttagtaaaaaaataaatttaaataaattcatttttctttcatcttcccaatcagcagtcttttccgctttacaataatcatcatcatcatccgcagaagcatcagttttgacgacggcgatcatccagctgtccttgcgccaattgacgcaatgcttccacaatttgttgcggcgtgccgttcaagccaacctgtgaagaaattgttatggaaatgtcttgtaaattataatgagcaaattaccaggacgccatgttgttggagtacgttcatgatgtctcgcagttgagcatcattgaccagttgttcagcaaacggtggttgtctgtgtccgggggcgtcattccccgcgttgttgctctgtccttcacgtggtggcattttctttaaaattaaaaacaaataagacaaaataaaatgaaaagcatcatcccctttaccttaagggtattgagcgtgggaagggattgttggcttgaaatgaatcctgctaagccatcggtacctcttaaatattcacaaatgacgcacatattttgagcccgccccctgaattaagaatattttgcggaatggatatttggcagctccaaacaacagcactagtgccgcgcacaaatttgcataatccttcgttgccggaaattccacaccctttagcagaactgtcaatcacccaccctcccatccatgggattaggattggtcacccccgcgtccccccgaccctgctcaaaaattcagccaaacaaattgttgaaatgcagtaaacaattaattcgtgttaccaatttgtcagcaatatccccataggttttggctttttccccacccaaataattaattaattaattgaccacccccccccaattagtcacccgaaaaccctcccataggttttgattttaattccccccatctgtcacttttccctttgaccagctgtcaatcaattagctaattagcccccctccactggtcagctgtcacttttaattagtgtcatgctgcagaggtggcgtatggtttactactgaagtatgaaaaaatcaaagaattttaattattagttacagttgttaaatcaatttttgggtaatttaattaagaaccaattaatcattaaaatgcgggaaaattattaacaaagttttgatcgagatgttttacatatgtgttttggtatggtcgaatcccatgctaaaatactccaattgctaatagggtatgacatctgcattaattataattataaccaattattctttaatttttacaaactgaatatttctggggaaagaagggttatgatggaacttaaattatgtgccacatttttgttgtaattcaatgaagcagaatacttgaagctgagacaaaggaaatgatgaacactaaatgagtatgataattgttgacagattaacttagttatggtattgatggctaggaaatatggcaattaattctaaaatatctgaaaaagaatgcaactttttgggtagcgataaaccttttttaagtaagtaactaattattacagccgcaaggattttagaaatgtataaaaacaaggaaaataataaaagatgaattttcggtagccaatactcggctctccggtcaccaatacctcacaaggctcggatctccggtagccaatacctaattaagcttgccccgccagtaaccaatacctcacaaggctcggctctccggtagccaatacctaattaagcttggcccgccagtaaccaatacctcacaaggctcggctctccggtagccaatacctaattaagcttggcccgccagtaaccaatacctctcaaggctctgacaccaaacactgaaaacttcattcttttgactatgaatttttatttttatgcaaattgttatcctcgtggtctaaaatttatatgagaataaaatatacctttcctattgatttggcaaaacgcataggatggaaaacggagtgggtaaactgagtttgcgatggtaaggagcaataatgaccgaatatgtgttggagaggaagggcagagctgaggaaaccaaataagtgaaggagaggggggtgaggtcacggcgtcatcttatcctgtaaatcgattcctctaaaaggaacaaatggaaagaggctaacgccaactgctttcttaacaaaatccaatatttagagattttggtttcgggtttatttggattattttccttttctctgtaatacactttctctactcttctatatctgtttactttcactgttattccttattaatttcagacctacatattgtctaaataatcgtttccgttagctatttttcaatatcttttcttccaacactatgttttattctcgaaccgttatcttccaagtgttcgtattcttgttctttatcaaactattctcttctctatacattacctaatgtttgccttactaactcacattaaattctcactatttaatattgactctcttcaaccacatttctgagttctctatctctatctcttacacccattattaattgtcattgattctatggtgcactacaatatcctcatatgatttcttcatttattcctattacaagacctgcttcacgcatacatttagcccttatctaccctttctcgtctgttccttattataattagaattattttacgttgaattaggcaaggagcattgtttgtgtttatgattaaaattaactagttttatataagttaataaatattatgcagaactttcaaacacacttatcctcacgctcgaaaaaacatacaatacacacacatacgcacacgcatagacacgcacacacgcgcacatgcatacatacgcatacacacacacacacacacaaacacacacacacacacacacacacacacacacacacacacacacacacacacacgcacacttacacatatacacatgcacacacacataccccatgtgtaatttttacagatttttgagtaattccttcatttaatcattatttttcttaatttttgttaaattgtatattctattccttaataatttacaaattgtgtcttctttctcttaattctgcatatttctacctaaaaacgacgttcccaaatgcttaataatttacaaattgtaacttccattgcttaattctgtatgcatgttcactccttaattatgcacttttctacctaaaaacgacatgcttgtgcatattttaaaattgtatcttctattccttaataatttacaaattgtaacttctttctcttaattctgcacttttctacctaaaaatgacgttcccaaatgcttaataatttacaaattgtaacttccattgcttaattctgcatgcatgttcactccttaattatgcacttttctacctaaaaatgacaagttcgtgcactttttaaaattgtatcttctattccttaataatttacaaattgtaacttctttctcttaattctgcacttttctacctaaaaatgacgttcccaaatgcttaataatttacaaattgtaacttccattgcttaattctgcatgcattttcactccttaattatgcatttttctacctaaaaacgacaagttcgtgcacataatcaaaatgtatcttcaactccttaattatttacaaattgtaacttctttcgcttaataatgcatttttctacctaaaaatgacgttcccaaatgcttaataatttacaaattgtgtcttccattgcttaattatgtatgcatttttattaaaaacgtgaataaaacgacaaaataacacaatttttggtataaaatagagaaataaaaggggtacatgtttgtgtacgtgtgtatggggtatatgtttatgcgtgtggaagagagatacaataaatggtgaacaaaatacaaaagggtacatatgtgtatgtgtgagagagatacaatgattggtgaagaaggtattacaatgtgtgaacaattacaatgaatggtaaaaagacattataatgggtgagcaattacaaagtgtgtccaaaattgagaacattataatcggctcctacaatacccttcccaatataaggctgataacatttttgcatagagcttgatattacagatccaccatcacgaatattgggtctaataaagtttgggtatattacattaattggttcaatctctcctgtttgagcataacgtttgacttgctgtttttatatctaaagccttggttgttgatcacatcataattgagtgtcaatccacggagtttaagcacgtattccatttccgcatcatgtagaacatttatttgtcttaaagccaacgcatactattttgcaccagcagtgcagaattctacgatttccatcaattaactgcttatagtgtcgatcttattcagctaaaaagcatcgcgtagatgtgagaaaacaagactatccgtgtcggtggagagtacttaacgccccggctatatcatcatttctgaatagttttattacccactttttttattttcgtaggtaatcaaaacatgatacacctttcaatcctcgatggccattacgtctattgaacgattatcccaaatattctccaaaatcaagtacatcattattgaagtaaagtctgttaaaggctgtaatttcgtaaagaaatatgtcgcacaaattgttcaagcatagtttaacaatcctactcttcttggttcacagctatctttgttgggttaagatctctaatttctctttgcactctcttacaaattcagcttccttctcaccatttccttttatgtcagtatcaattggtaaatgggtaaccttcttcaaccgtagtaacattaatttcgattgaaatgcagattgctcagccatctcattgtttgtgtttgcatatgtatttacgtctatcctgcctttttgattgtttttggtgcacttcataaataaagagaatcagagcctaccattcactttgacgggcaaaacagaatatcgaattttctaaagaaatcacccaaactttgagtattgtcaaggggtagtgtttatcttccgggtatttaactcgacttattcattcagcacatgtacattggtttaccaatcgagtagtgtgtagtaaaattaacgaaggggtagagagaaatgaagtcacatagaaaattttcattccgtcttcaaatccgctcatttatttgttgctcattaacattttcgcgatctcgcagcctaatacacttacaactggatggacaacttgacttcgtataaattcataacgttttacattcctctcccgcactttatcagttatttttttcaattagacattaatatacatcttctaggtagcgctaattgcaggcatgctaaacatatccgcttacttctattgcagttctctctgtttccaactattcatccacagaataatgatcaatttgccaagtgttcagttgaaaagttattgatctagaaatatcgcatacaggccgtatactagtcatacattcctttagtacatcaatggatactaaaagacgctgccttcccttaataatgccttagttcctttgagacatcaaataattccctcctaaacgataccagcgctgtcattaaaattttgaatgtcattacattttttctcattaattgcctctgtaaatacaaattttccagttgagaagatagttgtggtagaatttgtacctagacccttcattatatttgaaagatttatgtggttgtttttagtggatggggatattaaataaattgaggagaaaagttttactatttattgtcagtaacaccataaattgaatttaattttagatataatttacttaattttaatcaatactattgtatttattatttttattatattttaatacaactttaatttaattttttttattttatttttatttaacatttattttatttttaattttaatcttttttatttttattttactttttatttgaattaatttgaattttattttactttatttattattcagttaatttaaaggagttgttcagaacctctatccaataaaggctatttcgccgctcagcacggcataaaaggtattttaaccgtgcaccgtttagcattgtatgatatcctcatattttcaggatggtaagggattttaggccacctgatcgctattaatatgtcacacacacacacacacacacacacacacacacacacacacacacacatatatatacacatgcacacacacacacacacacacacacacacacacacacacacacttacacatatacacatgcacacacacacttacacatatacacatgcacacacacacacacaccccatgtgtaatttttacagatttttgagtaattccttcatttaatcattatttttcttaatttttgttaaattgtatattctattccttaataatttacaaattgtgtcttctttctcttaattctgcatatttctacctaaaaacgacgttcccaaatgcttaataatttancaattgtaacttccattgcttaatcctgtatgcatgttcactctttaattatgcacttttctacgtaaaaacgacatgctcgtgcatatttaaaattgt

SEQ ID NO: 1300 - DNA, 3246 bp, Heterodera glycines
ccggttatattcaattttcccctcgaaaaacaaatgatggagactgtggggtttttattccgatagacaagaccggggaatagttcaggagtgaaggaacaatattttgcgcctagaaagtcggacagaggtcctaagcgtatatgaaaaccaacgtctgctgtcgcaatcaaattcttcaccacaaattcgtgaattcgtgcctcgtagtacccaaattgtcgtattctttcggtgacctgctccgcagcttgcttacattctttctcattagctgctcctgtacatacgaattttccagttgagaaaattatggcggtagcatttggattatacactttcataatcacagcatgaattttacgtggattatattttgtggatggagatattaaataaattttttcaatatcaaggggtattttgaggtctacaacagaaacgcaatttttaatcgttggaaaaaacattttaaatgaataatgggagaaaatttttaggtatttatactaaaataaattgaatttatttatattttaactttaactttattataattcatttttaattttaaattctttatttaatcattgactcacagctgaaactcaacaggcaattgagcagctgtctcaagcacagaatatctgatgttgggttttgcataggcacaactgtcacaattaatcattgactcacagcttgacctctatttccagtggtatattaccgacacttccgtgggcattatacagtcaaaatgcatccaagggattattaatgaccattccattggctttggctcggtcagaaatgcaccaaaagaattcccaagggataattaatgaccactagcttcggttggacagacatgttcacaaaagaatggttaatggcgctcagttggcttttggtacaacagactccacatttcctaaggggatatttatgacactttcggaggcattagttagaaatgcactcaaacgaatgattaatgaccctccgtaggcttaggcttcggcaaaaatgcactcaaaagaattattaaagaccctccgtagactttgggtactcaataggctttgggtctcagaactgaaatatcccgtgggcactgggagtgaaatggctaaacttaaaaaataactctggggctcaaatggcggcactgtaaaaataactctggggctcaaatggctgcgcagtaaaaataaatctggggctcaaatggttgcactgtaaaaataaatctggggctcaaatggcatacgcgagcgtttaaatggcaaacacgcgggcgctcaggtggcatgcgtcccttccctataaggcatgacagctgacgcctatcctctgcctccctttccttctctaataggatttgacctcgggttttatccttcagatgttttttcaattatttacctcttctgggattggatatatttattataggtgttttttaaaggtttaaatttggtactgaaatgtccctttccactgggactgaaatggcggggctgaaaattaagggccaaaatctgcatgggtaactattctgataatttaatttgccatttatgcacatttttatcgaaaatttattttaaaactgaagaaaaatcattgcatttcactttggaaattttatttatttatgagtcgtaatttgatcaattttttctccctttctgctgcttgttgttctcccttttcttccgtttgatatgagtcatttctctctctgtgtgtgatacacagcacatttattggtggaaaatgtggcttaaatcacacacccatttttgttctcgaggctcatcacaatctttgcccgatcagttgcttgctttttgactaatttaccaccaaaacattttctccttcattttttggggttttatatgtcaaaaatatgaataaattcaatagaattatttaaaaatatgtgataaaattcaggattttagctgataaatttatgaaacataaagaatcagcagaacgcctggacaattttgaactcgtcaaccccaacgagttcaggtccttttgtttcaggttggccaaattttccaatttcccggttttttttttaaattttcaaaattttagaggcgaaggttgctgtaatctcgtgatcagtgcaaaaggacgccatgatgggaccaggttggggccaacattttcgaatttggttgcccaattcatccgtaattcattggttttttagaattgtttggaggttggccaaaaaacggaacaccgccatcattagtcataagccaaagtgggctttttttttgaaatattccacattttttatttattaacggaaaaaatgagtccctaaatattgtaaaaatgattttttctttttgattagatgtcgtttgctcaacatttttctggaaatgttcatttctccatttttgtgcaacagttacttgatcaaagcccgtcttgtctacatttccgtctctgaccttcaccatttggccaaagtttgataattatttacattattcgtattgtcttaaaataaaaatccaacaaaagcattttataaaatattttatttcgattcaaatggaaatgatgttgtcgaattttctatttttgttttgacagattcccgttttgccacacaacatgaagttggaggagttcagcgagttgttcgacgccaccaaacacccggcacagagttcacgttttcagctggcaaacaaaaggagcaacaacaacattgaaaacggtcgcactgcttccgctccgtgttggtccgccgccgctgttgtgcccgcgttggaaatgccggacgcgacgcgcatccctcggcccgtgccatttgcctgtggtccgacaataacggtggagctgaagccaaagcagggctttcgccaggcccatcccggcattgacctgcccttctgcaacaattgcatattgcaggtggcacttttttgggaaaaatttttttgtatttttgacaaattctttattttggtaaaattaagaaaaaaatctcaggggtaataaaaatttgttccgtttttttttctgattttttatgagaacttttgggcaaaataatatatttttaccctggccgtcagccaactgaaaaatggaatttaaatatgaaaattttattgttttgtttgcaaaaattttcttgaaaaaaaatcgagtaaaatttatgaaataaattttaattttgtccattcattattgtgaggg

SEQ ID NO: 1301 - DNA, 3276 bp, Heterodera glycines
  misc_feature (9)..(9): n is a, c, g, or t
  misc_feature (88)..(88): n is a, c, g, or t
  misc_feature (98)..(98): n is a, c, g, or t
  misc_feature (138)..(138): n is a, c, g, or t
ttcgttcancaattcgaatggcaccatttgtatggacggcgcacgaacagtaaaacgaatttcgtaatggacggaagaaatggcatgngcacgagganaatgctattaaaaaacgacttttttacatttcctgaattnttcttaataatttttttcgaatttatctatttttttttgatttaggctaggtaactaaattttaaataatttttttaattaaaataaaaatttgcggctacgttttgtcccccccccccggaccacacctccttgaaattgttgatccaatcagtgttcgcttgtgcgttgtaatcttcgcaacgcaatcgcttgggttggccatcttttctcggagagtgcaaccatttggacaatgcttggccagcagaaattgttgaatttggcccatcaaaatcgtcaccaatcgcagcgggcaaccgaccaaatgaatggattgaaaccaattggttaagatcgatgagaattgtcggcgaaatttgacgaagcaaattgtccaaatgatcaccacgggaaaagcccaaacagcgaatgtttgtcgaaaaaatgggccaaatttcacgtgtcaaaatatcccaaatccgctggccatccgtggtgtgtggtgaagaaatccaaaacaactgtaaattggtgcctcttttgtcgaaaatttggtgatttaaacgaagaaaagcgatgacggagtgatcgatgtaactgtgaaaatggaaggaatgcttttattgccataaagctttgatttttaattactaaatctcaaggctcttaaaacggattttgctgggcaacggacggtcgtccggcaatggaaattccacaaatttgtcatcgattcgtacagatagtttcgggtttgttacactgtccagcttcggttctggtcctttgtccttgctaattccgattgatctccaaattgtcaattcgcttttccattgaaatgtttgtccaccaacgcattgaaacgtggcgaaagaagtgccaatttgaggccgagttgaggacggtcaaaggatgggaaaatgtccatccaaacgtcgttgcaaatccaactgaaatgggaatcaaataaacgacgaatttgtgacttttaatttaattaccgtcggttcatttttggcagaaataagcacaatttggacgagttccgaatgatgtcacacaaatagcagaagaattaattgcgttggaaactttatttttatataatgagaaaagcggaaaaccaaaaattctaacgaaaatcacattttatccaaacaacttttgaattttgtttgccttaaattgttgcaaatgggcccgaggggttggacaatatgccaatgggagacgaaaaatcattgacaaaaagcgagcagaaaaagggaatggcagtgctttggaatggaaggaacgcacgcaacagaggagaatatattttgcaaaatgatgacatttgccgggcgttttagcccctacccccaaatcaatcaataaaaaatcaatttgacggattatttttatccaactttcatttgcaaatgttagacgcgcatttgttttttgaaatttgaaaactgaccaacgtaataataaatagggcttacatttttagatttttacctatttacgagaatttttgattttaaaaattatttttctcaatttgtcttaatatttgttgacggatttttaataaaatttttgtcattttacacccctaagttcggaactttttggcacctattttcccatttttgcacctatttttggggttttttagaacctaaaacctacctattttggcagtttttagcacctaaaaatgtaagccctaataataaagtcaaactaccgtatttctctaattatatgcaagtcaccaataatctacccctttcgaagtaggttgaaaaataatctccccttctctatttatctgcccgggggataaatagaatttatatttttttcgaaaaaataacttcttttctatttttataataattaattaattccaagttgaaattctttaaacaattttttttaaaattttcaaacagaaatttttcttgaaaaagcctgcgaaaaatttttctttgaaaattcggtaatagttaagaatgttccccacctttttctgaaaaaaattttcaaaatttttttttcgagaaaatggcgtttttagggttttcagggtcgaggaatccgattctgagactcaattcgacccattccgaaccacgaacccggattcgaacaaaaattgaaaattcgatttttcaaaaaattaccatttactcaacaaaatcgaacggaaatgcgcgcaaacaacttcttggttttataaatgatgttatagatttttattattgtaatatggctgcatggaagagcttcgaaatttcaatattaaaaaattgcatgaaaagttggcgctagaagacaatgagttcgagcaatggcttgagagtagttactagccccctttttcggggttggaaaaccaccgttccaaaccaaagcctattggtttaaaccaaagcctattggatgggtgcgggggtgaacctaaacctattgaagggtttttattgattaaaaaataaataaattaattaataaattaattaaaataaataaattaattaaaattaattaattaaaattaaaaataataaatcccaaaaccaaagcctattggatgggtaaataaagataaattataataaagaaaaattaaattaatataaatacaaaaattaataattaaaaagaaaaaaaaattaatgtgtttaaattataaaaaataattataaatgaataaaaacgctagatagagcgctgctatttgagtccgaccatttcagtccctgagtagttaaccctaggctggcgttacaattttgaatttggcgccaaaattcaaattttggcgctatttttgaatttgaattttggcgtggcgtccttttttccatgcctattgggtgttttgtgtgtgtgtgtgtgtgtgtgtgggttcgcggaccttttgaagtttgttttactttaattaatataatttaattattattctcttaaagccaaagtctattggagaagggagggaaggggagggcgtcagctgtcgcgccctttggggagggaagcgacgccgtgccatttgagcgctcgcgcgtgccatttgaccgcacgcaggggccctttgagcgcccactggtggcaatggaaggcaccagctgttggtcagagggcaactcaaattctatt

SEQ ID NO: 1302 - DNA, 12221 bp, Heterodera glycines
acgaacaacaaagggaaaagggcgaccgcctgtctccgcacagtcgcatatcttcaaagttaacaacaaccacgacaactactgccttttttacgcgctggaacttatgcgccactattcattgtataaacgtgggacaattacccaagacagatggcggtggattaacaaaaaccaaaccacggttcttcaacaaaaggcgctgcaactactccgcgaggcggggatccctacaacagagacagagtacgacgcggaagtttatatacatcaagtgcaagggttgtggaacgtcaagtatcccggcgagtacaaaatatttatttttaatgactaccagatacgaccaatcaccaaatctgatgtcaccgactaccaattccccattcttctctaccacaacaacaatcactttgatggcatcaaaacgatctccaaatttttcaacaaaaagaactactgtctctcctgcgagtcgccgtactacaagaaaatcgcacattcatcaaactgctcttcactctgtcacgggtgccgtgaggtgggcgttgactatccctgcgagccacaacaaggatacatcaaaaaatgtgatcactgtaacaacaccttttacaacaacagctgttatgagcgccacctccacaaggatttgtgcaccaaatttcagcgctgcgaagattgtggggtaatttataacattatggttcatgggagtgttgggcataaatgtggggaacagttttgtaaactttgcaaacaattccatataaaagaagacgacgacgacgggatgaacccctgcacgaaatgcttcatccaacccctgaagcaacaacgaattaagccatacaggatcatcgtgtatgactttgaggcgacacaggacaaaaaagtggagaaccggttcgagcatgaagttaactttgcagcggctaccatcatctgcaccgactgcattatcaacggcgactggaacaaatcactgcaggggaaaaagtgccaaatttgcggtcctcaccgctcaatcaccttttcaccttttgactacatggagacaacagtcgaccaaaaagtcgtcactcagcaaccgctgtgcgaattcgtccagtggcttcttttcgaccacaacaaaaagtttccaacagtcgcgtttgcacactttggggggcgctacgacatgacgatgatcataaaggaggttttggcgcaaggaattcacaatccggacatcatcaaacaaggaaatcgcctctacgagctgaaaatcagggaaaacgagcatggccccctcaccatctttcacgacagctacaacctaatgcccatcaaactatctggtctcatcaaatcttttgggcttcatataaaagataagcagcactttccccacatgttcaacaaatcagctaactacttcaacgtcctaccacaccttcctccacgtgatgactactgtcccaaccaaaagaagaaggcggacctgcagaaattcgacgactggtacaacaacaacctgtgccaaaaattcaacttgaaagaaaaattgcccgaatattgctgcaacgatgtaaaaatcctcacccacgccctcgtcgaactacgccgggaattcaaacaacttacacaacggaacggaaaacacggtggaatcgacattttgtggcaagccatgaccatcgccagcgcctgcgtcaaaaattttgcactcaaccatttgaagcccaactcgctcgccatcgtcccggagaaaggctacacgccacaacagaaccaaagtgcacttgccatcaaatatcttgactggtactcccacgtcaacaacgttaacatccaaactgctcactcccggtacggcgaatatgtgtttaagcgtgaagggcaggtataccaagtggacggctacatcaaaggaacagacgggaggcgggacaaaataatcgaggtgaatggttgtctgtggcacggttgtgaggagtgttttgatgacttgggcgacgaaacgaggatgccgaacggaaagacgctgcgggagattagggagcgagaagagaagaaacatgaaatattgagcaggtacgtcgacttggaggttgtttgggagcacgagatcaacgagaagctgaagaaggacaagcagatgagggagtttttcgccaactggaaggaccactcaccaatcaaaatcagagacgcgttccacggcggacggactgggccaatgaagctactccacacagctaagccgggacaaaaaatcagctacaaggactttaccagcctctacccgtggaccaactttacgacaaactaccctcttggccacccaaaaatcgtcagtgtcccaccaaatgagcagacggtcaactggcgcaccccatccgacaatccctacaaaggccttctcaaagtgctgcttctacctccaaacaacaacgtcagcgtcacggttatgcccgtaaaatttgatcaacgcctcctcttcccccctctgtgagaagtgcgccaaacacatcaccaacaaatacccaaatggcctcaaggacgacaactactcctgcccacacttcaaccctaacgaccgggccttcgtttctacttgcacccatcttgagctaaacgccgcgttggatgccggctatacagtgcgcaaactttttcacgtcttgcaatacgaccagtggagtgacaacgtattcaaatcctacgtgagtgaaatgatggccctgaaaatccacgccaccggcttcccgtcaacgtgcggcagtgagaggcaaaaggacgaatacattgaggagtgttggcgaaattttggaattcatctggagaaggagaagatgaaaccggagccgggaaagcgctacatcgccaagctctgcctcaactcgctttggggacgattctccatgaggaatctactttccaaggcggtaatcaacaatgacccttgcgtcctccgccaatacactgacgacaagaaaattgacctaatggacattgagctgatggatgaggacaacgacgtattcatgctcacctacaaaccaaaggaggagtttgtcgacgaaaacaaatactccaatgtagtcatatcgctctacacaacatcaatggcgcggctctatctctatgaagtgttaaaaaaagtggccaacacgcccggatgcgaaattctctactacgacacggacagcatcatctacgttcacaccgagggtaacgacccactcccgacaggaaagggtcatctcggtgagctgactgacgaaaagccggaccacaacattttggagttcatcagcgctggctgcaaaaactacggactgaagctggaacgtaaggacaatggggaaattgagtacgacttgaagataagggggataacactggatgaacaaactgtgcaaactatccattatgacagtgtgaaagatcaaattatgcgttatgggtccgatgaccccgcggaccccattattgtaacatacccccattttattcgccctaatctaatccaaggcaaagtgtacactcaatctctaactaagcattatcaacctgtcttcacaaaaggcattattaataacgccttccaagtcctcgaattcggctaccgtaattcacgtttgtaaggattgtgcactctcacactctcttttattatcccgttttccactatttttttcaatgcactgcaggacggaatgacccctggttgatcctccccagcactccaggccctccatctgagatgaaggtggacgagctgctcattattgtaatgcgcagcctggtgcgtgagtgtttgggttggggaccgaagggcgaagccgattcacgggtgcagacactttttccatttagtaggttcggaatcataatttattttctgagaacgttcttccgtcaattgtatatatataatttatttcgttattatatttatcacttgtatgttgtgattgcaataaattgtgaattgagacacaaattttgggtataatagtatttaagacagcaattggttgggactagcaaactttacgataattataatgagttcggcttcatcaaagaaagcgcttcaatcggtggtggtggtggcacagaagccagaaatacaaagcagcgaaaaacccaacaaggaaaaacacgaaaagagtgaacggagtaaatcaacacactctgaatataacttgattgaccatcaacgcttcttctggaaattggcccggccaaagtttgctgtgatcaactttctctgcccagggtgtcgtcgaatcaactacaagcacaaggaccagttcaagttgatgggagaagacgagttccactttacacaagtgatgtgtccgggctgtgtgaagtacaatatgacgcaaacagatatatataataagcatacaaagaaccctcattaattatatttaaagaatttgttaaatataagtaacaacaacaaaaataactaaataaaaatgattgatgacaccgtttttagttcaaacgacttaaagttaaaattgccttttggaatggtcatcagtggaccgtcgagtagtggcaaaacaacatttttgttaaaatttttaagagagagaaatgaattgattagcccacaaccaaagtcagtgctatattgttatggacaatttaatgatagtattcctatactacaaaaaatgggtgtacatgtgcacagagggccacccacagatgaattgctgagctctctaaagaagccgctcttattgattctagatgaccttttaacaataattgatgagaaaagtctatccgaattattcattaaaaaggcccaccatttgaatattggagttatatttataacacaaaatttgttcgagagaaaggtgaaggtagcccgaattaattctcaatatattgttttaatgtcggcaccgaatgccgcgctacaaatacgtaatttgggtgtacagttgttccctaagaggctttccttcttcctaagtgcctatagagatgcaaccgcatcaccgtatgggtacttacttttggatttacaccctgcttcgagcccattactgagaatttgcacgaggatatttaaagaggatgacgagaaaactgtgtatataaataatcaaaatgactaactacataccacaaaacgtagttggaaacttggaattcctgaagaagttagcggcaacaaagtcttataaaaagagacaacaaatatttaaagaagcgaccagtgaacaaattgcattattagtggaaatttgctataatatattaaagggatacttcccactaacgaggcaacaaaaatttcgtcttgtgccttacgtaaatattgtgagaaaattaggaagagttagaactgagaaaggtgcaaagaaaattattcaacaaaacggaggcggtggtttccttaatttggctccattactattaccagtcattattgccgccttaaaatatggagaataaatttatactcgttccatctgacttgtataaaaatttattaaagcctgacactggggagattaatgttgaaaatgctaaaaataaattgaactcacttttgaagcagcgaaaattagattcgggtacaaaaaatttactttataatcaggaattgaggcgtttcttgaaactaaggaaggaaattgaagacaaacccgtaaaggttgagctcaccgacggctcattgatggtgtttaatccaaagcagcgcgaaaggaatatgaaaataattcctacacaaattgttaatgacgaaggattggatgaaacgggctccatgccaacgcttgaagacccttacactactgctgaagagagtgatgctgagttgacaacaacaacaacaccaaaggcgagaccactgttaaggcctttacgagttgggacaagtaaatttcgtcaaaaacaaaaatcttttatagttaggaaacaacaaaaaattatgtcgattataaatgatgaccctgagaaatttggtatcggtgctaaaggacacatacttagagctaatggaacggcatatttaaaaagtaatgttaatcaagcgctagagcgaatattgagacggtcacccgagaatgctccatcgccggttggtacaaaagtgttagagcaacgactgagaaacgacccgaggaccagcggaatattaaaacaaaactttagtgatcaatcgggatcgggccttaaaagtaaacaacgaaaatttgtaatcaaaaaatggataaaaagaagttactgaacaaattatataatgaccctaattcacctgcgtgttatgcagggcaggaaagactttatgaagaggcactaaaatatgactcttcgattacaaggaaagacgttgaacactttctcgagggagacagaacatatacattacataaacctagacgtgttaggtttaagaggtcacgaacagtgcctgctggattcatgactgatgttcaggttgacttggcagattttcaaaaattatcaagagaaaatagcggattcaattatatattgttgggtattgatgtgttgagtaagcgggtctttgctgcacccgtaaagtcaaagaatttcaaacatatgagagaagcgcttgacaacttaatcagtcaaatgccaatggttcctcatagaattttttcagatcggggaacggaattcgaaaatagagaaatacataaatatttcaaagatatgaacatacaaaagcacaaggctcacactagtacggttaaggctgcactagccgaacgctgtataaggacacttaaacaacgactataccgttattttagtcaaaaacatacaatcaaatgggttgacgtgttgccaaaactagtgaatgctttaaataactcaaaatcacgaatcaccggaatgaaaccggtcgacataaacccggataacgcgcaaaaaatttgggaaagagtatatggcgatgaacatgcacaaacaacatatagaaaaccaaggttcaaggagggtgaccatgtgcgactcgcaaagtataaatccagctttgaaaagtcttaccttcccaattattcggatgaaattttccaagtttacgatgttaaaagggggaatcctcatcggtatggaataaaggacgacaatgaagagccgtttgacacccgcttttatgctgaagacttgaccaaaaccagaaaggacgcagagacaacatacagaattgagaaagttttgaagactcgcacaaagaagagtgggcagaaagaacatttggtaaaattttacgggtacaaagaaccagagtggatcaaagacagagatattgagcgatagcaagtatttaagtgtatttattgtctatattttgtgattaaataaaatgtcaaatttattttatgtccttttacctagtgataccccgggttacaccaacaataagcccaataagtttagagtgcatttacccaggactctaacttttggaggtcaatggctgtgcggactgcacagtataatatatacaaattcttggcctgctgtgggaacaaatgagaaccaatgggttaaggtacatttaaaaaacggagaaacaattaagatcgacattcccacggggtcgtatcaaaatgagcaagaattggaaaatgcaatgaatgacgctataagaaatgttataaagcaaccgattaaaagagctaaaagacacttggaagatggagtggatttgttttttcattacaatccggatgattactgggataaaattgaggaagaaaggcagcgatataacgaattgttgaagttgatagagacaaagtcaagcgagcgtgataatgagaccgacacacataggaagagaaaaatagaagaggaaattgctcctcttcaaaatcgatcattggctaagaaggcacggatagatgaattagaagagcaagcacgtcagcgtgacgagggaaaggaagaaaaagaggagagaactgggcaagaattcatcctaatgtaccctgataactatagggagaggctaaacgaagtacgtttggatctgataagagatttattcaatatacaggatcatatggaaaaatatcaaggcgttacagacggtcgcacaattcaggctctgaatgaggaagcattaagaatgagaacagcaatgaaacatagaagaaaaaatctgaatgcttttagtaaggcagtaatgaaaaaagatttacagttatctactgaagaatatgagaggactagctatgaacaaaataaggattatgttgaaccattttttgatagccatccatcagattattgggaatacattcacaaaaaatatgaaggacttcagaaagattataaaaagattcgtgagctacgtgagcagcaacaattcctaaccgatgaacagaaaaaacagtcaattcgggatgacattgatcggcttcgtcgacttattgactataggaggaaacgattcgcagcgttggaatacgaagctaaaaagagagacgcactactgcaacaacatcaaaaccacagtggcactagcattgacccatgacgaagtactgaaggaacgaattggaaaaatagacgggttccacccccccccccccccccaccccaccagacaacatggggaagagacaaaaactcacggacagtccattagtggagttaatagatcaggtacagaaagaacggtcagagactaaggctgccgatactggtatgacccgaggagaaattttgggccaaaaattaaagcataatgtggatgaagatgtagaaaaaataacacatgcggatattttaaaaaacagacttcaacaaatttcacgtgctgaagatggaagcgaagctggacaaacacgtggagaaattttgggctctttattaaaagccaatgtcatagaaaaagaagctaatcaagaagaaaaaacacctagtgaagtaccaaaaaataaacttgatgaaattgcgggtgagcagcaaggaaagacacacggagaaatattaaaagaaaaaattgaaagcagtaggaaagcaacgggtactgaaaataaagtaggagataaaactcatggagatagtctgaaacaattaattgacattagacacgcagaacgagtcttattcaaatatatcagagagcgaagaaaattttcaatttattttaatgaactaagtattgaatttattgagttgtcggctcaactcggctacattctcggattcgaggacccgacaaagattctgaatggagatattgcaaagtatcattgtgatctgaagggtggcattgacagtttgtgtgtgtacattaacggtataactgagaatgtgatagttggagataaattggctgcacttttacgaattgttgtcgttgaaggaaaattcggagacgtaatagaaaaaatttataacaccccaatgtacattaaggtggcagtaaaggaaattaatgagattgaaatagaaattacgaccagggagggaaggcttattccattccaatggggtaatacactacttgtattggcatttaaaaagtcaattgtattttagtatttaaatatttttgttcacatctttttgtgtatattttattaaataaatatggttcatcaaatatttgaccccaattctgttgattttgatgattttatgctagtagagcaggttggatcgggagaaacctataattattttcgtgggattcccccataccaacgagggtacggaaggcagcgtgggggaggagtaggagatattctaaggttattatggagaacaattctaccaaaattaaaatccgctggcacggtattgggtagagaagcactagacaccggaacacgtgtattggacactatagagaaatctgaagcaccaaataaaccatcaataatcgccgaagtgaagaagggagtggataatattctcgaaaagggaggagttggtcgtcaattcggaacgggaagacgaagaaagagtattaaaaggaacgcgataattggaaaaactgtacctaaaacagtgataaacaagagaaaaagatcggacgtatttggaaaactattttaaaatggtctttaagaaaatagacaaagagtcggtaaactctataacttcagctttatcaatattcagccttccaccaactaatgtgtctgtgagtagttcttcagtgcgcgaatatttaccccttaaccccttaacggacattcctttccactttaaaattcaccctagcgccagtttcatagacctaaacaaatgttacatcttaaccgaaatgtccattaaaaggttcgacaccgacaccaataaatatgttaatttgaaagtgaatgagcaagtggcgacaatcaacatgatcggtgtgacatggataaagaatataaaaatcacggtccaggggcgtgagatttatgactcaaattcactttatgcttataaagcatacttagacaccgagctttcttattccaaaaacgtaaaggaatcagacatgcaggcaagcgggtattacgtggatagcgagaatcaggacggtacggatctttcccaaccgggtttcgaactgagaagaaaattgttttcacaaagtcaaactgcacaatttattacaaagttggatgcagatgtgttcaaccaggacagatatatggtgaatggtgttgagattgatatacaacttacccctaatgataatgagtttatgatcatggcggcgtcaaacgataaatatagaatagaaattaccgcttgcaagctttacgtaaagaatcttgaagtcgttgatggtctcgcactggacattcagaaaatattggaaaacaaagaggcaaaatatgcacaccgtaaaacattgatcaaatccatatttataagtgagaatcggactgaatataatggaacgctatttacgggtcaattgcctaaacgggtcattctcggaatggttgagaactctgcgtatgtaggcaaccaaaagaaaagcccatttaactttaggccgtttgatgttcgatccgttacattgacggccaatggaaaacaatggcccgcagcaccatttgagcttaatttcagcaaaaacttatatacccgggcattccacgaaatgaacgaggcgctgggtatggccagttcaaccgacagtaacggaattactctcgagaagtacagaaaggggtggacaattttcgctttcaatatgacgaatagcatggaggagaacgaatgcatagatcttatcacagagggcacaacgacagtgtccatactatttaggtcaccggtcccagcgggtgggatctcactaatcgctatgagtgaaatggactcaattttgatcttggataaaaaccgaactgttatgactgatacaaccgtttgaaatgtatatttaagtgctttttgttagatgacaatttactcttttggaaatgtattttattctatatactttatttttgataaatttttcttcgagttataatagccctattctctaccctgaacgatccagggacaccgaaatgactgacatttattataaaatagcctctttcgaccagtcatacttaaacaacatgaaccaaagtgaacttttctcgacaattgaggaaattgtgaataaactacaactatgtaacgacgctaaagcaagctcattagcgcgatgggtatactgtatgctgttagttttgctgtggatagctattgttatgaccggaatttttctctattttaattccttgattcgaaatatgtgtaagcttatgcgtttatgtagagaagaaaatggacacaatgacgataagtcggattctaacgggaaacacaaagaccagagaacactacttgggatgcttcccttgcgacaagctccccgacaaaatcatcaggtacccttcagcattggtggcgaacaatgacccatccaataaagagggaacgcattggatagcaatgttcatcgttgacgacagaaccgtctactactttgacagttttgggcgtactccgaacagatgtatcagccactttttgcggaattatgaaggcgtgatttcaaacaagccccctcctattcagtcagcgctcagtgaaaattgcgggtattattgtattattttatttattgatgtgttcattgggaagaaaaaattatgacagccatttttgaaaaaatgacaaaaacactgaaaggagaaggataatcc

SEQ ID NO: 1303 - DNA, 4729 bp, Heterodera glycines
  misc_feature (20)..(20): n is a, c, g, or t
  misc_feature (51)..(51): n is a, c, g, or t
  misc_feature (54)..(54): n is a, c, g, or t
  misc_feature (83)..(84): n is a, c, g, or t
  misc_feature (91)..(91): n is a, c, g, or t
  misc_feature (114)..(114): n is a, c, g, or t
  misc_feature (161)..(161): n is a, c, g, or t
  misc_feature (4650)..(4650): n is a, c, g, or t
  misc_feature (4653)..(4653): n is a, c, g, or t
tttgaagtgagtcaaacacngtattagtgctttgctgtgccgagaccgcanggncaatggatggctttaatctgcaagaatannaatggcnaataagtggttgtaaaaaactgntgtaaggaattattttttgaagtgaatcaaacaccctattagtgctntgctgtgccgagaaccggcaggcaatggatggctttcaatctgcaagaaattagattggcaatatgtggttgtattgggtatggaattattttttgaagtgagtcaaacaccctattagtgctttgctgtgccgagaaccggcaggcaatggatggctttcaatctgcaagaaattagattggcaatatgtggttgtaaaaaacttttgggtaatgaattattttttgaagtgagtcaaacaccctattagtgctttgctgtgccgagaaccggcaggcaatgaatggctttcaatctgcaagaaattagattggcaatatgtggttgtaaaaaacttttgggtatggaattattttttgaagtgagtcaaacaccctattagtgctttgctgtgccgagaccggcaggcaatggatagctttaaatctgcaagaaattatattggcaataagtggttgtaaaaaacttttgggtaatgaattattttttgaagtgagtcaaacaccgtattagtgctttgctgtgccgagaaccggcaggcaatggatggctttaaatctgcaagaaattaaattggcaataagtggttgtaaaaaacttgtgtaaggaattattttttgaagtgaatcaaacaccctattagtgctttgctgtgccgagaaccggcaggcaatggatggctttcaatctgcaagaattagattggcaatatgtggttgtaaaaaacttttgggtatggtgtcgaggaagcgagtgaggtgcgggtttgctggactggtcggttgcgcttcggctgtcggtttgcacacgctccgcgacaatgttattgaacttagcgaatgggacggggttttcgctcttggaatggacttgtgggatggacagcccctttagacttagttggactgtcctggtggacttcgggataatcgagcttagacaaatgcaaacacggaactctgagttccgggaatgtcgaaaccgtagagaacaaggaacaccttcggaacaaaaaacttcttagacaagaagtagtttatttgtcggaatagcgcacaatcaaaggatggaataatgatttttcgagagacattctaaagggaaatattcgggtttatatatgagatttggacagggagggaaaattctaaaacacacctgaaaggaaatgaaaaatggggaaacttcgggaatattaatcacaaaaatcacaagggaacattcgagaatcttcttccgttctccacaggacttcctcatttctttcctccgggcggtcctccaaacggtcctccgagcggtcctccgggctgtcctccgagcgatcctccgggctgtcccccaatttccacgcgttcagtcgccagcggcgacactccgggcggagacgaaagttcacgacgcagaaccgagattttgaggcgcaacgactgcatgaatgctgccgcctggcgatgttccagcgcgtcgcggtcggctctttcctgttcgttggccttcagcacttcgcccaatttgcgcgtccactccacgtacatttgtccgatttgcgccccctgagcgatgacttcgtcgagtgctgccacggcgcgttttccacgttgttgcaattcctcagccatgctcaaatgattgtctcgctcgcggtcgattcgtgccccgatttcgctgagtccattcagcacggcatttgtctccattggcacttggagacccggtcgggctgccgccttcttttccgccaaactgatggctgccgccttgggtttttccattgcggccatcaattcttggcgcgctctttccttcgatgcgcgaaatgcgccctcagctgatgcgcgtccaccggcgaccattgatgcagcaacgcctccagctctggccgcacgtgcctgtccaccacctttgactggcagttgaatgatcggaggtgccgagcattccatagttgcttccgcgcgtttggcaaatgctgccgccttctttcgatccatctccgctttgaccagggcattggtctttgggcagcgagcctcgtcgccagacaaatggccaagcaatccacatttgttgcaacgcgatttctgcgcattcagcgggccttctatgcgcgctcgcttcacgaatggtccctcagctgccgccactcgtttggtcttcggtgcctccataggtccctgaattcgaggctttttggcctcttggacaaccggcgatggtgcggcactggctaccgctgcttcgagtgctgccgccgcttcttcctcatcgtcgtcgtcctcctcctccgactcactctccgaaatgtcgattcgaagcgcttcgttgtcactttcttcatcaatttttacgaaacggacgacttgttgtttctgctgctgctgttgttgttgttgttgctgttgttgatggtgttgctgttgctgctgaacgaattcttcgctttcatccaataacttttcaatatccatgttcggtaggagttccgttgatataaggggcaggaataaggaaatgtaagtgactttttgcccatttccctcctccttatatagctgccgccagagggcagaggacacaattttgtgtccctgattcatgccataggcgcacaaaaacggatgactcatgttcgttcccttcattcggaaggaagcatctccatcaacagcgctcatcggcccatgattcaccgcctcttcttcgcttcccgggtgcacatctccgccgaagccgtgcagaaagatctgattcatcggcgcttctcgcattttcaatgaagaaggaccgcgggaaggcaaatgaatcagcgccgatggcaattcttttgcgccgaccgagtgaatcataataaatgcggacaacacaagcaaaattattttgcatttaagcggcccgatcaattcaatcttcgaattcgccggaacattcatcacaattgatcgttcctccgatctcggtggatctccgcgcatttccaccggatttcccgtcggactattagagtcaatttcttggataatcaccgagtggttatccggtgagatcccttccattggattacccgcccccgactgtggagtgccatgatattccacagtaatggaactccccttgctgcttatggataaccgtttcggggatttttctccctcttggggtcccgtgttgacagtttctggattgtcatcccatggcattcgggttccaaagtcaaacgggggatcgcgatcgaacgtttctcgtacttcgatcagttccaatgggtagtagctcacatggtttcgccctcctttctcacacagacatggagcctccgggaacatcaaattccggttgtgccgagtccgaaagtattggatgacagtcgggcctcgtccattgaaggcacccaattcatcggcaccgtgtgccgtaatggtcgtgccgaagagaatcatgtttgcattctccggtttcaaatgcgtggtgaccaatttcgctccactttcctggatactttccagcttctcttcaatttgggtcctcgttccaggaattccgcgaatggcacgggcaagcaaatgtggttgcattttgacgtgtcgcgacagaatgtaaagcaaatttgaatcggaggagatgttggaattcattttcggagagaatattagaatagaatagaatgagtgaggatcggtctttccatgcccttttaaaggcacctctaaccaatcagactccgccacgtatttaatgttcgagaatgttcgatgggccacgcccatcccaccggggggtactttaagaaattcgttttccccgtattcccggctctcttccatcatttgtatcatcagaatcagcataatccatcttgctattcttctccatacgatgaatgctggattacaacgtattatcaatatgatcacggcacctgcgaggattcccgccaatattatgacgattatgttcgggaatccagccatgaatctgataatgtcaatccaatcgaaattcagatcaggccatccaatgccttttggacttttcaacgtgtcggaaatccgaacgcccatttcaatttgttgctggattgggacatatatcaaatgtcctttcacacggaatttcgattttcctccactgcattcgattgtgcagtttgtgtcgatttccgcctggtcaaaggattctgatcttccgcttttgaccggcatggtaccgtgaaacgtgttccatcaacacagtagacatctgacaatgctgaaccgtattccgtccaacatctaagcttcaattgggctcccgactgacacttataacaacctttaagtgtttttgtttgtgcccaacacttggtgaagtcttcctcgatgccaagacggagaccctcgaattgcaccatcacttgtattggtgtgtagtgggtttccgagaaaatttcgccatctttgtatcggatattcaaattgcgcagacttaacggtagcctttttttcgggntgntgaattccttttctcaggatgagtcgcggcattgacaatcaactctctgggcctcttcatcgaccccacatttcgg

SEQ ID NO: 1304 - DNA, 5704 bp, Heterodera glycines
  misc_feature (1330)..(1330): n is a, c, g, or t
gtatcatcagaatcagcataatccatcttgctattcttctccataggatgaatgctggattacaacgtattatcaatatgatcacggcaactgcgaggattcccgccaatattatgacgattatgttcgggaatccagccatgaatctgataatgtcaatccaatcgaaattcagatcaggccatccaatgccttttgggcttttcaacgtgtcggaaatccgagcgcccatttcaatttgttgctggattgggacatatataaaatgtcctttcatacggaatttcgattttcctccactgcattcgattgtgcagtttgtgtcgatttccgcctggtcaaaggataatgtcacattttggacttccgcttttgaccggcatggtaccgtgaaacgtgttccatcaacacagtagacatctgccaatgctgaaccgtattccgtccaacatctaagcttcaattgggctcccgactgacacttataacaacctttaagtgtttttgtttgtgcccaacacttggtgaagtcttcctcgatgccaagacggagaccctcgaattgcaccatcacttgtattggcgtgtagtgggtttccgagaaaatttcgccatctttgtatcggatattcaatttgcgcagacttaacggtagccttttttccgggttgttgaattcattctcaaggattgagtcgcggcattggcaatcaactctctgggcctcttcatcgacccaacatttcgggcacgcttctttcgacaaagtgcagccggaaaaattgcttgctatttctctatcttggcagagaagatttgtattaacttggtccaccattgagaaagatgttccatctgacaggaacttatgccctaagataggaactggtgcttgtgataccgcaactggtgtcagtttcacctccttccatttgaaggtaatccctggtatcaacgacatctcaatttcacccttaaagtttcctccggattcggctttaagtttcgcattgattcgatactcccacgttggacacgaaattaattcgtatataattttcgactcaggcacagcgtgtactcagtagaatatgcaactcgcagtcggaagtttgcatccacagttccaaaatgaacacgattctcggcaacttgtaaatccaggatctttttgaacacttcccagttcttgtacaaatgcactgtatcctttcatgtaatcctcatgcactctctggcaaaatttgccaaagcaactgccttctcgtgggcagctcttcactgatgtggtccgaacggtatatgaccgtaaccatctctcagtttttgngatacatacaatgctgagtgacagtaatttcatctcaacgactcccatgactcgctcttccgggtctctaaggataagtcgaactggttgtcctgctggcagtagagtgacatctgtcgagctttcaatccggcattccgagccatttgcctttctcagacagttttctgctactgcgcttatcgaaacaacacgggctgagccttcagcatgctcaattagcagtgagcttgccgccaatgcgagtaagctcatgcccattttcgaaagttttttggctctgttcggggtcatcttccgcttattcggttccctttggactactctggcatcatctctttgtagccttttttcaatgccttggatgaccatttttattggagttatgatgatccatcgaataagccaaaatagatttgaggtaacttgccgcagtattgaaagtatccaacagagtgcgattatcccagtgaaagtgaacaatccatacactcctgtggacacatctggacggcagtccgggttggctatcctttcaatacaaaaccaacagtcaatcaatgtgcatgggtcctgtggtgggcattccacttctccaatgttgacttttccatctcttagccaatacgttgccccgcactggtaatccgcgattagttgctctcgacgcagctcataaataagtttatccggagtatatcggtgtaccaaacagctgctggttgcaccacaacatacttcgaatttggtcacttttcttggtacagtgactttaatgcctctctcagcacactctaacttgcacattttacaaggaggaaattgtattcccctatgtaacttcgggatatccggtgggtttggaacaaatcgagtttctacaaaacaaatgttgtccaaatcaccagcatgaacattaatcccaagatggaagctgctttcgtcatggacctggtcatcattccgtggtttctgatctgtccttgttggacatttctcgctctttccgcctgcttcccatccttttttgggattggctcttgaagtcctatttttccgttcggaacttcttcttcttcttggtcttcagactcgtcaacttttggtacttcgagcctatacagacggtttatcggacgcgaaatttcacgccatgaaattcgctcgccatttgcctttggtattttgagtttggcacttcgcacaatattgtccgatccttggagttcaacaattctgcccaacggccagcagttcctcggagttttttcttcttcgataattactacctctccgatttttggttggtccgccaggcaacttcttggtcctttatgctcccattgtaatctgttccgaagcattaacaggtactcttttttccatctggtccaaaattcatccaatgtggctagagtaccttcccagcgcatctgcaattgcttctggagatttttaggttcattttcgaactccgtgtccgacgattgttggttcctccggacatccaaactcaatatggcctttggcattatgaaatcgaccggtctcaatggctggacagcatttggtccttcatcaacgtaggtgatcggtctttgatttattgtcgcttcaacttctgcgacaaacgttctcaattggtcatagggcaaaattcgacgcccaaggactcttttgaaggccgcttttactccagcgacttggcgttcaagaaatccattactccaaggtcttagtgatggattaaatcgccatttgattccttcgttggccaggtgctcttcgagcggacatgtgggtgtcttcccagcttctaatgctgccgctactttagctgccagtacaaattgtgtgccattgtcagtgatgattctttttggagttcctctcctactagtgaatcgacggaacacttgaaggaatgcctcagcgcttaagtcaagcactggttccaaataaatagccctcgtacttaggcaagtgaacaaagcaatccatgccttctgaagctcaccattaattttggtattcgttggtccaagataatcgatcccaatgctttcaaatggtgccgtccgcctcacgcggtcctcaggaagaggaggcatcgtcggcaatttatatgccgggcattggatcctgcgacaacgaccgcatgctcgaatgaccttctttatggtcagtctcgctctgggtgtccaatattttcccataaattctgtcaaagtggattcaactccagaatgggcaagggactcatgtaccgactgtgcaattagtcgggttattggacaattctcaggaaggataatgggattaaccatatcttctgatgcattgctcattgcgagccgtgttgacagtcggacaagaccatttttcctcgatgtctttacaagttcttgtggttgctttttccacattggccaacatttttgtgccatttttacaagtaagatctcggcgtactggtaatcttcactgctcataggaacaccctctgaaatctcgaatattcgagtcttcctcatcttgtttattgcacggagaaaccaaaccacagtgcggcgtagtttagtccaactgctaaatcgacaagggtcaatccatggattgtcttcactcgttgttgctgatactgcaactacattgtccaattctgaactttcttgtccatccttcatggctccctttggggtgacctcgaagtcgatcggccaacttttcattggttctcggagccatgttggtccattccaccaaagatgatgggatctcagctcttctggagtgcatcctcttgatgctacatccgctggattttcgtgcgttctgatatgcagaaatctggcattttctgatatcctccggatttctctcaaccgattctccacaaatctgggctgggaatcttttgactcaatccagctcaagacgggttttgaatctccccaaataaatttttcatttattgggattctcagctgattttccgcaaatttcagcatcctcgccccaattagcattgccaagagttccattcttggaattgttacttcagctttccggggcttgagtctactctttgcatagagtaactgtacattggtttcttctcctttctgagaccttatgaaaagtgccgctgcataagcgtccttgctcgcgtccacaaatgcatggagttggaccatttcatcttgcagcacggatcgtctcggaaatttgaatggttcggtcttccattctctgatgacagcaaaccattctgctgtttcatcagctggtaagatttcgtcccatccaagggttctgtcccacaatcgttgtaggaacaattttgcttggagaaggcaaggtgcgaccattcccaatgggtcaaatatgcttgctaatgttttcaaaacaatgcgttttgaaatcttcccggcttcattcgtcggtgggaatccaatgctcaattcgtccttttgaatgtcccaagggatgcccagtactttagtccctggtttattaagccggtcctcttcgggaatttgctccatcgctttcattgagttgcaaattaattccctcaggttcatttgtgcttcagcaaacaatgctttcccttctcgatacttctttaagacttctccagcgtctttgcatgaagtcattagattgtccacaaaggcattcccagcgaattccaacgccaagggggaagctttctccttcagatgcttctggacaactgcagccaaaataaatggcgaagaaattactccgaagggaatccgagcccaacggaagatctgcaaatcttagaaggattcccacgagatcgggaatcatcacgggtcctctgaacatacactcgttcaaagatttctctccccgtgggtgtgctgaagcatcaaaaacaattcgaagtttatgagttactactccatgatgtggcaggaagtgttcaggaaaaccctcccttctttcgccaagttcaaagaatccgagattgaactctctcgagattgactcgtggtatttgtccaataactcgggagtcttgcgcagtttttcaaggaggttgaccaatctcctatatgacatattgtaattcgatggcaaatcgggcgggaactctttccatggccatcccgaactataacgtccatcagcgagtctcttggctttcttttcgaagatttccatcgctgtgtcgtcatcattttcttttgggtcatcttttattcctatcagttgtaggtcccaaaagttttttgcagtgtcgatgcctgtttctgcaattcacaatcagcttttgctgacatgactgcgcaaatttgtctcgtttctccgatctcctgtgggatatcttttccacatacg

SEQ ID NO: 1305 - DNA, 1398 bp, Heterodera glycines
cgcgacagaatgtaaagcaaattggaatcggaggagaagtggaattcattttcggagagaatattagaatagaatagaatgagtgaggatcggtctttccatgcccttttaaaggcacttctaaccaatcagactccgccacgtatttaatgttcgagaatgttcgatggcccacgcccatcccacccggggggtactttaagaaattcgttttccccgtattcccggctctcttccatcatttgtatcatcagaatcagcataatccatcttgctatttttctccatacgatgaatgctggattacaacgtattatcaatatgatcacggcaactgcgaggattcccgccaatattatgacgattatgttcggaaatccagccatgaatctgataatgtcaatccaatcgaaattcagatcaggccatccaatgccttttgggcttttcaacgtgtcggaaatccgaacgcccatttcaatttgttgctggattgggacatatatcaaatgtcctttcatacggaatttcgattttcctccactgcattcgattgtgcagtttgtgtcgatttccgcctggtcaaaggataatatcacgttctgatcttccgcttttgaccggcatggtaccgtgaaacgtgttccatcaacacagtagacatctgccaatgctgaaccgtattccgtccaacatctaagcttcaattgggctcccgactgacacttataacaacctttaagtgtttttgtttgtgcccaacacttggtgaagtcttcctcgatgccaagacggagaccctcgaattgcaccatcacttgtattggtgtgtagtgggtttccgagaaaatttcgccatctttgtatcggatattcaaattgcgcagacttaacggtagccttttttccgggttgttgaattccttctcaaggattgagtcgcggcattggcaatcaactctctgggcctcttcatcgacccaacatttcgggcacgcttctttcgacaaagtacagccggaaaaattgcttgctatttctctatcttggcagagaagatttgtattaacttggtccaccattgagaaagatgttccatctgacaggaacttatgccctaagataggaactggtgcttgtgataccgcaactggtgtcagtttcacctccttccatttgaaggtaatccctggtatcaacgacatctccatttcacccttaaagtttcctccggattcggctttaagtttcgcattgattcgatactcccacgttggacacgaaattaattcgtatataattttcgactcaggcacagcgtgtactctgtagaatatgcaactcgcagtcggaagtttgcattcacagttccaaaatgaacacgattctcggcaactt

SEQ ID NO: 1306 - DNA, 1039 bp, Heterodera glycines
ctccgcttaatcccacgaggtcaatttttggcaaaatatttctaattttaacagtacggtgtgttcaaacatacggtagggaccggtttagtaaggctttggttttacgcatatttcataagtcacaactgttttggtttcttacaattagtcaaccaatttagaaaacgtttacactcgaaagctcttccttcacgagttttattatttaaatgtcctaaatcaaatttggttttcctaaagtaaaaagtaactaaattctgctggattttttcacggttacgaaatatttttattttacgtcgagcttcgaatgccaccaattgcaagagttggcttgataattaaaataagctaagcttatggatgctgcttccttcgttaactccaccgtatatttttctcgttaattcggcaccttcttgttgctcgtacggactctgatcaaatgactgatcaaatctctgtgtgtgttgtcttaagtcgtcgcttccaccgatcggaaagttttcctcctcaaagaatggcatcggccgatgtctttttggcgtcggcccataatcgctgtcgccttcgtacggtggtgcgttcattgtctgtacatcaatttggtgttgtctgtgactcgcatttggtgagaatttttgaggagaaagttgcggagcattgccacgaaaattcctgaaaatgcaggctttggtcggttcggaaaagtcgaaatattttttcgatttttattcccccaatttcaattcgcatttgcgttattccgtctcatttcaatccatcaacttttttctcatctctttaatattcactttcatttctcattttttaccacttcatactcatcaccatcgaataaatctcttcaattcatcgatcttttcataaaaattttcaaatttcaatccacttttccccttcgaattttcctcttccccattcccttttcacatcatttccatcaattaactctttataaccttttctcagaaaatcttccgaaagaatttcggcggaagtcgttgtcgtcgtc

SEQ ID NO: 1307 - DNA, 3292 bp, Heterodera glycines
ccttctctccccctccccctcccttctcttccattcccttccctcttttccctcactcgctctttcctctctctctctttctccctttctcaccatcgcccttcccttttcctttccctccccttttctcttctttcgttttcatacatttccttcgtcattttttctctttctctctcttttctcccttctcttttttccaaattttcacattttctgttatttgtaatttgtaaacccattctttcgtaccaaaattgctcgtgaatcgtggtccctgtatcgtccgcctgttcctcgtccaaaatgttgtttccccgccccaaaattgtgatcagaatgtccgcgattatttaacgctggaaacggatgttttgatttatcatttgttccttgctgttcggtttgtccctacatctgcgccacgaagaccctccggcatctcctcgagagtctttgctgccactttccgttttgctgttcgatggagtgttctgctgttgcggcgttggcatggctcggtcactctcttccgcttcagttttcatcgtaatgactttccccttgtgttgctgttcttcttcgtccatgatttcgccctcctctggcaactctccttcctcgacatcgttcgcagaattccctcccattttgtcactttgctcatgtgaacccgtcattattaaaaattcttcacacttcgctgacttaattcaagaaagggctatcagttgacttattttatcttaaagacgtgcgatattttttttcttattttaaaaacgcaattaatgtcgtatataatgacgcgcagatctaacgccacacacacactgatattaagcaggttttacatcgcagtatttttacgtgctatcgcgactaacttcttgggaggggggggggggggcaaagaatccgacaaaaatgcataaaattcatgagtaagcgcgttctttaaattctcacatttggatttgggattcctgtaataacaggaagcttaacaatgttagttgacaggaagcttaattttagacaaggctatttttcctattgagctcctagggacctgcaaacaaagaaaaaatgtattaaggtatatttccaaagaatcggtaaaacccgagtcgtattggaccatactgttttccagaccaaaatttggaacctttcaattaatgatatcttgacaatctaaatgttctctatcctgcaaaatctcaaaatttgttgattaatttaaaaaaacctataggcattgtcaaaaattgaatttttgcaacttccttgaaacgaaacattttcttgttaaaatagagaacattagatccggaaaattggtaaaattttgacattttttaggacgaaaacagtacaaattggccttatatgtatgaacaaccttcgttatcgacctgtatgtttttgaaaagttacccaaaaggtttttcagttaatgctttaaaaatttacaattagtgtattttactctagtttttattttggtcaattggataaggaatgacgaattaattaagatacagataagccgatatacacagtcctaatttatgactttttaaggcttgttttttgttcttaaggtctaaggactaaccgttttagcaatttttagtctaaaaatcggagccctattcaagatcgtagaatttaacccaacatatgaatgaaaatgagataatggcttatcgaaataataaaaaagaacgttgcaaaatctcataaaattattgtttccaccgttattaaaaaaaattgtttgtcttcttaattactttatattctctaacagaaaccttcaaggattgttttgatttaagatgatggacttttaaaatttgatttttttttctatctcgccgttggcgtttttcggcggtcggcgccatcgaatacccaattccttttaggtctccaaaaagcatcgccgccaaacgcttaaatttcgaaaattccccagtggcatttatccgtaatatagtcaagaaaataaataaagccaagtatttttagcgaaaatcctatttgggttgatgttccttctcgaaaaatgactttgtttttactaaaattaaatctcccaaatcattggtttggggacatcaaatacttcgaaccatcgcagaactaaaagcctaaagcattttagtctcagacacgaaaagttcaaaaaaggactaggagctggctgagtttgaaggtgatttccttgtcttaaattccttgagaaatttcttggattacaatatgagattttgcaaattcaacaaaattttcgctttctttaacccggagacaaacttatgtagtgattacatatattgatattccatcattctcatttcaattttgttgatattatgtacaaacctttggataaccttccaaataacatacattggagtaactttcattaagagtgataaaatgcattatatgtaaattttcaaattcgtcttctcgttcagtgagcaataatgaaagagcccccaaccaacgagaacgacaacacacataagacataagtttgtcatcagtcgattttctctttttgctggttggtgaataaatgtggatggcgaagcgagtagcgaggagaaagaagtgcacgcacacacacagcacaatcccaccgatgttgggggggaggggggggtggaatttgcgaagggttggggggctaagcggacgaagggacgcgagcggtcgaccgccacagcagcaaaatgtggaaattggggttaaaggaatgggaagacaatccaatctcaccacagcgcaaagcctagagtaaaagagaagcgaaacgaaaagagagagagagagagggtgactgagaagcagaggaattagggaagagcaataacgagagagaagcagagaaagaaggcactgatcgatatttcagagcaaatttatcttcaaacgcgatgatagagaatggaaaaatatatgattatacggtatctgaatgcccgcatatacagtggggagcaaaagttagaccgctctcaggtaaaaaatgttatactgtatgtgtaaacctaacttgaataaaaaatccgttttgccaaaactaaaaatgcaataaaaacataaaataggtacgagtctgtatcgtttcggcgccgccgtttcggcgccagggtcgtttcggcgccaagccaaaattaaaaactcatgaatcagtgggaaatttttaagctgatttaaattttcaaaattttttaattttaacaaaaatgtagaataacaataaactaataaa

SEQ ID NO: 1308 - DNA, 6557 bp, Heterodera glycines
  misc_feature (6030)..(6030): n is a, c, g, or t
tttaacaagaaattttgatttttaaaattaaatatctatccttaatactgatttgtagggtttccaatttttttcctggactgtgaggggcccgcacgaaaaacatgtttttagcttggtgcttctaagattttttttatacatacagtatcttcgatatttttccatatttcacgattcatgtttattggcattatgtccataaaatttttttccaaaattttttcgagtttaaatgccgacccagatttgatggcaataatgcagaaagtagttattagcctaattcaggaccaaagctctgcatgtcctatttaaacaataagaatcaattaccatataaaagatgaaataccctactgaaaccacagatataataacattttccttttatatttctgttatttaaataaatataattttcaataatattttcatcggtattcgtaatacatatgtaatagctgacgatgagggaaaattgtacgctttgagcgcttcagagaaacaacgtacgaaagagcaaaacaaataaagcaaattaaaagcgaataatttaatacgcgaggggaaaggatatctttgaaaattcggaaagaaagatccggaaaagagcaacgattcaaaagccgggaatgaacaacgtaataaaacagaataacagggaaaataaattaatttattattgtaattgtgcctcacagtcagtcaatttccgttggtcacttccttcatattcggcataaagtcaagggccatcatacacgcgaacaccgtcatcaccattttggatttgacctgggccatcgtttaaaataacaaccaaacccgtgatccatcatcaatccacctcaacgatgtcctccggtaatgcgtaaattttcgctccaatttttcgtcccgaagtgatggcgtattttgcattttccaaattgctctaaatttgtatataattacaaactggctcataaaggttaattctccaaacctcggctgacacatcgttcttaaccaagtcgtagttgatcgttcccggtttgatagcatcgatcaaatcgatcagaactcttccatccgcaattgtctgatcctggaaactcttcagtcggcttgtctaaaataaaccccacttcaaatagatgtcaattagttgcagcccgacaaaccttgcctgactcttccaattttttgttgacccaaacaataatttctttttctgtggccaaactttcgccgctttgtgtgcattgtgccaaaatagtcaaagtgtacgcccgcataagctgccagacgagtgctaaaagataactttttgtaaaaagaatacaaagagtgtcgacccaaagtgagtgtggggttcgcgtcgtaaatgtccttgccctgaatgccgaccagggaaaagcgcaactgtttgcccaattcgaccgcgtagttacagttttgtatttggtccatcatgctttgtaacttgcggaactgcttcaccacccgcttccactggacaattccaggacgaatgcattcgtacaactgacacattttggacagaacgtaaaatatactctgaccgataatgctttgaattaaaagttaaaatcacttgaaaaatcacgaggccattctgcagatccgagtaaatgtggttgacaaaagggtccactcccaaactgttcatccaattccgataagttttctcttcgcgcgtctcttccgtcacttcggtaatttgtgctgaattaaaaagccattcgcacatttttactcatttttttcatacgaatttcatcagcgcccggctcgggaagggcggggaatttgttgaacagattggcaacgaaggcaaggttcagtttgtagttgcccttggccacatcgtcggcagtgacaaattcgcggcatgcgattttgtccgcttcgcgaagcattgcgtcggcacgtggcacatcacccttggcaaatcgtaatcataacacccaaaaacaaaacgtacgtgcacattcaaagggctaagcgaaacggcggctgctttcggtgcgatttgatgcagcaaatacgtgtaaatttccgagtcggtcacatcggtggtgaaatttgtcaaccgattattgacaccggcctaaaaaccttcgtacaaaatagggaaggggaccacaaccttttccatgtgataattaacccaacgcattagaatttgctcgggcgaaaggcgccgcaaatcgtccaaagtttcgccttcctttagcaaacgaaaaagaccgggcacgtggacaaggtcaatttcgcggaagagtccaatctaagggcacaaagtgtcgatttaatggtcgaaagaaatcattactcggatgatttgccaaagcaaaccgagcaccaaatgaggcttccccttggccaagtcatccgcatcaatgttgacgatggcacaaccaatggcacgagcggaattcaacgccaatgtgaggttctcaagcctggtgtacgtgttcaacacactcgtgttcaatgcacgctcatcaatggtctccggaacagccaaattgatcattttactgaaatagttagtatccaatgtttggtcagtagtttggcagtttcacttgccaaatgatcagtccgtcctttactttcccgtaaaggtcgccacctttcagcgggagaagtcccttcaggtgttggtcctctgacaaactgctgtttatccaattggcaaatgcgacctcttcctataacaaatgatattctgctctcggcctgtacccttcaaaaaacaccaaatggcgattctgaattgccgaaattttcgaaatgggggtgtccttcccatcctccgtctcatattcgcttttgtcccacctccactctgatggtgtgtacaatttcctcagccccatgctccgcaatgccctgcacttggtaagcgcctgtaacactgccaatgcgctttttccatcgcgccgtctccgcatttcgctgagtgtccaagtccatgtaaatggcttcgaattcagaacaattcaaatgttttgggtcgccatgacgcgataaaagttcacgaatcttaaaacaaaagttacttatggcattaagcaacgaatgactgagtccaaagtcgacctggtacccaggaaggtcaatacccaacagtttcagcgccccttggacttcggtggaagaaatgaaaccacttcctccattttgcagaagctaaaacaataaaattaggtaaggaagaaacaaaggaggttatagagtataccgtggggtagtgttcccgtaattcttcaatctgatcgccagcaaaagccatataatgatttattagaattgcaaaaatcctaaaaatcaaagttcgaaaagagagaccacaattaaacaaaattaaatggcagagaatgcaaatctacaaaataaaataaatgaagaatgtcaattaagcaaagccctatatatgtcccgcattactgtcaaaactaaacgatttatgcaggcataaaaagtgatgggatatggcgccgaaaagccaggaaaaaatgtaggctcgcattttaggcacccaattgacttttaagcgtcctatcaagatcatcttcaattttttaagccttaactttttcttatttggtcaaggtcacattcttggtatcaaacgaaagctaagactcgggaatctataaatacaagagagcaaactttttttttacaataatggtgtctatcagaaagaggacaaattcggtaatacagtagtttcccgctcccctctcattgaaaaatttcaaaaattatctcataaaacacctagagagtttttagcatcgttgaacacgaatcagaaatccatatgcttatatgtatatgaactgatccgctaatggaatggcaattactcattcccattgaagcggctgaaaaaagcattagaaacatcttttcagttaggctacacaacccctttttctccccttgcaggggactctctcctcgcgaagtaaattcggtacaggcgacgcatggtcagacaaaagcactttggggctatggaggaagggaattttttgtgagtggatggacagcgaaatcgaatgaatcgaattgatggtgacggagaacagtaaaactttgggaggatgggcagggcatggaaaggatataaaatggagaggtgggaagaaggattgcgcattatgtccggttgggcagacaaagcgaaggagtgaacacaaaacaacatcagcaggacgaacaatcgcacactcttcaacaaaaaagacaaaatgcccattaaaaacaaacactttcatctaatcatcgtgggaataataatcataattatctcacaaattgagcgaaaagatctgttccggtagaataatttatatcaaaaaagatgtttacattaaaaaaaaaattgccaaacgctcaatggaagagaatatggggaacaaaaacaacatttgtaatgtttagagagaaaatgatcagcgaagaatgtttatttcgagaaaaaaaatggaattacaaagtgaatgggggaaagggtgattaataaggaacggatcgattgacgaagaatgtgaaattatttgtgtatttatgcatgactcatcaacatcgctaatgcattcattcccttcgcttaacatcccattctcgactttatgtcgacatttttcgttttcggacatataaccgaaattattgggaatttacacatactttagaataatgaatcagcaatttgaaaatgaactatttgagtgttcgtataaaatggaattaattaattaatttttattatgccttctttacacagcgtccgggaaatgagctcctgtgccagaaaagatttgcatgtgtggcgaagtggtttttgtaagatagtaaagggacaaagggtggtggttcgagtccgttgtgcaacatgaatattttcatttatttttgtccaaaatattaaaaaatcacgatatttgggaattatttttgaaggtttttgccaaccaaattggataatcttggtatctttcgaaagctcttgataatgagaagctttttctaagcaaatgctaagcgatttggtgtaccagagaaaagttatgaggctttaaattttgtttttcttataacttttgaaatagagcattaacaaaaataaattcagcattaatcgatgcagaatttttttctctaacgatatgcaaaatttcctgtggatctaacatatagaaaagaagctaaacatagcgaagtaaatgttgtttttcctaataataaaaatattagatagcacgccaaaaggagacaaaaaattagagaaaaaaagataatgtttttctctggcactctctatttattggtacacatctcgttttttcggacggtgtgtttaattaaccttagaaatattgatggttttgatgggattttacgaataataaatgaatgagaatggcgaattctgcgggagagtgacccttttctgaagggcttaaaagggaatgataaactcacaatgaaacactgctaaagtgaggggagggaatggacaacgccgtctttacattggccatcccccggggggggggggaattcgaagccaatgcatttggcatgcccaattcgccagcagctgtcagttgggactgacaaaaattaaataaaaatggccgaatgaatgagtgaaaacactaatatgtggcctttggcaaaagcaaaaattacacaattatttgaaattgcaatggttggggtcggcggtgtcagaagatttgcttaatctctgccggagccgctgatctcttttaatctttgtcggccgtcatcaaaatgagaagatgagcgtgctgctaatgctatggaaaaagtggtgatggaaattaaatgaatattattgtaattagggtttgaaatttttttttgtgagtagcgacagccgaatttacaaagaagcatttgaaaataccattgaataatcaaatgaaatatttatggaaataaaaaaacaattagcgaatggatgttaccttaaangctcggaattttgaaaaacctaatcaaaaatcgtgaatctcaacctgacttaaaaattctatttatcctctcctggtccgggcgcttttttcaaaaattcgtaacacccttggaaattttgacagggtccggcgagctccgatttctgatagttataaattaaatatttttggaaatatttaaaattaaattaaaataattcttttatttttctctctttcttttcattttctctttgcttgtccgatggtttccatggcttccgttggtgttgtaaacattcagcagaataaatcctttgcattttcccctttaaatttcttatggtcctttcggatcgaatggctcttcgtattgtcaatgttttgctgttcgccgtcacttattttgcttggttttgtgcatttatcgcaggttaatccattcatttttcgaccgatttgcttaaaattctgacaaatcatctcccccccccccccacttaagcctaacggaattccaatgcttttttgagtgcttctcaaagt

SEQ ID NO: 1309 - DNA, 1187 bp, Heterodera glycines
cgctttttgtcgattttttttctcgatttccttatcacttttgctatgttttgcaagccaggccagaaaaaaagaaatctctaaggattttaagcttttagggtctttggcgtcggtccaacacttttcttgagaagccaaatgtccaattcaatgaacacactttgttcacctttgaatcactctcacaaaatgaggtcgtccaataacggtcacttattaattattttagattaattaatttacagaaaaaaatatttttttggagtccaatggccaaagtgaatgaaaatgtgacagatcaatttgagttacttgtgccaataattgaaactattcacaacgattgggacggggactggcgagcggacgaagttttttttttttttggctatttccatctaaaaatgttaaaaccaattaagatcgaaattcgggtcgctttccgacacaaaacaaattcgaattcttcgccgtcattttcgcttaatttcaccgcattttcttatgcattgttttttgatgtaaaattggagaaaagaacattagttgaggtgattgtgaaaaatattatgccacaaattctatctttcagctcaaagggacgccaatttttggaaaaattcaatcgaaaaatccattcaacgaaatacagtaagaaaaaggaatgtttctttaatttaaattacttttatccattcaaatttttagtgtaatcggctcaatggattttgttcagcgtaattttttgccagcctttggaaatttaacttttgctcaatggtccgcacaattttctgcggatggatttccttcaaaatcctcaccagaggaaattgactggcaaatgcgcaaatggtcgatggaacagaattttagcattgttttgggcaggtgaaaacacttaaattataaaacaaaaatatgaaaaaatagaaaaattgaacgcgttcggatgacaactcatcagagacttggcggtggcattctttgccaattcgtttttcatattcgaataagcgaacagaccctacagtacaggtttacttggaatttggtacttgattacataattttcatacagaaccaatgcttgggagatggtcaaatgggcgtgggtacagtacttggctctgtttgtcgttgtacggtatctggccaatacactttcttcatttctttatcag

SEQ ID NO: 1310 - DNA, 2131 bp, Heterodera glycines
cttcttttaggcaaatgtccaaaatttcttaaaatagaaaataaccaaattaaatttttatttggttttctccttaagttttaatataaaaaaatataaattttgtatgcctattttgtttttcgccatttttgtgccgaaaaaattcctattaattaggtatttcttgatttgtataagcataaaaaagactccaatgagtttatctgtcttcttaattgatcatacataggtgcacagcattaaaatttcttaagtgtcaatatcaagtaattttactaaatttaaagctaaaaaatgcttaatcgatatcaattaatataacttaatttctcatcaatgatttttaatccttgataggattttgataaaggataaatttttggccattaaaaataacaaagaatgaaacagttttaattattgaaactaatttttggtcaaaacatttaaaaaagcgaaagatttcaattttcgttttttttatctgggatataatattatatttaaatttaattgtaggagagaatgtcaccgaagtatgaaatgcccgtgaaataattattcttttagaatgaaaatattaaaaattgtctacaaatacatatgtctctgtctaataatttcccaatataaattcataattatttcacggggaaatgttagttttttcgtaaattgatttacaaacaaattttaattagttttattgatttaattaattaattattccaatgacccatttcctgccaaaaaaatataaaagttcattatttaaattaaaatttatagaaaaattataatatataaatgaaatattttatgaacatttttatttgttttatccatttttacgaatgtcaaacgattgaagaggatatttttgaagaactttggaaacacataaacaaggttgaccacaaatttgaaagtgaaagtgtgctaccaaaagtcaaagaagagccaatcgaaattgccaaaaacggagtgccaacaatcaaaactgaaccctatgaattgccaatgaattatggaaaaactgtcgtaaaaaatgaaccttgtgaaaatgaaatgccaaaaactaaaaatgatcaacaaattcaaagagaaaagactcatttgacaaattatggaagaatcgtaaaagtaaaaaaggaaaaattcaatgctgaagagcccctgtataaagaagaggacaatagggatttaaaatgtgaaaatgaatgctatgaaaacagttcaacaggtaaaattaaatttaaataattaatcagatgtatttataaattaggatcagatacgaccgatgataattatgaaattgaggaaagtgctaatgatgattatgataacagcgaagatgatgctgatatcaataatgttcctaatgagggtaagtcgatttttcacatttagaaattatgattatgaaatttttctttaacagattcctcgttgacagatagtgaacaagaaaaaagagtgcatttaacaaaaaagagattaagagggattttcactaaaaaagatggcccaaaaaatggtaagaatggagcttggatttgagtgagaggatggaagaaatacattaatttttaagtaaaatcagttgagtattatatgaaattgaggtaaatttcctttttttatgaaaaatttgctcaatatttagcgattattcttaaaataatctacttttggaaaatatccttattttcggggttctttcgtctaaaaaaaaccttttagccaaattgttccgagcaatgagctccacggaagagaaagtgcgtttggctcaggcaaaagcaaccaaaagtacataatttaaatatacttaactttgaatccttctcctccttctctgtaaaaggaatctatttaaatttaatttttcaaaatttttatattaacataaaaaaaattttaaaatcaattgaaaattgtatttttttattttgggaaatcatcactaaaatttatgttttttttaaattttaaatgcttaaatttcagctaaaaaattgtctgacaaagaaaagaagagaattacgaaacaatttttcaacttaaaagaacatttggaaaatgaaaaaatgccaacgaaaatgttagagaaagaaattgccaa

SEQ ID NO: 1311 - DNA, 1437 bp, Heterodera glycines
  misc_feature (12)..(12): n is a, c, g, or t
gaaaaaggactnttggcatgacaagtaaattcaatactttctttaataaaatttctgactattttttttattttttggttttttaattttcgaaaagttaatttttcaagtgaaaatttaaaattttgtaggtcaatttttattctgccatttaaaataattattttttgatgacatatttacccaatacaattttatttcgttgaaaattttgtttttctttttattaaaagtaatatttttatttcttgctgcattagtttttattattttttcaatttgaaatttttgtaaaagggatttttaagaaataaaatatataaattgagactttttttaaagaaattcaatataatcacatttcttactcagattaattagtaaaaataaattattaaaaaattggttttttcagttattttgaaaaattatttttttcagatagcaatcattgtcatgacgattcagagaaaataaaaattgtcaaaaaatatttcaaaatgataaagctgaatcctcatctttctaaaaattcctttgctgagcaatttaatattagtcaccgaacacttaataattggatcaacaaatttgcgatgaaaaatgtaaataataacaaaagtaaaataaatttaaatttttgatttagcaacaaaatggcgttctcttctgctgaaatgatcgatcgtttaaaaattgtttgaattattaattgctattattagttgccgctaagaaaaaaaactaaagtttagaaataagttttttagtttattgaaaaattgtaaataatttattttattttttcttataaaagtttaatatatttaaataattttcatattgtattcgttgcaaagtttttttttacaaaaaataaaaatttttcaatttaaataaaactcaatgttacggtgggtgccttcaaaattcagtattagttagtgactacactatctataaattcatctatttattaaataaattttcatttaaaaattaaaaatgtaattttttttaatagtatcacaaaaaataaatcagtattataaatttttttatcccaatgttaataaaaccttaaaatttaagaatttgaatgtgaaatacttatataattcttccctccctggcgattttgtttttctcttaattacaattaaattaagacttaaaaaatatttaatgtggccaatgaataaagttaattaattaaagtgggttcgttttacttctaaacaaaaataataatcataatttaaaacttttgttcagctgttgttgcggaaatcgcctagttcggcgccgtttgttataaattatgtcgattatcaacaaaactaaaaaatttttgttcatttgatagctcttaaggttgattggccacttgtgaaactgtaatttttgatacgaaaaatatgaaaaagtggataattt

SEQ ID NO: 1312 - DNA, 5011 bp, Heterodera glycines
gcacttccattcccatttcttcggaattaattcgtcactcatcttcgggtttgcttcttttatttcaaaatatcgcttcatcttcatcaattcgtcctcatcggtacgacgttcttaaagaaaaagtacaatttaatttcactaaaataattcttacttttacttttatcgtattttggtgccaattcttttttccatttccaaaatgtcacttcagaaatgcccaattccttcacaaattctttctgtttgccatgggcatataaatctttaaattcatcaaatcgttcaatgaattctttctttttctcctcataaaaactctttcccatctttttaattatatttaattcaattcatttttccatttttgtattaattgcagatttgttcctaataattttgcaatttttctctcaattttgtcataatctttccttttgtattttattttttccttcaacttttctttaattgcttcaaattttttaattatttctctctttttgtgatcatttttcatttgatcatttcggtcatttcccatttcttcacccatttgatcaactgctgctgattgtgagttctcatttcgttcattttgttcaattttcactgtttgttcactttcttttttgtcccatccgttgccaaatatttcatcaaaatttgggtcggattttgccggattcaattacaaaaacaaagaaatatataataaatattaaatacaacaaattcatttttacaaataatgaaaaaaataataatattacttatttattgcccattttttttcgttttattggcattaatttgcaaatcgataattcactgattttttaaatatgaaaaaacatttattttttaaaataaaatcagctcttctctactttgaaacacactgcttctactggtgaataataggctaacattggctttttttccagtccgttgattttcacttttatagtgaatgcgtgtaatttgtaatttaatgcaatgtttttgccgcccgcaggcggggcaaatgaccgctaagttttaaaattaatggtatttaatcgtaaaaagaaaaaaagaatatgcattttatttaaaataaatgtacaggaaaatccaggttgccgaaaaatggcctgtgcctgtacctggatccaggaaaaatacagggctggatccaggtacatgttgttctctaatctacacccataaaacacagttaaaatcgggaaggttgagaaaaaattctagggggttgtgaattttttgaaaatttgaaaaacccattggaaggtaaaagtttttcacttttttttgtaaaatttttgattaaatttttaccttttttaatttttggcttcgcgccaaaacatgggcgccaaatcgtcggcgccaaaacgtgggcgccaaaacgacccagtcccccattcctgcacaaaattggctgtgctataaccaggctgccagataaaaatttgaaatctatcattttgccaaaaaaatcagcatttggcgttaaaaagcattattttcaaaaattttattccaattaaaaaatataataaaaggttttttttgctgtacgtttttccaaaaaattttttttgcgcattgaataggcacagataagcacgaaaaaaattattttccacttggattggggtcaatacgatgactttcataatacctattcttacctatttgggagtttttctacctattacctaggtacttatttttatacctaaccatttggatcccgatttttttttacattttatgtacttattttgaccactttttgtacatatttttgccagccctatctatttgttgtttctttaatctaaatcctttccctcttcttttttttctttttaaagtttctgtgtaataggtacgtaaatgctgaaataggtagaaaaatgggtaaaaacaaaattgttgttaacaaatttctgatagtaaataagttgatttaatgcttttttgttaaggatttttccggaaatcctgaaaaatgcccaaaaattgcgaaataggcactaaaattggcattaaatttttgaaaattttcagcattcgcttaaaaaagcacgcccaaatttaaaaattttcccagtggcgcctatcggcaccgccggaccctattttcccatatttttgataaatgctccccaaaaaggcaaaaaagaaggtgtgatcaaagaacaaccacccactagaagagagagacaattttagacataaaataaaaaagtattatagatcaaacacaaaagaaatggtaaaataattgaataaaatgatgtttttatattgtcatgatgttcaatcaaataaaaatcactgctcaattagtggtagctaattgtttcttccaatttataagcgtgtttcgtgaaatttccaattctttagcaattattacatcgctcatttttggatttttttcttttatttcgtaatattttttcagcttttctaatctgtcctcattgttatggttttcttaaataaaagttacatttaacttcataaaaaatatattcttactttgacttttataatattttggcaacaattcttttttccatttctgaaatgtaaattcacaaattcccaattccttcataaattctttctgtttgccttgaccatttaattctataaattcatcaattcgttcaatgaatttgcgctttttcgcatcatagaagcgctttttaattttacttttatttaaatttaattcatttttccatttttgtattaattttctatttgtgcctaataattttgcaatttttgtctcaattttgctttggtcttttctttgatattttcctttttctctgaacttttctttaattgcatcaaattttttaacagtttctctcttttgctgatcagtttcattctttttataactctgaacacttttgagaatgttttgatcattcaaaccgttcatttgatcaattgggtcatttcccatttcatcaccgtttggttgaagaaaattaacaaatttcaaatttttattttgcttcttttgttcattttactgtttgatcactcccatctttgtcccatccgtcgccaaatatttcatcaaagtttggtcgaattttggcggattcaattttataaacaaagaaaattatggaaaatatgaaatgccataaaagcatttttgtggaaatcaaatttattgctgtaaatgattatatttaatgttatattcgcatttcaataatattatttccacttcaacaaatatttttaaaattaatacatgaataattcctaacagagaaatcaattttttactcagatttaacaaataaatttcgcaaaaaataataaaaattaataaaataaagttgattgcttcaaattgtttattgaatccacttgcctgtaaaattttcaaaattatttttggtgtttgttttttcgttaaataaattgtgcaaagcccttcagatgctctattagcctgcaaaattccaaaacatttcgaaaaagttcgagccaaaaaagttggaaaatttggttttttgaactctactgaaaatattatatcttggactgtttgaggcttgaaacggacgaagacatatttttatcttggtttgaagcttcaggatggagtttctatatccatattttctttatttcgcgaattatgtcatattttctttcatatttgtccatattttgtaaagttcattttatagtaaatttttctctttgacatagtttaaattcaaattctcttaaagattgataaatctgttcaaaaataaacaaaattttgtaattaggttgttttttcgttaaataaattgtgcctttatttttttattaaatgattttaaatacctatttagcctttgtgaagcgtttactttatatttagcgaatctgaagaaattttgagaaattatacccttaattttgaaaaattgtgtccatattcttgcaattactttccatatttcatgttttttggtcaatactttatgaccattataaattcccagcctagttatgacttttatatgtagctaaccggtgaaaatttgtcaattttgctttttcacggaaaaaattgtgccattaattggtttaggaaatatcaatgataattttgacaatttttctaaaaagcaaaagcttacttttcatttatcaattaacacaaatattttgattgcaacatttattgttattttctctcattctcatcacagcaaattatgtaattgccatcaattaacggtcattctgcaatttttgccacagcggtgctgctaaaagaaacaaaaaacgttcagcattgtttcgcatcagatcatcatcatgttcctcataatccgcagtagatggaagcaaggaacgttgttgtccttgttgttgcgcttctaacggaggttgtaatggttgaccattttcaatttgttgttgcatttctaataaaatgaatgatttattcaaattaggtcataattttgaataattgaaaacacaaaatccttaagagaatcaaatttccttttttttgaaacactgaaaaatatttttctattttttcaattttctttttttgatttatttttgaacatttcgccaataatgcaataaaaaacttgcccggtgtcaatggcacttctaatcgttccggcaaattgtactttttttgttgttcctcattcaatttgaaaatcacaagattggacgccgagtcgacgatgtaatgaacatttttggaaaaaagctgcccaattttgccagcaattcttggcagaaatttgaatagtttagaggcaatgttgagtaaaccccgatcaacagcgcttaattggtccaaatcaaaaccatcccgtggtggaaattcttggtcttcaatgagattgaagcgttcatcttcttcatcatcattaagaccatattttgcatgattaatttttgggttcaatcatttgccggtgccgtcgccaat

SEQ ID NO: 1313 - DNA, 7419 bp, Heterodera glycines
agcactggtaagaatgggggtctggtgagaaaagagaaggaaattggtggagatggagaaatttttagagaaaaaaaaataaattaaattatatatatttcatttacagatagaatatttttcatattttctttaccatttttatgtaattgaaattctaattaataaaaatatatcaatttttttttctttaatttttattcaatagtaggaatggtccgaccttaacttttgcaaaaactaatctttttactaatagccgtaagcggaatttcatataaaaattgagtcatctcaaaggtaacatataaaattattgaaatttatttcttaaatttttttttgaatttttattaaaagttaaaaattgcacaaagtttcaaagaaagcatatcgtttatatttttaaccaaaatttatccggatgatgcttttaaaatttaaattttaatcagaaatctatttaggtctaagtaatttcttcttcacttattcatcacaaaataaatagaaaataaaacaaaatattctcttactttgatttttatttgccttggccatgtaaatttttaattttgagaatttttgaaaaattatagaatttttttgcaaaaaataaaaaaaattcttttttttaaatgtatccctaaaaaataccaaaaataaatttttaaaatacttaaagatgtttataagcctaggttgcatgcctatttcaccctctacgaagaaattttatccaaaaaaataacaatttaaaaaattatttacatagtttgtacatattttgaccatttttatacatatttttgacatccctagtgttaatgaaactaaattttaatattaataaaaagattttcttagcaattttatttaattttttttcattcgctaagacaacgttttaaaattggcgaaaatttgaagaccgttcttttgctgaccaaaatattcccactgatctgcttgaactttctctcaattttgtgctttaaaactttgctttggctttgctttgacgcagctgaaactaatgctaacaaacaaaaacttttgtttaaatatcattgcttataattaggttttttgtctcaatttgatttttccttttgtattttcctttttttctcaactttactttattataatcggcataattcctcatctgattaatttgtgcgtttccattttatcagcattatgagcaaaaatgaataaattgagaattttctttttcgtccttaaagtatcgttaattgttggcattaatgtatcattcttatttgtcctcattatgtatttaaaatttaaaattaaacatactctcttgcttctatatcattttgttgagaacggttcaaaattttttatttgtttaaattgttcagattcaattaaatttctgtgagttttttggggtcaatgtcaactcgtacaaagggcaactcgtacaaaaaaatttctaagaattttcaagtaaaacttagaatttttagattaaaaaaatctaaatggattttttagcctagaaaaactttttaaaattttcaaaaaatttaagaaattaaaaaaatcagctgaaaattagtaaaacttaaaaatttttttaaaagttttactaggctaaaaaatccatttagatttttttttatctaaaaattctgttttagttgaaaattcttagaaatgtttttttgtacgttgccctttgtacgagttgccttttgtacgagttgactgtgtacgagttgccatgacaccagttttttgagacaagctgttatttataaatttaacatagtgttcgagccccgtgggcaggggtggcttttcgcgggggcgggggttggcgggggtcagagtcgcgggggcgggggcacgataattccgccctcgcgggggcggggtacacggcctttcttaagatcgaagggtgaagcgcaattgcttttattgaaaaaacgacacaacgaacggactctaaggcaactaaaaggatgagcgatttgaagagtattataaatcatgtagcttaattacctggtcgtttgttggtggtgccgcatcgggaatttggttagtgccagacatatacgccgatgcaatgccctttaaattacaaaatttttaaatgcattttgcttttgcattgtttgctcacaaaagttaaatgacgaggctgcggcactctggggaagaagccggctcgaagccgaaattggcaaagatggcggtgccgactgaagtggcgatggaagccgatggatgtgccaatggaagtggcgatggaattgccaatggatgtgccgatggaagtggcgatggatgtgccggtggtactggcgaaccgctgttgttcaccttaataatttttgttaaaaaatttccgactttttctaactccgttctttgaatgcttttttagctgctttaatgcattaaaattactttaaagggtttctgcactttatctgatgcttctaacatacagttttacattttatttgactttttcctactttttagatgttaatggttttgtttccactttttaagccaaatcaattgaggaaattccattcaattaaggaaattccagaaaataagtcaatcaaagagatcggtactgaaatcggagaccatatggactgaaatgtttaaactgcaaaatatcaaacaaaatttggcgtaataacaacattcaaaaaagttttttgttgcgttcaaaataatcattttttgtgttgtttgcacttctattcattcttaaaaaagcgtttttgatttagttacttttgtttagtttttcattgtctttttatgactttttagtgcctttttggcgatttttatcactttttaatcgacttttaaatttaaattttcagcaataccaattttgttaaacttaaaacgcaccatttttgtactcggctgcagccagtagtcgcgtgatggcctgcgacttagcatcgagtacaaaagggccgcggcgagtgccagccccaacttcaacagcatcgacgatttcggcgcggctttcgattgatggtcgtcgttcggccgtgcagtcgtcgtcgtaactgctgatgttgttgctgatggagtcgtcgatgtttgcgacgtacatcccgcacccggacacggcccaatggcaaatggcgttgggtccagcttctccaatgcgcttggccctatttttattgtattaactaatttttgccttttcatatattgctatttattaattaataaaaaacatcttagctcaaaaaaaccacattaatttcacttttgaacaaattctctcaacaatttctatagataaaaaaatattgaaatttaaaaaatacaaaaatttaccgaaattgtagcaataaattggtaaaaaaaatagaaagtattttggtattaactatttttgcctttttttagtcaaaatctgtgcaatttatgtcaaaataaatagtatcgaggcgatcaacgaataaaggaatgtggagccaaagaaatcattcataaaaattaatttttttatgagttttttggagctaattcaaagcaaacccccgcccccgcgggggcggaattatcgtgcccccgccaccgcccccgcgactctgacccccgccactcgtacaaaaaggcaactcgtacaaaagggcaacgtacaaaaaaaaattgatatatttttattaattagaatttcaattacataaaaatggtaaagaaaatatgaaaaatattctatctgtaattaaaatatatataatttaattttttttttctcaaaaatttctccatctccaccaatttccttctcttttctcaccagacccccattcttaccagtgcttattaagtgtcataaacataatttttatttcttgtttgatgcattaatcttccaaacttctatttatttgaagaatatttcattaaattttcaaaaaatcgaaaaattaaaaatttgatagttattttcagttttttggtcatttcatagttcgtttctcagctttacacacatcaaaacgcagaataattagccgagaattaattaaaatgctatcgctaagttccgggtttttcataaaaaaaattatattaaaaagaatatatttaccgattattttatcataattttatttacttaatgaattttattgaaacgtacattttttattactttcagaaccaaagtttcatttaaattaaataattttaaaaaaaattaaaattttagactgattaagattaatttaacattttttgagcttattattaacaaaattttttggcgaaataaaatggcgactgatacggtaacgacaccgtttttgtccgtccattactgtatgtgctgtggcaaattgcacaataaaaacgattcattggcgtgtgagggtgacatgttgcgcgaatattgggacgactatttacacattcaatgaatgtttttattaaatttgcaaattcgtgttataaaaattggaaatctttatttattttcttttaaaaatttcatttttctttttgcactgtaataaaaaaaatcaaaaaaaaatttcaatggactgaattttgactgaatattttgatggtttttcttttgcaaaaataaaatgttttgattatatttctatggttaattgccataaattttttaactgccattaaacggtaataaaaatccaataaattcgactataaatttatctctaaaaatgaataaaaatgaacaaaaaatactggctaaattcagattcattctaaatttaaccaaaagaaataaaatgcatattcttttttctctttttatgattaaataccattaattttaaaactttcataaaaaggtaataaaaaagccaataaattcgactataaatttatctctatagatcacctcatgaattttcatttttaagatgaaaaaatgaataaataacagaaaatttactggattaattcattctaaatttaatcgaaagaaacaaaatgcattttctctttttgagcgtcttttcactctttttggccaaggtttttttttattattatcaattaatttcttatgtttaatttttaaattaagcactgttcaaatgccattccgatcggtgctggtaaccaacgggatgtgcggcgatcaatggtcattgatcttcttaatgccaatcaagagtttgatcagttgcgaagtcaattggcgactgcatcggcaaatgatttgaacgctgaagacagggtttttggcgaccttttcaaaaaaattggaaacattgctggaaacattgggaactattttggtaagttttttattacattattagcgaaatgttcaaaaataaatcaaaaaagacaaatggaaaatcttttgcaacgtttcaaaaaatgaacttagatcgaaaaaaacctggaaatggtgaacctttacaacccccgcaagaaccaccacaaccaggacaaggacaatggcagccacaaccaggacagggacaaggacagggagaaggacaacaatatccaggacaaggactgcaacaaccaggacaaggacaatggcagccacaaccaggacaaggacaacaatatccaggacaaggactgcaacaaccaggacaaggacaatggcagcaacgttccttgctaccatctgctgcggattatgagtagcttttgcagaatgaccgttaattgatggcaattacataatttgctgtgatgagaatgagagaaaatgacaataaatgttgcaatcaaagatttgtgttaattgataaatgaaaagcatgattttttttttttttagaaaaattgccagaatatccattaccattgatatttcgtaaccccgccaaaggctcatttttcttagagaaattttttccgctgatgagttaaaaaaatcgtcactcaaggggcaattttttttttgacaattcagtatcaaaaaaattaagctatactaaaatgaagaaaagtattataacattataacttttgattaagaattagggctgtgagagaaggtttttaccgaggaccgagaccgagaaatgaccccgggaaacgatacgagaaccaagacccaaaaaaccagagaatttctcgactcgggaatcaagaaattaaaatacaattgattcaaatgtatttttaaaaataaaaattacattaaaaatggggtaggtcaatcagaatttttgccaagagtctggagggcgggggaggggggggggggggggtaaggggccaattttgcgagtgcttccaacaccgaattcgacgaacttttctgaacaaaatgagtcaatataactttttattactgagaatgtcgaatcttctaaacatttaagtcttcgagtttgctgatttgctgagttttattaacaaagaaaaagatagatttttgaactttgctgagactgagttggctagacggagttcacccaatattcacatgaccatggcaaaaaacatagcctgttcaatgctttattactttttttcagaagcaattagagtaaatttttctttttagaatttgaagtcctctatttaatgtatttatctttaaaatttcaaaaaatttcatagagtttcaaaaaagatcaggacaaaaaattccgacttaaggttttgtggaattaaataagcttaacttttttttatacttaatgtaaaaaaatttaataaaattatattctgatatagaacacctagatctattgaaagatatcacaaaaatttaatttgattgaatttgagccaagttatgaatttataggtcttacatttttttattttcctacaacttggcagtatttaagaaacgcccatggtgtcagtttttaagaaacgacctggcacttttaagaaacgcacccccaacccgcggcacgatgccctttctatttatggatcttatcaacccccgttttacgtattttaagcgcccgagcgagcttctttcttagaatgatatcatcatatcgaaatagaagcaattatttattaatgatgttgaattcgatacgatggagaaggctaaatagcctggggttttaatgcgcgaggagtctgtctggagtggaatggatgtaaaatggcacggatctgcacttttttctcgcaactcgatcctatgaaaatatggatttgaaaccgttgaatcgaaggcgattaatttatttatcgaacgatctcctctctgtttgtaatgaaagaattggcggcgaaaattctatttctaatatgcgaagcgtggaaaattccacgatagcgagagaagagcgactcgagaatgccgaaaaaaatcgtaagatgtctaaaccgaacctctgtgggagagatgcaccggaaaatatttttattattccgaatgatttttgtgcccgaatacttgaa

SEQ ID NO: 1314 - DNA, 2260 bp, Heterodera glycines
acgaaggagcaacttaagtgcatcatcctcgtgattgcacttcgcgacgagcaccacgatttgcgccaaaagtgcctaaaaatgctcgaagaagcaaataaaaacggcacgcaagtcacgctcaagcaaattgaagaggaattaaggaccattcagctggtgaaggacagcgcactcactttggcaaatcctcctgttgcaacccatgccattcacacccggccacaacagtggagggacccgaaaggcaaaacaccgcaacaacccaagagggccaacaatgcaaaggagcaacccgcgcgtccaccaaacaccaattatggcaaggcaagccgcggatcaccaacgcatccgtgcggctcatgtggagaatcggatcattggcgtacggattgccgattcaaggacgccacatgccataagtgccaaggacaagggcacattgcaaaggcatgccgacgcagctccaaccaagcgaaaaatcgcagagagcgatccgtccacactgtcgttgtcaaatcccactgcatgggaattggaaccgcagcaggccgctggtggcgactcacgttcatcatcaatggaattaagattttgatgaacatcgacactggtgctcaggccaccattctcacactcaaaacgtggaaaaagctgggttctccaaaattggacaaacccgacatcgaaacacggaactgcaatgaagtgccgttcaacatcgaaggaaaatttgtttgcgacgtttgccaacccaatcaagcacccaaaaagcttgtggcatacgtcagttccgaaatcaattacgatcttttcggactgccctggattgaggctttggaagtcatcccgcgtgaaatcatgcaccccgacatccacccaaaagctcaaccagccccagcagaaatcaacgccatggccattcctcagccaacccacaaaattttggatttggaatcgctcacaaaggcactccaggctgatttttcggatgtttttggccccggattaggccattgcactaaagccaaggcccatttgattctcaaacccgatgctcacccaatattctgcaaagcacgccccgtcccacacggcgccctcaatgccgtcaacgaagagttggaccggcttttgcagattggagccatcaaaccgattgagttcagccattgggcagcaccgattttggccgtaatgaaaaagaatggaaagacccgagtttgcatcgacttttccaccggcctcaacaattcgctcgagttgaatagacaccctttgccccggcctgaagacatttacacggccatcagcggctccgtctatttctccaatctcgacctccgagacgcgtatttgcagatggaattggatgaggaatccaaacacctttgtggaataaacacccaccgtggcctcttccaatgccagcgcctcccatttggcgtcaaatctgcgccgtctattttccaacatttgatggaccaaatcgtctcaggcatcccaggcgcgtttgcctacctcgacgacggcataatcgcctccaaaacgcttgaagagcacatttgtttcctttacaaactcttcaaacgaatccaggaatttggcctcaaaatccaattggaaaagtgcaaattcctccagcccgaattgctatttctcggccacgtcatctctgcgaaaggaattcgccccgaccccggacgatcagaagcaattcgccaaatgccgccaccacatgacttgagcacacttcgctcgttcctaggcgcattgaattattatggaaggtttataaagtccatgcgcgaaatccgcgaaccactggaccagcttctgcgaaaggacgtgaaatgggaatggaccgacgaacagcaaactgccttccaaaaggccaaagaaatcatgctgtcggaccttttgctcactcatttcgacccgtctcttccaatcgtcgtggctgcagacgcctcaaaagacggaattggcaccacaatcagccacatttttccggacaaatcagaaaaagtcattgagcacgcgtcctgcaccctcaacgacgcgcagaaaaactacagccaaatcgaaaaggaagcattggccctcgtttttgcggccccaaaaattccaccgaatgctatttggtcggaaatttactcttctcacggaccacaagccattgttggcgatttttggctccaaaaagggaataccgatttatgcggcgagtcgtcttcacgctgggcactgatcatgtcca

SEQ ID NO: 1315 - DNA, 6079 bp, Heterodera glycines
ttcaacgctgggcactgatcatgtccaatttcgaattcgacataaagtacatcaacacgtcatcctttggacaagccgatgtactgtcccgcttaatcgccaattatccccggccggaagaagacattttgataacaaatatctgcacagagacagattgctacatcaacaccatcctccaaactgcaactgatcaattgccgatcacgaaagcagaaatttcagaatggacgccaaaagacgaagtcctccgaaaaatttctgatcacaccaaaaacggctggcctcaaaagtgcaccgaccccgatatctcacattattttcctaagcgaaaggaaattttagagattgatggagttttgctctacggaaagcgagtgatcgttccgacccaacttcgtgaacgcatcatcaaggctctacacatggcacaccccggaattgtgcgcatgaaagccctcgcccgtcagcacgtgtactggccaggattggacttggaaatcgagcgtatggtcaggcaatgcgaagattgccagagcgcccaaaagagtccacccaaagcaccgctcgctccatggacgtcttgctcacgaccattccaacgcattcacattgatttcgccggtccctgttcagatggccactcctatttgattttgatcgactcattttcaaaatggccggaagtatacagaatggaccgaatttcgacaccagcaacgctccaagtcctccgatccattgtctaccgcctcggatttccagaagaaatcgtgtcagacaatgccactcaattccatgccgcagaatttaaggaattttgcagcgagtttggcatcaaacataccttcaccccgccgtatcacccgcaatccaatggccaagcggagagattcgttgatacgttcaaaagggccatgaagaaatgcgccaaagatggaaaattttgggcagaaaagatgcttctcgcctacaggacaaccccgaattcggcactcaacggactttcgcccgatcaattgttcttcggtcgaaggcttcgaactcagctgtctctcgtccatccgaaggaagaacaagccgaagtcatcaacccagccaaaatccgcaaatcacaagctgattatgcgcgaaaaatggcccgtcaatttgatcaacaccacggatcaaaatcggttgagtttttgccaaaagatcccgttttgcttttgaactttaatcgtggaaaacgattttggcttaatgggaccatcatcgaacgattggaaaaatccccgacgtatcgtgtccacgttccggcactcggaagaaacgtccaccggcacgcaaaccaactgcgacgccgttatcctcttgaggaggacggtaatgatacggtaaggatcccaccccaggctcaagaagagcaagactggacccatcgccgatccgcgagcctcctccgcaaccggcaccaattcgacggactcaggcaaagcgacgatctccgagtcctcctttggccccgcgtcgatcgcaacgccaacggaaagcgccgatccgcttctcgccaaacccctgagggttcagcttaaagaagggaggtgttggagtgttaaagaatttgaatttggcgcgcatcgattattgattaatgttgtgacgtgtcaatccctcccccttattcattttgtttatttaaacactccctccttccccacatggttccttctccattcatttgctattttacattttatattttgtactgcatttctcctccgacataaattgtgtttattattttattgtgtgtccaaagttgagacacaacaggttcattactatttttattctttagcctttagcaacgaaagaaaaatgaattgcaaattaattcaaataattaaatttttaagtttaatttttaataagccaacgaagtaatgacatgccatttcagaatttgttcttccatccatcataatttattaatcggttgatcaaaaattgttttggcacgtcctttgctcgtcctctcttttcttttccaagtccaatgtgccaatgtcgaatattttttgggctctgccgctatgaatgaattcgggtggcactttgatcacaaaaaggcgatggcacggctaaatgtgctttcagaatgcctttgtcgcctctcatttgtccctttcccccctctcactttaatatcgtccgcacagtcgtggattattcgcaattcgggctcaatttgactcaattcgcgtgtggtcccatccaaaacaaagcgtcctttgccatcggtatggcccaaaagtgaattttgcgattatttttattcgaaattcatttcatttgcgtggcacttgggccgcaggaattttcgcgcaacccccgcgccgtggcaatttttcggccattgcgctttttcctcagttgtcccccccccctttaaacaacctttgtccagtaaatcatccgaatctcccgggttccgatcaacgtcaaaaatggccaaattagtgtgtgctgcgaatgcgccgttacacaacaaaacgcccttaacgccaacgccttgaagccgaaaggaaatggcaaaagatggaaaattggacaaaaataaaaggagagaagggaaaggcaattgtgtgaagagaggaaacatcgaaagggaaaatgggaaaaaaagaaacaaattaattaatgggaaattaatttttaaggatcagctaatgaggcaatcaatgataatgggaaacattttgaaaattgcaattaatgaacgatatgagagaaaacgggcacaaaataaatggttgcctctcttctgatcagaaatcctttcaattggtggcattcgttcgccgctttgttcgtctcgcctctctctctctcttccccacactctttcctctcctactcgccaatgaataacagctgtttaatcgttttttgtacgttcaataaaggcaccgctaatcgaatcaaaaaaatcaaatttattgatagggaataacttttgatctttcgagagcttgattcttttaggggatgaaattttcatttatttatttttgttatgaaatgggcaaaatgtcaacaggggcagggaacctattttaggcatgaaaaattcaaaaataggcattttaatagccgagtcatagcgcaatttccggcaaataaaaaacactgtatgtgaataaactgatgaatacaattatgtccatactgaattctttcccctcatttgtcagtggactctgtccatactgaattggctgatcgcttcttcccccgtttccgcgtcattgtaaatgtataaaacgacccgaaatttgatgttttctttgtgcaaattgtcaatttgccattcttccaatcgccaatcgttcgtttctcttctgatcagtcgcactttctccgacgccgtcaaacttttggttggaattggcaattctctttggcggtgaaaagaaggaacgaagcgaatcgaagggaccattttttcagcgtttaaacctttggcggcatgcttaattagtttggacgtttaaaaagagcaaattgctcaattaatttgaatttcgacctcaatcagccgatcggtgaagtcgtcgccacaattgatcacccagcgagtgctaaatgcttttatgtgcggatttccattgaacaaaaggtggagcagttcatccgagaagatcgtcccgttcgctttgtccataatttccgtttggagatgtttcaaattgaattggacgtccaactgaaaaggccgtgactttgtcaattatcctttgaaatgccagaacaatcgcttttaatcctcacttggtcaaatggctcataatcgcagcagctaaacgttttgcatcggaggcggagaatttggtccaatttgttgaggttaagccattccaaaaagcgaggacaaaatttgggcattcctcgaatttcttcttcgaaaaacacttccgatatttgatgaagccaaaaaattaatgaggcggcattttgggcggtgacaaaagggccaatttgaacgaagaatttgtggccagagacgaactcgaacagaaggaaagtgggctcagtctcattgagaaacagcggaatttggccatccgccgcggggggccaacggagtgacgcgagccgagcggacaaatttggctgagaatttggtgggggaggggggggggggtaattaggtctaattagatgaaaatccactaaatgttctctaataattataaaaattattaccggtaattcgacgggaaaatcgctgagattatccgcgcggcagagagttttaagggcgaagaactgaaaaaggcaattgaccggcaattatcagatgtgaaatcacctcgagaaaggtcaatcggtagcacctgtgcaggggccaatacagggaattgtcgttgacaaatttgcaaagtcggcggtcggcgaattggagagagaccaaatgggcacgggggaggaatttgcaaatgtccaaaaggacttcgtaaggaaacatggccaagaatgagggaaatgaagcaaacgccaaacggaaacttaagagggcgagagggatttgtgggaagtgatgaaacagcgccggggggcaaaaggcaaaaagcaaaaagcaactgctggccaaagcaaaggatgggacgaagagagaattgatcaaacagcagtcaaaaccaatggatggatagagcatttatctgctgatccgaaagtgagtgaaaaccaaacaaaacgctgtgggggggggggtcatttgtcgtggaaagaaagaaaagaaagaaagcgtccgtccgtccgtttgatcgatcgtccgtttcaattttcgtctccgatttcgacatttgatttgctttttgtcctcctgccattcaaaggtatgaactggccaaacttgagccgagaaagctctgagccgtgacgctttgctgactcggcgagtccgaacggatggttttcgacttggaccgtgcgcgcgaacctcgcctttgactttggcgcgactgcggcatcggcgccggacgcacgggaaagtcgtcgttcacttcggcgcctaaaaattaatttcatttgaaggaaaaagcgaagggaccaatgctctgaaccatttaccgacatcagacactcgaaatataaacataagctaattgagtgatcaatcgacaaattaaacgggccaaacggaaaaatgcccaaaattaccgagcatttgcctttggacgagttgtttgtacagtccctcttgcgcaatcagttccctgtgtactccctgctgcaccactcttcctgcactaaccaccacaattttgtccgcattttccacggtactcagtcggtgcgcaatcaaaaggacagtccgtccttaattttgcttaattatgccttccatccttaatttctcttgggcttttttctccttttacaatgtcgtcccaatggcttttcctttttctgcgcacctttcaaatttttttggattgcttcttggacaagatgttctgattccgaatccaacgctgaggtcgcttcgtccaataaaagcaccgccggctctctcaccaaagctcgagcaatggcaattcgctgtttttggcctcctgtcacggcaaaattcggaatgtcttccgaatgctctctctcaccagacatttgaccgcccttctctcccacgtccgtctcatagccttgctgagtgtccataataaagccatgcgcattggcatgtttcgctgaccgttgcacagcctcaggcgttgcgttttcatagctatttaatcaatcttccttttattttccattctctttttcttttccgataacacaacttcaccactcctctcccccatccctccgtctccctccccctcctctctcctctcccctccttccctcctcttctcccctccttccctccctttctttcccttctcccctccattattctccctccgttcccccttctctcctttacctccttccccctctcccttcctctcttcatccccttgtctctcctcttcccttcctactcttctccatcgcacttttccccttctcttcttacccctcttcc

SEQ ID NO: 1316 - DNA, 1597 bp, Heterodera glycines
attccgtccaagcagcacttcgcccgagtcgggctcgtaaaagtgttcgatcagtccgatgcacgaactcttcccactgccactggggccaaccaaagcgaccgcttggccaggctcgacagtgaaggaaaggtcctcaagagaggtgatcaaatgtgttggaagctgtccgccgcttacgtttagcaccggcacattcggtcgggtcgggtaacgaaagcgcacttttctgaattctatgcgcccctcaatttttgcattgcgtccgtccggcgcaattcgcccgtcattttgcaccaacggacggcgatcgatcaattcgaaaactttgcgagacgcgccgaccgcctgcataagtccgttccaaacttcgcctaattccttaataattaattcttcacttccttttttctgttctgagttaaactctgaggttttcgcccaattggaattggtagagcataaaggagacgagcaatcccgagctgatctgatcagaaacaaaggctgattgatgaggggccattgacaactctttcttatgacacaatgccaaatttgagtggcatcggtctcagagaaactcataaaattcataacggcatggacaaacctttccttggatgaccaaatgtcctccgtagaagagtaccatcgtgaggattcccatttggaggaactgaaacaatgccaaatgaatttccccaattagcaggattaattgccaaattgattgcccaattcgccaagtaattaattaattaattagtctctgccttccgccactttgactcgcctctgtggtgagaagaaagccgatgtgtgccacagcttttcgcgctccaatgccgagggtaatgttcaaaaagctgaggaagcgaagcgactcgaaccgttcgcaggcgaaacttttcaccgtccgaatggaactgagcacttcctcggccacgtcgttggaatttgccactgagtgctgattttcttccgcaattcgcttaattaatcaattttaagctttgaattcttttttggatgacttacgtcgtaataaacgccaaaaactttggaaatgagaaaaataattggcacggcgatgaaagtgataacggagagacgccaagagagagaaaacatgaaaatcagagagccgaacagcatcacaatgttacgactgaagtgatccattggagtgatcagacaacagagacaaactgaccaaaacacgttcatgtacaaggatagagtgttggacattgtctgacagtcggcattcagacgagagcaaatctcgccttaggggaagatcggtgagggtacggtaataagtgcatgggtagggaatgggagtacggtcattgggacggaaaaacaaaactaagcaatgggtaattaataataatgacctgttttatttgcatcgaaaaaaccgatctaaaagagaatcttttcaaattgcaattgcctttcaaatgggcgccgacctcttgagaaacgagcgatcggaacaaatcgctgcgaatacggcgatcgattcgggccaaagaatagcaaaagaaaccgacgcgaaagccagcggaaacggcggcagacaatgaca

SEQ ID NO: 1317 - DNA, 3435 bp, Heterodera glycines
gtaaccgaacagtcgccacagcatggccatcgtctcgcgcttctgcgcgtccatttcgctctcgcgcttttgcatctccgcgaagtattcgttgtccacctgctcgaacattcgctggtgccgcacgtcgccgcgcgtgaccatcgattcgcgcacttttgcgaaaacggtcacccaaatgccctgaagcaattgggtgtgccgaaaaacgatcggccagggacctggacaaaaagggcggcgacgatacaccaaaccatcaaaatccaatcgccaacggcgaattgcatctcctcgtgttcatagaaagcgagtaattttatgggggagaaggcgacaatgaccaaaacgaaggcgaaagtcaaattggagaaggtggcacacgcctcggcaccgccctttgggttgaaatatacgccaagggcaccgccgagaaggacgcaaacgcggagaatggcaacagcctaaggcattttgggacgcatcgagaaaagcccccgggggacagaccaaaaaatccacggggttcagtgtgaagttataatagcggaagtcgaaccagtggtaaatgttatcgatggtgaaaaagcgaccatcccaagccaagccgagcacctgcggggaagtaaaacgatgatggaaaattgaaattagtcttggcattatcacattgacgagaatgtccagacaggcaaaacagcaagccaagccaagggcttgcccaggtgagtaccaagaggatgactcgaccatggcaagtaaaaatgggaagaggacaagcggagaaaaacagcaaaaggaagaagctgcggatctgaggaaaagcgatcagacaaaagagtcggggcggaaagtatcaagcaaaagaaagaagaaaagtgatcggagtgatcgggcaaaaaagtcgaatgtttcggtgcgcccattccctccacacccaaaatattcccctccttcgacctctcaattttccgttgtccgtcagtccagtgaatgaatcttatcaaagaaagacaaaaattagggggggggggggtaattagcaataaaatggcgaaggaaagacgaaaatatttgggagagaacaaaatagtacagagatgagaagagggaggggacaaactgataaaaaatgacccaaaaaagaaaatagcgacaaaaaatatatgaagaagccaaagcatagcaaaatttgcaatttaaacgcattttaatggaaaggaaattttcatattttttgatcactgatcaaagccatcgtaactaatgatcactaattaaagctatctgactgttcaatcgctaatcattcacgcatttaccattcactcaaatgttctcgacccgagtcggggaacatcgcgaaattgggacagaattgggaagcgctgaacaaaagcaatgggaggaaaaggaaaaaagaaataaatggccgcgggcaatgaaacattttgagggaggggagggggcgggaattagagctaaaatgtaaaattagcagagcaaactgcgaattgtaagcagcgaatgacagccaaagcaaatgaggagagaatgtccaattggacagcccaataaaaattagaaacatttaatatttcaaatagtgaaatagaaattgaaatcaaaattcaaataaaatagcacaaataatcggtccgctttttcctctcattcttctcaatattcgccgtatcctccgcccgttccccgtgggcagcattcgtacccacaacattcctgaatttttatacgcttttaataattgactttttgagttcgattccccccccccccccccctctgagttttgccaaatttcgacaaagctgtgctatttattgtttaagatgagttgaatttgtctcgacgtaacctcgtgcatctcgcaactccacacgatctccttgggcctggtgctgtccggcatgtacacttggccaagcaccgggtcactcgggtcgatggccattcggcacattgtgcgcgaggccatgccgtggcgttggtggtgggacgggtaatactgaggccctaattggcaatgcgtttggtatttagtgtggtaatgccaattgcttattaccccagtagtattgccggttgttccacctaaaaaatgacagaataatgcaaaatttttgccaattgttgcgaagggttggcgatgccctccccggaaactgacatcattggcgccgccacattccgaatgatcgctttgccggccttataagccaagaaaccggcagctgccccgacaatcatattctgttaaatgggaattcgtaatggtctcctgctttaattaatgaatttgacctcctcccccttcctctttttaccccttcccaaaatcactctttttaagtggtgccatagtccccttccccctcccatccgagtgccctctcatccaatggatgccattcttcccccgtgcggcgcctcactttgaacgtgttcgatcgtgagcgggagcccattccgctgttgcggaacatcgatgttttgtagcctcctcctcctccacccaacccgcgatggcgagaacggctcagtcccccgagaagccccccaccggcgacgccgcgtccgaccgcacctcggccaccgccccccaaaagtcccgcgccttttcccccgtatttgcctgtcccataacggtcataaccaccataattatgccgatttttatgtccaaataatcttccggttattcctccgcctctgtcacgtccatagcctcctatcgggtaatttgagccggaatttcgtccaagagcggaagaaatccttcaaaattcggggtaattttcgaattttgggtttagtaaataaaagtttaagcgccaaaaaacaattttttccatttgatgggatttaagcggtccgatcagaaataaattaagagccataattgacggatgagtgattggcacctgctccgtatcgaagttccgcgcgacggcgacccgcccctgccaaaggacgaaagaaaagtaaagagacggaccgatccaatccaattcagatacgatggaaataaaaaaatacgtaattgggcagtacagtaagcgatggtacactagtcaagtgagtacggtattgcccacctcccataagtgccacttcgcttgcagacaacaaaaggctcggcaataagggcgaggaccaaaatgagaacaaagaattttttcgaagaattcattttgaaagaaaatgtcaaattgcttcgaaaatttaatatttgggatgggacatcaaagggaaggaaccgacccatttgagtcgccgtcgacgctcttctgatggaggaaaggcaaggaaagccgaaaagaaaatcatctgtcgatgtgatacatgtcaaattgcaactaatgataagttcctcacctattgaaaccctgagatatgactgcatcaagacctgca

SEQ ID NO: 1318 - DNA, 2873 bp, Heterodera glycines
  misc_feature (2789)..(2789): n is a, c, g, or t
cccccccccgggggggggggggggggggggtgggggctcagttagatacgatagcatgccaaaagggaaacaaccacagccaaagaggaagcagttcatatgtgaaaaggaatttgtggttcattaaaagggaatcgtaatggtgacaaatcatttcattgatcaatttgcaccccaatcgaattttgtccaatttggctgttgcgatgttgacgttgcgctccactgctgcagagactgcggctgatgttgttgttgaagcgcgcttagtgaagaaatgtttggctgcaaattggcgggtaccaaagacggagtcgaaatcaccgaacgttgaaccgtcggttggccttgggcggctcgaaaaagcgacataaggtcatcgtaacgctccttttcccggttaagctccctcttcagactttccacttcagtgctgccaatgaacaaagaaattaggcaatttttaggatttaaattaacactaaaaatcgaattttttttgaatgcgtattcaaaaaatactttttttaagaactaacaaggtgttcagatatttgcttgcaaaagcagacatttgggattttgcgcccgatttcgtatggttatattttcggacatttgcgagtttaaatgaataaagagctaatgaattttaacaaagccgcaaatattcgggacgcaagtggggggtatccactagcaatgccatgtactaatccatttttacgttaattccgcgtttcgacgttccaactcaatgactaattgaggggacgggtgagacggtgcggttggtgctgacgttggagccatctgtccgggaatcgttgcaaacggctgattgtgagcaaaagatcgtttggagggcggtgcaaaatcttcactgacgaactcgtcacctcttcgtctgctgagttgcgctaaataaatgaagttttgacaatagattgagcattgctacagacacatttcctttttaaaataattttattaagggcatcttccagtggcattaatttgggttaaaatgcgctgttttcactgttaaaggttcgacctcctgccggaggcaccgccgggtaagcgccgaacgcaagcgacgaaggcgaaccgccgcagttcctgccgccgccaaagcgtttgcgtcgctcttcgtcgcgattgatatgccaatagcgacattgcgggccgcgcgcgcagtgtccattttggaactctttgcaaagcggaattccatttatcgtatcgcctttcaacagcgctgccaaagctcgcgccaacccaagcgtcacgtcgccgctgcgcttgtaacgatcgacatcctcgcgaaacgcgtgaacataacgacaattttcgcggtaacagccctggttctgaaattgcagcataaatggacttttagccgccaccgcagaaagtgaaagcaaatattcctatttatgcgcctgtccatttaaggaaaaatcttgagcgaacataatagacagatagtaataaataaaataagtgatacaattatttagtcttggtttgagttaatcgaactttaatgccaatacggcaatcctgaagaatgggtgttcctaatttaacttttttattttgggctcaaaaccagataggggttttaaagggtgctgattacggaaggggttttaaagggtgctgattacggatcttaactcggattttcccaattccgaaccctaattcgaacaaaaaaatgaatgtttttttcaataatgtattttttgggtaaaagcttctaatacattaaaaactatttattttgatgtaaaacaatgcttcaattgttaattggaaaaatatgcaatttgcgctaaaaatttgaccgattttaacgtatattttggaaaaaaaattttcaactttttgttcgaattcggacccggggttcggaataaggcaaatcagagttcagattcgtaatcagcatcctcgaaaactgattttgagctcaaaataaaaaaaagttaaattagggacacccattctccaggattgccataaatacgaaccttcccaccctcccaacactttgttatggcaaccaacgttatggcaaaaattgaggttgctgggatgacaggaaaacgagtacaaattatcgctaatcgactataaagttttgcgcaaaagcaattaagagaaagaagcataacaaacctgaaaatcaatgcagaactgataaggctcatccgccgagttttgattcttttcgacactgtcttccggatgataaaatttgcatcgattcccctcaaatatttagtgtttgatttgtaataaaataaaagtgagagagaacataccctgctgcaaatattattcagaaaatcacggcagatgtcctttcttttggctgcgtctttactgtcgccattggtcccaatagcgttgttaatgtggtcatcgtgagaaaaatcacgctcatttgtcatttctcgaaaaacctaaaaaaaattataaacgaaagtttgacaatagataatgttggaatagatgatggacaaacgctcccaaacgctccacagaaaacacaactcaacagcacaacacacatatttttttttgttttattttggaatgaacattttgccaaatttttattttttattaatttttcagttggaaagtggtttccatcttttgttttaactttccttttggttctttaagcatttccttttgttacacttagagatcgcttgactattcgcaagaatgactaaagccgaacaagctgcggaaaaaaggagaagagttgngaaacccatgagagattaaagatcaaaactctgtctcacatttgcgtcggtgagtctggtgaccgtctcactcgtgctgcaaag

SEQ ID NO: 1319 - DNA, 971 bp, Heterodera glycines
gcttttattgtctgcagtcaaggaatatgagcttaccgcgagaattttcggacactggcattttgggttcggcattcaggagcacatcgatttgggcataaagtacgacccgtcgattggtatctacggaatggacttttatgtggtgctcggtcgtgctggtttgcgggtggcaaaacgtcgacgaatccaaggacgaattggcgcatcgcatcgtgtgcaaaaggaggaagcggtcaaatggttccaacaaaaggcaattattttgggttaagtgggactaaattgcgtattttttacttgacttaaacttacccatctaatggaaattaatttttgttgtaaatctcacccttttcagtatgacggtgttattttgccacccaaaccgaaggaatcccgtaagggtggtcaccgcggacgtaagcgctaattttggatcgttttgttgaatgctattttcccttgttgataaattactatttgttgaatttggtacagtaaatttcttattatttgttaaagttgacaattttccttaaatacatcatctttgtttagccaacatgcatttcggtaaactcaaaaattaagattaattcgtgttaacaaatgatataatgaagcctctgaaaattgacgtggatttcccctcgaatagtcatcccacttcccaagaattaaaccaagattgtattcctttgtacgaaatgcttgaattcgaggaacttcaattcccaaactattacctttccgaacaattgggaaggggtgcccatgcgacagtgatgccgtgccatttccatgggaagccggcagcggccaaacttttcaatgccaacgtggacttcaaaacgatccaaaaggaggccaagctgttgcacgagtttcgccatgaaaacatcatcgaattgtatgttagccgaaatgtgtgacactttgaaatggcaaatagaaaggtacgctctttt

SEQ ID NO: 1320 - DNA, 2880 bp, Heterodera glycines
atgttggagtccctatgtcggatcggagtccccaagtatccggggtttccaattgtcgggtcccaagttataaatccctaaatgtcgttttgcccccaaatgcccaagtcccaaatgtcgaagtctccaagtttcgggatgtccaattgtcgggtcccaagtcacaaatccctaaatgtcgggtagccccatctgccgacaaatctgtatcccaccaaaactaattgatgtattatctgactaattaatgtacccaaataaaagggggatttgatcaattgtagggatatcagaccacacacacacacaccttgcgttcgattcttgaaatatttttcataaaaattcgcatttgacttttcttcgccttcatttccaaactggcactcacagtacacagcgggcaattgtgttgcatttttcagtttaacttctatatcattacaaatgttcaccttgtcaattgcatgcatacagtccaattggattaacttttctttaccttaaaattttggaaaaaaatcatgtagttgatgaaaaattattgacaaaaaatcaatgatttccaaaatctgagctaagatccgtgatcagcgcattttttaagcctagaaaaaatacgtgccaaatttttaagaattttttttttcgtcgggatgacacgggatttcggattctgttttccgacatttttgaggtcggaattccggtttccaaaattttttatgaaaggtcggaaatttttttttttgatttttttaaaataattaacaatttgtgtacaatttctgttaataaattgcactgaaattttaaaatttattatattttttcaaaaattttcgatttccgacgtttttggggtcgaaattcagaattctgagttccgaaaaatttttgggcctcggaatgccatccctaatccgtaccatccggtgagctgcatcctatgccataacacatggtcatgtctggagcaccgcaataatttccaagattcacactagggtgacggatgttgtcagggtccaacgtctgtttgaacttcatcgaatttgtttccaaaaactctccgcaactgaaagcgccactgaaaaattttacaaaaaattgaaaatctttttttttcttacggtaaaagtttggaattttaatttattttaatgtttgattttttgtttcactcttagtcttacattgaaaggacaaagttggcgaggaaaagaaggacgttgaagaaattcattgttttttttgttgattttttaaatcaaaaatatttcgatgtggcaatgcttaaaataaattaggaagaatatatgtaagccgaacaaagtttaatgaaaattgtttactagtaattagttaaccacatctcattagtagaaacttagccaggcctagtcgggattggcaaaaatgccctggttttgggcgcctgtttgatagcgaaattctcgacagaacagcaaagtgcggttaaaatttcgcgcacttttgttaaacggatttactttggggaattaatcggaaaaaatatattctttaacaaaaattaatgagatttgtgagaaattgaaaatcacataactataatcaaaatttcatctatgaaattaagtttattatctccaaattctccgaaagggtgtcaccgatccccgacaatttttcgttcgccgatcccggacaattttgagctgcttgatccacgagaattttcttgcccaaggggccctggcttaaccctaggattgagtatcgcccggccaaaaagtggagaagttatttttgtggtataggcaaaagccaaatgaatgcacagagaaacaggaagcactttgtgatcagaggtgattcagagaatttttgtacattttcattactaattattctcccattaacaatttgtccatcaattgaccgataaattcactttttaatgcactaaaagtaatgattattgttcattatttatccataaaattatttcctggcaaaaaaatttattcggaaaaaaggaaaaaaattcattaacaatgcaagcaccaatttgtgtggtgaaatgagaatgaaaatgatgtggttaatgctaaaaaaagaataaataaatgtttttttggtaaaaaatattattttgtttcaaaaataattttttatatacttttttttttttactgaaagctcggtttgaatctgattcattaaaaaaaaaataaaaaaataaaaatcgtctcttttaattgttaaatttaaaaaaaaaattccttttttttcattttcaaactctgttcaaatacaaaatcctatttttgtcattcattttccgtgtgcaaaagattattcgtctatgttgtgaatctgtgtatggcggaaataactcgcgagaaaaaagtagaatccggtccatacggtataaggaacggtacagtaacaggccacttcatcaattttgtagaaagctaaggatgtagttacagctgtgcaaaggatgtaggtatagaccaaaatctaaatggaatttttatatatatagatattatttatgtatgtataggtaatataaagtagaaaaattattttattttattttactttacacatttcatattttcggcgccagaccaagtttttgggctatcactttttttctttataaccaaatctaacattcttagtatcattagaaagcccttcacatgctctattagatttacaaaaagcaaaaagatttcctagcttgtaaaaaagatttataaagaaaaaacttaaaaaatttcgatttttttccaattttaaatttataacttttttggtaattcgaatcgagaagcgatagcttagaaactgcttttaaacatgtagagctttagaatgata

SEQ ID NO: 1321 - DNA, 928 bp, Heterodera glycines
ttttaatggtatttttgggccacagcttttaaaatattaaattttttttaaatttctgaggctaataaagataaacaatcaatggccggccacagaattacaccaaagcagattcatatatatatatatatatatatatatatatatatatatatatatatatatatatatatatatatatatatttttttttaatcataacctcctccgttttgatagacaagatgggcggcataaccgaatggaacagcaagagttaggtcaatggcggtgaagatgcgcgggtccatccacttaagagaggagcttccctaataaacgaaattatagtattggtcacataggagggatatactgaagtgtcggggtcggttttggcacggaaattattttaatccattccttaagccataccgatttaaagtttttaggtgttttaggcatattttcaaattttttgaaatcgctgaaaaatatattggaaaattcctcaaaatgacgaaacaacacaaaaaagcactaaaatgccaaaagcacgaaaaattaaaaaattgagaaagcaacaatataagcaggaaaaatataggtttaaaagcacgcgtttttcatgccgcttagctcgaccgaaattagcattacctatttttctacctattttgagattttttttatacttaattaatagggcttccttttttaggcaaatgcctaaaattttgcgcacttgatatgcaaaaataagcacgaaagacgcgttttccgcttggttagagatatctacaatgacctttataatgcctaacttttcctattttcgggttttttgtgcctaatgtgcctattttaaggtttttgaaaaaatctttaacaaaaatgcaataaaaacggaaaaacactccccccaagaaaaaaccccaaaaaaaatttt

SEQ ID NO: 1322 - DNA, 2236 bp, Heterodera glycines
taaaatttttggtttaaaaaattgtccttatttggataaaactttaaactatttaataaatcatttacagttgaaatatattttattaacaatatattatttgcgcatttttcattggctttgcacaatttcaaacaatttcgccaattcgaaattctaaaaactatattcggggtgaacgtatcattttatgtctcactgtactgtatctcaccttactgctgaaggcctcaagatcgcgtcgatggctggatgacatgacaaaagccggtaagactggtaaaagtgaggaaacaattgcgttggttgtactccagaagaaagacattttagtagacacactttttgggaagtttcaatattaattaatacacaaaattaagttaagttcatgaaaacttcaacttttcgagaatttttttaagtgccatttatgctataacttatgttaaatttggtaattttatttgaagttacttttgcaagctaatagagaaaaagctgtactatcgaatggtaaaaagaatgtagaatttgattgcctttaagcaaaattatggcatgtattgtcgaaaaaactaaaatggcggattttacgaaacgcccaaggtgccggatttacgaagtacgcgaccaagcccaaccagataaatataaatttatcgcaagattataaaattattgaatgaagagagcaaataattagggtagaaatgcaaatggggcggctactaatggacgctgtgtgtgacagctgtcccaattttatatccctctcggcaacacaaaataaatcaaatgcgaagcgcaaatagatgcgccgccaggcacgacatttgtgagagctaaaagggctgtaaaagtgcaaacattttaggattatttgatagcctttggtaatttcgaatggtgctaggtcgtttcttaaaactgccagggcgtttcttaaatactgccaagtgggcgtttcttaaatactgccaagttgtagtaaaataaaaaatgtaagacatataaattcgtatcttggcccaatttcatccaaattaataattattggtattattcaatagcattaagtgttgtctatcagaatagaaattttgaaaatttttttacaaaattaaaaaaaagttatggtcataaattttcaatgaattttcagtcaaattattttaccagaacttttttaaaactcgatggaattttttgaaattttattcataaatagagaattcttaggactatcgaatatataaatttattttctcttaattgcattttaatgccttgaaaattttaattttttctggacaaaaaattccgacttaaggttttgtggagttgaataaccatatctttttatatacttaagtaaaaaatttaataaaattatattctgatagagaacacctatagctattgaatgataccaagaattattaatttggttgtatttgagctaagttatgaatttatatgtcttacattttttattttactacaacttggcagtatttaagaaacgcccacttggcagtttttaagaaacgccctggcagttttaagaaacgcccatcgtggcagtttttaagaaacgacccagcacgtccccgctggtcctccgtcgtcacagtttcggtgtcactcggcgaatccctgccaacgctatgccgggggaggtcgtgtataaaattcttaattctgaaagagagttcacacattcgcaattttttgcattacaagagatattttattttatttttacctcttttttgaagaaatttttattaaggggagggttatgtttggatccgggtgtgtcgcgactacacgaaaaatagaaaaattaaattaaaaaataaaaagcattaaacccaaaaagaaaatatttaaattaattttaaattagagagacaaaaattaattaattaaatgtgaacgaaatgaaggaatgagtgaaggaaggaaaattattagtcatattagtcacaatttttccattcgaaaaattgtcaaatgttaaaaattaattatgaataatcgcaacgttaaaagaaataacaaattataaagaaatgttaaaatgggacaaaatgtgaatgataataaagaaattgtaaaatgttagaaaattgggaaatgctaaagtggcacaaaagagaaaaatgagaaatgttaaagaaattggcaaatgttatggacagaaattgggacatgccaagttggcaaacac

SEQ ID NO: 1323 - DNA, 3235 bp, Heterodera glycines
aattctacaaaagattggtccgcaaaaacccgaaaatggtccgtaagaaatgggccgcaaatgtcagggatgcaaatgtggggtaaccttcatagcaaatgcgaagaaagaatatgcaaaagcatacaacttcgaaccctagttataacatttggattgtcgtcaaaaataataaacttggtatgatttgaaagcagacagtccctattttttattcgttatttttgtcgttggcttataatcgttttaataaaacttgataatagtagaaccaaaaaaggcaaatgcaatttattgggatattgccgaacaatttactttgatggtctaatcactacagaagcgatggaaaagtcaattcaggcagcccgtctggctaagcgtttgagccgtctcccaacaattcttcgacatcgcagttctgctggtcccacggggcgtgaaggccgccctggttgcatgcccacacctggcagaatgaaaactggttaatatctgaatgaatttctccgccatttttaaatataatttttataaaaaattcttaattcagaaaagaccggcggcggctgtgcgccaatgcatgcggacatgcaaagcgcccacgctggaagaaatggaaggaacggcagacaggctgagggacagccgagtatgcagaacggcccaaatactggagggcaagctccaacaaacatctgtaaaatcaagattataatcatgagatgcaggaaaaattggggcagaccccgccccaacctcagcctttagaccagcccaacaagcggacacgcacaactccgagtttccacaggcagccaagcagatgtcgtaagcggttggcgcccccattgagttatttgataccaataagattaaaaataagcttaatcaaaaatcattgccttattaccgtagaatttttattggattaaattttgtaacttacattttgttcacagatggcatttcctaaataatttaaaaataaaaataaaaaagaaaaattaatgtaaatgggcatgagaagcaaatgattgcttttataaaatttttttgacaatttaaataaaagaatgggacaaggctgctgctgtgctgattgaaggcaggcgttttctgtcttggccacaaaaaatgtaaaaagttatgcagcccacaaaataacgacgaaatttgattgaagagtatcgttatcgcataaaatataacgacaaaatttgattgaattgtcgtttatcactttttcgtacaattgcaaagcaattttcttttgtcagttaatgaatgaattcacatttttaattgaatcatcaatttccaaatcgttaatgtttgaccaattgatcatttttttatgaaattatgatgtaataatacaaaattatgtgtttcaaacaatctttcatttaattttttctagcattttgaaatttttatgcaataatttaaattttttataattatagttttatgatttattgaaattaaaattcattttttatttaaaatctattttcttttcctttttttgattacaatttaaaaaataataactgattacatttaaacagatttttaacatttttttacttcctcttccgggataataaactgtgataaaatggattacgaaaatccgtaagaagatattcggacctattggcccttgcccgttcgtccgatcatttatttacccgtgatttcctaaaaaattaatttttttttttttggttttaaaatagaatgccaaatatggcactgattagggatgtcaaaacagcaaaatatttttttcccagatttcactccgcgaacggcctcagtccggaagtgaaccgggtggaagcagttcgcatgttcagtgtttgcagtgcggtgaatttgtggcctccatttactccagtcagctaactaaccacatgaacacaaagtgggatatttttgcaaaaaaaaatacagttatttttaactaattaggcctacaaattaccccccccctctgatttaggcatttgcatatggccgtttacacgtgccgtctctgtggccgtgcctttgaatcgttgagcagttcagcggccataatgcacgtcaaatcggcccacgggcggggccgtaatgacgcggaggcggaaattgttgatcaacgtgacgtgtgcttgaaggagctcaataaacgctatcggaccttttttagctgattttggttttgaaaattgttacattttatttttggataatttaaattaaaaaaatttaaatgcagcattttgtcattttaaagaatttaattataaataaatttaaaaagtaaaataatcattaaacaccatttagttaattgtatttgtttaattaattaatttgttgattaaaatactaattgattaaatatttattttccaatggtaaaaagattacgaaataattacatttgatcagaattagcaaaataattagatagtgcataccccatttgaccatttgaagggtcctataacaaatccaggagacatatgcttataaaaatccactagaattaaaaagttacttaattatgcgccaaaggctattttttattcgacaaaatgataatcaggacacagatttatttttgctaaaaaacaaaatatgtataccatatacatatctatgtatttgccaaaaaaaccatctaaatatttgctaaaaaaatcacaaaaagaccaaatattgaaacaaaactgtataataaatacgtgaattgaactcaaaaaattctcaccaagattgttggatttagatgaaaagggtgagatctgtttttatttctaagaaatgttctaattttgggtagtggctgctagggatgtgcgagagtctcggttcctgactcgggaaattttccgggtttttcgcttcccggcctcggttcccgatctgggggtttttagtctcggaaaccgagaaatattcccctaagatttcaaaattggaatctgaaatacccatttttcagtaaagtctgaaaaaaatatcaaaacttccattttttctaaggcggctcctatcgcggtaagggatgaactccgtctttttttctataaaaatggcctttttgtctaaaatctgttacataaaaaatcgcacaaaaaatccaaattttgaattttttttaaaaattgacttaaaacaaaaattggtcacgtttagacaaaattttctacaaatcacactcaaattgccaaaaaaa

SEQ ID NO: 1324 - DNA, 1897 bp, Heterodera glycines
gggtccaatgtctgtttgaacttcatcgaatttgtttctaagaactgtccgcaactgaaagcgctctgaaaaattttacaaaaattgaaaaaatcttttttttcttacggtagaagtagggattttttattattttaattttatttttattttttgtatcgctgcttaattttacgttgaaatgacagagttggcgaagaaaagaaggacggtaaagaaattcatttttttttttggtttttttatagcaaaaattgttttatttaatctagcaaaccttaaaagcaattagtaacgattggatgtaagcctaacaaaattgataaaaaaaatttgttaatagaattagtcaaccacatctcattagtagaaatttgtgccagataaaatatggtcaatcggcatttaattgggaaaaattgggcacataaagctcaacatgcttagccaggcctagtcgggattggcaaaatgggtgcttgtttgttcgcgaaaatctcttcacaaccgcaaggtgcgacaaaatttcgcgcatttttaaacggatttattttgtggaattaatcggaataaatatttttcttttaagtttattatctcccaatttcttcccgaacgaggtgcgatcaattcccgacaattttacgctccctaatcccggacaattttgagctgcttggtctccgagagttttcttgcccgtggggtcgtgacgcttaaccctaggtcgagtatcgcctggccaaaaagtggtgaaaatatttttgttaaggcaaaagccaaataaatgcacagagaaacaggaagcactttgtgatcagaggtgattcagagaatttttgtacattttcattactaattattctcccattaacaatttgtccatcaattgaccgataaattcactttttaatgcactaaaagtaatgattattgttcattatttatccataaaattatttcctggcaaaaaaatttattcggaaaaaaggaaaaaaattcattaacaatgcaagcaccaatttgtgtggtgaaatgagaatgaaaatgatgtggttaatgctaaaaaaagaataaataaatgtttttttggtaaaaaatattattttgtttcaaaaataattttttatatacttttttttttttactgaaagctcggcttgaatccgattcatttaaaaataaataaataaatagtctctttttaatgaatcttaaatttaaaaaaaaatcttttttcatttttccattttcaaactctgttcaaatacaaaatcctatttttgtcattcattttccgtgtgcaaaagattattcgtctatgttgtgaatctgtgtatggcggaaataactcgcgagaaaaaagtagaatccggtccatacggtataaggaacggtacagtaacaggccacttcatcaattttgtagaaagctaaggatgtagttacagctgtgcaaaggatgtaggtatagaccaaaatctaaatggaatttttatatatatagatattatttatgtatgtataggtaatataaagtagaaaaattattttattttattttactttacacatttcatattttcggcgccagaccaagtttttgggctatcactttttttctttataaccaaatctaacattcttagtatcattagaaagcccttcacatgctctattagatttacaaaaagcaaaaagatttcctagcttgtaaaaaagatttataaagaaaaaacttaaaaaatttcgatttttttccaattttaaatttataacttttttggtaattcgaatcgagaagcgatagcttagaaactgcttttaaacatgtagagctttagaatgataccaagattgttggatttggatgccaaagaaaaaagttaaagcccaa

SEQ ID NO: 1325 - DNA, 7144 bp, Heterodera glycines
  misc_feature (7130)..(7130): n is a, c, g, or t
ttcaaaaatttttactatgttatccgcttcgaccatgttcctcccgggaccccacgagaagtcggtccgggagttttcccactccaccatgaagtatgtgaaggtctcatggcagacctcacattctacattccaagggcctaaaaaattttttttgttttttttcaatttcttttttaaactcacccccggttattttattgatgacgcccttcaccggcctataagcctttttaaacagttccatattccggcgtttgagttccatcatagccggtgctagatgattgcctgtgcagttcttaatttgctctttgcgggtattgagctcccgattgcgcttgaggcggcgcttttcatcttcgcattcgaagcattcgccgcatttgcacaacattttttaaaaaatctaaaaagtttttttaaaattatttataaaaaaaaatatttaaataaaaatcgtacagcactgaattatgagataattaactttcccgttctctcctcccccctctttcttttgcccgtccagcaattctctgacctttctcatgcattaatatttactgaattgaattttgtctaaatatttttcatcattcattcattcattcatttttatgttttttgttttgatattggcttggtgcgctagtgcctggtcgcggcttgtggcctccggccttacgcttttgcggtgaaaggttggacacggtgctagtgctcaaccctgtgcttggggttggtgcgctagtgcctggtcacggcttgtggcctccggccttacgcttttgcggtgaatggttggatacggtgctagtgcccaaccccgtgcttggggttggtgtgctagtgcctggtcgcggcttgtggcctccggccttacgcttttgcggtgaaaggttggacacggtgctagtgcccaaccccgtgcttggggttggtgtgctagtgcctggtcacggcttgtggcctccggcctacgcattaaggcgaatggttggatacggtgctagtgcccaacccgtgcttggggttggcgtgctagtgcctggtcgcggcttgtggcctccgacctacgcattaaggcgaagggttggatacggtgctagtgcccaaccccgtgcttatggacactaaatttttctaaaattcattcattcattcattcccgtccccctcttataaatgcataacgaattgatgtttatttatttttcaattaataaggtttattggattggttggatgagtttaaataatgagtgagaattgcaaatgccaagtggcaatcaatgatcgtttaaaaattgtgataataggataatgataggatggacaaaatgataaagggtgttcgagagttatcaaatacatcaatcaatcatcgtacaaatggataaattccatcaattcggacacggcacagcatacaagtcgcgaccttgtggatcaccgcgttcaccgcacatgtcgagcacaggtagatgtgtccgcaattacggctgtagaagtgtgcgcggttgctggtgcagatgatgcattcggtctcccaatagagctgggctggcggaacgagcactgacgaggcaactcccctttcaaatcgctgcgactcgcgcagctgcagtcgaacattacgttcgaactgcagctgctgatgacgaatcagcggttgaggttgcggctgctgctgagggggctgtggttcgatgttctcgtcgttttcctgctctgctgcctgcagttgttcgtgaagaagctctgcttcttccatttgttgatcaaagtgctgttgtctttcgcgttcttcccgttgctgctgctgctgcgcttgctgaagcaacagatggtgctggtgctcaagttgctgctgcacagcacgatgaaccatctcgtcccgaattagacgcatccgcgaacggttcatgtggccttcaatcacagcgcttagaacggggcctgtcaaaaattcatttatttgattcaaattattaagggttcatctcaccgttttcacgttcatcgtcaccaccattactcgccgtacttggtccagccacattgctctctaaaaaaaaaacaaacaaaaataatttcagtttttttttcaaaattagcacaccattagtacgattttgcagagccccattgtttcccgaacgtgaacttagcggagtcagctgctcttcaaaaaaaatcgaaatttattaaacaaaaatttcctagtttacggttttcatttggtatgggccgaacatttccatcacttggacccgcagcattattattattctccacttgcacttgaattatttgttatttcaataaaaaaaattacagcctacccaaacgagactgttgtcggcgttctcgttcctcaagtcgacggccgagcagcgaaagctccactcccgccatgggagagtatctcgggctgaatctctggttcccgcgagactgaaataatcaaatgattatttataaaaataagcgaaattaattagttttaaatacttgtttgaaaattgaacttacattggccaagtacccctccgttgattcaatccgcatcatattctgaagcaacactgctctctgatcaacgatctgacttctcagcaaaaagatcatctgctgctgttcgcgcactgcacgttgtagctgtcgaatggaatctgccgccgagtccatgttttcagaattaattttattgctaaaaaaaaaataaaaaatataaagcaggtaaaaaaaaagggaaaaaggaagatgccaaaaggggctcacagaataaatgaagatcttaatcccgcccaccaacagtccataacattttacgccacatctcatatttctccgttgtgcatttaggggggggggaatattgggacgattaaagtgcttgaactgttggaagggcaatttcttttaggttaccgccaattaccccaacaaggcaatgaataagcacatcccttgcagtgcggagccgttaaatcaagtaaggaatgagcaaaaggtcaaattgcttccgcgctcggcattttttgttgctatgcaaacaaaacaaaattttgccttttttttttagggggtttgggaggtaatggagattaggggcgagaagttgcgagatgaccaaataaaaaagatcttataaaaaaaacatttatcaattagctgcatacaattaatatcgaaattatcattataattatcgaaattatcattacaaatattgaaataccgaatttatcattataattatcgaacttatcattattattaaaaaatcaatgatcgtattttcgacttccatcacttggtctatttctttggcttgaatggagcaagaatatcggttgcacgacagttgtcggtcgtgcacttctcacacaattcaaagctgacaacggttcgctcgccattggttgaatatttgtttgtattgttccataagcacgaaagacatgctaaaatttaaaaaaattttaatgttttaaaattattacttaattaccgtcgcaaaaacgaaaagttagcatatattttgggcggaaaagtttccatgattggatgcttcgtggggttttagctggttcatcttgttgctcattcatcttttgctcattctgattttcggccattatttcaggtgaatggattattttaagagttatttttatttaaatgaaaaaatatcccagtttttttcaaattttatacccatttttgtttgtttaacctatttatttcgagtattaaaaatgaaaatttattgaataaaataaaagccattgatatagcggatggtgaaattcgaacactcaatttttatcctttttttccatcattttttgtattcatttcttttctcaatcaaaattgcgtctcggcgttcctttttcttcgcgtattctcgaaggctcttctcaacttcaagcgccccttttccgccaaagaactcacgcagaacctaaagaaataatttaaaaaatggatcaaaaattttatttactgacatttgcctctcctttgtcgaggaattcttgccaaagctcttcttcagctggcattttcccgtagcaacgctggtcccactcaatcacttgttccggcgtccatttctcaacttcttcgggtgaagggtcagtgtcaacttcatcatctaaaatttgaaaaaaaaaatttgtacagtattgaaaaaattgcaattaccatcacaatttgggcattggttttttggtaaataatttttattagaggatgtggacatttttaggaaaatggaagaataataatacaaagaactaaaaattttgcattttatacctttcaatgtttatttaacccataaaataaatttggctcattcgaaatcattataaatagcatttatacttgcttaattttttcattttgttgtcttcatctcattaatattgcatttttcctctataaattgcactcttcctttcgttaatttttccaaaattgtagcttccaaattctcaaaatggtgcttcttacggaaaaaatcgccaaaattttaaactgccgtgtcagcgagctccgtgatcggcttaatcatccttccgattgtgaaacggtggtgaaagcgctgacaggacaccgtgttaaaacaacatacaaagacagaaatggatacaccaaaagctttgcttttgggggaattacagcacaaggagctgcaataactatggcttatggacgtctgggtcgtcctttcaatgttaatgtggccgcacatttctacgtccgtcaccgcattaaactccgacatcctttcctccactgtgctgttgagagctttccggaaggacaagaggatcgcttctatcctcttgaattatgcgaaatggaggatggaccaaacgaaccagattggcttggtcgtattttcacagaaattcgtaacgacaactacacagacagcatgagccctgcaaaccgagaagttttaacgccggaagacacgtcaatgtctcgtgaagggcgtgatgagtgcagtcaaaatatttcttacaccttatggtaattaattttttttcaaaattgtctcttctctttcttaattttgtacttttccagccaaaaagtactctttcctatccttaattttttcgaaaatgtgttttagatgatacttacactttctggtattgattaatattttcaaaattgtctcttctcttccttaattttgcacttttccagccaaaaagtacactttccaactcttaattttttcgcaattgtctctttgttttaattcaatttaatgttttttgtaataaaaaaaatcgatcgttaatgtgcaaaatttatgttcaattaataatcacaaatttatggtgaaatgtgaccaaaatcgagaacacgaaaatcatttgaacaaacaattcccttaccaacataaggtttataaattttttggaggggagcggaggtgacattgccttggattactgccgggcggagaaaatttgggtacaacactttaattgggtctgtctttccggagcgggcaaattccaggacactctgtttgaatgtgttataacgaagcccttgattttctgtcacgtcataattgagcctaatccctcgaagtttgagcacgtattcaaattcgtctgctgttcctttctttcgtagcttcaacccgtactgctttgcgccgccgcttacgaattccaaaatatcgtgctaaatttaaaaaaatgcagcgcgatttatattggtcttttacctttgggaactcgtcagtgagttgtcccaagtgcacccccgtctgaagtgggtttgagtcttccgggtgtacaagaaacaatgaatcggtgtctaaaatttagaataataaagaaaattattgtatgtttacccgtgtataaaagagtgcagccgggacttctgaccactttctgcattgatttcagtaaatgtagtcgggctgctgatgttgtgaacagtgaaatcacaacatttgaacaaggatgctctttgatccaatcttttttcaattgataactggtcagaattctttccggcgtcagcatgtcaaggccgctgatttcaatctttttgttgtccaggtaatttccaagctcagatgggtcatctgtgatgagcgtctgcgaaagaccataatttcgaagtgaaaatcggccccctaaattttttgtttataatattttcataggataacgaaaaaacatacataaattattcacagccaattttgccaatgatctctttcccttgttcgggaccatttttgttcgatcaatttttattccaaattggtcccagcattccgcaataaattgctcttcggcctcaaaattgcctttgatttgctcatcaaacccagaagcatggagtttttcaacaacgaactcgctcatgtatggcctgaagagtttgttgtcacttttgtggtattcgagaacgcgaagcagctctgtcactcgatatccctcctctagtgccgcatttaactaaaaataatttgaataaaatattaaaaaataaaactttacttccaacgaggtgcatgtactaatccagcctctttgtcggtcatcgtgagtacaactgtatgatgatttgacggcaccatacggaaattttttgcaacatttgatgcaaagtggaaaacaaagccgatcgtcaactttgaccggcaaaacggggatgtcgatttgtcgcggtggaatgatgaacacttttagaatggcgagcgggtatgggttgtcctcgggtcggcgccaatcaacttcctcgcagagcacgtggagagttggatgtccaatcggataatcggtcacacaactattttttttaaatattaaaaatgttacgacaaatattcacttgataaaaggatagaggctggtaaagtcatagtagctaattttctcgccccttgccgctttgtgataaagcttcaaaggaccagttctcccgcccatgaagcaactgcgaatatcgattggtcctccatctccattgaattcgctgaatttctgccgcatttgtctgtcacgggccagcattgcctcgatttcgcattgccaaaacacgtcaacattgggaatttttccgangtataaaatccatc

SEQ ID NO: 1326 - DNA, 7072 bp, Heterodera glycines
  misc_feature (105)..(105): n is a, c, g, or t
tctgtcttccggagaggcaaaattccaggacactctgtttgaatgtgttataccgaagcccttgattttctgtcacgtcataattgagcgtgatccctcgaagtntgagcacgtactcaaagtcgtctgcggctcccttctttcgcagcttcagcccgtactgctttgcgccgccgcttacgaattccaaaatatcgtgctaaatttaaaaaaatgcagcgcgatttatattgggcttttacctttgggaactcgtcaatgagttgtcccaagtgcacccccgtctgaagggggtttgtgtcttccgggtgtacaagaaacaatgaatcggtgtctaaaatttagaataataaagaaaattattgtatgtttacccgtgtataaaagagtgcagccgggacttctgaccactttctgcattgatttcagtaaatgtagtcgggctgctgatgttgtgaacagtgaaatcacaacatttgaacaaggatgctctttgatccagtcttttttcaattgataactgatcagaattctttccggcgtcagcatgtcaaggccgctgatttcaatctttttgttgtccaggtaatttccaagctcagatgggtcatctgtgatgagcgtctgcgaaagaccataatttcgaagtgaaaatcggccccctaaattttttgtttataatattttcataggacaacgaaaaaacatacataaattattcacagccaattttgccaatgatctctttcccttgttcgggaccatttttgttcgatcaattttaattccaaattggtcccagcattccgcaataaattgctcttcggcctcaaaattgcctttgatttgctcatcaaacccagaagcatggagtttttcaacaacgaactcgctcatgtatggcctgaagagtttgttgtcacttttgtggtattcgagaacgcgaagcagctctgtcactcgatatccctcctctagtgccgcatttaactaaaaataatttgaataaaatattaaaaaataaaactttacttccaacgaggtgcatgtactaatccagcctctgtcggtcatcgtgagtacaactgtatgatgatttgacggcaccattcggaaattttttgcaacatttgatgcaaagtggaaaacaaagccgatcgtcaactttgaccggcaaaacggggatgtcgatttgtcgcggtggaatgacgaacacttttagaatggcgagcgggtatgggttgtcctcgggtcggcgccaatcaacttcctcgcagagcacgtggagagttggatgtccaatcggataatcggtcacacaacttttttttttttaaatattaaaaatgttacgacaaatattcacttgataaaaggatagaggctggtaaagtcatagtagctaattttctcgccctttgccgctttgtgataaagcttaaaggaccagttctcccgcccatgaagcaactgcgaatatcgattggtcctccatctccattgaattcgctgaatttctgccgcatttgtctgtcacgggccagcattgcctcgatttcgcattgccaaaacacttcaacattgggaatttttccgagtataaaatccatccgcttttggttgagctctcggatgcggcccgcagattttccacatggtaaaacttcgttgtcatccgggtagcactttgcacatgcgtgccatacacatccgtgaatctcgagtcccttttgttgagactcgatccagccgtccaagcggaaatttcccaccctttgaaatattttatagatttaatttgtactcaaagttaccttttttctccgtcagccgaaaatgcattttgaatccgaacgccgtgcttttcggcataccactgcataaaattgagagccagttcactctgattgtctccacagctgtcgtaacccttctccggcacaagtgccaaatgtccgggttttaggtgattagtccgaaaatggcgcatgcaggctgacgcaattgtgacgcaatgtcggacagggtcaatgccgttgtgcggtgttttgtacgctgctctgtcggcttttccatcgatgcctgccggtcgttttgtcatctccaaaaattctcctcgaaaggcgatgagtccagccattaaaatgtcgacatcgtttttgcaatagcttatttttttattattttatcaaaattgatttattcatattcaccttgccaatgactcatccagcagaaacggaatatttttgttttgctggtaccattgatcaaattgtttccgtttctctgggttcattccgtcggccaggtaatctgctttcgacggaaaaatttggcatccataattgtcaggtttgttggccatgtgtggaaagaagggcttgtcctgcacgtccaagccgaacatgggcaccattgaggcgagcgggccaggaatcaaattccaagaatcacgaaatgtcacattcgggtttaagttctttctgcttttcacctgagatgggaaaatgattaaataaatacatggaaaattataccctcatctcgaacagacggtttccctttctgatcattgaggggttcagtccctccatgaaaagttcccgaaagaccaagaccatgtcgaaacgtccgccgaaatgggaataggcaattgtttcgtattgctttggaagcttgtagagaagccatttaacgaaggcaacaagagggtggcggtcaattgtttgtctgtcgaccgttgtctcacggaacggcatttgactgaatgttattgtccgatgatagccgcaaattttgcagaattttccaagaaggctctctttccattttccggtcgaaatgcaattcgggcatgccacttttgcagtaacaaaattcacttgatgcttctttcgttcagggaaatgcgggtccgcaggctcatgctgcattgtttcaacgtcgaatgtgacaaggcgccacccgtttgtttctttcttcttgttcggctccaatgggcgaataaaacatccccgctcaaattcgtggaagatttgacaattttcacaccagcgttcattgcatttgtgaccctattccaatattaaactattattaaatttttaaaagaaacctctctcccattatcgcaatttttacgcatgtcccatacgacgccacagtatttgcactctttgctcatttgacaaaagttggaagaaagatgatactggtagcaagcattattgaagaacattttattgcaatccttgcacttttgccgaactccagcaattggtttgcatgggaattgtggtcccatttgtgagctaaaataaaaggtaataaaaaattacaagaaattaaccatttaatgcagcgcgatttgcaactagcaatgtggcgtttcggtcggtcgtaagtcttttcacagctcagacaatagggcttgccaaaaagatttccgcttttctgcaccccattgaagtgtccatcgtcaaagtagagaattattggaacgatgtattcctctggcccgtatttgaaaagcggcttgtaatgccccattgctccaaagatgaaagctttaaacttccactggcctgcaaacttttcgttgttccaccaatcaacaatccggggcacataaatttctgcgtcgtaattgggctgtccaagaggtgcttgaacggcttccatcaattctgttgtttcggttctcagcttccctcgcattccatcaattccattgagatatccgtaaaattgttgccgcgtcatggcaccaactgcccgaaccatcgtcgcttgcattgcgtagaataagcagtaattgtctccattgaaatttttaatctaaaaaatgattttttaaattaagaaaaaaagtgaaaacctttataagacattgttcatgaattcggtggtggaccggagccaacttccgcgcggctcccccttttagcttcattttctctggtagtccatttcggttaaccgttgtcacaataacggtaaatgcatctccccaaagcgtcaccccatcctgttttttgctctgcgccacgtcgttaaagcgattaagtatggtgtttatggtgtcgggtgtcatttgacgaattggaatccaaatatcggatgtcagtaactggctggaaatgatacagccgagatgtgttggttgaactcctttcaagcggctgtcaccaattgcttcgtccatacagtgttgaaaaattccaattaaaagtccctcggggtcagccggtacatcttcaatgacgaagcgagacttatttttcacccattggaatttcggaacgtgttcgatctctgagtcgagctttctgacgtaatcctttgccgacttttgtggtggggaaagctcgttgtagggttcccgaagcaattcttcgatgaaaaaacggcgagctcgtttcgaaggaggagattttgacattttttctttaattaaaaattaattttccaaaatatgaataatatttagtctttttcttcacttttaaacctttaaaaccatttttatttgcttgtgtattgtatttactaatctaatttccaacgattaatctaagaggaatggtcatattggtcattcaaccaatcatcatcatcctattttttattctgctggagtgaatttgtccttcagccaatcagcattcgcctatgctgttgaagggaaaggtcgctcgctccttttaccttttttttggcaaataacactcgccgagatttattcggaaggaaagggaccccatcgacagtcattggtccctggcactgagcggcactcaatttttgcctttcctttcctatggtcaatcctttttgggacggaaccaaaaaaaaaaaagagtcataaaacaaataaaacgaatttttttctattttatcgggaaattgcgaataaaattttgaacaaacatttctggattatgcgaagaattcaatttagagaggaattgagtaaaagttagtccgcttgataaaaaataaacaaaacaaatacaaaaatgtccacatgaatttgatgaaactgattgatagggtctttggttaaaatgggttccaggaaaagcattaagaaaggatttaattaccaattcattaatgggcaaagacagactatcaaagtaaatggtcttctgatctaatccgtatacaaatattgcaatccaatgagagcccggaaaatgatgagggtccaaattaacaatcaatgatgcgggaaattttattgaattagggttgggtaattgatcgcatgggaagcatccaagaaacttggggctcgttatttttgatgacgtcaaaattttggtgatttgattgttgtccatttgtcctattgcgctgttgcgtcagggttagtttgagccaaagaattgatcgaaattggtagataattaggctgatgacggacaagccaaaaaggataatcattgcccaacaaaaaatatgtgcatacacatttgactctttgggtagttctttacaaagtgggataaaaggaaaattgatgctttcttggggttgataatgtttcaatgcatgggttgtctgtgagcttttagttgttacttttgtttttatagtagtcttttttgttgtttttcgagttgctgaagaattccttaacacaatcgaagtaactatcccttttgttgttgttgttgttgtgtttcgaaattctgaagaatttttaaatcccaaaagtcttttccactcattatattcaggaatttcctctgtttttattccttcttcaacaatcaatgaaacaattggttgaaaaaataaggaagcaagtaaaatttggtacatttttatcaaatggttgtatcggttgcaatcgttcggtttttatccaaaaagtaaatagagtccgcttcacccatcacaataagtgttattccaccatcgggtactggttttttgaatttaatgttcactgctgtacagccttttttgattagatcaaataaaccgccatgatcgtcgccgctgtttgtcatattaaacacataaatacagtgagtgtgcaaaaaagaaaagtaatcaattccatttccatatgtagagttggcaaaaccaagcgcctcctgcgtgtcattgtagggacgaacaaatttccaattttcatagtcaatgtcatacggtgcctggggataggagcgaccattggccacaacacttaactcccgtacattaaagtgctgaaagttgaatgggctccttttgatgttccccacataatctgaatttgcgacaagtcccattgtcacgcggcgtggaacttggtccatgaacaagtttgcattaaattcatagcgtcctgggcttatgaacaatgctttcatcattgtctttcgtacagcataccgtgctggtttcatttccaattttttcgccaactcaagagccaaaccatccataagactgacttttttacagtagagtttcaatccaacaagctcaaggctatatggttgaccaggggggtctaaggtgtcaattaacaaaaaattgtcgtcatggggttgtatcgttatatcaatttcacaatgattaatcaaatattggggtacattgaaaagatcggcatcaatttttgcaatgtattgtgctgttcgacctcccaaataccgttgtcttctacttttgaacccttcggaatttgcgttttgtagattgctagcatcttcacggtcgtatccagcagcagttaaatgcgaaactttagcttcaagtgattgcgaaagttcatgagaaagataagttttgtatgccatcagtgaattagaattgaaaatttcacgaccgtttattgcaattttcaggtcccgcatgaaggtgtgcctgatcaattgtattggaacaacctgatcagtagcatccaaatgtccccattcaccatttgggggtgtcaattttcgcattcgaaattcggtcaaaaggtaacactttgacaggtcaatgtagttttggctcgagtgtattttaaaatgataaggagtgtcggtgagtggattactcggcaaaatctcgaaaacctttgacgatg

SEQ ID NO: 1327 - DNA, 8630 bp, Heterodera glycines
  misc_feature (8624)..(8624): n is a, c, g, or t
agatgttttttacctttggactatagcggccaacgggacggacaaatgggaagagaatcaaaggtagaacccgaaatttcgcatggaaaattttgagggaaaagtgcaaaaaatttttcaatcggagaagtttgggtagaataaaacatttagaaatatttttattttttggtttataggagtgtgacgtgaaagaggaattgaagaaaaataaggagatgaaaaagttctttgaaagtgtgccggacaagggaccgatcaatccgagggatgcttatgccgggggaagaacgatgccattttgtttgtacgcaaagactactgaagaaattgagatatcaatgttcgacatcattagtttgtacccctttgttaattatggtaaaatctgcttaatttttgttagtttcctttcgcttaagacaccccataccccgttggagtcccgaaaattgtagtgagcaggaattttaatgtgaattggacagcacccgacgacgtaccctatgatggacttttgaaagtaaaagtgatcccaccgaaaaatcttttgtaccccctcctccccgtgcacatcgatgaaatgctcctcttccctaattgttggtcttgtgcgagaagggccaagaatgaatttgtgatgacaaaagatgtaaagaaatgtaaccatcgtccagcgcagagagcatttttggggacattcacctcaattgagttgcggaaggctttagagctaggatatagaattgtgggattctatcgagcgtatcattttgaacagtttgacagtcaactgttcaaaggatatgtgcggatgtttttgaagataaaggtggaagcgtcggggtggccggcggaggtgaaaagtgaagatggaaaaagagcattcatcgaaatgtacaaggcaaagtatgacatcggtttggattatgataagattgggtttaatcccggactaagaatgattgcaaaattggtgagaaattataaaaaatctctaaaaattgttcgaatttaagggattaaacagtttatggggcaaattttcgatgcgcaataccctttcaaatacggaaattgtgggcagcatggaacgttggatggaattggggagagacaatacaattgagtttgggcgcccagtaaaaataagcgaagagatatcaagagtcgtgtaccggaaaaaggaggagttcatcagggagcataaagtgtcgaatattgttttgtcattgtggaccacgagtgctgcgaggctaaagctgtacgagtacatggagcaggtctacaagaaggaggggtgtaaactgctctattgtgacacaggtgaaaaggaataaaaagaaaataaacacaaaaaatttagattctctagcttttgctcatcggaaggggcgctgtccgttggtggaggggaaatttttggggtaaaacataaattttgaaacgcatttaaattgtggttttaagggagatgactcgagagtatgcggacagcgaaattttggagtttgtgtccgcgggtccgaagcagtacgccttgaaacttagaagaaagaaggatggtgtgatttggcacaaaaccaaaatcagagggatgacactggatagacgaaacgaatttaaatatgaattgttcaaagagatggtgctggattacaagaaaggggtcaaaaaagtttttcactacccggagaagatcgggccgacaaacgacttccgggttctctcaaaagacgtacaaaaagaatatacaccggtgcagaaaaaaggaattattgacgatcactttaatgttttgccctttggatattattaataatttttgttttgataattttgtctcatgtttataacatttaatattttaaattaatcaaatttgtttcattttttttagaatgtcaaagaaaaatttccaagaaacttcaaaagaaatccgccgctcgaaaaatacaaaaaattatttcaaaaacagtcctaatttggaaaaatgtttcgaagaagtggagagtcacataaaggaaaataaaaaatttgggataaaagagcacgtgacaactttctattttaaatgccccgaaaatgaagatcccgaaaaaatgtttaaaaaaatcctgaaaaaattaatgggggatgcaatgagccgagaagctgagccgggctggaaaattgagaaaatttcagtggacctttattgcagtgccctgtcagaccccgtgatcatccctgcccgccccttccaacaatcgaacccagacattgttttcaacgagttcatgcacagacagcaatcatttggagaagtgaatttgttagaccagagaatttcaataattattgccacttattctttccctgttaaataaatttttttcatttttccctttcattattttttgtttattacaataattatttattcgacctttttctttattaatttttcagttaaaatgtactcgtttcaaaactattttgaggaggctctcgaaaaagaagattttttctggcagaaaaacagagcagaagtggaggcattgttaattgaggcttcaaattataaaattataatacacagggactacgaaagccgctattctgattatattgccacctatcaccgcaccccactcttctgtttctgcatgattgagagaaatttaagatttttttacgacacaggaaccgggacgcctataggaagggttacaactgtgctacatgttaccgttgaggcgagctatacaggagagggattcatttcgcctatgttttccttttggttttattgggagggcaggagtcaaacaacaaacgaatctttcacgagccgtctttatttgtacactgtttcgatgctaagagcaatgggcaaagcctggggcagagaactacttttgaaccctgttgaagttttaattgatatgttctaccaacgtatagataggttggaacatagaaaaaacaatttaaaaaaatattttagagatttggtcggatcgtggtcattgttctatagactcccaccctcactttttgacacttcccgccgggtggttgcggagaataaactggaagaatttttaaaattaccatcattttttcgcatgcttttttataataaatattaaatgttcatgttgtttttaaagtgaaggttttgacccaaatatttaatcaattttaatttattatttttggtagaattccagaaaatgcaaacaatcgctgaaattaaaaatttcgagattgttgatggtggaagaatttttgttgtgagagcgagaattgagaatgtgatggaggcggagtacagggtttgtaataaaaatgaaagaaaatttcagtttgtttaggcatgcactttatgccgtaaaggggcttgttcttgcggggctgagaaaaagatgacatcttatttgaaggtgtctgtggcagatgatacagggcttttggaaaatgtgggatttttcggtgtgcgtgggaaacagaatgggatggtaacgcaacgcttttttaaaaatccatatacatttaaatttaggatgaggtcaaaagtttggcgggcgccgtgtgcaccatgaaaatcggcgctagggtgaaagaattcggagggaagaaggggatctattactctttggttgatattgtcaacctttaaatctataaataaacttgttaattttttcaaataaaaatgttttacttaaaattatttctagtttggttcttgttggtcggaacggaaagttgttgcctttcaaaagaagaaaaagagcaatttaccagtgcccgaagaactgtagaaggtgtatttagagacataattaggttagataacgaagcaaaagaattttctttttctgcacataataccatggttgaagcccaaaatataaaaaataaaaaccctgataaacctggtgtaaatttttggcatagcaaattattagatggagttttaaaaattcatgccctatttgacaaaataaaaaaagaagaaaaaaatatgaaaaatattaaaaaaggtatggaaaaatgtctagacagaaaagatttaactatgtgtcaagaattagcagaagaggccaaacaatcaatcgaaatagccaaaaattatcggcaagaaattgggcatatttatcggaccgcttactcgcagcccgatttaggcattggagacttggcaaataaactaaaagaaacaatgcgcgaaaaccaaatacggtttgaaaggcaaagacctcaggaagaatttagggatgaatttattgcttataaaatttaagaaaaaaataaaaattcgagaaaatgaaactgcatgggaatcaaaggttgtgggacataaaccaaaaacaggtgaaaagggaaacaggtgaaaataggtgaaaaggaaacaggtgaaaacaggtgaaaataggtgaaatttcacctaaaaatatataggggcgtgtatttaatggggcatattagataatgtctcaactagtatcaataaaaagtgccaaaggaaaattttgtgatggttatcgctattacaaacataaaacgaccaagttcaaactttggtggaaatgtgaacttaattcacatgggtgccagggctggggttttgaaaaggaagggttttttacaatgacgcgccgacacaatcatcatcctgacactatattgattgaaatcgaagaggacataaaatatcataatttttctgcgggggcaaaatgctttttgggtgacaacaagaaatagttgatgatgctaagaaaaatccgagactccaaactgaatttagagatgaatttattgtttgtaaactataaataggatcttgaaaaaaaataccaattaaataaaaatgaattttcataaatcggaaaaagctaatgccattttattggaggcagctaaaagagagacggagagagcatggaaggatgttgttgcactagaggaagaggttagcgattttgccaaatcttctcgggaaactcttaatcgtgcgataaaatcccgagagaaagccccatacgctaatggtgttcgggagttttacataaaaatatccgactcaatctgggaaattttcacaatcttggacaaaattaatgtagagtcagaaaaggcagaagctgtatggagggaattggaaaaatgcaaagacttcgaactggcaactaaatttgaggaaaaatcaataaacgcattaaccgaagcccataggttgcatttcgaatcccgaagagtgcataataaaataagagcgtatgaaaatagacttcaaaatattgtctgggaatttattggacaagtgtaagatataaaaagaaattttttttattaaaattaatggaagagtttgttgaagttgaatcattttgtcagaccaatacaaaatttggccttaaaaaatacatagccaaattttattttaaaaataaatttttagttaatgttgaggaaaaacttaaaataatactcacatcgttaatcgatgaaatttataaaaaggaacagggaaaattcaaaagcattttgaagctttcttttggttttgaatcattttattgccctcttaaatgccctagcgaaaacacagccgaggctttgttccaacatgtcctattaaaagaagaattatattcgcttttctatcctttggatgatgtcataacgctagaagtaactataatcccagatgtcgacaatagaccaagaaattaattttataaaaaacaaaattacgagaaattggaaaatttctggaaaaatacttaaacgatcaaataatctcgaaatttttgcaaatatgatttttaaacgggtgaaaaatttctacataacagcatttagtgcacctggaatcgaaaatttatatttttcattcttagaaatgctcgaaaaaattcaaaaattacccggtcttattatgggtgaatatagaaaacaggccttatctatgcagaaactagaaattggcatcaaagaaacagatatatttaaatgtcaagaagcagagaatatatccgatgccaatttttcggagataaaaagttatcaaaaaaagatagggaattataaatttaatatcaaaatgttgtacaatgaaattagagtaactgcagtaagtcatttgtttaggcctgaaaaagaaatattttttagtccgtttcttacagaaagaaatagagaaattttttattcattatttcgacatatctaataaaatcgcaactttttttttgcaaaaacgaaacgttttcgttactaatagaatcgcatgatttttagtgtaatatttgagccttactgcacaaaagaccaaaaagttttgcaagtttgaaggtcatttactaatttcgtttgctgaatttgaactaaattagggttgcgtcagcattacaatgcaaaaagcgactatttaagaaactctaaattttcattaccgatatataattttgccttcaaacattagtttatgctatttatttttgatttaacattttttttcccattaagaaatgtcaatgcaacaaaatcaagggtccgatgatgttttgccaatgtgggcggtaccggattttgatgaaatgggccaaatgccgcagcggcaaaaacaaaaaaaaatcccaacgttgaaggagtttcggaaccaatggaaggaacgaagacttctgtgggagagggaagaagcagaaaaaaaagaccccaaaacatggaagaagaggaccgatgagatgaagaaaatctgtgaggagagattggagcaatcgaaaggtgcaggcggcagcaacaaacgacaggaaccggacaaatacacttggaactggggcgaactgcagcgccaagaaagagaatatttggacgggggtctatggggaaaatgatgagatacccccccccccccccccttcacctccctcccgttcgtttgatcgattattttattttctatttgaaataaaaaatgaataaaatttaaattgtttaaaaaacatttaatttggtaccctttgggaattttgattttttaatctttctttttttttcataatttacgacttgtttgcattttctgagtttttgcagtttctgattttttgtattttttagtaatattaatgggttttttgtaatttttaacacttttctgattttttggctatttttatgaattttatgatttatttgcgattttttaaatattggtatttttagtttttatttttgataacctgcgtggattaaatcacataataaacatgtatgagaatgtttaaatttaagatgttggataactttttttttaattttgtctgtgttggtagttgatcgcttctgtcctccttctgttgaacatgttgaagaagtcccgattttcgagtcaatcgcatttttggctctgtctctctgttctgcgtgtttttcgcccagttcagcgtacagggcgcgtatgtgctttcttaattcatgcccggactttgaagtatttgttgttgacgccgatgatccagaagatgaagggatgcgctaaattagtttggtttttatcggggccccagaactgtgtgttaatccaaatttggtggttttttgagtctttgatgttttttaaaaatgaggatttgagtatttttgtgggtttgagaattttgaggatgtttgaggcctttaatttgggtttcgaataaattttgtaaaaatgagacttttgacctaaaatgaggctttttacttgtaaataaagtttttgaaaatttaaatctgctaagcctgttttttaccaatttttgttaaaattagttttttattgatttttaaaaaacacatttaaaatagaagtcattaggcctgtgatttggttatcgttgtcgggtggtggcaccccctctaatggactgtcagatataggcgaatattgttggttttggtgttgctgtgtttccgtctcttcgtcctcatctatgaatacatgggctgttagccttccttcactatcgataaattgccgcggttgatgttggcgtatttgtgatggttgctgttgcgacattgatgatgctgatggctgttgtggtggtggtgatggcggtgatgtagataccaaactttgttgtgttagtagttgtgattgaagttgttgttggggatgtattatcgatattgactgttgttgttgcggtggttgtggtattgatgcagatgccaaattttgttgtgttggtagttgcgatgacgaggttgacggttgatgtgatgttgcttgcgcagttacagcagcaacgacagatttaaaaagcgaatctgcagaagtttctgtggggctgaatgcgtgttttgttgtcaagagttgggcgtccgtttgtcgcaatgtctcagccgtttgtagaccaaattgttcattttgcgcgaatgccattgtctttttgcgttttgcaataggcgccaagggaaaaatgtcatcataaaataaaaaacaagttacaaaaagggttaagacatatatgtccttacaatgttgacacagcaatttgtggtctcatcaaaaccatgtatttttagagctccatttgtatttcgaagcatactataattaattattttttcattaaaacaaggantttata

SEQ ID NO: 1328 - DNA, 3328 bp, Heterodera glycines
gggaccctttttgtttgcacaattttctaatatatagtcatgaaaatttattccctggaattcttggggtctataaccttgaattagatgtcagattcgtgatcagcgccctttcaaacccccggataataaaattttatggttttttatcacaaaaaaatttgcaaaacaaacgggtcgccctttttgtttttaataaaattcaaaatcgcccttctttaaagtagcgccaaaaaccccattattactttactggatccacaaatctataattacaagcaccaccttataattagtatttttacttgattttgaactccacaggtgcctatttgggttgtctgctgctgccattgctggatgctgtgcatcctctgcagatgcttggcatgtactgtttgatcatgatgaagcgaagctgactgagggttggccatgttttgttgggcatgtgcagtggtcgtagcaacagcagcggtgaactgctgttgtgttctgacggaaatgttcccattgttgctgctgctactgtttggcgaagggttcatttgttgctgacggaatgcgtttgaaggtctcccggggccacgcgcagcagaaaaagacgcactagcggaattctgattgtgagcacttttggacaaagacatcgctggaggatgaccaatggtaggggaaacaatttcagaggtttgcgatggactgaaactggtcattctttgggtaacaaaaaaaaaacactgtatcacatacaaaaaaataattgaatttgcggtccggacatttgcggtccggacaattgcggcctgctgaaaatcggacatttgcggcccgacaaatgcggtcggacatttgcgcctcggacatttgcggccaatttcttaagggccattttcggacatttgcggcccgacatttgcggcctgctggaaatcggacatttgcggtcaacggaacgccaaataattattttttaattccaaaaacaatgttttcttcccgactttttcgaccccaatcaaaataggttcatttatcggaaattcttttactcttaaaatttacgccgaactttaactaatctagtaattcttttcaaaaattgggcttgtcaaaaccccatcagtttgaaaattgctagtcagtttaccaactcttgcaccgaccagttgatattgtagagatctgagattttctactaatgttcgtacttcttttgccatcatttgggaattgtttcgctgatattcttttcctcctcttcgttgcttctagttgggtaggtttacgatttttttttcgagaagacttgaatcggcggcttattagagagcattaaattcggttaaaatggatggaaaataattttctgaggtttttattttgttggagtcgaaaaagttgaaccgcaaatgtcgtatttggctgtggccgcaaatgtccgaggcgcaaaagtccgaccgcatttgtcgggccgcaaatgtccgattttcagcaggccgcacatgtccgggccgcaaatgtcctacaacccttaaaagtaacttcttttctaaacaaattcgctgtttttgaaaaaaatcttaggaattcttcattttttaaatgaaaaataataatagttttgaaaattttcaagcaaaaacatacatggttttttattcacatacggcactcattgtaaagttcgattgtcatgttttgaatttcgcttttgtcagatgatggcacctttgcttggcagtggaaatgaccaggccgactgcgacctcatccgggcttttctttcctacattttgaaacgctggggcaaagagctgaacgcacgggaagagagcataaagcgaagtgcaacaggcaaaatgcaagcggggatgcacaaacaaacggtggaacatctctccccgctgatgaaatccctggaaaagtacacagtgaacaacgacatccgactgtacttgaccaacattaccaagtgggataaacagacccttgacaaagacaagtgactaaaaatgacacgggatagagaccaaacaaaacaattacttgttttcgttttggatttggcatatcttttaccattataatcctctaacactgagtctcatcttttgctcactttgcatttgttgacacaaagggaggaaaaagtgaatgattgtagcaatgcaacttgagttttcagtcttgcatatataagagacttgaaaatgacaaaattgttgcacattttgcggcccatcattgacatttctttattttaattcacaaattttcagactttgtgttgtcgaacgcaattacatcgtcgcaagcactgcttacatggaaatgtcattactttttttagctaaactttctatttgtccctgcaatgttttcttttctcaggtcaattggcaatgctccgtggcccgtcggagtgactcggtcgggcatccatcaacgccccggctcatcaaaggcgtacgtgtccaatgtggcacatgtgatgaatgacgaaacgcagagaaagtagccgagtttcaattatttaattattatatattttaagatacatccacggtcttaaaaggtattttcgttaaagcgcaagatttcaaagtcttatttctaatcgcttttttaggataatgtcaaaatgccaagaatttttccccaccgatcccagcaaatgtatggaatttgtgaagaataaaagcgatcaatgagaatgaattttcatttttcatttacaaacaattgtttgtatcattttattgatccatttgtttccttaagttttttgtaattttttatatgcacagattgaaaaatggaccagaaagagactctaactgctgaacagttgcagaaagtgctgttggatgctgagaaaagcggagaatattcatatgaagaacttcttccaatttgggaggaggcgaagggaatgattgaaaacgaagagcaaatggtttcactgtacacaacgtttatttatatgtcgaggcgcttcgccgaaagggaaaaaagtgagcggaaattttgaaggtcgaatttcgggggggggggagggggggtaaacaaaaattatttttgcttgtactcgaaaaacattgtaatttcaatatttttaaaaacgcgtgatttcgtaaatttgaacttcgacttttggttcgggttcggaatgcttctgtatttcacttgttaaggcagtcccgactattcgagagcggaggaactcttccacgagggttcgaattttctcgaggaatgcttcgatagtttttccgatgccagcattcgatttgagaaaaatttcgcctatttttgttacaccaaa

SEQ ID NO: 1329 - DNA, 8537 bp, Heterodera glycines
  misc_feature (12)..(12): n is a, c, g, or t
agtcctaacttntgctctatacactcaagttttctctgcctctgtatctattttcattttctttaaatcagccttcaaaaatacctaccccgaaaatgagcatttttacttaatcaactctagctcctaattaacttttccatttctattgatcttttgcctgaaaaatggcaactcattattgataataaggggattatttcgaatcatgattgtgttttgttcaattaaaaaaataataaaatctcgaaaataatttcgagggtcaaaacttagttgacaccctaagtaaaaatgacgaaaagtagcaaaaaaaaagagctaaagtgataaactgtttaaatagtgtcaaaaatagttgcaaaacaacaccatttgcgtcattattttggtggtcgataaatccataattataatatacaatgacaattaatggacttaaaataaattccggctaaaaatgtttttttttaggtttttttcatttacttgagatgagtatcgttttttcaaatgactctaaattctaacaacattatttcattttttactcttcctttaggtgaatgtcactctcacagatggaatcagctcgtacattgtcacagtgtttgagtgaaatggcgcgacacgcgaacaatgaaacggaaccacaacgaaatgtcattaaaaggaaaaccagctgttcgtctggtgatctacaacagaatcagccaagctttgcgtcagaacaaatggatgacaatgacacggcctaacacaactttcatggatcatttgatctattgttaattcgttccttctccgttgcgaatttgagcaattcgaatttctaatctaatttgaacaaaaaatcattaatcggaaattcaaatttcttcacttttacactagcgccaaagattttccgatgaatgaccgtattccctccatttccaatttgtttattgtttgtgatttgtttaaacatgcagtcaatatttaaaattaatgcatatttttacagattcatttcattttacatgcattttcagcgatatgaaattttctctgttactcgcaaaaggccaattccatttaaaccgtaagcaaattccttttcgacttaattttgtttaaaaagtgtccaaaatttagcccacaagtggttcagaggcatgtggcagaagggctattcgtggccatcgttttccagcgaaaattggttcgttgtccatggagagcagaattaaagataaacaaaacgggcggtttgcgataacgttaaaactgatcattgttggcttaagcaaactatcacctgtaatttttttttttttgagtggagcccagcttctccaatattactaaacgtttaacaaaaccatggagtttttctatgatttttttcttgttaatgcattgtcttggtgattgtcccattgtgctttcagcaccggatgtccgcctccgattgtgacggatcatgccgttaatcaacttcgtaacatatggacgcgcaaattgaacattcttaagtggatggccaattcagacaataccttggtttgacaccgcaaaaaataaagcaaccaaccgaaaaatttcaaaataaatttgtaattttagaaaaatgcttcttcaagagatgctgatattttgtcatacgagcagttcgacttgttcgttgcggacttagatgaaagtgatttgttcaatgtgactattttttaaatttttttcatttgcttttttaccttctctactcagatggcaagagactaccagattggcaatcatcaccttagcgcaggcatgtttccaaaatcgccattcacccctccgccgcgcggaaaaataatcctaccgaatcaacggttcatgatctctcttccctgtcgccgagtgccagacggtgaaattctccatgtctggtttttagtggatattggtaagcacccatttgttatcaacatgtcttcataaaactgcaggatcaccttacaccgctgtgtcatgtacaacactgtctgctctttacggcaacagatcggaacccgtggaccacttttttctgaatatcttggtatttttatgtttatttaactaaaaaacataattgaactatgtttacatatttacccgaaatggccgcaaatcaactatttttagcaattcactatttaaaaattttgtcatgcaattttttacaagatctttttcaaatttgtacgcagtttagctcttctttaaaacatgaaatattttggtgtgttttaaggacccacacattaatattggatgtcaaatatcgagaggacatttttccgatcttaatttgttggggacaaacactctggaagcacttcaactcacacccgtcgctgactggggcaataagacttttgtcttagacaaaatgtaattttttttttgataattaaatcgaaaatgacatttttagtaagctatcaatttttgggcgtttttatgttgttggatgatgtacgaggaaaagaagattatttaattttgttttggcgattttggcatttcgttaaaaaaataatttttaaacaattttcatcttaaaaaatatatatttttatctctataaaataaacatttaaaccaaaattgacttttgggttgacggttttaaaaagttgtgaccactttctcctcgccggatgtgtaggaggggtgaccaggttgccgagtggccagaaggaattggcgggagaggaggaagttgtggtcctttacagggagtatggatgtttccgcgtggaggtggtcggcagaggagatggaaacgcatcctgtaattgtgcgaagggcggagttctggcatctctggaggatggaccaatttgagtcggccagttggggggaccaaatcggtgctgcataattgagaagactgcgagcgatggctttgtaggtggtcaagagtacttcttttgattgtccccaggttgttcctgccaaagcccggaggatgttgttgcgtttttggatttttgatcgaagttccacggaatgggcattgaatgtgaggagtgggtcgaaggtaattccgaggagttttgggttgcacaggaatgggatagggccgtcaatggtgtgaatacgcggatcttgttgggaggaaggcgttgattttatcgctggcgattgcgattgaggttgcgcgggccagaatggtgatgtcgtcagcgtaggtgacgatgtgaattcctggtggaggaatggggattgtggcggtgtagaagttaaataaggcaggtgagaggacgctgccttgtgggacacccatgcggatggtgcgatgggaggaggttttgcctcggaaaacgacttgagcttggcggccaccaaggtagttgcggatccatcttttgatgatagggggaagtgttgtgtttgagatgtcgtggatgaggaggcggtggtctacggtgtcaaaggcctttgagaggtcaagggagaccgcgaccgatcgttcaactggtgcttgtcggttgagtccgtctgtgatgtatttgtggattgaatggagggcagtgactgtagagaaaccgcgacggaagccatgttggttggcggggggtgggaggtgtgcgttgaggtggggaagaaggagtctttcgagaaccttcgccactggtgatagaagggagatgggccggtagtttgacgggttggttgtgtctttgccaggttttggaatgggaatgacacgggcatttttccatagttgtggaatgatgcctgatgtgatggtgagattgaagaggtcggccatgtatttgacggcgacaggtccgaggtgacgaatgtgggatgaggatatgttgtcgggacctaaggcggtagagtttttggtgttacttatggccaactggactgtggtggccgtccatgaagcaaattctgcggaattacgcatggctttgtcgatgtgtcgatttgcttgtcggttgacttttgaaggtcggccagaagggcggggatggaatgcggcatttaggagggaggccgcctttgagttgtcataacatggaagattgttaaaatgaaggggaatgttttgttctttggtgttgttgttgaggctttttattgttttccataattgtctgctattgcgaggacaacgtttgaggtgttctagccatttttcacggcgaaattggcagacacgctttgtgatagtgtttgtcaaatcgtgaattctgtggttggcgggatcagtgagttggagatggtcgcgttcatttgccaagtggaccatgtcgctggggaaggagggacgaattttcggtatgcgaccggccgggatgtgatgggcaggtgcagtcaggattgccgagcggaggcgtcgttcgccatggacaatgttcgttggtttagggagggtctttaggagtgagtcgacttcgtcagcaaagttgttccaatttgcttttgagaaattgatgaaagtgcgacgtggggtgtgactccattagatttggccttggatggaaatggtgatcggtagatggtcactaccaagagctgccgttgttttccaggttgttgaagtggcgagcgagtcgctgatgagggaaatgtccggggatgacagaatagtggaattgccgcggggggccacacgggttggagtgtcttcgtcatttagaatgacaaatgggtgttggtcgatggattctgcgaagtcgacgccgcgctcgtcttcgggggatattgcgtcccaagtagtgtggtgggcattgaaatcgccaacgatgagtgtgtcctggttgccggagaggaacccgttgatgtttggttttgagttgttgcagctgctgtttggtggaatgtaaatgttgtgaatgattagtgggcctttgtctgtgtgaattgagatggagatggcttcggtaatgttgtcacggactggtgaattgaggggagtgaaagaaatgcggtcgtcaatgatgaatgcaacgccgccacccttgtcagagggtctgtccttgcgaaggaaggtgaagccagggcgtttggggagacggcttttggaggtccattttgtttcttggatagcggcaattgtgatgttgtttgtggtgataaagtggatgatgttgtccaatttgccgcttataccgttagcattgaactggaggagggttagtttgtcggtggggatttgggcttttgttggaggggcagtggcccaattgaatgtagttgatgggcgggtagccggattgaactgttgtgtttgttgaggatgaggaggaaggggagcccaattgaagcacaaagggctaggattgggatggacgtccccggcgaggaggagtaaccgacgactagttgccgggtcaccagcgtcggatgggagaaaaacatgccagagtgaagagaagaggagcggaggagatttgatgggccttgactggtgatgacaagtcgaccaggtgtctattgccaccgaagaggcgcccattttgaacagactgctgctttgctccaattgtcggtggcatttgctgcgtaaaattgcctatgatacactgagtaacatcgcaagaaatgtttgtttgtttgttccccgctaataaaaatgcatttctaccagataaaattggtcgacaaattgtccaccgttttgctgaacaccgtccaaaagggtctccactcggacgacaaatgcaaagtgatgcgatccatggaaattgtggctggtttatgcgcaacgccaaccaacgagtcaattgtttgtgaattcttcgaagaatcggttccacgcttttaactgtgtttttagagtaattattaatttttagcaaatcataccgcggattttcgctcttttgtcactgaaggatattttgatgtgtatgtgtgccatggagtccgtgttggccatttccgagttgggacgggtcgcgtgcgaagccgtcgcccgctgtgaccgcgccgttcaaagtcagtggcaaattaatgctttttcattttataataattagtttataatcatttctgctgtattttagtgctcgtcggctttttgaccaccgatgccctttcttttggcaccgtcggtttggcggggatgcacgtggttgaggtgcacggacaccaaaccaggccttatgttgcggttagtttccgtcttgaaaatcacaattagaagatttaaaacttcgcaaaatgaatcaatttttagccaaacaaaaagaatcctcccccgccgcttaaacttcaacccgtacaacctcccgttcaatatgcgcaacaacggcaccaaacgccggcgagcagtacaacaacaacggcaccaccatttggtgaagcgatggaatttgcaataaatgctcgcacagatactcttgaaacatgcccaggtaattgatattaattaattaattatccctccgaatgctttcgtctccttcagatgcctttcaacgtcgtgcaaccgatggcaatgactctgctcaatttgcctctcatcagcgtcatccaccgactcgcaaaaaagtttatctgaaatcttcgcgcctgccttttctcaaccaccgacaacaattggccaccgatgctccgcctttacaaaatggcctttcgtcaattgctgccgcggttccgtcgtccattgaatctgtggcgaatgaacgcgactttatgtgcgaatggctgatgcagtcggagggggacgacgattggtcggacgaggagggcacagcagcggggccaattgagccgtgcgcgaggtgtgccgggggttgtagttcttatacaaaaattccagactttcccggcggccggaccccattgatttttgaaaattttatcccaaaacagcaaaaattgaattgttcaatttttatgcgcaaaaccgctgaattactacttttttggcctgaagagcaaaaaaaaaaaactctccggtgccctccccaaaatgttttatggatactggcatagtctacggtctcactggccatttctcagggcattgttttgttttttctctttttgttccccacttaattctttcgtctgaaatttcaggttttttgcttccgcctcacaaatgcttttccacgtgtacaacgaacatttggtgccgcttgtccaacagcacagcgacggcgaaccgccgaggattcgctgtcgttggcccatttgcgacaacactccgcgcactctgtggtccatcacaactcatttgcaagtaaacaatgatgagtaatgcattatgaaaatggatactaaatgtgctcaatggtcaggatatccattgcactgaaaatgcgttggagtcggcgatgctccaacgggtggagatgggctaccacggtacaatttgatcttgaataagcgagttcaaatgcaataatccatcggtgcttccctacaaagagtacgtctatcacattcggcaacagttcgagcgcagtagggaacggccatccgcgcagaatgcttactcagactttgccgcacaggaagcgatacgacgacacgcatttgccaatttgcgcaaagagattacggtacgtacagtgcatgcagtgcaagtattctgtagtattggtgtgattttccattccgtcaggaagattcggagggtccggtgacgcgaagcattcgcctcacttcagcgctcattctgcgcaacatttgtcaccattccgtcgccggacgtcgcaaactccgcgcgcatgagagtttcattaggtgaacaaaaacacatggccaatcaaagggaaaggcataaatggaccaggaaaacaatagctgacaatgagttaaacagagctaattttcatttacttgatttgtgtattgttttttgaaaataattgcaattctaacaaaattatttcattttttactcttcctttagttggctgtcactctcacagatggaatcagctcgtacattggcacagtgtttgagtgaaatggcgcgacacgcgaacaatgaaacggaaccacaacgaaatgtcattaaaaggaaaaccagctgttcgtctggtgatctacaacagaatcagccaagctttgcgtcagaacaaatggatgacaatgacacggcctaacacaactttcatggatcatttgatctattgttaattcgttccttctccgttgcgaatttgagcaattcgaatttctaatctaatttgaacaaaaaatcattaatcggaaattcaaatttcttcacttttacactagcgccaaagattttctgatgaatgaccgttttcccttcatttccaatttgtttattgtttgtgatttgtttaaacacgcagacaatatttataattaatccatatttttacaaattcatttcattttacatgaattttcagcgatatgaaattttctctgttactcttgaaaggccaagttaatttgaacagtaagcaaattccttttcgacttaattttgtttaaaaagtgtccaaaatttagcccacaagtggttcagaggcatgtggcagaagggctattcgtggcctcaattttccagcgaaaattgg

SEQ ID NO: 1330 - DNA, 2748 bp, Heterodera glycines
aaattgttggacaaacaaaaaagtatgaacttccattgtacgaactgtcgattacacgccaataacatacatatagttagtaaaataaatgtgtcaagggtctccatacacaacgcttaccaagaaaacgtgtgaaacgatctttgaaggagaaaatatagaagatcttcctcgtttttttcgtcttcgtattctggtatgtttgttaggttactatatatactgaattaagcggcaatcatttgcaagttaatgtataggcaggcacttgcaaatactcgaaaaccctacttgaccgttgcataaaaagggttctttttcggagttccaaaaaagacaattgtctagaattgtgatcctgatgaaaaaattctttgcaatgaatatggggttaaaaatatgctggtcacggatttgttcagattttgaaaactcgttgatttgtcgaagggtaactttgtggatatttttgcttattttaccgtgctttttttgtttgatcttataaaattttattagcagaattgaagtagaaaatttttgtatctttttttccgaccacattttttgcaaaagatttcgataaaaattttaaaaaaatcaaggatatgatgaaaaatcatatgaaattaatgatttttcaaaatctgagcaggttcgtaatcacaaggaccagaattccacacaattgccaagtaaagatttggtcgctaatttgaaaatgttaaggatcggaagttcgtcactcagtgtaatgtttcaaagccccattttgagcaagtgaacattttggggaacgatgctttgagtcacatgcgtttgtccccaatcgccatttgggataagaaagagttcagtttggtcagatatccaacacccaaatatttttcatttccgtttttcaaatattaattccattgtgattgtgctttgtcgctgggtacttatggcttttgccaacaacttcagaaaaattagtttaaaaattctgggagggagtggcaaaagccataagtgctgcaggacgacacccaactcgttttttgtctatataactatgtaggaggcagacagcgtgaagtcagacagttcatatacatataacgcaaaaaacgagttgggtttttaccgtactgaagaggtagaagtttggcaaatatacgaaacgtctgaaaattttgcagactaatagaaaataattggagctctcaaatgtcaccaagcttttttgattggattttatgagaaaaggatcaattttcttcaatttttcttctttagctactcagcaccatcccattttaatcctctcccaaaccgaaattgtcatgtaaatattcacttttccatttcacctttttcttccattttcgtgttttatttgttaaaaaaatttaccacgatttttgtggtcaaaatataataatttcatgtaattaagtattttcgacacagactccaataacacttcctttattaataaaatacgaaccaatcatcagacatatgaaaacaaacgctcacacaaacaataggcatgacaagatataaacaactactagtttaggtccagcagaagagagtgattgagaggaaaggggcactctccaaaagtaaggaacagcgagtaaaagggggtgaagggaaatcggaaagggttgcgaggaagtgtcagaaaatgaagtcctccttcgccatgtcgagagcccagcggaatttgtcgcgttgcgttttgctgaatattttctcaacgggcacgtcattctttttgcaccatgcaaccgaaatcctgaaatttttttggacatagtaaattggaatattcgatagaaccaacctcggatccaagtagttcagttttgaggttcccagtgcaatttgtttgttttcatcctgaaatcaaaaatgaccaatctttgctgttcccgattcgttgatttgaagggtgacttatttccccaaaaaaaatcaaattccaaatttgtctcggactttttggccaacccttcctcccccatgccttgtccgtgcgctgtgtgttcagtttggcgatctgttccttcaatctttcgtatttttttgccattttctcgtccaccgatttgctcttcttcagctgatccttcaactccttgtactcctgcttcttctcttttatctgaattttgcttaggatttgcttttccgtttcatgtcatattcactttattctccaaattttccatcgacttttcgtgcgtttttggcactgccctttgatggttacaaaggatggccacctgacgatttgcacctgaatgtaggcaatataagtgaaatgcctctgaaccagtggctttacgattgtaggaaagcattttctcgtggacggaatcggaagctgaaatttcggaattaatttggcaattaaaaatgagatggatacgatttgtcagtttgtccagctgttcttggagagtgatcgacgcgttatacgtacgaaacactttcgcggtcagtccgtccatcagttccttcaggtattggttcaacgaactcgtctaaacaagcgagtaaataagcaatgtttcctttttgctctctcacatccaatcggtcgaacaaatcgtcccccggatctttctcctccataaaaagcttcagatttttaaacacttgcttttccaccggcacacggttgtaatagcggatggagtcttttgccgagaagtcgaattcccacacatacttcaggtcgtccatatcatc

SEQ ID NO: 1331 - DNA, 4092 bp, Heterodera glycines
gcagttgatgacccacatcctccggctgggacccgtttcttcagagaacccatctttggatggtcacctgttcatcaacaagtctcgctttcctcttcgttctcttatttcactcaaattacctctccccctgaatagtcccggcggttctattcggaagttgccaattttctgtttgtatccgtccaacatggcgaacccgtacacctttccctcgccttccttctcctctttctccgcctttttctcctctttgctgcgcgctttgcgcttctccgactccgacacgtaaaaagcgtgcatttgcctttcaatggatgtaaagttacaaaatctctcgtctttttattttttttttgtttacctaaaatcgcatttggccaaatctttaatttcgcctcgctccgcctttgtcatcactttgacccaatccttgaaaaagttctggttgaacaccggttttgacgtgtagtcgtggtcgagcattttcgcgtaaaaggaagccacttcttcggccggcaaagacaaatccatctccttaaaaaactcccatatcaaattttggttttaagttgtaattccaccatacctttccgtcgtatttgaacttgatgtgttttggcaatggcacataggccggtgcaaagacgggccctttgtggacaagcgtttgccatttgatggacccatcggaggcgcccgcgttcgactcgtcctcctcccaccagcgccacacttcctcttcttcctcctgtttcttcacacgtttcttggacggacttccctgggaagaggagggctggaaatgtccaaaaataccagggttaaacaaataatattccagggaaattagaatgctttttctctacttttgagtgtcccttccctcccattgtttcccttcgcttcttcttccgactgacctcttccttcacttcaactttcgttgtcttccgtttcttgtgctcaaccccagcgccgctctcttccttgacctccaccttagtaacttttgttgttttcgttgactttttgctgtcgcttttcttcgccggggatgggtccgacttttgtttctttttctgaagtatgtcatcctttttcatccgttttccttctcttcgccttacctttggctgatattcctcctcttccccgtcggagtcgtcgtcaaagtcttcttcctctccgctgctttcgttcttttttcgactttttgaggtcgactcctttgactttttcggcataacttcctcagcttttttctcctttttcttctcattgctggtttcttcttttcttaaattggtttgttttcaagtgatgttaccataaaaaggcaattcttttaatatataaaaaagcgctcaaaatgttcgttaccgtttccccgtggtgtcgcgtatccgttcgccccatggaacattgtccaagtcggtcccctcactttgtcctccttttggtgcaggaacattgttcccaccattttgctggtgctcattgttaataacagcagcttcagatgaggaattggacaactaaaaaatacaataaaaattcgtgactcaaaaatcttatggaaaaatactccgttttcggtgcccgtgccaatggaggacccttcttggcttgaattcgagtccattaggtcaccaccattcaacagtggggtctctccatttgcctcagccatcattgccatattagggcaggacaacagaaattacaatacaataatagttaaaaggggggtacggtaataaaaaaaacttaaatatgaaaaaaaaaattcttgtaacaaagaaaatgaagaaaagaattaggtaattcagagagacaattacgatcgattaaacagtaaaagtactcacgaaagctaagttaaagaacaagctacgcaaatgaaactgaatatgtaaaaaaactgcggacgacgtacggagcacgaaaaagcttaaagacagacaaaatgccacaataatttattgattaaatttaaaattgaaattattttgtacgtctggcaccaacccaaaattaaaaactgacaattaccgcattccttttccctctgtttgagctttaagtccaaatccgccgtacacaaatgagtgatgaacaaagcattcgccgatgtattacaaatttatgttccaatttggatccagctttgattaacgttttgttggacgatgaccaattgctaacagactctcaaactgataatgatacgttgctgtttccaattgtaaaagcttttagacaacttcatgctcaattgaaggtataataaataaaaaattaagcatttctcaatttatgatatttacagtaattcaggaggagcttagttgcgttttaagtggacaaattggcagtgaaccaaaaccttttactctgctttcgattttggaaaaacaaccaaaaaaaaagtctgacgataaattggaaaaagaaaaaggcaaaaacctcattattataaattataaaattaggtttccttcagaaatgccaaattcgaatggtaaagaaaaagcattgaatgaatgcgctgaatcgattgaagtgatcagtttgaaagagcagaaagcaaacgaactgaacattgataaaatggtaaaagagaattagcaaataattaattaatacataaaatacaaaattagaaaaccgatgttgccaatacgacgcggaagaatgtactcgaattccaattcatcgatgccttttcgcttggaaaggaaaaatattgcaaatttgttgaccgatcggtccaagtcgaaagtgacatggattttgccaatttaaaagtggaaggcattgaaaaggaggatgaaaatcttgttgaaagtgtcagtgccgcttcaatttacaatggcaaagaaagttcgatttcaacaacagcgaactcgacaaattccactgaaatgagtgttggggaagtgaatggacggaaagtggcgcgaatattggccatgaggtgggagtgttcacaaagatgacatttggatcggttccgatttcagaagtggcattgatgtttatagtgcggacaccgaaggcgcacttctcacttttgcacaacggcggaagccgcaaaaaaagtggtgagaaaagcaataacaacaaaaatattgagattctataattaggtattaatttttggacaaatcggttgtagctgtgcaaccagcaacaaatgtaatcattcgttggcggaggagcggcgcattgtcattacgtcacggaggcaatcgccacaagcggaggacgacgaactggtcgaagttctgtctgccaaaacattaaccgaagagagaatggcacacagtggaggaggacagaaaagtggcaaaaatggacaaagaaaagggcgaaatggggaggaggacgaggaacagtcaacgctggaccaagtgacaccaatcccaacaactttggaactgagcaattccacatgatgaactaacaataagttattccacgttaccaattaaagtgtaataaaaatgcatttggataaagaacagtgatgcaataatatatatgagcaaaagcgaaggacacttttatgatttagggagaccgatgcttatttcaaaaaacaaggtgacttagttggacttaaaaattagatttattctatacatactgccgtatctataaaagtgccgacaaacgaaaaatacagtcaaagtgtgggcaatgagaaagggattcaacgacctcccgcttttcggttgctatttggcgtacgacggcgttttgcggtcctcgcggtcgaatgggtccctccacacgggcagccctcccgcaagttcctccctcgacacgggcatccgtttccaccactcgcgttgtttctcagcataatattcgttgctgatcatcggctgaatggcaatcgcccaaaatgccgcaccaataatcgtaacagtggccacaactccgaagaattggggcttcatgtagcgcttcactttccagtacacattatcataaaagcgggcgaagggaggcaatttaactcccgaaggatagcgaattcggggggagcgtatccaaaaattgtttaaatgggatacactttgg

SEQ ID NO: 1332 - DNA, 3798 bp, Heterodera glycines
agcattcaatcacgtggggactcaacccacctttttccatcaacaggactcaaccctacagcattcaatcattgggactcaacccaccaacattccaatcaacaggactcaaccctacagcattcaatcagtgggactcaacccaccaacattccatcaacaggactcaaccctacagcattcaatcagtgggactcaacccaccaacattccatcaacaggactcaaccctacagcattcaatcagtgggactcaacccaccaacattccaatcaacaggactcaaccctatagcattcaatcagtgggactcaacccaccaacattccaatcaacaggactcaaccctacagcattcaatcagtgggactcaacccaccaacattccatcaacaggactcaaccctacagcattcaatcagtgggactcaacccaccaacattccaatcaacaggactcaaccctacagcattcaatcagtgggactcaacccaccaacattccaatcaacaggactcaaccctacagcattcaatcagtgggactcaacccaccaacattccatcaacaggactcaaccctacagcattcaatcagtgggactcaacccaccaacattccaatcaacaggactcaaccctccagcattcaatcagtgggactcaacccaccaacattccaatcaacaggactcaaccctacagcattcaatcagtgggactcaacccaccagcatgtcacagaacaaaccactaatgttttttcaaaagcattcttcattcatccacccggggggataaatagaatttttattttttcgaacaaataatttctttaaaaatttaattaaaaattaattaatttaaacgaaactcattaaatgtttaataaaaatgaaaaaaataatatagaaaatcacttagttcgccgggatccgaacctgatgacccaactcaccctcagaatgatgcctcagaatcctcatttatgcagggattctgagtccttaacgttgtactaacaaccaaaatctaatttcaaattctgatcagagccctaaataagcaggaaaatttttccactcgaaaaccatatgaactcactttggtcccgaatcccaaaatgagttttattgttaaaactttcttcaaaaaaaagataaaaaatctaaaataaatacctcttataattagggcaaggaattatatgcattatacatgaaaattgcgaaaagccgaaaattttgaagttttttcttaataaaattttttccaggcttgaaaatcttttcgctttttggtaagaataatagagcatgttaaaagctttcgattgatataaacaatgttggatttgatgccaaagaaaaaagctatcgtggaaaaacgagctggcgcctaaacgcgtgggtccctaaatcagttgaaaaaaaatccaccccgtctccttttatcccccgtatctaataaccccccccccccccttctgagtaggttgaacaataatccccccggggggataattagagataatacggtatgctattaaacatcattttagaagaaaaaatcaatacagcttaaaatttactcattttagcgaaaatcaagatgaaaagcgaaattttcgtttttttgctaatttgattctttagaatttttactatatttaaattttgtggcaacatccgccatgccacccaccattgtatccaccggatgtgttacaacaagggcacacatatgtgatatatacgataacgtaacgacgacaaatccgcttaatccccccccccttaaaattgatgacgaaatcggagggttttgattgagaagaatgaattgctcgtcctcttcgtcggttttgcattccattatcgttcgctgatcattcattcattcacatatcactcactcactcatcaaatcatcaagcatctgagttgccatatttactctaaacatattttttaatcgcaaaaacccaaaaaaaaacctttaaatttaatccgtctccaaaaaaaacaacaataaattgccaaaactttcaaccatctcctcagaagagttacgaggaatctgccaactaccaaagattttacaaaaataaatttctgatgctgctttttgtgttgctcgccgtgtccgacgcgtacagttcaagaacaacggtacaacaacacccactacagcaggacacgttactgtacaagcgcagtgagcggcaatgctcggccggcaacttttgccgggaggaggacttcttccattattacggctgcagctttggcatttgtgacttccatctgcaggtggattttggcgagtcaataggcagtgcgtacaaatagtttttaagtttcaattaaattgaatttttctcaaaaaataagaatgaaatttcaaatctagaaaattaaaaaatatatatataaaatttttgttccaaattttctgctatttttcaaatttatttcaaatttttttgaaaaattttttactagttttttattttttttctagatttgaaattcttatgatttttttaaaattggtatgaactgcccattgtataaattacgtataaaacgagatgatatgggaatcttcgtctttggctctccgtcttcattttgttcactttggcgctccaatctcccggaagcaataataggaacagcaaaaaccatgattttccggcattggatttttcgaaaaaatggagacagaaaattttcggaatttgggattccataatctcaaaaaagtataggcatcgtacgactaagtaatccaaaattaaaaataacattgtaggaaattatttcataatttcttcactgaaaatggcaattgtccggcaaaaaaacaaacggcggaacaacgggggccaattagcctcattagtgtcagcatcatcatgtgaaactgtgccgtgccgaaaacccatgcctatcagcagaagtgccaatttcgtttgaccaaataaatcccggcggcaccgccagcagtcggctgcttctcctctcatttgcactttcacttttgctcacttttctgtgtttggcatatgcacgcaaaaacaattaccactacaaagtaaagggaaattattagaaattctttttttacaattaattccaagactttttacataaatttattctcattacgataaaaaaaaatttggtttttctaattttttaatatttgaaaacttagaaaaaatttttgacggaaattcgaaattcgcattacaacacatttcactgataaatgatcctttttcaattttttattttaatttacaattaccgagataatcaattacttcaaaaaaatcaatacccctgatacctaattagtccgtcacaataattattgaaaggtaacggtcatgagaaaacggcggcatcacataaacagtacagccaaatcagctgcttcaccagcaacggaagcaaaggtactcactcggcgggacagccaatttcagtttcgaatttcggattcgattcagtctcggtcttcgagattaagcttcaatttgagggattacccctccgcattttaatcacccagccagcttcttccttacaattataaaaaaatgtaattaaaaattttcggaaaattatttctttgaagggagaacgaccgctcaacgacaacaacaacaccagcaacaacagcacaataagcagcagcagcaacagatcgattctgagttctccattgaggacgtggacgaggaacaaattgacgaaattctttcggacactgcccaaaaatttggt

SEQ ID NO: 1333 - DNA, 4572 bp, Heterodera glycines
  misc_feature (3468)..(3468): n is a, c, g, or t
cgtaaaaggttcgaattcttgggtaataatgcagaattgtggtcccgacgtggtgcccccccccatttttcggcagaaaaattttttgttttaaaaagccgtgaaaacatgcttctaagggttttttgggtctctgatcacgaatatggcatttattttggtctatttcgaaccccagactcgaactcgaacaaaaagtcgaaaaatcaaaattttgaaaaattcattttatgttcgaatctgagcagaatgattatttttaatcttccaaaatcgattcaaatggatggaatggccaataactgaccgtcgttcgtctcttcgttaaaaaatgtgctggcttttgtccattgctctgcatttttaacgccttttgtattcaccattgacaacaaaagaaattattcatctgtcatatttgtgggcccgcaaattcggcacatttgatgacattgaaaaggataccgggatcagtagacaggtcatcactgattggctgaatttttaccgcgatgtttgcgctgagtattttgtccgacacccgatccaaattgggggccagggttggaataccagggttagaccgttgtcatgattgcggtttaaggggtaacggtcgaaatcgacgagacctgcattgtgcgcagaaaatacaacagagggcagttgagggggaatgtgaatgagtggctttttggaggcattgagcgcggggaaccaatggacaaagggctttcatggtgccagtcctccgcagacgagcccaagatctgctgccattgatagagcaatacattgcccctgggagtataattcatagcgatatgtgggcggcttatggggggattcccaatctgccacagaggtaccacatcatacagtaaaccataatgaaaatttccttaatcccaacgacccaaatgttcacacccaaaacatcgagggtatgtggtccacatacaaacgcaaattccgccccaatctggtaatgtttgttttcttcttttctcatgtcttcaacgcatttgtattgccattccatccatttgaatcgattttggaagataaatgtgaattttgttgaaaaatgaaattttgactttttgttcgaaattggtcgaaatggaaaaccccaggaaagacgttttgatgaatttcaaaaaaaaaatcattttttagaaaaaaggtggggaggggggggggacaaaccctactattaccccaaaatattcgtactaataaattcaaattcagtaattttccatattgactaattttgagagaagcaaaatccataaacaaaaccaaaactaattagaatatttcatttcttaaaaactatttcaatgcaactctttttgtttcactaacccaaagacaaattccttccgtttcatttactaatccaaaatttcaccattcttggcaaatagaaaaaacaaatgaaaaatcagaatcaaaacatttgttatactaataaaacatacacacaatcctgatttttaaccccaaatgctgattttttgatggcataaaatttgaaaattatcaaaatatttaagaaatcggatcaaaaatgaaaagggtaaattcatacccaatcaaactgaacaaatttggcatctaaaaaaagattttgaaaaggggaatctttttctaagcgaatgttaagtaatttgtcatctcagaaaaaagttgtgggaatttcaaacttttatcatgttataactcaagtcctaggcagactctttctaaccaaaatgctaaatttattctttttcctattgattctaaatgttcaaagtgattttgtacccttataaccaaaattattagaattttcgaatttatgttttttcatgtgttagagacatgaaaatagtacgccaaaacgagagaaaaaagaaatacgtttttattattatttataatttttgaatgggagtataaacaaaaataaaatcagtatagaaaaatgcagatttttcttctctatcgctatgcaaaatttggtgcggatttaacatagagaaaaaaagctagacatagaaaagcaaatgttgttttttacaccattaaaatgaagagatagtacgccaaagagagagaaattacaaagaaaaagagaaacgacgagatagtactaggcttttctctgcacagtggagttgacccatagtgatagtatggtttacaggttcgaattcgggttcggggttcgaaattggtcgaaatgaatattatattcgtgatcagcgccctcgagaaccctaaaggactttgaagaattgcataaaaccccctttttgccttttttttgtgggacctgtaaaccatactattaccgaatttgagtgccaaaaaagacatttttgtaaaaaaccaaatttttcaaaaaatcgccaaagtgggctccctttaaaaaaaagaatttcaaaaatttttaggcgccaaaaatcgtgaaaaaggcactttgataggcacgaaaaaattgaaaaatttttatgcttaacacatcaaaacaaacgcacaaatgaaaataaaaataattcttccgattcaacgcttgttgcaatccttcgtacagtggctgatgctgtggcacaacgggcacatttttcctcgtcttctaaatttcaatttggtcacaattacgattaattttatgaagtgtcaaagacaagcgttagtaccttcaatgagttgtgacacagcggtggcacccgtggcgccgcttgttcccggagttgacaccacctcaaaagcatcaaattcgaaatctgatcactatctcatttgtttgactaataggaaaatttaaaaatgattaaattcaaaattgaacaaattatttcaaatttcctaaaaagattttcaagatgagctctcctgttaacacggccataaagaccatcaaccttcaaaaatttttcagaatccgacgcttaggtttcaccttcttgggcaaaataataaaactcaatacaaaattctcaaaatctaagaataagtcggggggggggaggggtgtcggagccagtcatgtaaatcaacaaattttttctcttaaaacggctttttttgcggccaaggaatgtcgcgaatttgatttgcgacaagaatttctgaaaatccgaaagcatcagtgatggaggagacaacggggatgaggacggggaagcgaaatcgttggggaatgagtaagacgaattatttaaatatattttttcccagaaaccggcaaaaatttgtcagggatcagagacggtaatcgacccctaatggagtcagtttggataatccactacactatttgatgtgtaggtatgtcacattttaaatggattatttttcgaagcgaaagtcttagaaaaaaaagaaagtaaaaaaacctttttttggggtggtccgggccaaattttgcgatgttttggcaagtctacgactttttaaaaaaaaaaaacgttntttttgcggcgtggtttttaaaaaactttttggggggacagggggggaaaattttaaaattttgtatagatttcgctaaggaaattgtgcaagttttaaaaacgcattaagactttgtataaacttattttccaattaaaaaaaaaacatctttttttaaaattttctaacatttaaaaattttttaaaataattcggaattccgaaatttttcggaaagcattccctccccagtgctgacattagccaaactgaccaactgttgctgcatctgctgctccacctgctccgactcctccacaaaagccttggcattgcacgcgtcgcgcaggtggccctccaggcacttgctcaggttcagcatccaatcccgttggttctgcattttgcgcaggtacacctcgatcacttcgcccgccgggtggcgttggttgatcagcgcggcgccctgattttgcaagtcgttgaactgcttctcgtgatggagcagctaaatggcagcaaaacatggtcaccaaccattaaaaaggtaatcattcaatcattaaatatcagtagttggatgagcgagattcttgatatttaaatccgggtgaaatttgtaattttcaacggtaaatttttccataatgggattcaaaatcattgctctatcctctgatcattttattcatctataaaataaaatcactctattacatataagaattttgaaaattaaccaagattttagaaaaacttaattttgaaattaaaaaaaattaaatttatttaaatttatgaaattttgtaggtttgattataaaataaaatttttcattttgcatgcgatgataagttgttgcccataaattctataaactttttaattactaatccattaataatgccgatgcaaaattaaaacttaaatttcgaaatatttcattgctaatcgatgaaattgtcaatataattttaaatgctcgatcccgaacataacaaaaacatacatgtacaaggggtgtctcgacacccaccccctcgtcataagaggcctcggacaccccccccccccctcgttcgtcgtaaggggggcggctgtaaaagagggagggggtcgtc

SEQ ID NO: 1334 - DNA, 2071 bp, Heterodera glycines
cactggtgatgatgatcatttttctcccccgtcctcggtcacgtcgtttaggcgccaaaaatttttatttctttaaaattgggaagaattttaaaaatatgtttgtttggttaatggattggatttttatgggaccatcattaaatatattatatttttttattaattggccaatttgtggcagaacgttggccgtaaattattaaaacgagtgaatggtatttcaattttaaatcgttaggaaaagtggaagaaaagcaaaaattttatataaatgattttaaaaattatatatataattaaaatgattcaagggattaaaaataaattgtttaattttattggcgacaaaaagtgatcaaatcatctcaattataaaaaaatttaaaaagaaaatatttccttcgataaaaaagtgaagcaaaaatcaattttaacataggcaattatgcaaacaaagaaaaccctaaaagaatttataatgaaaaaataataattcttatttctgtacataaatataattattttcaaccaatttcatttaattgaaactcattaaacataattactaacagactgtttggcgaataataaagcaataaaaaattcaaccagtgagtaattaatcatgaactcccttccccccccccatggctacgggcctgcgtatggcccttggtctgagacaccccttgtacatgtatgaacaaaaacaacttttttcacaatttattttctggccaattatgcccaattagtcacgcccgcccaactacctgctttaagtaaattttcagcatcggaatgtccaggcgtcccaagtcgctccggttacgcttcacttccaatgcctcacgacgacgatggctcaaacacagttcaagctgagcagcacggatgaaggcgatcagcgagtcctgtgatcagagagagagcattttggttgatcagtaataaacaagaaagaaaatatgatcaaattaagagaccatggcaaaaattaaggaaatggctaacgcataatttaattgccctattaaaggacctaattaagcatggtataaagcccaacccaccaaatcgaccatgcgcccggcagacagttcgcgcaactgttggtactccgactccatcattttcaacagctcacaataatcgtatgaatcttctgctgatacttcagcctgagaaagtgaaaagtgatcagagaacgtagacgttggaaggaacgaggaatgattcttgatcatagtcatcttggtcgagattattatatgaaatatacggtagaaccaccggttcaatatcagagatttaaaatattccaatattttgactctaacaatttggcattttgtaggccagaaacaattcaaaatatttttatcacataaatttggtgtctcaccttcccccgatcaaaaaatggattgtaagatcactccaattgttttattaaattatttttggcaattttttttacttgtctggcaatgcattcgtccaccgtttgtcgaaagtcctgaatgtcccggttgtccagcttgtgctgttcaaagatttgctccaacacttccagcgtctcgctgaattgcatcgagttcagcttatgctgaaataaatgggtttattaagcctgcgaccatataattaggagtcctaattcacgtaaatgattaaaacactgctatttttatgatcaattcaatatggggatcagttaaaaccgaaggaagaaattgatcagaccattttttaggtctgttaaacctcggagttgaagtgatcacagcctttataatacgttcagctcataggaaaaatgataatgatcagttgatatatttattgggttaaaaaatcaaaacaattcaaacctaaaccctaacccggttgtttaatcaacacataacaagcatttaattattgagtatatccgcatcaaacacaccattcgatcacgaatccattggatggcatcctcaactcgacgaaaagcgttgccacgcgtgccggacgatgcggtcgagtatcgttcagtgacgtagcgtgctccctggctgaggccaag

SEQ ID NO: 1335 - DNA, 1629 bp, Heterodera glycines
aatttgcaatggaattgagaagcaaaaagaatgcaataacgaaattaaacaaaccaaaagagaagaagagagaaaggaaaggaatgagtgattcatccgccaatttctctcttttttattgtctttttttggcattttcggattaaagaaagtttgggcaattggcggagggggggggggagaatgggggggggaacttttgagagacataaattgtctccatactgaatttcgggcaaaaaatgacttttccggggtcccggtttcgggcatttaaattcgacttttcgggatcccgtgctacccggtattccgaatcgggattcctgattcgatttctgtcaggtctctaaattattgtacacagattcattcacacaatgtttggggtagtgggggagggagcaaataattggcagttaaaaagtgaatgaatgaacgaatgaatgccaacaacgattgggcacaacaaagatgatgtgatgtgatgagacaggaggaggaggatgatgaggaagtgaagaagagaaagtgctgattcaaggtcatttatttttcgtctccgcgtccgtccgtctccatcgacggcgcggcggagacgaaacaaacggcggaggacgaaaaacgaggtgtataatgacgggatagtgtgttcactcccccttatatatgcaacctcccccccccccttcccatccgaacccaattttcaccaccgaccgtccgtctccccgccgacaatgagcagaacgcatgatgtgcctgttgccctcttatagggggtgggaccccgacttttttgggggacataaatttttgaaaatccgtgatttatatggttggcattacacccaatttaaagtgctggttgagactctgaaagcctgaaattatcactcgagtcgagaccgacactcttgagcagcattatgaccagccgaacatgcccaacactccgtgccaccctcgtcactgttgaagatgcaaatttcggaaagtgccgggtttcaggaaacaattaagtggctctaaatctttaactcgggatcacggaagacttcctgagcttaaaacgctcaaagggtacaggaaatacaggggagattcgagatgccgaacgcgggattagtgggaaatttttggactgagtttaaaaatgcccgacgtgggggtggtacaagaaattcggagagactcgaaatgccgccgcccttggcatcactgggaacctgaatttgaaatccccaaaatttgggacgaattttttgaactatggcggcacactttggggattttgtgggattttaaaatttaaaaaaaatttttttctgaacccatttgaatgtcccactttcaacctatgataagcttaaatggtggagagctgagcggggctgctccactgattgatgctgttttgctatgcattcgtcgaccaatcggtcggtccccgccgacattctccttatgtattgaataccgctaaatcgtttgtgaaggataccatatcttcgagacgacatgctggatcgatgatttcttaatattaaattccctattgttttactctgccttccctatcagattaatgcgtatgatgatctcaactaaatagtgattgtgcaggca

SEQ ID NO: 1336 - DNA, 3278 bp, Heterodera glycines
gtaagttaaaaatgaaaatggataaatttaaatcttaaatttcattttatggcaaaaagtgcactaatccattttctggccaagttgcatcatatgtgggccaaatatgggcacaaattaaattaagaaagtaaagtaaaaatcaaatagggaaaaaattggaataaaaaattgtcgcacggatataaatggattttaaaaaattaaaaaaaaacaaattaggacgaaaatttcaaatttttgagctatattccacatacttaaaattcgagtgtttttacagtagacataattaatactctaataattacgcattatgaacatataaaaaaattcactatttaaaaatagtcttcaaaataaaataataaattaaattttcataaaaattgcattaaaaaattgatttaacacataaatgcaggggtgcgatcgaaaatttttcaaaataagaacatcaaggccaaaaaataagatttttgggtccaaaataaggacattttgcaaaattgctttaaatcgcttgtataacactttattcaattaatatagcatcaacttttgtacttttcgcctccaaccaaggaattttggagaatgggggggggggagatggtccggcggtgccgataggcgccgccgaggaaaattttttgtaagttcgttatgatttgttaacaaattttcatcaaaaaggccaatttttgcaattaaaagccaagccgacgacctttttttgccttcgaaaacgctttttttgcggcgaatttttcaaaaatttttgggggttggacaggggcgtccggtggcgccgataggcgccgctgggaaaattttgtgttttttaatgcgatttgttaacagattttgtctaaaaattgccccaattttggtgattttagagctaattttaaagaaaataaagtatttttagcgtccggcggtaccgataggcgccgccggaaatttttttttaatttatagggaaaataagaacatttatgccataaatttctaaatttatgaataattttaagaaataagaacaaaataagaataatagcccaaaatcagaacatttcttacaaataagaacatttttattttgtaagatttggaccctccaaatcagaacatttcttataaataagaacaaatggaagccctgagtatgcggcctcacctccaaatttaaaaaagctccaatggtagcgcgcaacagttatttaaaaagcgcaattataattactcttcggacgagagggtatttaagtgccgggtagtggaaggtcattaatcttgctgctacttctgctgctgctgtttaataattgttgattaattgggcagtgatttaccacggaaaatgggtttttaaaaataaaaatgatattaataaccatcctctcccatttttggcaattttttagagctctaagcataggcatcagtgtcattccaagggtccaaaaatttcccgaattgtgattagccgtgagttttgcacataaatcactctaacatattcgttcaatgaataattgaccaaataaagtatgccactaaattaatcattaaatgttgtgaattttaggcaatttaaattcaaataagccgaaaagcatgacaatagtgaacaagtgaatattaaaagatttatggtttgaaaagcattgaaatatatagtatatgcacaaaatatggggaaaacggaaaaataaattggtttgatccgccatttagagagtgccaaagtccgacagacaacaaaacggcatcaaatccgaaaaattccaacataaaacacaaattgccgccacattcattcacttttgctgttgctggccacttgaactggcggtggatggttcgtcctccaaaatgctgagcaattcaaattttaattaacaaaattcccaaaattcacttcctttctcacccttcttcggtgtcgtcatcggccaattcaattgtaatttggtttgtttcatcttcaaatttccattcgaatgcctccatttccatttctgttgaaacaaaattagggggacagtgccgaaacaaaatgaatgtttgattgccattgagtctgagactcatatgttctccagtaaaagtgttgcttatggaaaatgttggaaatacaatttcatccgaatcccaaaaacacaacgacgaagcggaagcgggatgccgccaaacggaatgcctaaatcaattgtgccgttgttcgagagtctttacttgagtcacggattaatggatctcaaaatctaagtatctaagggccccaattctcgggtaattttccgtctcgaatagcgttattatataaataaagcaaaaaaaaggaagaaaatttaaaagaattctggaaatataagttaaaaaaaattcctacttcttaacctaaatttaaaaaaatcgtaaaaatctgaattttcaattttttttgtttgagtttgcgttaatttcttcgtgtcttacgaagtcgcctttcttttacgccttcgtctctgacttttcccctaatcgcttcacatttttttgtgcctttgtccaaaatcgggttcaaattaagtttttcaaatcactgacagcctaaacaagctttaaataagcgattgaaagtgattgtatccgatcatttgatcgtcaatgaatttttgaaaaaattattaattttcaaacaagcgcgcaaaaatttacgccaattacgctatttggcgttatgagaaattttgtctaacactgcggaacgggccaactccgtctggccaactccgtctgagccaactttgagtcaatataactcttgaagttattgaccgaatcaaacaatcttgatatcattcgaaagctcttcacaggctctattagcctactaaaaattacagaaaatttcgaactataaaaaaagatagaaataaaaaactttgaaaattctgccttttttgcggttttcaactgacaacttttttgagagctgcttaatcactgagaaatagcttataaatatcttctaaacatctagggctttcgaatgataccatgattgtgaagtttggccaacaaagaaaaaagttatagctttttgaacattgctgagacggagttggccagacggagttgacccctaccgatttggcgcgctgtcaaaatgtcccgcgtcataatgtcccgcagtcataatgtcccgcgtcataatgtcccgcgtcataatgtccagcgtcataatgtccagaggtcagaatgtccagcgtcataatgtcccccaa

SEQ ID NO: 1337 - DNA, 6481 bp, Heterodera glycines
attttcaaaaaaaacatttacttttggcatagtctctagttcggcgctttcataaacattcaaatattgttggcctatagagagcgctattactctgctattatattacgtttggccctgctcagtcaaacaaggatggttcgtccgacttttgctgactaggccaatcgtcctgtgggccaatggttttataagccattcgccctgtaggccattcgtcccaaagtccaattaaaggacaatcgccgccgtgtaggccaatcgtcttataggccaattgtcctgcaggtcatttgttatgtaggccaatcgtcccctaggccattaaaggacaattgcagtgtaggccaatcgtcccttaggccattaaaggacaattgcagtgtaggccaatcgtcccttaggccattaaaggacaattgcagtgtaggccaatcgtcccgtaggccatttgtcgggcagtagccaaaaactgtttggatgttgtcgaactgccaaacaagcctaatgaaagagcatctgttaataattaaaactcaaatttagcatcattcaattatttgttttgatttttaaggcacaataaatcgacgtcaatcttcaaaataaaaaatgtcggacaatccagaaaaagtggaaaaacagatggaaaagcaaatgtatgtgtaaataaataaatgtgccgtttttcagtaatagagaacccataaagaatatgcttgctttttccgctcaattcgtacaaaaagcggccctccttatggagactaattgagtaattaatacttaaatagggaaatccttaatgtgccaacccagtggcgtgacaattcgtacatgtcttaggctaggcgccgaagccttaggcctagacttaggcttcttgggcctaggcttaagcttatgctttcttttgtaaatttttttattgtacgagttgcctttgtatgtgtagccattaactcgctaatcctgaatttcgtctgttaaactggatgtttaatgacaaattttgccgaaactggggtactgaattcaaaaatccgtgcacagagacccctaaattgagcaaattccaaggcttttcggtgcctaatcttcaaagctctgcttggggtgcaaaatggcacttcatttgccatttatatgaacattttgttccgttttgaaaagaacttgtcgttatgtaagactgatgtaaaccgcaaaaggaggctttgagcttttttttttttgtgaaattggcattagggctatgattacgcgattaaaatctcggttttgccgagatttgaatctcgatcctgggattcaagtcctgccttgatgagatccagatcgcggcacttctttcacaaaaggcgggatcgggatcccgggaaaatccaggcgggatccagaccaggattatattatcgagattcaactcggttttactggggcataaatctcgacgctgggattcaaatcatgattgagatccggatcccggccctcttcacaaaagccgggattgggactccagggaaatcccggcaggatcccgaccacgtctggcgagccctctcccgctcgtctttacaaaataaatcttcgggattgacagggatcgggatttcgtcgggatgccttcgatctcagctttttcagattcatttgcggcgacagttggcttgagctgttccatttgcttcgacccgccaaaattgggcttcaaattgcgctgctcagcagccgttttgacgctttggttgacgaacacttcaaaacacgccattggacattgggaagcattctaattaattgccaaaaaattggtggcacccatggtggagaggacgaagacggcgacggcactgccgagaaaaagcaaatgcaaatttttttcttgaccaccggactgacgattggaaattggtgccaattgcggacagaccggtgcccaacaaagtggtcggattccgatacatttacattgagtaatggctcgtttaattactttaattatcatttattaggcaaaaaccatgaaaaactttgaaaatttctgggttttgccattgaagcaaattatttttaatttttttgatagaaatataaaaatttttttaataataatttaatattgacatagtgtccttcactgaaggattttcattcactctcagattgtccttaattaacggactatcctcctctggtggattgtccttaattaacggactgtctttcactctcagattgtccttaattaacggactgtctttcttgacagattgtccttaattaacggactatcctcctctggtggattgtccttaattaacggactgtctttcactctcagattgtccttaattaacggactgtctttcttgacagattgtccttaattaacggactgtctttcactctcagattgtccttaattaacggactgtctttcactctcagattgtccttaattaacggactgtctttcactgacggattgtccttaattaacggactgtctttcactctcagattgtccttaattaacggactgtctttcttgacagattgtcattcgctgattcattttttggcaacaacatttgcagcttgtttattcccaacgaattttgccaatcttttctggcttcatttctcgacaattattgtacgccaacaactcgcacactttttttgcctttttacgacaatatacccgtatttccaacaacaacaacaacaacaacaacagttggtgccatggatgatgcgcaacaaagtgccgatgtgtcgtcgccgaatgaagttgcgttggccaaatggttgctcacgccaatgccgtcgtcgtgcgacatcggtggcatttccctggcgccaaaagtgctcaaatgcggatggcgcagcatgttcaattgtggcgaattcgaaatagagaatcggatcttaaaagttgaaaaaatcaaaacggtaatcaaataatctaaatatttatacagtagggcactttgacacggtagttaccttggcgcgggtatcagggggacaatgtccaaaatagggtaaaatgggcgataaatcacaaaataaataataaaaaatatcaaaattttggcttacaaactaagcatgtgtaccaccgagttatgaaagtgccacaatttgttttataatttactgcatgagttttgttagtggcagttggtgcataggcgctgcgatatcatcatttgttgggtcaaaggttcggatcccctagcattcgaacccatttacaattttttttctgctgatctaaagtaaattttacaaaaaataaataaaataattttttaataattttgatagtttagtgaaaataaaatttgtaaaattgatttaaaacttgccacatcatagaatttaaagatcttttttcggttaaaagaaattctcatgttttgccaatttatttggctctatccaatgtgtgacccattcattatttggcgctatgcttttcagtcatttgccaatgcttcttctcgtgccaacttcatcatcatcatcacgtgctttaattggacctttagtgttagagatgcccaagcaattgaaccgttttgcgtgaccaacgcattgaccggcgaacaattggcacttcaacattttgaaagtcctggtgctagtatgcaatactatgtggtgatgattcgccgctgtccaattgcgcgggatcggcacaaatgggccaaatgggaaaaggaggcgattgaatggaatttaaacaccaaatggaacgtcattacacttagtgatgatgttgattccctttcctaatgatgatgataacaattataataattattaagatgttgactgtaataataataataattaatcacacttattcaattttgatcagtttttaataaaattttgatcactcattggatagattactgtaagtttctctccatactaattaaatcagtttgacaaaatgcgacaaagacatactgtgattaggtcgatgttgtaaattcatttccatttaatcagttttacacaaacgcaatatcgtattttgaatagcttactgtaagtttgtttccttaaaattgcaaatctttttgcttcacagacacatttcttatcactcataagcagcagctgaaactgtgaatggtgattatccctaatgaatcgttaaatgttttcccattttaacgaattttcgacaatttaaattcaaataagccaaaaaacattttataagtaattttttaaacaaaaacaacgacaatagagaacaggcgaatgaatatatgtaaacaagagtaaatatgttaagaaggcactgacatttatatggaatatgcatagaatatgtattgaaatatgcgtatgtattgtataaaataaaagtgaatgaatgaaaaagaatatgccgaaaagaaacattggtcggcagaaaataatagaaaattaattggttttgttggccatttggagagtgtccgacagacgataaacgggcattaaatccgaagaaattccaacactaatcgccgcatcattcatcacttttgctgttgctggccacttgaactggcggtggatggttcgtcccccaaaatgctgagcaattcaaattttaattaacaaaaatgcccacaaattcacttcttttcttacccctcttcggtgtcgtcatccgccaaactaataataattttgttttcttcatctttaaatttccgatttgacgcttcaatttccgcctcaagtgaaatcaagttgggaggacattgccggaccaaagtgtatgtttgattgtcattttgtctgaggctcatatgttcgccggtgaatgtgttgcggatggaaaatgttggaatttcaagtttatgcggaagacaaaacacaacaatgaagcggaagcgggatgttgtcgccgaatggaattcctaaaccaatggtgccgctgttcgagagtcttgactcgagaaatgtcggctgttcggggtcacgaatcgcaccgcgacgaacccggggatatgttctcgggtcacggggatcaaatgaagaagtctcggaccaccgacggggggaggaaattatcggtcttgagtcacggattaatggatctcaaaatctaaaggtctaagggtcccaattctcgtgtaatttccgttctcgaatagcgctgctataaataaaacaaaaaaaggaagaaaatttaaaagaattctggaaatataagttaaaaaaaattcctacttcttaacctaaatttaaaaaaatcgtaaaaatctgaattttaaatttttttttgtttgagtttgcgttaatttcttcgtgtcttacgaagtcgcctttcttttaccccttcgtctctgacttttcccctaatcgcttcacatttttttgtgcctttgtccaaaatcgggttcaaattaagtttttcaaatcactgacagcctaaacagctttaaataagcgattgaaagtgattgtatccgatcatttgatcgtcaatgaatttttgaaaaataataaaattttcaaacaacataattaatgttcttaaaaatcaaaagacagtagtgatcttttcataatttaaatgctgtttaggctatcagtgctttaaataaaatcaactttgactccgattttggacagaggcgcaaaagtcggggctccggtcgtcacccccgccccctatttaaggtatggtaaatccattaattgcttacttttttaagttgtgcaataaacgcaagagcaactttcttcgtgcataaaaacttaagttttttcaatggcaacagatcgctgttgtacggaagtgccgatgatgggcacaaccaattgacaaaagcttgcagcgcagcaaaagtagcggtttccgtggaaaactttttgtgcacctaaagcacagaatgaagtggtggacaatcggtgagaatggacgggatgacacgaatgacgtcattgttaaaggccaagccattggtagtgcgcgagaatagtggcaaaatattgagcgaaacaaattccaacatgcgatcacttccctttgggatgctcacataaagtggacataaattgaaaactgtggtcctccatttgttcaaaaattccataacttgttggctgatgtatctgaaaaaattcaaggaaaaattaccgtaactcttagttatacgtgatacacttcggccctcccccccccctccagcttcagcatcaattagtggagtgcccattttttggtctacaaatttcttattaccaattttttgggagccgttgaagagcccaattgtaaaagcccccccccccccctccctccctcagaaattgtataaattaattaaaattttcaaatattttacttgatttcaatttcttcaaatccaataacacgtcctgtaagcggatgatttatgtaatccaaaacgtttccagccaattgttttttattctgctgctcaatcatttg

SEQ ID NO: 1338 - DNA, 10151 bp, Heterodera glycines
tgggtgtgtgggctgcatagtatcagctatccctactcatggcattccacaattggtaccttggatgatcaatggatagacatttattatactaatttgataaatgaaagcagtgtaatccgagtgccggtgcccgaggcgtcacataaaacagtggatcagctccagaaatttttaatcgaaactttgaagcaccaaagtaataatgttcacgtggacaattacagaaaaatcaacaaaactcaattatcagagggagataaatttttgcaacctccccagctgctttcctctccaccccgaaataaaagatcagcgccagcagaagacgaattgacttccccaccaagatttgatgaggaagaagggttaaaatctccgccaaggtacgacgagacaaagagaccgaatttggatgatgacaaatctccaccccctccggttaaaccagcctctccacctaaaccaataacaccatctcctccagctaaaccattaaaaccaccccctccagctaaacaaataacaaaaccccctcccgctaaaccaacagcacaaccccctcccgctaaaccagcaacaccactgcctgttgccaaaccaacaacacaaccccctctacctaaaccaatagcaccaccccctccacctaaaccaataacaccaccccctccagctaaaccaacagcaccaccccctccagctaaaccaacagcaacaccccctccagctaaaccaacagcaacaccccctccagctaaaccagcaacaccacccccaccagctaaaccagcagcaccaccgcctgttgccaaagaaaaaatgccatcccctccggttaagccaacacaaccttcgcctcctgtaaaaccaattacaccggttaaatcaacacagtccattcctcccgcaccacgtccacctcccgtacctcctattaaacaactaatacactcaccaccaagacatcaaccacctgcaacgaataacacgtcggatagatcaaacgaaacaacattaattgcttcagaacccattgcggcagcactaacatctctaccccctaatgaagaaatacaactcgtttggactgatatactaccaggagagaatttgtctaagaaaagtgataacgatgagtatctcaagtacattattaaagcggtggaaattcaatatcttgatgattttgaacgattcaagctggttattgatgagccgaatattagccacttatccttctcgccacagttgggctatgttctgggatttggcgatcctcagaatgtccgtaatggagaaattgccaagtacaggtgtgatttgaggggtggtttctccagctttgctgtgtactcaaaggggcttacagaaaatatgattattggaaattcgcttagctcattgcttcgcgttgtatcagttaccagtggtatgcctggtgattatattgagaaaatttatgattcgccaatatttgcacgcgtgctgcctcgggagagcaatgaaattgagattgagatgcgctcaatggacagtggaagacatgtcccattcgcttacgggacgacgctgatcgttttgttatttaagaaggtgataaatttttgatcattctcattttgtattcatttatattaataaaaatggttcatattgtgtttgatccaagtaatgcgggttatgatgaatatgtgcaatatggtagtggcgtagagattgaagactatttcaaaggatccagcccattccaacgaggatacggtgctcaacacggtgctggggttggggacgtgtttcgagggatttggcgctttttcttgcctattcttcgccgtgtgggcactacagtaggatcggaggcgctgagcactggtcagcgggtattggatagagtcggaaatgagggattgcctataaaggaggcgctcgtgagtgaggggaagcgaggcattgataatgtgttggataaaggcggattaccaaaacaatttggcacaggcaaaaagagtataaaaagaaagcaaaatagccatcaaacaataattggacgaagaattgcgaaaccagtgaggaaacgtgtacgctcagacgcatttggtctttattaaatggcttttcataaaattgataatgatagtgtaaactcaataacgaatgcattggacttttttcgtattcctccaacaaatgtgagcgtctcatcctcaaaagtatttgagcttcttcccagcaatccactggccgacacaccttatcactttaaactacattcaagtcaaaatttcattgacctttcaaaatgttatttgctcactgaatttcgcattcgtaaggaaaatgaaaacggtcagttggtgaacattaccgcagcggacgaggaagtggcgccaattcaaatgcttggccacaccttcattaaaaatatgcgaatgagcatcaatgggcgtgaaatcttcaactcaaactcactaatggcttacaagacatatttctcacacgaactttcatattcaactgccgccaaggactcgcatttgaatgctgccgggtattataaggacacctctttggttctcgagacaaactcaggctgtgctttaagaagaaatttgtttactgaaagcaaaacagcccaatttgttgcaaaaattgatgcggatttattcaaccagccgatgtatctaattaatttttgtgagcttgacgtggaaattctaccaaatgacaccaactttttgttaatttcacccacttatgccgggacgcgctttcatcttgaactcgtgggattgaaaatgtatgtgaaaaaggtatcactgatggatggattggctttggacattgcgcgaaaattggaggcgaaacccgctcgctatgcggtaagaaagacattaatgaagtcaatgttcatcagtccgggtcgttttgagtttaatgcaaatttgttcatggaccaaattccacgccgcatcacaatggggttagtgggaaatgctgattatgttgggaatattatgcgcagtccattcaactttcaaccttttaatgtgcgggaaatctcaattattgctaatggacgctcatttccgcaagcaccctatgatttggactatcccaatggtaaatatgtgcgcgcttttaatgacatgaacgaagcagtgggcttcagcaactcaaatgaaagcaacggaataacttttgcacagttcggaaagacccattgcatttacgtgttcaatatgacaaacagtggtgatgatcaggcggcactatttgatttaataaaaaatggaacaacggctgtgagtataaagttcaatgaggctgtgccagttggtggggttatgcttgttgtgatgggggaatgcgattcgctggtgatgttggataaaaatcgctcaattagcactgatgtgactatttaaatcgatttgtaattgtgctttggccagttaataaaatgaaaagaatttctatcatttttctattggttcgtatttttcttcctgtcgtgagtgaggtgaattccttacctttttttaccaatattgatcatttgaaaagattagataatgcgaccataacaccacacaatacaactaaagtttccaaactacctgaaccgcataaattgattgatgagcctgtcgcagcccttctcccaccattaattcaattgtgtaaaaataagccagaggaagataatttttatcaacaaactgtgtgctgggctctttttcttctctatttaatgctaattttgagccttgttctgcatcaactctattcaatttgctggtttaagcgaaatggacagcaaacaaattacgaggattttgatggaaaatcgattcaccgcaccggtctttcgggggtgcttcgctagcgaccaattaccctctccacacacactacagtatcctgcagcgctcgttgtcaacaaagacccccattacaaggagggctcccattggtgcgctgtttatgcaaagggattggatgcgccagtaatatattacgatagtcttgcgctggcaattgcgccctcacttgggtcatcatttctaagccaattctcagaaggcgtgattaagaatagtcaatcctatcagtccccaattaccacaacttgtgcaccacattgtattgcctttatatatcatatgtccattggacacacatttgccaaatttctcgatattttggataattgcacaagcccagatttatattcattaattttactgaagaaaatgctaaatcgttattgaatatttattacgcccaatggttaaatgcttgcatgtgttatttgatcagtaaactgagaaaatcatataatgaaggtcaggattactggttcgggaatcaatcatgagaaaccccacataatgcccataatgactgttttttagaaaaaacatttgttctttgtcggtgtgcgcgacctggtgaatgccctgcgacgacatcatgcgagccgtagagttgagaattgtcggaaagtccgaacggcgcaagaatgagactgcaatgtgctgtttcagtgtggtcggtgttggactgttcaaaacgaattgtagcagtatgccacacaatgctccagtcacagctgactataacatattaaaaatatatattttttaatttttctcatatttaccgcatccgaaggcaggtggactaaaatgcgcgttgttgcgattcggcccgaacgagagtagagcaaataacgggtgaaatcgttgaagtagaaagggtccagcagctggaacgcaaacttaaattgaatatggagctgaccagttggaagccagagttttgcacagatggtttcaaaatcaagtgacagccgtttctaaaatgcgaaaaaatattttcattaaaaattttttatgcaccaattggacgaaaagactgcagcgttttgttcgaagattttcgaatgaccaattaatgagcccaattccgcaaggagggagaaatccgtcttaaatttaaaaatgtaataaattttaaattgtattttttaaacaaacttgtaacgggtgtcgttccaccatacaactgcataacaggcacgaaattgaacatttcgtaaacgagctcggctggaaggcgtcttcgagccttcaatttcttaggcttcggcttgcacaatgccactaaaaattttttaaacataattttaaatatttaaaatattaccgccaaataagaacataaaaggaatccaattgataatttcgtcaagcatttgacgtgtcaagggcctgcaaagtcttggcttcttgctcacaacaattaagtcttgctttctcttgataggagacatttgaattatatttaaaaatggaataatgaatgcataatgaacgaaggagaaaaaaagggcacaagcaccgaaattgccgtcgcaggacataaaatgacgcaattaaatgcccaaatttcaagcacacattgatatgccttgatgctttggtctatcaaacacctgctaatttaaaataaagtcacatgcaaatgagtcgaataagcggatattccataggtcaaggtcataaattatgcttctaagtaaaaattgcgaacaccccaaaaatccgacatctgctaattctcactattcattttaaaatttggctaacattttgcattttttttaatcaataactatctcatttttgctgttaatcagggcggttgatcaaatcctggtctccgtttatcctgacagcatctcttttagctcttcatggtagatcaataaacttttctaatttcccgagccgtttaggtgccctgtcgtcttgtgcttcatatggcagtgcgcagctcatcaggccaagatttgtttgccattaaaaaatatgattttttaataaaataattaaaattatgttatttcatttcatttgtgctttttccatttccattatccgtcaattataaaatgccacaagtctagctattttactcatttaaccaaagttaatccctaattatttaaaatagattacaaaaatgtccaatcgccaataccccaaattctttatcagcaacattttggggccatcacagccgaagaagccacgccaaggctttctcatcaaccaattgcttggtattgtgcagcagcagggagaaggggtctcttcctcatcatctgctcaaaagaaagcaaatgaatacgtcaaaaagttggacaacagccttgaacatctgccagggttcaactattcaaaagtcaaatcgcggttcagcatcgaggatgttcctgaaaatcctgaaacattgttgaccgccatttttacgcattgtattgatgaggcaaagacggacagcagcgatcgcggaattgtgcccacacatctcggatgtgtcatcagcagtcagctactgacggcaggcgacctctttatcccgatcaggcagataacagacaacacagtcgacacaattctcaacctttttttaaaagtatcgcagagcaaaaagactgaaggggtcacgctgtggggcgaaccctttacagtcacagtgactactgttaaccgcgacgggcttcctgccaaacggcagctcaaagggggagcacgtcggagaatagctgctgtacaccatcgcattcatgaccagtctttgataaaggttttcgaatagctgatggagaaatataaattgcagtttaagatccgtaaccccgatgatcgaaactactgtttgttctattctttgcaagcaaccatggtggccaagacgcgtggatggccccgctggaagttttacgattatttgcacagccagcatggacagcgagacaaatttctcagtgacactttgtcgttaatgcgcacagttggcatccaaatggatttgaatggttacgatgctgatacgtttgtgccgcgcataatcaaccactggaacaacacacagcaaaatcaccgatttgccgttttcatctttggttcaaatggacaatatagaccgctgtacaagtacaatgacaacacatacgacacaccgctacttctttacttcaatgacaaccatttcgatggtgtgcaggctcaaggagggttgtttggccgtaaatattgtctcgagtgtgaacggccgtatcgaagagacagcgagcacaacaaatcatgcaaagcacgctgtctgctttgctctcgggttggaccagcatttccatgccctgccgccgccggcttcttcaaaaaatgtgatggctgcaacaaaaaattccggaacaacaattgctacactcatcatctgcgcacaaatttctgcaacaagtcaaaattatgcaagcattgcggcgtaatttgggatgtaaagcctaacaacacaaatgaacgaaaaggtcatgtatgcggtgaacagttttgcacattgtgtaacaactaccacaacacggaaagaggatgcttcatcaaaactcttgagcccaaagaacaggacccataccgcattgtggcgttcgatctggagaccatgcagcatcaaccagttaatccacaacagctcgatcggcgaagtcatcagccaaattttatcagtgccaaggtcatttgccctgattgcattgaaaacgacacatggaagaggggtacagcaggatgtgcggtgtgtgggccacacaggacagtcgcattttgtcagcggccctttaacaacaccgtcgttgaccaacaagtggtgaccgacaacccattggaagcatttgttgagtggctgatcttccagctgcccaagcaatacgacacttttgcttattcgcactttggcggccgctttgatatggtcattgtgtttcgggagctgttccggcgaggatttaatcccgaaatgttgaaaaaagtgaaaaattaatttaattttttgtaaaaattaaattaattttagggaaacaaaatgtaccagatgaaggtgcgaaagcaaaagaagcgcaatccgaacgtggtcttcagagactcgttcaacctgatgccaatggcacttgcgtctcttgtgccgtcgtttggtcttgatgttgaggacaagccatatttcccgcacttgtcaaatcgaccagaaaactacggtcaacagatattccccacgtccgacgactatctggcaaatggaatgatgccagataagcgacgcaaattcgacatgtggtatgagcaacatcgcgatgtcccctttttgctggatgaggagctcgccagctattgcaccaacgacgtggaaattttgacagctgctctcgttgcttttcgccaagagttttttgaaatctcccaacgacaggagggtgttgttgcagaacgggccgcatcagatgagcatcatgatggcattgacgtcttgagggagtgcatgaccattgcgggggcatgtatgcgtcacttccgcacaaatcaccttccagcggatcatctggccattgtgccggagcggggctacgacaatgcccagaaccaaagccttttggcacttcgcttcttcaagtggtttgcagaggaacacggtgtggtggttcaaaccgctcactcaccggaaggagaaaagaggattggccagtacagccttgatggatggatccaggccgagcggagggccatcgaagtgaatggtaattgattttttttttggattatgcgtttcatttgaaaaataaggttgtgcgtggcacgggtgcaaaaagtgttatccaagtgataacatgctgctaccaaatggaaagtcggcaggagaagtgcgcgagcgggacgcaaagcgcctggaattcattcactcccaagtggcacacgtggatgtgtattgggaatgcgaaattcagtgtatgctgagcagaagcaaagagatgcggcaaaagtttgcggaatacgttgatgatggaccactgttgatcagagatgcattcatgggcgggcgcacgggaccgctaacgctttaccatgaagcacgagatggagagaagatctcgtactttgatttcacttcactttatccgtatgtaaagtgagttttgatccaaaaatgggattcaaaaattaacgttacatttcagctttgtcacgcggtatccggttggtcatccaaaagttcacgtgttcaacgaggatgtcacatggacacattccggggacaacccttacccccttgccttgctcaaagtctttgtggtgccgccaaaaaagtgtgatgtgccagtgctgccagtcaggatcaatgagcggctatgttttccgttgtgccaccgttgcgctcaagactatcccatgggggacgtggacccggactaccactgcgagcacaccgatcaacagcgcggatgggtgagcacgtgtacatcgattgaacttaacgccgcgctggatgaaggctaccgggttaccaagctcttccgcgtgcttgagtatgagcagagcgacgacaaactcttccgtggctacatcgctgaatttatggcccaaaaaatacaagcatccgactttgcggccaacatcaaaggcaacaatgagctggaggagcagtttgtcaatgagtgccatgagatgttcggcatcaccatcgacccggagcagatggcagtgaacaaaggaaagcgttcaatcgccaagctatgcttgaataacctttgtgagtgtcttaatcggcttatgcctagtttgagctcattattttaagggggccgtttttctttgcggaactttggcctggcccaaacggtgatcacagatgaccctgcagttttggctgagtacttggacaacaaatccatcgatgtgatgtccatcgacgaactgaatgagacaacgattctgatcagttacatgcagaaaaaggaatgggttgaagaacatgaatgttcaaatattggtgagagacaattaaattgaaattttaattgaaatttaaaattttcagttatttctctttggacaacatctgcagctcggcttctccttttgagagcgatgcaaatggttgttcgaacaccaggctgcagacttttgtatacggacacggactcgctcatatttgctcatctcattgccaattgccctcttcaaacgggtccacacctcggtcaattcacggacgaatatccggaccatgaaattgttgagtactgcagtggggga

SEQ ID NO: 1339 - DNA, 1445 bp, Heterodera glycines
ttcattacgcagcatttccaagtccaatttttacttacgtatttaaattatattgctctatttgtcagtattattgtttatttattaacgaccggcaggattcgaacctgcagcctcagcactgagtgctgcgctcttaccatttgagctacggtcgcccattaacctttaccacttttctttttaaattattaaaattgtcatatttatgtgaagaaggaaacatgatttaaacaaagtgaaataagtcgaaaaaaaaacattagcttgatttaccaataaaactcaggagatttctggctacattgatcgcgtccagtgtcttcttcatcacgcaaaactaaagttttgtccgacagggttgacgagctgctgcaaatgtcatccctctccttgaacaagttgcccagccattgcccgatcggttgttgtccttctttcacaatttcgagcagttccatcgggtagttacggttctccccacactcaaagcgttcaacaatgcacggaatgtaggggtgatgcagtttcacacggtgtcgggcataaaaatgtgccgccacatttatattaaacggctggcgaagacggccgtaggctggcacgaatgccgctcccttttctgttatcccatcaataaagaaagtcttgcgcatgccatttcggtctttgtaggttgtttgaacttttttgccggtcaactctttcagtgcgcgttcccgatcctcaggatggtttagacgatcgcgaagtgttttaggagaacaaccaaaaaattgcgcgcaatattcgctgaccaagaccatttttaaaaaattgcaaatgattgtcgtaaaacgacgggtgaactcattatctttgtgttaagccccgcccaaattgcgccaaaacaagcgcctttgtttccccgctattaaaaccaaattattttaaaatttttcaatttaaaaatgctctcgacccaatcttcccgcaatgaaagaaaggaaatggagggtcaagaagagcagtgtgaaaattcgcccacaaagaagcaaaaattggacaagccaaaggtgtatgacagtatgctgtggaagatcctcaagggcaaatacatgatcagcatgtatctttgtgcaggtaataaacattaaaatatttttcacatttttttattttgcagatgattggcgaaaactgttcgagaaccgcgaaaaagtgcagcgttccgcgaatgaccgagtgcgcattagctttgacatgtgtgaagagtgcgcgcgtgtcaattgccgtatgactgacctgattgcaccaccaaaaaagaatttaattttgtaaattcatatttaaattgtaattgcttggataaatttaattctttggccttttggtttattaccatttttgagggagggagggggaagggtctcattgcgtttccctaaattattaagaaataaaaa

SEQ ID NO: 1340 - DNA, 1963 bp, Heterodera glycines
ggcacactacatagtttaatataaaaaatgttgtctgccttttttcaaatttagctggcgtaattgtaaaaggaaatacgaaatattaccgggatacaaaattaaagcaacgggactttttagaacagaacgaaaggatttatttggcacactacatagtttaatataaaaaatgttgtctgccttttttcaaatttagctggcgtaattgtaaaaagaaaaatacgaaatattaccgggatacaaaattaaagtaacgggactttttagaacagaacgaaaggatttatttggcacactacatagtttaatataaaaaatgttgtctgccttttttcaaatttagctggcgtaattgtaaaaagaaaaatacgaaatattaccgggatacaaaattaaagtaacgggactttttagaacagaacgaaaggatttatttggttaaggataattgttggaaatcgccatagatttggaccatatgcgaaaaattcgcggtgaacgtaaaagaaaccaaccagcattgacttgtgcaatccgactcgttaaaataaaatgatctttaaaataattgcataaatttatagggacagtatatttaatgtctttacttgttgcaatccgactcgttaaaataaaatgagctttaaaataattgcataaatttatggggacagtatatttaatgtcttcacttgtaagtttggggtcagatgcgttcagaactgacggcacactacatagtttaatataaaaaatgttgtctgccttttttcaaatttagctggcgtaattgtaaaaagaaaaatacgaaatattaccgggatacaaaattaaagtaacgggactttttagaacagaacgaaaggatttatttggttaaggataattgttggaaagcgccatagatttggaccatatgcgaaaaattcgcggtaaacgtaataaaaaaaaccaaccagcattgacttgtgcaatccgactcgttaaaataaaatgagctttaaaataattgcataaatttatggggacagtatatataatgtctttatttgtaagtttggggtcagatgcgttcagaactgacggcacactacatagtttaatataaaaaatgttgtctgccttttttcaaatttagctggcgtaattgtaaaaggaaatacgaaatattaccgggatacaaaattaaagcaacgggactttttagaacagaacgaaaggatttatttggcacactacatagtttaatataaaaaatgttgtctgccttttttcaaatttagctggcgtaattgtaaaaagaaaaatacgaaatattaccgggatacaaaattaaagtaacgggactttttagaacagaacgaaaggatttatttggcacactacatagtttaatatacaaaatgttgtctgccttttttcaaatttagctggcgtaattgtaaaaagaaaaatacgaaatattaccgggatacaaaattaaagtaacgggactttttagaacagaacgaaaggatttatttggttaaggataattgttggaaatcgccatagatttggaccatatgcgaaaaattcgcggtgaacgtaataaaaaaaaccaaccagcattgacttgtgcaatccgactcgttaaaataaaatgagctttaaaataattgcataaatttatggggaccggattttttatggccttacctggaaagttgggggccaaaggcgtccaaaatggccggaccccaacatagttaataataaaaaaggtggccggcctttttccaaattaactgggggattgtgaaaaaaggaatacacaatatatccccgatacacaattttagagaagcgactctttataaaacaaagcaaggagatatatgtgtatagagatatgtggggaatctccacatatatgtaccccatgtgagaaatactcgcggagcgcaatataaaaaccccc

SEQ ID NO: 1341 - DNA, 2594 bp, Heterodera glycines
gaaatattcacgggatagacaattatagtatcgggactctttagatcagatcgaaaggacatatctggttaaggataattgttggatttcgcgcatagatttggttccatatgcgaaaagttgctcggtgaacgtaataaaaaaaaccaaccaacatcagctagtgcaatacggctcgttaaaataaaatgagctttaaaataattgcataaatttatggggacagaatatttaatgtctttacttgtaagtttggggtcagatgcgttcagaactgacggcacactacatagtttaatatgaaaaatgttgtctgccttttttcaaatttagctggcgtaattgtaaaaagaaaaatacgaaatattaccgggatataaaattaaagtaacgggactttttagaacagaacgaaaggatttatttggttaaggataattgttggaaatcgccatagatttggaccatatgcgaaaaattcgcggtgaacgtaataaaaaaaaccaaccagcattgacttgtgcaatccgactcgttaaaataaaatgagctttaaaataattgcataaatttatggggacagtatatataatgtctttacttgtaagtttggggtcagatgcgttcagaactgacggcacactacatagtttaatataaaaaatgttgtctgccttttttcaaatttagctggcgtaattgtaaaaagaaaaatacgaaatattaccgggatacaaaattaaagtaacgggactttttagaacagaacgaaaggatttatttggttaaggataattgttggaaatcgccatagatttggaccatatgcgaaaaattcgcggtgaacgtaataaaaaaaaccaaccagcattgacttgtgcaatccgactcgttaaaataaaatgagctttaaaataattgcataaatttatggggacagtatatataatgtctttacttgtaagtttggggtcagatgcgttcagaactgacggcacactacatagtttaatataaaaaatgttgtctgccttttttcaaatttagctggcgtaattgtaaaaagaaaaatacgaaatattaccgggatacaaaattaaagtaacgggactttttagaacagaacgaaaggatttatttggttaaggataattgttggaaatcgccatagatttggaccatatgcgaaaaattcgcggtgaacgtaataaaaaaaaccaaccagcattgacttgtgcaatccgactcgttaaaataaaatgagctttaaaataattgcataaatttatggggacagtatatataatgtctttacttgtaagtttggggtcagatgcgttcagaactgacggcacactacatagtttaatataaaaaatgttgtcggccttttttcaaatttagctggcgtaattgtaaaaaggaaaatacgaaatattaccgggatacaaaattaaagtaacgggactttttagaacagaatgaaaggatttatttggttaaggataattgttggaaatcgccatagatttggaccatatgcgaaaaattcgcggtgaacgtaataaaaaaaaccaaccagcattgacttgtgcaatccgactcgttaaaataaaatgagctttaaaataattgcataaatttatggggacagtatatataatgtctttacttgtaagtttggggtcagatgcgttcagaactgacggcacactacatagtttaatataaaaaatgttgtctgccttttttcaaatttagctggcgtaattgtaaaaaggaaaatacgaaatattaccgggatacaaaattaaagtaacgggactttttagaacagaacgaaaggatttatttggttaaggataattgttggaaatcgccatagatttggaccatatgcgaaaaattcgcggtgaacgtaataaaaaaaaccaaccagcattgacttgtgcaatccgactcgttaaaataaaatgagctttaaaataattgcataaatttatggggacagtatatttaatgtctttacttgtaagtttggggtcagatgcgttcagaactgacggcacactacatagtttaatataaaaaatgttgtctgccttttttcaaatttagctggcgtaattgtaaaaagaaaaatacgaaatattaccgggatacaaaattaaagtaacgggactttttagaacagaacgaaaggatttatttggttaaggataattgttggaaatcgccatagatttggaccatatgcgaaaaattcgcggtgaacgtaataaaaaaaaccaaccagcattgacttgtgcaatccgactcgttaaaataaaatgagctttaaaataattgcataaatttatggggacagtatatataatgtctttacttgtaagtttggggtcagatgcgttcagaactgacggcacactacatagtttaatataaaaaatgttgtctgccttttttcaaatttagctggcgtaattgtaaaaagaaaaatacgaaatattaccgggatacaaaattaaagtaacgggactttttagaacagaacgaaaggatttatttggttaagagatatattgtcggaaatc

SEQ ID NO: 1342 - DNA, 1285 bp, Heterodera glycines
ggtcagatgcgttcagacttgacggcacactacatagtttaatataaaaatgttgtctgccttttttcaaatttagctggcgtaattgtaaaaagaaaaatacgaaatattaccgggatacaaaattaaagtaacgggactttttagaacagaacgaaaggatttatttggcacactacatagtttaatatacaaaatgttgtctgcctttttaaaacagcattgacttgtgcaatccgactcgttaaaataaaatgagctttaaaataattgcataaatttatggggacagtatatataatgtctttacttgtaagtttggggtcagatgcgttcagaactgacggcacactacatagtttaatataaaaaatgttgtttgccttttttcaaatttagctggcgtaattgtaaaaagaaaaatacgaaatattaccgggatacaaaattaaagtaacgggactttttagaacagaacgaaaggatttatttggttaaggataattgttggaaatcgccatagatttggaccatatgcgaaaaattcgcggtgaacgtaataaagaaaccaaccagcattgacttgtgcaatccgactcgttaaaataaaatgagctttaaaataattgcataaatttatggggacagtatatataatgtctttacttgtaagtttggggtcagatgcgttcagaactgacggcacactacatagtttaatataaaaaatgttgtctgccttttttcaaatttagctggcgtaattgtaaaaagaaaaatacgaaatattaccgggatacaaaattttacttgtaagtttggggtcagatgcgttcagaactgacggcacactacatagtttaatataaaaaatgttgtctgccttttttcaaatttagctggcgtaattgtaaaaagaaaaatacgaaatattaccgggatacaaaattaaagtaacgggactttttagaacagaacgaaaggatttatttggttaaggataattgttggaaatcgccatagatttggaccatatgcgaaaaattcaaagtgaacgtaataaaaaaaccaaccagcattgacttgtgcaatccgactcgttaaaataaaatgagctttaaaataattgcgataaatttatggggacggtgatgatgataatgtctttacttgtaagtttggggtcggatgcgttcggaactgacggcgaccactagtgagtttaatataaaaaatgttgtctgccatttttcaaatttagctggcgtaattgtaaaaagaaaaa

SEQ ID NO: 1343 - DNA, 5349 bp, Heterodera glycines
cgtgccggccccgcgaaactgcggtgctcgtttcaatgcttcaggctatttggtcacatttggaaaggcaaagagtgcaacggcaccaacaacaattgccaaactgatgaaccagcaacagaacaaaccgaagcaacagccccaaaaaacagaaaacccaataaagaattgtggtcggcaaaacgcgcgtaagactcctgcaaacgctacaaaaatgagcatttccgttggtgccgatgaaagtgtgaaaaaagtggggacgcatccacgatcactcgcggaatattgcgttttgggtagtggaattatttattttatccaataattcatttaattgacagtcaattctcctctcacattttcccctgctgctttgtttcgccagtgctcctccatggcttcgtccacttcggccattccatttgctccgactcaattccaaggctctccgcccgtccgttgtctgagccctcttcggccaacttcgccttgggcgcgacctgccgacgctggtagaagcgaatttgaattggcagttcaattcccgagaattgaattcaggcgaacaatcggcagacgccgaacaatcgcaagaagcggtgagcagaggcgaccgagcggacggcagagaaccgatcagtctgtcgcccccgtcgctgatgaagcagcttctttccgggacagggcggatattgggcgtaagtcctttcttccgtttttgccttacattcccccctccctctcccacagagttcgcccaattcgtccacttcactcaccgccattaatccccgcaccttttccctccactttcaccagcagcagcagtcgcccgcttttcaggcgatgatgcgccagcgggtgaccacaatgagtgccgtggcggagggtgcgttggcaccggcgaatgcgcacccacttccgattcagcaccaaatgtcggccatggccgaactgtgcgctggtaaaagcctcgcgggttggccgatggcggtgatgccggaacagcaggtggccaaaaagccgacaaaatccttgagctgctaatcttattgcatttttaagagcttcacttcaactgttttggtctacgacaccgtttcacttttgccaatttcccaggaattggcccggtcttacaagtccaacatattctttttccacagctttctttataatgctattcagacttctcggcagttcgccaatggcaatctgtcgccataatcgtgagcaagccgcgagaaaagggagacgcgatttattgacagtttggcaattgctcgagcaatgcgtgtgcaatggcaacggcacggccaaaaagtgagccaattagcatggaaatttaaatttgataaatgctggatacacttcttaattgacaggtatgatgaggacagttttgtgaatgggagtccgacaaaacattcgatggatgtcttttctcgtgcatttggcctccgacctgatgtcactgccaaaacattgatttcttcggcgaaacgagcggacgccccgtggtcaattcaccccttcggcagatcactgatcaatcgaatgtgccgacgacatattttcatttccttttattgctgaattttcttagattggcacattacgtttctcggcatgaccttcaaacggttgcagtgatcacttgcgtattggacggattgaattcggacggacggaaagtgacaaaggaaaggcgaatgagtaacaaaaaggaaagtgctgccattctgcggagattggaacgacaaaaatttgtcggagaaatgccgaaaaaagcggcggacgctttgctgaccgccgggccgaccaaagaaatgcagacggagcagcaggtggccggccactcgatcatagaatccatttgcaatatttgcaggtcgaaggactgttcttcgccatggatcaggccgactcatcgtcctctgtcggcaaagtgccgccggcgccccccgtgccgccccttttgccctctcagcaactccaattgcctccgtcgcggaagacttccgctgcccagggcggcgttggcacttccctcgcctctgtgatgccatccttgagcttcgtcggcggtccttgtgcgttcgattgtgctgaccttttgttgattttccgtcttttctttggggtcgcgtcaatcgtcggagtccaacgcgacttccgcggtgttcgcctcgccgctttactccgcccgcacaatgtccgaagcccttcacacttcggccacttctgagcggctgtctccggcgcctgacgctgtgacgccttaccaacgaagtgcgacgatggaagcggcgaccggcacaaacatcgccgactccgaagaaatggcaaatggacggggaagagaggacgaaggaacacaaaatggcgggggaaacgaactgtgagaaaagccatccgtggaccaacatgcacaccacaattcgccccttcagtctgatcgacccttcactcactcctcggcttgaacagttgcggctccgttacgccgacattctctacagatggcgcatgtacagaaagtgtgccgaagtgttgaaacattgcagccgcggggacggagaagagacatccattggcacaattaatggtgttgaacggaagaagcaattgcttctttgttatgcatttccttttttagcaatttgttggtgcacttgttgtggccagcaacaattgacaagctcaaaatgcacgaaatgccatcggataccaatctgtgagcacacccatccaaaactcatctcatacgttatttttagattgtgccatttgcgaacagccatgtaaaggtgagaggggaatgaaaaggatgccttaatctgaaaaaacttcgcagtgtatgaattcgagggttttttctcttctccctatttttatccactataaactttcaaaatcataggcagcaacgcctgagaatatgcaaaattttggattttcattaattgaatttaaagtacccattaaaaaaaccaccccctcccctccgctggttacgggcttggcatacgatcatattttgaatgacttgctacgtcgtcattttatttgaataattaaaaaatgtcgcatttttaaaggtattgtggccacttgctcaatgtgcagtcatggaggacacttcgcccatttgactgcctggttcaatgcccagtcccggtgcccacttgggtgtgggtgcgaatgccgattctaaccaattcctttgcaatataatattcgatggatttattcagagctggttcaaccgcaattaaattttttttgaaaatgcctaaaatgaaaaagcttatttaaggtttgccaaggccttgattttttctcttaaacttgtgaaatataagacaaaaagcggtcgttcttatattaacaaacattaaatcttttcatttgaatttcgccacctctttcggttcactgccaacaaaaggtgagaaagaggcgggcgtccctaagggattcgaaaccaacggcgtgtgagaacggggccgagcgcgcgcgattgttgcaccggacaaagacgcgacagattggctgaagtcggagagcggaagttctgacagtaaaagagaaacattttcgaaaaagtgcattatggagagaatcaccgtggtatttgcgacgcaaatgttcgtctccggtcagtgccgctcggattggtccctcctggtgactatttgagaaaaagccggaagggagttgcgtcgtcacactttgagttgggccacctccccaggggtcctttaacataaaaatatgtttattattcttactttttaaaatagttacccttacactttcacttcctttgcatttgggcagagaaatctgaccaattgccgttctcaactcatcgaccgatgcgtttaattttggttgttgagagtcattaagtgggcgaatttgcatttgtctgatctttgaccgttgggctgcgaggcaaatgtcctcttcatctggagggaatttattaaatgctaataataaaccggaacctacccgaagttgtgctgctgctactgctcgcacttcgccgattcggtcgtccatcgcccaatgttcccccactcgccatcgatacaaaagacacagactgaagaatcggttgttgctcttttgcttttgttgtcgacgatgtgccaacatggtcagccgagaagcgattgaacgcgctgaccaactcgtcattaagtggcggcggttcggtggaggggaggggcggcggagggccgaacacttccaaagggtcgagcactttctgctgaaagaaagtaataacattcattagcattgctcagcttcattcaccagttctttttctgtttgatccaacgaagatattggcgctcttacaaaaattcaaagttctgataaatgatccaccaataccgtacagttccgatttgccgattgctgtcaagtcgcccatcgaccgtttcagccctttgcctttttggtagcgcttcagaagaccagcggaagaattcgctgaacaattcggacaaagaataaccgattttaagtattaactcacttttgatggatggatcattgcaacttttggaaaaattcgaagctgatccgatgagttcgtcctttgtctgctgatcactttctccgactgcgaatggttcaattgccattggaccggccaaattggactgagaagttgagaaatgtttcttcagacgaccgctgaacttctgacggccaagccaagaagagatttgctggggaacataagaggacgatggattttgagcagagaaattggacagaacagaagaggaagggttggcagagaaaggcaactgaagcagcagaagacgcaatcaaactgatgtgaacatgggatgcccggcacggcacaacaccccctccccctcgttggtcatgtttgaaaatatttctcggaggttttgcagggtcaaccaacttgaccaaaactatatgtaatttttgttgccatttggtttcacacttcccaattggttgttggtttctaactctccacagctcacctccaaatgcctctcggaatcgctctctccggccgacttattttgctccgaacatccgttgatactgccccttttgactcccaaactgcacatactttccccgaatcctccgtcaatgcttccgccactgtttgccgattcgccgccacccgcggcgatacttttccctccgccgacggttagccacgagtcattcaggccgagcaaatgattcgcattcgactgcaattggttgccggaaaagttagggacgatggcagacgaatttgaggaggaagactgggattggacgcacgagacacgtcca

SEQ ID NO: 1344 - DNA, 1217 bp, Heterodera glycines
catcatctgctccacgttaatgttctgctcgactctctggcgaagagttgcgctcacttgtgcatttgcgccgtgggcattttccaaacatttcgccatttgcgtaaaaaaaccttcaaaaagtaattgaaaataataattaaagttggcatcttccaaccaacttttcatttgtagcaaatggagtcggtcatgttcttggaaagagcgtgcggcttggttgacgcgttcttcgaaagtgtcgcgtatttggctgtacttgtccatgtactgcttgtactcctcgtgagccttgttcaatttgttgcgtgccttagtttacaagtactttgaggaacatttggttaaatgaatcttaagttaagtgagcactcgaaggtattcttttgtgctggcagccgtccattctttgttgctctgtttcagactgaccacctcagtgcttcgctggttgaacgtgtcccttgcctttgttaataaatgtattgtaagaaaaagctcaattagtattaatttgccgaagcattattcaaaattattttccatttaagattttgaatttccttaagggtttgggtcctcaaatccccaattatcttgaagtccttaggcctaattgagcacgttctcacatgccattgtgtcaattaattataatattttaattttcctttttaacactttttgcagacaggtggtcgttgtttgcatcaaattgatcgtttccaaagtgtccgcgtctttggcacgttttcgcatccgagccaattcttcttgataacgagcgacttctttcagaagatcatttaaatttcgaagtgtcgacgattggatttctgaaaagaaatgattataaaacaatgctaaattcaacttttatttgggtacataaaaatgaaattattatttaattgcaccgcttatatttagccgtaccagtccataattccaaggtttccttcgccaatttccacgcgtccacaaaaccgctcttgtttgaaatgtatccgttaacctaaaaatcaaaatccaatgtttcaaaaatatttaatcgccactctgtgcagactcttcccaagcgatttgaataaatcgtcctccatatttacgcgttctttgagaaaggtcagaagttcgtgaaccgactcctcgcccttcttcatgttttcataaagcacgctgtatccaatgtgcttgtccccctaggcattcatttg

SEQ ID NO: 1345 - DNA, 1550 bp, Heterodera glycines
ggccattttgaaaaacttgctggcaattcacagagtaaggaactgatggggttttttacaaaaccacaaattgggttatctgaagatgttttggttttcttcgaatccactttggttggcttctatggctctttgtttgtcgtcatttcaatcatttggcaactctatggccaactttcctaccgcattcttacacaactcttcatttttctctcccatttgcaagttcaacggactctcttctcaaatgttgggtttgcgatgaatttctttgccgtttttgttggttttactgctctattttctgctggaatggcttttcataacatttcacattattttttatcatgaaattcgattttatatgcgaaataattaatagattaatggatataacaaggcttggaatcaaagtaaatcaaattttaaggaattaaagaggataaaacagtgtctgtcttaaaatgcataaaatggcactatttgaattgtggaaaagatagttgtggtttggcttctgtcgaggcatcctcagaacgccacaactgggtcacagttcgaatttgggtgtagaaattaagaccagcctttccatagaaatttgcatcgccaagaaaacttaaaacgcattaaaaacacaacatgagagaagtgtcactcaccttccacgcgaaccggtgaaagagaacatcggaagtggcacagggattggcacatttatgcccacttggcccacatcaatctccgagacgaaacggtgcgcggcaattcccgaccgagtgaaaagggcagtgccatttccgtagggatttttgtttatcaaatccatcgcttcgtcaagtgtttccgtttcgagcacacacaaaacgggcccaaagatttcttcctaacaataaaaacgaaaattaaattcagaaaaaatatcggacggaccttataacagagcatttcgggctttactccagtgatcacctgaaaagggcaattttaacccaaacaaaaacagctataaattggcgaagtgttgtgcattaatctcaccgtcggtccgacaaagtttcccttctcgaagcctttcactgtcacattggtgccatccaatggcacatcggctccttcttccagcgccgattcgaccaactcgcaaatgcgctccttcgctttttgtgaaatcaccggcccaatgtccgtccccgcctcccatcccgggccgacgcgcaatttccgggctcgttccaccaaatcagaaacccatccgcgcgcatcacccacaaaaatggccgtagagagtgccatacatcgttgccccgcagcaccgaatgccgcggcagcgacctgaaaatgggagaagagaaggcacgcaaagttcgactaaactcggagacgaaagtgcctgattcaacgtgtgttctcggttcgcgtcaggaaggatgactccgtgattcttagcgcccatattcgactgaactcttttcccaaacttagacccgtgctcgtaaatgtatttgccctgaattcgaccaaaatcccatcggaaatatccacgaaaa

SEQ ID NO: 1346 - DNA, 5226 bp, Heterodera glycines
aaaagaatatcacacagttaaacatgcgatagtcatgagtgacaacagatgaatggcgccaagttagaaatgcctttttgcaggaatggacggacaattgcatttcgtccaacgtcgactcgggcacaaggcagaccacttcatttgtagcctaaacactgcgtcaattttagtcgattttatgcacctctcccccccccccacttcaaattgacggtactttcctgttttgatttaggacccataacttttttaatatgtatttaaaacacagtacaaaagaaatacacaaccccttcctcctcctcactggatttgttagttcaatccattctttcgttttggattcgaccctttgtccatgaatccaattcggcaccgtcgaaacaaatctgacactccaagaaggacagtggacaactgagccaaagaagggtactactgttttcccaactatatttaactttatggacggagaaatggctaaacgcataatcaaggccctaaattgtttttttcaaattaaatatacacaaattcttaattacagaatagacaatcagtttttgtatagcggcaaacaaaaaaccacggaaatgcgaataaatttcattcctctccaaataacagaggcatttaaattggaacataatacaaatgaaataaaaacagctttgtgaataggtatgtgaactagatggttcttagaattaagggtgggggaacattgaaatggggacaacggggcggaggacattggaaaggaaattggatgattttcggaaatgaatagagtactttggagaggggtgggcgacagcaatcgggaaaaacgtgacataaattgatcgatcaataaatgggcacgcaccccaatccgattgcattaaatggactgataatttgcggtaaaagggcacaatggcttgtttgacgcccttatgaatcataaaaagaacgatcccaagtaggtttatcgacaaataagacaaagacaatagaaaatgaaatattcaatgagaagaaatatttaggtgaatgtagaaatacttgaatgttgggggctgggagtatttgtcaatcaggcgagtaattctggtgggttttcaaacatttagacaccattattaatgtgataaaactaaaatatcattaataaaatccgaccttcacaattaacacttcgtttagctccttcttccttcttctgtcgcttccgtcgaattctcttctgtctttgtctgctgttcctcctctcgaattgggcacgtttcttcctcatttctctgggaattagtcgtttcgtccatctgccgaaggggagtgccaggttcagtaagcgcttctgcttcaacaatgtcggtcatcccagttcccgtgtcttccgcctgttcaccctccttctctttgctgctttcttctggcggggaatgattctttgtctcctctgtcggcccctcttcacaagcgctgtgacaataatcctcgtcatcacttttgcagtgctcccttttgttgcagccaaatgaagaagaaccaaaaaccgattttggagctgtcatgtcgtcgtgctcttcaaaagtggtttcctaaattgtttatgtcttctgtctgaatgtgagtaaactaagtgggacggaaaccacctcttccttctccattttgtgttggtgtagcgtaatttcactgccaagaaccgcctcttcatcggcaaccgattcgtccaaaaattgaagttccgttggctccacagaatgtgcatgttcgctgtcttcgatgtgctcttcactgactgctgttgacagttcttcctcttcccaaattggcggctgttgttgccgatggtccatttgttggttctgttgcatggccaatgcgaactgttgctgctgctcctgttgctgttgtttgctgcgcgcgtaggcaacacttcgagttaccacttcatcgacagtctcctcaatatgactcaaattggaggcggacgaatgcgcctaaaacaaacagaaaatctttgttattttactgatccttttacgttgtggtgaagatagtgatgaatgcccgaagatttttgtggcctcctaacagtcggaatcgaatcggttgcggaagaagcaaggtgcgtttgttggtgttgctgttgttgtaggtgttggtggtgatcggaggtggtgacaatgatctgatggtgttgctgagccgtgggcggtgaatcgggcggtggagtgatggtttggacctaaaagaaacaatgatagatggaagtgtaaagcgttagaagataacttacacacacaattataaagatgaattttaaaatcagtcaatcgtttttgtttcctcaatttttctttttatattttcaactttcttccaaataataatatagttttgagtggatatcgtacaacatattgccaacaaaaaattgcaaaaattgtattaagtagttctacattctctcaacatttccttgcccactgatactattgcccatattgcgatgccatgtttatggcatgctgcccataaattgatgccaacaactggtcattgttttcattgatattgtgattgaaaactccattagtcggaaaataaccaaaagcgttgttatttccacccattgtcaggtcaagcattggaccattttccatactaggaaattgttgggtgatttcatccttcaaattgtttggcagcttttctttgataaaatcacaatttacctgctgataaggcgccggctcatcgcccatcccatttccgttgcgcgaccgacgacgggcattcatgaaaaaatttgatacggtggacatgtctaggcgaagatgttcggcgatggtttgttgcatctcacgactgggccgttgggtctctttgaaaatcgcctgaatttgttaaggtgattaaaataccacacaagaactcgaaacctggagcgtccgtttttgtatgtcagtgaaaacaagacgaggccgcttttgtggagggtttccctcctcatttgtgtcactggtcctacgatttcgatggtgatgacgagaattttgtgctggcgtaggtggtggaataacaccggaagccattggacctgcaaaagaaacgttcaaaagatggaaagagctgttattataacctttgtacatatccaaaatgctcaaacggatgtgcaatggttgttgcagccaattgaacatccggcgaaatgtttcacggccggatttaaggcgattccagggcttagggttacgtaacaagtccgacaatgtcccctggctacggcataagatccgctcagcaaaaatagcttgtgggatggaatgttgctgaaagttttattaaatgctattgtattaaaaataaaaagggggctaaatgggtcgacctttagttcatacgcaacacgtttgcacaagtcctttgtgtcaatgtaaatttcgtcatcaatttcggcattcaatgggtctgttgtgtctgtcgttgagtaagtggtacgaggaattcctttaaatcgtatttaagtccaagaagctttgtagatctaaccagctccaggtcccatcggcccgtatccagactgtgttccactaccattcgaagctaaaataatttgctgatccgaattctgcgagttttgaccaaggttttggctgagagattgttgcttaacctgtaattttgaaattgatgttttgtctgattatatatattacacctttgaacgacgtgccgttgttgagggagtggatgtgattgggtggcgctgaactatttgatgttcaagttgctgaggttgacgagacatttggtggacaatgaaatgggttggttggtgaggactttgctgctgtatgttgggtgaaggcttaaaaagaaaattgatgccaatcacacattaaattctatgttttcagcttaccgattcgcgtgaaagtgacgcaagaatggatgaagtgatctcgacattgctaagtgctggtggcgtctcagcatttgccatccgttccaattcctgggcagtaggcccctggagggtataaggtccggcatccccgtaggcctcatgatgatgggaaacagatgctgccgagtgataccctccaagttcgttcgatggattaatttcttccttaattttcaataataagatccgaaagcgtaaagttgatcaagaatttaaaggtatatctttaaccattgcacaaaatcttactttaatgtacgcaacattgttgctgctgcgtctaataccattgagtaaatcgctcgttcgacttccgccatttggacgatgcaaatgcgaaacggaaacactactcaaaagtccgagtgagccttctgggtctcctctcctcgtcccttccaagtgcaacggcgaaagcaatccggcggggccattaccaaaacttaaaaaaatttcgtcgagtgaataagcaatgcacgaggaattattcaataagaaattatgaatgttaagtactttgttttttcaagttggtttgaatggagctgttgatggtggccaaggtgttgttccatcgattccattttgagcgcagaaatgtaatgcgaggagctaggcatcgacaccagaccagcataaccactgttttattaaagttaatacaagaatcgtaaaaatatggtggtatttgtttggcttcttaaaagataacataggaaaattaggattctcgcagtcaatttaaacgctttgagtgatgttcgtctgatgtgacccaataatttattgaaactttcgaaaacctgttcccatcagctgtaccagccatgctaactgttgtcaatgatgcaagttgtggagtagtggttacatgtgacacatttccaccactttcatgatgaagtccacccaatccagctattagctgatgatgaccaacagagctgtgaccctgttgaggacttatggtttccaggaaattctcaggcagttcctcgaagtgtcgactagtcgtattaaaacttatttgtgggtcgatttgaataaaaccagcaacggtagacaaatctcgcctaaatttaaaggtaaagaaaattagccaaaggcaatgatttttaaattaaaggaaatacttttgcaatccaccggtgccatcgtttaggcctgaagcagaatgtccaccgacaccgcacgaggtgacggctggcggttccattcaaaaatagttttttatccagtactttgtgagaagtcaa

SEQ ID NO: 1347 - DNA, 7631 bp, Heterodera glycines
tttttgtttgtggttttgagtttatataaaacgcataaaatcgtcaagaaaaaatttctgatttcgaattaaaacccactcgaaactgcttggctccgccgcaacaaatttgccaccaacttgaatgtcgccatacaattttacatccactgatctgcccggcaacaactgaaggaaacgaagaaagcgctctcgaagttctgcgttgccatgttgatcagtgtcaacgacgttcggttcagcggtttccgctgttgattctatgggttcagtctccatactaattaaaaacaggctttagtgcagtttatgcgtccaaacgacaaagtctctggaatttatagttagaaaaaagcaaataaaatgagaatatccgtaattccgcttaatcgagtataggtactttgggattaattttttgagtttccttaaacactgaattttgaaaaattctataaactttaactttcgattgataccaagaaagtatgctttgacccaataaaaaaaaattataggcctaagaaattgaggttcacattgacagtaaataatgttcacaaatactgattgacaacaaaatgtttaaagttcatacagcaatttattataaatggaatttaaaaaaccataatattatttaccaacatataaattaagaaatacaatatatcccaaaaaacggtgtgttaagctttaaagcattggttttaaaaggaaagacgacttccaaggaacaaagtgggcacgccaataacagccagccatttcaacgtctggaacatgttcaactcgagccagaagaaaacgtagagcccaaaaacagcacacagaccaagatgaaaccctaaaaatggacaaatataaaacaataataatatgacagagaatttaaaaagtggtatttaccaagagcactgagcgaaaacttgaattttccaaaattgatgccaatacgaagccactaaaaagtaaaaattatgtagaaaaaacatccaaatttaaacatttaccaaaaggaaaaggatgataagcggcgaagcacacaaaacagaaaacatgtcagaaactagaacagatggtcggggttcagggctgcggaaggtgtgagaaatttccggcagaagatcgtaattgacatgagacgattttggcgacatcgaagcaacaaaaataaatgtacgacctaaaaatgccaaaaatcacacaagccttattctgacagaacactaacaaaaaagtacctaagtccaagccaaaccccaaaaaattacgtaggttttattttcagcctttcgcagatttaaataaaaatacataatgccacattaaacttggcatttaaaagaagcactaattcaaatgatcagtcgaaagcaaaagcaacaaatggacaaattgcttgaaaaaatttttaaacgaaaacaaaattgaaagaggtaaattgaaattaaaattaggtacatatgtgtcatttattcttttttttttattggtaatgcattttcaattacctaataaagtaatgcattaattttagtcattttttcgcatttttatatgttttcgttattcccgtctgctctttttttgcttctccaccacattgacatttattcgactgaccaaattgaggataagaaaaatagccacaaggaattggataccgaaatccgtacgctcttcaacgaaacaaaagtacggattttgattctttgggtttctttgaaatacaaaacaatcaattagagttcgacatttttaaaaaagcctggacctggattccttccatgttggcctggacctttggacaaaaaccctgaaaaacgccaggtcctaagaaaaatcccggttgaaaaaaaggacatgtacctggaaacaaggaaaacccattcctacaaactttataaccatcaaaaagcgtgttaaatacatttaggattatattccagccgcttttcgactacatgacgacgaattgctatgcaaatgcaatcattttgcgacctgcggtaaggtaacaattttttttttgcttgttttatttttattttccttaaatttctttttcttgttgtcaggaaggtgtggcgagttatgttggtgaacagtacatggacgtgtgccggcctggtcgaggcggatactgtagtcgggtagtgtttttgaacgcggatggcacaattcgggaagtcatcacatcgtgagtttctaaaaagtttttcatataggtattttggtgagcgattgaaaatttaacaccaagttttcacagtttattatgacgaaaaatttacagaaaaaggaatcaactccaatttttcgtgggcccaaaacaacttaaatttaattttttattgaaaccaatatagattgactatttttagtgttgcagttgtttgtgattcggttttgcgttttaaatttgaattttcggcactttttgttcgaatttgcaattcgaaagaggccaaaatgaatatgttatagtacaatataatccttaaattgcggccttatacatgcgtaatttttcattcatttttcactttgtttagctgtttgaaacgggaacaactcgtgcccagggaattgccattcgtctgccaaaattcgaccactccgcaatggaacaaattggtgaactgttgcaagtctgaatcattttgcaacgacatccaagtaaataaattaaattcattttttatgttagtttgattaactttgaattttacaaaaaatatatagagcaagcaaattttcagtttcccattgaacttggtcttcgcaatggctttttgcctgaatccttcgatggtttgccatccgtttttctgacccttctcatttcgcttgtccttgtgctgttgtttgcattgagcatttgtgttgccatttcctgttgctgttttcctcgaaaaagggctgttgttgaccgatgcattggttggttggtgcagtgccgttccccaacattgaacaggtttttttgcgattgaaaaaattgtgaaattttaaattttgattttttaaaaatttagttctaaggctgattgtgaaatggacagtgaaagtttatgtggcgcaccgatgggccaattggcggaggcggcaacattctcaaccggatcgggtatatttataggacattcagaaaggttcctctttctcaaaaaaaaatcagaggttattgatagggggtgttcgttcccctccccggatcagttttaagaaaatttcaagaaaaattttggaaaaattttttagcgattttttcaaagattcaaacgctgaatttttttttactaaaattttctttttaaaaaattgaggctgggaaacgactcctaattgatggataaacatacgccctttcgcttttacgatgttttgattttgtgctccgtttcgctatattctggaaatacaatacaattttatttaggtatttaataggatgcccccaaactccccccccccccctccttcccttattatgcctaaataaattaaaaagattaaataaaaattgtttgtttggatcaaggttccggcgttccaatgttggcaccgcgcacaatctcttaccaaatttcgctgcaaacagtgattggtaaaggacgttttggcgaagttacattgggcgaatggcgtggcgaaaaagtggcagtcaaagtgggttggattaattgaatgaataggaccaaattttttgtgtaaaacacattttttttgtgaatttttaagttatttctcggccatgtcgtcccatattaaattcttatttaacgccttttttattacatttttttaaatgcatgagtgcaataattgtgttcattgtcagattttcgagtctcgtgaagtggcttcgtttgatcgcgagacaacaatttaccgggacaatatgctacggcaccaaaatcttcttcgctggatttcaagtgacactgtcggtgggttcatttgataattttcaaatgggggtactacattcccactgtctcgtattgttacccccaccctcccgaaatttcaaaaattaaatttttttttttaaaaaattcaagaaaattttttttctatacgggttgcttcgtgatcatataaaatttggaaaaaatcgccagaaaaaccttacaaaaaatttttctttaaaatattcaatgttaaaactaaaaaaacatttcattgacagatacgggagaaggaataatgcattggttggtcaccgattattgtcccaacggttcactgttggaccatcttgaaaacaacacgctcaacacacaacaatgcctccaattcattcgctcaattgctcacggaattgactatttgcacacttcattgactggcaacaaaaatttttgtaaatttttttaaataaatttttaaaaagtaagagtttcaacatcatcaacaaaaaacaaaaaaaaaattttcagttaaaccgtcaattgctcatcgtgatctcaagccggggaatattctcatcaaaaatgattggacctgttgcattgcggatttggggatgtgcgttcggttgaaaagcgacggaattattgacaggcccgagggtggcgacagagggggaacggcggtgagaatttttggggttttttcgcataattttactacatcaactattgtattattgtaataactaactgtatggtggacctagagcacctgtttgttttttaataatcttttgaaagatttctagcgcttttttcctaaatttaatttccatttttcaaaatttcagcgctatttggcacccgaatttttggacaaatcatacagcaatgactcaattacctcttacattcgcatggacatttacgccctggcactggtcatttgggagatttgtcgcgttggtggaagtgaacaatttggtgggaaaacattgggcggcacattaggggtgaaatttttttttccatttttaaggtttccgcattggactatcaggtgccctaccaagagtatgaattgacgagcactcatccgagtccggacgcaatgaaacaaattgtttgtgtggaaggactgcggccaaccattcccaaagaatggtcgaaaacaaaggtatgtgcttttttttacaatttttttttattcttttaaaatcaaagtatgccatggaaaaatagttcgggtttcggtacgggagaaatgtctgatttcgggcggtaaccccctgtaaaattaaaaatatcttttatagattctcgaaaaatgtatattcttcattcattccctgaaaagttttcaaaaaaaattgaaattggttaaaacattaaaaaatctttttaaatatgaaattcagggttaaaaaataattctaatataaaaatgattgtgaaaattaaaatttttctctcttcggcacatataaaatcattttcagatactcaccgaattcactcgggtcatcaaagagtgttggaatgccatgccgcagtcgcggctcactgctttgagcattcggtgcacaattgacagaatttgcacggaggagaacatcataatcaccaccacataggcacaaatgccaacaaattcctatcccttttttcttttctttttctttcatttcatttctcactcagagagactgaataaaacattgtgcaatgtgacaacagttctttgtttttgttttttggatgaaattgtcaaatcattttttagttttcttttttaaattgcaatttattattttatattccccattttttgtcatatttttttgctggcaatgagcaggaacttcgccgctcttctccgtgtaacgtgtgaccggaagatggcacgtcgggccaacaaacagctgaaaagggtgtgcaagaaggcgcatgcgcaacacaaaaatgtaaatttaatgcttttgtgcacataactcgtacggtaatgaaattttgaaaacgaggcctatcccctaagctttgattcaaacaatcttttaaatttcgaaaattaagaaaacttatatacgagttgtcatggtgagtgacatttttatggcgccttggtgatcaaaaaaaaaacaatttcccataaataatggcaccaattttctgtttgccaggtcgaaacggtcatccaacagcagttcgatgatcaggcaaaattggaaaagcgacgggagaagcggcgaagacagcgcaaacggaagcgaatggaacaacaggaaaaggaaggggacgacaaaaaggaaggagaaaaggaggaggagcaaacagaggacgaagcggacccatttgacgatgagaattacaccgtcaaacagtttgaggaggaggtttggctgtcttaatttatcaaacaaaaaaattgggatttacgactcaacggacgcgacatcattttgttttttggggttgaaacatgaaaattcttgtcagatcggcgaaattttagagattttttggtcattcaattaaggagtgcttttgagattcgttttcaaactgtttaactgtatttctttaatttttgttaatttaattaaacgacatcaaaagtatttctgaatctctaagtttcgccgatttgacatttattttttcgtttcaacccaaacaacgagctggaatagaacaaagagttgacactgaatcaaacacgagacgatacaaaaactgcaatgttattcaaaaaattcaggctgaacggatgcgcaaaaagcggatgggaaccgaattagatgaggacgagcgcgaaattaggcatttggaagcaaaactgaggaagaaagggcgcaagaagggcaagaaagagttggaggaggacggagatgaacttgatgagttggagaaggccattttggggggtggggaaaatgattgatcactgatcaccctttttaaaagccaataaaatttatgattagaatttcaaaaatgccaaggaatggaagtcggttgctttattccgaattttataaattgcattttatggattcaattcattggtgatgttcccttttttaaagcaatatttagccagaaatgttcaagaaattcgattcggcagatgatgtggtcggttcccagcagctcaaaggatctgtgcaggttagtcaatctgataaaacactgatttttctaccagtgtgatgatgtcgaaaacagcaattggtttttaattatggggcctatccgaattttttttaacgatgcgcgaaataatttgtaggtgtgcccgtgctgaaaaagtgtaaccaaatacatattccccgttacaattactgagttaactcttaatttaattgacagaagtcaatccgggccaagctggttgagcagtatccgagcattgagccgtacatggacgccattctgccgaagaaggagaacttcaagttggtcaagtgcaaggaccacctggagctgatcgcggacgccaacggcactgtccacttcgttaaagtgggcattttcaatttaaaataaatgaatttgattcatcaaaaaccattttttatccgatgggcaaccattttttttacttgaaaaaaattttagaaaatgtgatggccatttaacatttttttatgcctttttaaattcaacaaaaatagaatatatatcaaatttggttgagtgtttgttacacat

SEQ ID NO: 1348 - DNA, 1485 bp, Heterodera glycines
tgatttggcaaattatttcccaactctgagactgctgcacaaatacccgttcatgcttccacaccaacaggtgaaaaatggtgggggagggattcaatttaaatgtgcatttaatttgactgactctctaatgcaattgaaatttgaaatttctgtcaagggcatagtcaaaccccttggcttcggcttttcttttttttcaatacgttttttcaaaaaaagcattttcgaaatttatttgacctccccccttccccccgcaaaaggtagacaaaggtgccatcaaatttgtgttaaacggttcgcatataatgtgccctgggctgaccagcgcgggcggccgacttttggacgattgcaacgaaggggcattggtcagttttacaataagaattaattatttatcaaaattataataataattattatttttttgcatattattgcataggttgccattatggcggaaggaaagcagcacgcaatgggaattggacaaatgaaggtaaatttggattggttttctcataaaataattgatttgcttacatttaattgtaatataattttcatccttcattcattccggtttaatttaattaattaatggacgaataaattatttcatccattaaaatattcaatttaaaatttaaaaaaatgaagctaaaaaatgccctcttttttagctttcgtcggcgaatgtgcggtcacaaaatgttggcattgccattgacaatgtccacttcatgaacgacgggctgtggcgattaaccactgttcaatgagcacagaacaattttttttaaaattattgtttaattgactctataattaatcgctttttcaattttaaattgttgatgtatgaggaatcatattttttcgtgctttatttgcaaaatgaaatacacaaaattttcattcgaatgtttacattaataaatgtgaggtgattttgatgtggtaaaaattggaatatataattaccataaaattatttccaacatttttaaatgtacaaaaaaaatgaagaaagaaaagaatactgactggtatttcacaatacaaaattagcatcggaagcaaacttaaattagtaattgaaattgaaaccattccctccgaaacacatggattcttccactgctaattgattgattgttgagatttgctaattaggggtaattaatactggcattggtgtggggtgggtgtggctgaattccccaataatacaatataaatgaataaaaaaaatcgttaaattttccattattttcccaagtactgctccgtctcctcctacatgcttatcatgttctgctgctgctgctgttgttgttgttgttgtattcgctgctgctgttggaatgcttcaatttctgtccaaatcatttgacgccattggtctgcaaaaagggggcgtgtcaacaaaaaatttttggaattttattggagatggcgctgaagacacagggacgt

SEQ ID NO: 1349 - DNA, 2834 bp, Heterodera glycines
aaaaaaaatgaaaatgaaacgaaaatgcattcgaggcggaacacgaacgaaaaaataaattttaaaaccgaaaacgaaacggaaatttcgtcggggcatggggggggggggttctctgggcccgggccattttttgggtataactcctttcatcattgccgaaatgaatgaatttaatttcattcgatagccctaagtgttctctattaaactgcaaaatttcaaaaatttttgttaagtttgaatgaaattatggacaaaaatgtttggaaaacatggttttttttaaattaattcctttcaaaatattttgaaagaatataaaattctgattttttaaacaaattaaatatgagggcgagaaagtgtgtgaaaatgagaggacagacagacaaacagaatttattgtttgtgcccgattttgaatgaaattctctgtccattcattctcaacttggcatggaagcgactttcatagagaaataattggccatttttaaaattaattaattaatatttgacccacatctgcggaaatacttggccattttttataaccattaattaattaattagcatttggcccaccaatgctcagctcctgttcaatgtccacttcgatgtgtccgtccgccgttggctcgtcgtttgggtcgtggtactgcttgaagtacacgtgttccatcgcttgttcagcggttggactgtgcaacaaaaaattatttattcgaaaatcggtcaatttgctaattatgccatccaattttaccgataatcagggtccaaattgagtgttttctccaaaaagtccaccgcctcgggcgttgcgttggcaaaaaattttttgaaatctttgcgctccattcttggcatattccgaatgtaatttcgtgcctcttccgacgagattttctggaaaaacgaaaatggcataagaggtaaatgaaaaatgccgttttttgcctatgactttcaaaaattcgtcgtttggagtgccacagacggacataatccgggtcaactgatcaatatcttcaaattggaatttttttcaaattttattttgttttttacggtccgctccaggaaaaagtgtacgaccagtgatcagttcggccattatgcagccgaccgaccaaatgtccacttaatttgcaaaaaaagcaattagtaattaattaattagtaaaacccaaataaaaaacaatttgcaggtcacaatatttgataaatgattaaaaaagcaatttgtagttgataattaattaatttagcaaaaaataatcaaaagagcaattaatagtctaaaataaaaaataaatcaaaaaatatttaataattaatttatttatttaaaaaagtataaaaaagcattcacccgtctgtgtgtagtgcatccaattcagcatgatttccggcgctcggtaccatcgggtggccacgtagccggtcatttcttggtcagcatgacgagccagtccgaagtcgagaatcttgaaaagtaataaaattgccagccatttcgtgccggtatcatattgtttgttatacatttttttttaatttttggatccgattaggggaaaattcaaaaatcccgaaatttcaaaatttgtgaatcgcaaatcggtgtacgatgatgacctaaaaatgtcggggatttgattcgggatcggcttatcccctggattgaacctggattttaattcaaaaactaaaaaaatgcaaggaaatacagtattacttgaaaccaaataatggtcatactgtaattgttgaaaaaaatttgggcggaaattccgacaaaaaaatacttttaaactgatcattctgctgaatttaaccaatcttgaacacacaacacactttcaactcgcagtcctcgttcaccgcaatgtttgacggtttcaaatcccgatggataatgccggccgagtgaatgtatttcaatgcccgcaaaatttggtacaccaaaaattggatgtgctcgtcgctgagccgttgaattttgagaatgttggacagatcggcgcccatcagaatggacacaaaataactgacaaaatggggaaaacggagagaattttaaaaaaaaaaatttgaaaattcaaaattcggcgcatatttgcaaaattagccaattttttgcgcaaaaatcgcaaaaatcttttcccgacgtcacattgctttcatataacttttttttcatgaattagtgaaaatttccaattttatttaatctaaaacacaactgattgaagcaaattttcatgaaaattgtaaattttctacgaattgatttcgctataaaattctaatttaaatttccaataattgcccccaggggcattcattaaacacccacacgtcattaagtgttgacgggtgctgatcaggcgtgaacacgtcgtacagatcaatcacattctcgtggttcatcagccgcaacagtcgcaattcgcgatgggttcgtttggcatggattgacgattggaagggccctttggaaaattgggggggggggggggaaatactcccaagattttttggtaattaattaattactcgtaaatttcttgattgccacccgatcgcccgtggtcacacattcagccgaacttcaaaaaatgcaaaaatattgttaaggtttaggctcgatgtccaggaattcagaaaaaagtcgggtttgggccgagattttgtgatcggaactcgggatgcgaaaatgatcgggattcgagtcgggatggtctaggtttttaaggcaaggacacgaaaaaggtcgggattcggcatccgccggctctgaatgtcgaaaacttttctagattcaa

SEQ ID NO: 1350 - DNA, 1761 bp, Heterodera glycines
  misc_feature (1703)..(1703): n is a, c, g, or t
  misc_feature (1727)..(1727): n is a, c, g, or t
aaaatgttaaaaaatatagaatgagaaaaaattagggggttaaaacaaaatgcaaagctgttttgttggctcaaaattcaccgatcaaattgcattttgcattatttgatcagaagcgttcgaaccgatcggggagcaaatctggcataccccaggggcataatttctggtgccaccaaacgctcaatttgaaacctctcggaaattgagcagacatttgacaccaaattatattgaatccggactttataccactggaccaccaaatgacatacagtaggggatcagtaaaaatattataaatcggattcacaatttttagtaaaaaaaaaaaaaattggggaataaaaattagaaaaaataatgaattaatttgaaaaaataaaaaattaaaagcataatttccgtgaattaatttgcctatttttgtaagaatgtgtttggccccatttttaaattaaatttaattcgtttccgatcatttaaaaaaagattaattatgagtgaccaaatttggccaggccaaacaatattaaaaaaaaatgcaatggatgttatttttaattgcccataataactctcttataaagacagagaaaggtaaaattaatttgaattatttataaaaccgttacagtatcccaaccccagtgtgaattttgaatatcgtaattcgccaccgttttacatttttggtagcattcgggaatgatccacacagttttgttcagctccaccgtgtagaagccggccttcacattggttgcaatgttctgctgctgttgttgcacctttttcgcatggacatggcaatcggaggcgtacatttacggcaccctggggggacaaagtgtgccgaagcccggcgggggacaaaaaaaaaacaaattgagaataagtgtaaaaataaaatgaaatttaaaaatagttttttaaattcaataaataataaaataattaaaattggaattcatgataaaaagagattaagcaaaatgattattttttctattaatttacaataaattaaattgtgaaaaagaaggtgtcatggcggcaaaacgtacaaaagcaaaatggaaagttttttggaatttttgaaaattaagcccaaggatttctagagctaagcttaaaccaggcataggctaggcctaggcttcaattttccatgatgtatttttgtaatttcgttttgccattgacccggaaaaagagcataacacaaaagcttgtttaaacagtaagaagaagtggatagacaaatgtaatggtcggacggacaaatgaattaacgatcgatttgcttttgcccaattgaaagggtaattaagccattttattaattagtcggctgatcgcacatccacctcattattcgaatggagctgaccctttgtttcattgtgatgccgttccaattcgtgccaaatgatatctaacaaaaacatttatttatatgtgatcgggacacttgagaggccaagaattgaccatgaaacacgagaccgagcacttatatcaagttcgagactctcggtcaaaaaatccggtgtccaaaaatgttggaaattccgttacatctctgcttttttagaccatttccgaggggcattcccaccattaccagtcaagaaccaccacctttccagtccgcaacacttctggccaagtcatcgccgtcctcaatggtgaagggctgngccgccaccggttcatccgctggncaatggtagtcgcgcatgtacggatgcagcagcg

SEQ ID NO: 1351 - DNA, 3234 bp, Heterodera glycines
agaaattatttagcaataattagctcaaatcccatataataaattgaaaaatatattattttccactattgtgacatttttcggtaaaaaaattttaggaaaattatgaaatttttaaaaatgtttgaattttattggccaaagcattgtttgtctgactaatttaatattgagcaccaaaagcagaaaaaatcggaaaaatatttaaatcaatttcaccatatatttttgaatttgattacaaaaatgcgaagtggatgatcaaattttaagaaattaattagattatattccccggcacaggtcaaactttgcccgaaaatattttaacgttcattttgattttccaattctatacttttccaatttttgaaaaaatttcgtccccataatttttcgctaagtgatcagaagaagttcaccaaaccttgcagggatactaaaaggaagagaatcaaccaattttaaacattttcatcccatatcctaaaaaatttcaacgctaattggttttaaaaatgtttttttttcaaaattcagagttttccattattttattttattttttaagttttaaatatattttttaatttaatttttaaaaaccaaatttgctctcaatcgggacatttaattttccggtcactaagtccaaagttcaataataattaaatcaaaattcaatcattatgtgccatcttcgggcataataaattcatatccaaattcacctccggacttcggtaccaacgcgaaatcacataagcggtcagattgtccccattgttggacaccgtccgggccaagccaaagtcgagcacagtcaaatcgcactcctccgtaatggccaagttggacggcttcaagtcccggtggattacctgaacaatggcgaagctattaatggatggaaaatcaggattaaatatagctcactcaattgaagcatttttagaacgtaaaaaatttgatcggatttcgacaatttaatttttttaaatgggtaaaaccccgaggtcaatctcggcattttccctttttcgtaattctgaaatcctgacctttggtacctctcccgacactaaatcctcacattttgcttttgatttcgaaaatcctcgccgttttttttttttttttgccttttccatacactaaatccctgcattttgcttctacaataatttagaaatctccatcttttttttagcatttccttccccgaccaaaaattcgccgggttcgttcttcgtccttttcccaatatcaaatctcggcatttactaatcaaatttgatcgagaaataaaacagaaattatttaaacataaaaacaattaaatattctggcgtaacatttgcggaatggagatatttcagtgcacgaagcaattggtagacaatgtatttgatgtggtcatggttgatcagcgattggcccaactgtttttgtcggtccaacacctgctttaggctgacgccagcgtatccggacacaatgtaactgccaacagaaaagtgtggcacaaatgccatcgaatgagaaagagaaatgccgagaaaaacccaatcgaagtgccataatatgaaaaaaaaagtatgtcaaaaaatccaatccaattgtcatcctgaaaaaagaaaaatgtccccaattcgtacaggttttttgagttcctctagccataatttttttgaaacttgatgaaattttttgaaatttgtagaatgatagagaacacttagggctatcgaatgatatcaagaattaaaaatttggttgctttttaggaaagttatcaataatttttcatcaaatcatattgatgattttttaaataatgagagtattttccattatatttacacatttttgaagcatttgtcgtccatgtcaggcgtgtacatgtccacaaattggatgatgttctcatggctgatcagctgcaacagtttcaactcgcggaacacgcggcgcgctttgatcgcgctgctgaatggctcgtacattttcttcaccgccaattcgacgccttgcgctgctcgcactttgctgccaaattcaattttgggaatgtgtttttttttctccgattttttggccaatggcacaatgaacggccaaaaaatgccggatttaatttgggaattttttttctccgattttttggccaatggcacactgaaaggcaaaaaaatgccgcggagttttttcattttacgtttataacaataagctatgaattttctgggtcgatgaccaaccagtaaaatggcacccatttacgatcaaaatccagaaacccgtgccaggatttgaatttttaaacaatttgatcgacaaaaccctaattaaataaattgtgctggaaataaaatttgttggttttaaatgccttttggtgttgtctgctgtggaatgtgaggatgtgctcaactcacatcacgttgccgtagttaccaccgcccaaatagtccacaaattggtactccgatggcacggcatattccacctgaaaaaggcgccacattttttgaataatgccatccaagcagcaaaaatgtcgaaaaccgtgccaatgtttggcaattagggaagttgggaagcaaccggattagtttttattacgtgccgtgcaattaagcggcactaattattgtattgcatttatccatttacggttgtttgaaaaagatgacaattaattggcattggcaaatgctaatgagaaagttggcactgtgaaaaagtggcatgtggcacgagtttttaaaatgccggatcatcagaccaattaattggcacggatttttgtaaaagcccgaacatcagaccaattaattggcattggcaaacactaattagaaagttttggcactactgattcttggaaaatgacggacccaatagaagttgggcaaaacaaactttggtaatcaaaaatattattagtgccaattatttgaaaatgtaacgaagattaagcacttttccatcgcaattagacatatttagacaattaattgtgccacgaaactaataaacctaccatatccatgttgaaacaactgtatcatatttgcaaccaatgatgaaccaccgtaaaacaactatcgtactcatgttaaaatacctaccgtattcacgttgatgtgtacaaaaggccgtgtcgctgtggacgaacaatcagaagatgaatttgttgttgttgtgccaaccattgccatttgctggagg

SEQ ID NO: 1352 - DNA, 8073 bp, Heterodera glycines
  misc_feature (7962)..(7962): n is a, c, g, or t
gaagatggaattgagttttatcaaagataaaataggttgaactcatgcaatcgaacatccaattcgactcatgtagaacccggaacccaaattcgaacaaaaatcattcatgtgtttctcattttatccgtgacaataatcactgccaactttgtttggcgcattttaaccggagttgaatacttgtgaattttattgtaaataaatttttgactttttgttcgggttcggagttaagaattggtataaatggatgccagaatggatcctccaggccctaataccataaaatcaactttatttttaaaaaacatgaaaaaaatttttatgacccaccatcttacagttaactttaatacccaaaactatcaatcctttttcaggccaatcatttttggtcgtttcacgcagcggtgcaattgatgttcatcggcaaccgcagaagttcgggacgttcggagacagcaaatgcccgttgaacaatcctttggtgccggccaaattgagacaaaatccgaggcccacgtgctggcaaatccccaaagagttttggccggactgtgtcaggtcagttgcacatttgtccatttggcttttatatttaatttccacattttttttgccagggaagttttgtgtggccgttccgccggtcatatcattttgttggtggagggtacggagccggtcttcaggaaaatgacgttcccattggacggacgcgtcgtcacggtcgacaacattttgccgctcatccaacacacacttggccgccgagaaagagtcatttgcttgccggcaagtcgcccaaattggcagagacatttttatgggacaaagatttttggactctcttttcaaattatcatattcggaggatttaaatgaattttcaaataatctgattgaaatggcactaattttgagtcaatttcagatgttcgtcagaggtttcttcaaaagggcgggcgtttggcgctttgccgaaaaatggcaccgtttcggctgtttgatggtcagcgctgaaaaaagaaacaaaaaattgcgaagcaaatgtttaagttttcttctgcctcgaagttttcacattggcgaaagttcggtggtgcttttgttgcggctttgaagggcaaaggtgattagtaagcaataaatcaatattaacatactatatgttacagtatttcattgcttcccttccctttaattgtctaagtcgcctttttctcgcttgtctttctctcccccttctttctcatgctctctcctctttcctccctcactctctcctctttctctctctctttctctttatttatctcgttttctcttcctttttattttctttctttccctcttaaatatgttaacatatgtagaaccacaccgtactttgcacccattcactttttaaaaggctcatttgtttgtctatccatccgcagtgcacgcattcgtcacaaactacgtgttgttttcctccgtctcttccccctccgctttgggtgcattcacccctctccttccccccttccccatttggtctctctcacattcattacttttgtttatttgtttacttctcctaacaaataagtgcattggtcccccctttacccgctcatcattctctcgatcattcatttcccacaaatcttttaattccttaaatagttcaactaaaaaaattaactaaaattaacttaattaatgatggaagaagagataggtggtcctcagcgcagttcgactccaaaccaaaacagtgacggtgccatattaaaaaataataaaacagcataatgatgctttaacaatttcagacgcgccgtccctttctctcaatgacgacacaactccgagcttgaatggttcggggtcgttcctggatattacggccgacgaaagtaattagccagaatgaacttttacaaaaataaggaatttgccctttcagacttcaatcgcttgatcccggcgagcagccaattggagaagagagacattgccatcggcgttttgagcagccaattggacgttttgaacagccaactggagaaaaaagacatcgccatcggcgttttgaacagccaactggagaaaaaagacatcgccatcggcgttttgtcaattgctgtcgtcgggatgggcgctacaatcatttatctgttgaaccgtcgctgagttaacgctaaccttctgttttttccattcactgtttatttaaccgactttttaattggagtataaaaaaatttgtattaatatttatctggaagtcgcttgtgttccattttgtgcttcctggatgattcctaagtttattgacccaatttcttggaaatacagaattaataaaaacagaatgaagtcatagctggggcccaaccgtgagggcccaactgacgtagaccgtcaaatcgatgtgcatttgcttgccttcgatattcgcattcacatgaaaaatcgaaatgccatttttccgtctgcctttcccagcagttgttgctcaaccacttacaacatggcatcctcaactgtatcttgttgactaattgtgccgttggtgcctttgtgccgttgacgtcatactccgggaacagttcggcatgggcgaggaacgcgatggcgagcagtgaaaaaatgacaacaatttacctatttagaaatttaaaaattaactatttcaaaaataatatttttgctaattttcaaattcaaatatcaatcattagctgatgctctctcctccccgcgatgatcaaatttgtcgattggaaaaagtattaattaataattcattctttatcggttgggtcatccctttgctcaaagcgaagtcgacgaatcccaaaacactaagaacgcatatgacacacccaatggtcctatttatggaatgccattccaattacctttcacttaagccctttctccaaagttttacgattggaagagttgtgccattctgcgagaataaaacaattggcacagatatagagcatagatgtacataatagctgattatggacagcaaaaaatgagcatttccaattgttaatttaacaattttccatcattaatcactaattgttctttaaaggtgccttaattaccctttaaatggcattgtttgtgtttctcattgacaacagagcacaggtagtgccaaagaaatatttgtgcttaactcagcaggagaaagttggacagtttttgaaggtactgcaaaagcgaagaataaacgaaggatgaactggaaaacagcaacgaaattccgaaaaatttttagcaacgcaatcgcgacccatcctccgtcaatgaccgctttcttctgacgccttttgagcagttcccctccaatgtcaaggtgttcatgttcatgtgtacaattgttttgctttcgctggaactttgcattttactgtacacaaaatggttcaaccacatttaggcgtctatttgactttttgcgtccattcaatgaccatttttgttttcattggccataacttttttcttacttggtgagattttacttccttcgtgtcaatcgaaagcaaaagtttcagtaataactcaagaaaggagcaaatactgaaattaaattttcaatgggaaaacgagagatttagcttttttcaaatatatttagggcttttcttttaaaacgttattgccaaagaatttttgaccaatctccctttccctttgatgatcactcccgactccccatagtcttgacccagtaattttattatgtaatttttcccttttaatgtgtgctttttctctctccctttgtattccccgtctgataagaattatgtcggcatcttctctttccatccttgactatttaaactctgtccccattgactcttcgtcttcttttccctctccaatcctaccactcctacactttttcaactctaactttcctatcgttacctatcgtacttaaataaatttctttccattctttggcaaattttggagtaaaacccgggtattaattgggagtttaaacaaagcctcattggctaaatctctcccgacgaattgtgcatggacagtgcagttggtgccacgacccgggatttactcctaattcccattttgccgaaccaggtaaaattcccaataggctaaacgcctaagattgtcgagtcggagctgtgtgcttgctcctcggcggctgtgtgccatcaaaaaaagcattcaaattttgaaataggaagaaatgaatggcacatacaaattatttttcattgactaaataactaactattgagtttcaacaaaaatttatttttatattttttaaataatatgtaaaatcgcggaagaaatgctttgttttttcagttttcttccgcctccaattttttccactggcgaaagttcattgccgcttttgtttctgcgttgaagggaaaaggtaattagtaaacaatcaatcaatactaccatactattacagtatcctttttctgtgcccatttctttgcttcccctctcaaatttgccttttcacccccctctctttttcatactctctcactctctttgtttatctcatcattttctcttacttttcattttctctacctttccctcgtcctttctctcttcatttaaaaatgttaacaaaacacacacactgtactttgcactcacagtcactttttgaaaagatcatttcgtttgtctgcccatcagcagtgcactctgcactcattagtcacacactattacgtgttgtttcccccgtctttttccccctacctatgggtgcattgaccccctctccttcccccttccccatttggtggtctcccattcattccatcttggtttatttttgcagctcctcaaccgcattctttgggtgggtgcatatatttataacccattttcctttccatcattcattcaattcaatcattttcaatataacatattcttttattccctcttatttggtcttatattttaattataatatagctaactaaaactaatcaaatcattattaatggcagactgcggtacgccagtgcgcacctcaactcccaacgaggacatttctgcctccgatcgtactgcaaaatgcctaaatattagaaaaaaattacctaattaacagaataaattaaaaagtaattcaaaaaatgattttttcataattgcaggcccttcgtccagcagcagcgagtcatcagcagcatctttggacagctccggcggaggatttgccaacatctcttcggacaaaggtgtagtctcatcaaacacaacaaaaatgaaatattttttttttccagtgtactccgaattccctgtgaccaaagaaatggacaatcgcgatgttaccatccgttggctctccatggttgacaaacgcgatgttaccatccgtttgatctctgtggctgttggcgggctttcagtggctttgttcctgagccgtcgtcagtgaatctgtggcttaacactaacctgttcattttttcacctattcgttttttaatcgttatttctcatggagagtataaaaaggatacggagttttactttaagaaattttacattaacaatagcaattttgccctataattgtgttggtgttccggtacaataccttatatgaacccgaatttatcgaattcaattcttaactcccatagctcaacaaaaatcaccgagccataggttaggactgatattttccacaaataactattaagtaaaatgggatgtgagtttctataaaaattagttaaaaaacttaaatttataaaaatattattcaaaaaataattgtgaaattcaaatttaaaccattagctcgttgcccattccttctcgcgatgaccgatttgtcaaattgaaaaaatccattaattaatttatttattctcgttgctttaaatctgttcgttaaaaaacatttatttttgttgcatctaattttataagactatgtaaatgcatcttttcaatgacccattttttggtcatttagggacaagagtaagaatttcgacttttgttcgaattcgtgtcagggatttgaaataggtcgaaatggagtgatcagctaccccgaacttgtggcgccttcgctgggacctgaacgtgaaacaattccattgctgaccgcgctgagcgactttctaggcaccacactgctcgccatcgcattcctcgcccatgccgaactgttcccgtatgacgtcaacggcacccaaaccccgtcaattaacgggaatcccgccgggaaacgggaaaaaaattttaaggaaaaaattgatttttaaaaaatttttactttgaattacctatttttcaagtgaaaatattttaaattgtttaaaaatttctttatgtaaattagagttgagcgagaccgggactggtactgaaaaaacgggtacaactgagtacccagtcccggttttgacaaattttgaccggtaccgggaaattcccgggtttttcccggttttcacaaccaaaaattccggtcctggtttttgtcaaaattcccggtcccgctcagctctaatttaaatgattgagtatttttaaatttaatggactaaaaatttccaggtccaggcaaaactggaaaaacctggatttcctggacattagaatttttatttcaaatgaccgatgttttttcaaaaaaatgtttaaatagatttaaaaacagattattagtgtaattagtagaggccgagatttccaaaagtgccggaccggaccggtctgatattttcagaagcaaccggtttccgggcccggcctctcaaaaccggtgaaaaaagacacgaccataaaatatttttgaaactttaatacactataactttttagagaaccatccaaattaagcattattggtattatttgatagccctaagtgtcctctatcaaaaactttggttgtgtttcaaaaaagttgtggcttgtaaatttcaaaaattgatttggtaaacctcttgaccacaacttctttgaaactcatgaaatttttttaaatatacagaaaaatagaggacactttaggcttcaaatggtaccaagaatgtttaatttggttgcttcaagaaaaaattatgatgcactaaacttgcaaaaaaatttttatggtcgtgtgaaataaaaaattcaacagaaaagttcaaaaaaattgataacattatgccaaaggaatattttccaaaggaaaatgaacaaaaatcaagaattttaggctttgtcataaaccggtaaaaaccggtccaaaatgccggtttccggaccggtttggcattttcaaaatgaccgttttccgggcccggcctctgaaaaaccggtcaaaccggaattttccctaaaaccgccggaccggtttccgggcccggtaaaaatcggtaccggatccggtccggctcggtctctacttttaaccataatttgaagctcaattgaaaatctagagaaaaatagcctattttgaacaattttggacattttcgtccattttattagcacaccgatgtgaattacgcagtaaaacgagtataaaaagcggtgaaaaagtgaaaaccgtccatttccatttcttctcctgtactgtgcagcgcagaacactgttcttgttccttcattcacactatgaggaaattctattatttcaagctgttccaagcggtcttggcatttgtcattgtttggcaaatcctttcgattgagaagctttgcgggaaatttgctgagccaaaggtgcacacattcatcatcagaccatcgcgaaccttacatttaattttgtactgatttactctccatgctttcagtgtttctatccaacggaagcttgcgacaacttcactatcttcaaacaaaacgcagaaaccactgaactcaacgcggacaatgaaacaaaatggatccagctgaacgacctcncgaccggcgagggctgtctcccatcaatgtgaattgatcagctttagctcgtattgctcctcttctaaacatgatctttcagatttccattgtctccactcttcgaaatgg

SEQ ID NO: 1353 - DNA, 2736 bp, Heterodera glycines
  misc_feature (37)..(37): n is a, c, g, or t
  misc_feature (2708)..(2708): n is a, c, g, or t
aaagggttcctgagagttttcaggctattatgatcanaattcaggatccattatctcaagtccaaagaaaattgagttatgagttcgacctgtacttggatttcttgattttgagtgatttattttattttttattttacaaccaatattatagtaattgttggcttgttttcagaatgatgatgacgtggtgattgtcggtgaaacgtgcactgtgatgtcgagttcgcccaccttcggcttcaactcggacatggaaatgcagcagttgcgaagccctccctcggcatttgtcagtggtggacaattcgagcacattcaccacgttcagtcatcctcttcaacctcttacgacttgtactatgatgatcaaggtttgatttgttgttgtgtatagccataaattaattagaatcgatgttagtggatacatttggcatttatagtgccgtaaatttgcgttttttgggctgtttgtgaggagccccgacttttgcgcctatgtccaaaatcgaattcaaatttgaattttttgaagccctgatagcctaaacagcattaaaattaagaaaatactgtcttctagttttttaggaacatcaattttgttgtttgaaaattttattatttttcaaaaattcattacatatcaaagatcggctacaatcacttttaatcccttttttatgctgtttaagtgatcatggactgaaaaaaactcaatttgaacccgattttggacaaaggtgcaaatgtcgggccgcataattggggggaccgcaaatgtcgggacacggtttgggatagagggaatacaaattaaaaacacaaatatccgaaactccaaaaatcgattttttgaatttattttttgcaaagaaatcaagtccgcccatttacagcagcaactcaacaatattcgatggtttctcggccaatgcattcgtcggcaatgaatttgggcggtgatggccaacccattcagcaacaactggaccaccaccaacaacaacaacaaatgtaccatcaacatggacacgcatcagccgaaacgcgaggatttgttagacgagtgacggcaccgacggcgaaaaccccatttgaagaagaggaggaggaggaggaagatgaggacgaagaggaggaggaaaaggaggtgcaaatgggaggaaatgaaaccaaagaggagatgggaggaggaggcggaagcattggacgacgcgcatccgcgggcagtgggagcggccgtgggagacggacaattctgctggacgacagtgcaccgcttcccctcccgccaacgatgacaaaagggggcaaaattgtgccggacaacaaacatccgcttcagcaggtttattattgtcaatgtcaaaggatatatgttgggagtggtcaaaatcggggaacattttgatgaattttcgttttttaaaatcctgagttaggtggtgcattataaaattgtttatccattttcaccaaaaaattactatttttggcatcttggtctccatttttaaaaatatgataaaatgggagtccggagatgccattaagcgccggcgtgaaatttttgagaattttaatgcaattttaagataattgcttaaaatttcaaaaactctacgcccttgtgttaaaagaagttcgactttgaaaaatttccagtcgcattacttctttcaatttttgttatttcaagtcgtcgaatcgtggtgccgcccttgacgaggagaacaagcagaaggtccgacgtcgtaagcaggaatttgaaaaatcgacaacagccaacaaaccaatcgttggcgaatcgccttcaaaaaccagcactgccacagcggtctttggaagtgccggaggagtgaaagtggaagtgaaatatgacgacggaacgactggcaacaaaaagggcacaaaaacgaaacagcagcagcaccaaagtgatgggacagcgccagtgattgaggagacatcgccaacaaccaaaaatttgatgcacgagcaattaattaatttaacaatccataattattcatttttgcatggcacattaaaggcttgagaaattggctgtaaagggcactcctccagtggacatttttatagcacaaatgcctgggttttagcaaaatcaaaaaaatgttattattatatccgagtcaaaatttggcattacattgacgaaaaatttgtttagatccgtcacacttttgttaaaattccctgtaaacaaaaattttcgactgatgatcgaacaataataataataatgcccacacttttcagtgataaaggcctcattgtggctcaaacggcacaacgccttggcaccattgagggatggcgtcggatgaatgggtggcttaaaagtgccatgaaacagtctgacatgaccaagctgaaacaacttctcacccagctttcgaatgtgaggcatttgcactgtaaatttaatctttggttggatttcgattttctcaggccgacataagtgttgatttgttgcgggaagatgtggacacaccgaagcttgtgaagagtatgcaaaagtcggaagataaaggtattgtttatacacctaatcagaatacaatggatgtgcgaatttccgtttctcattatttgacttttgtttgtttgaccctttttgtgtttaacattttgaccatttaccgtctgaaacccgtgtgggggctacaatccantttttacttctcattacgtgctgctttt

SEQ ID NO: 1354 - DNA, 3824 bp, Heterodera glycines
caaacttcaaatcacttttcactgtcctattttaaagcattagatcttatttaaatctcaaaacattacaatcgtttggtattgtcgttctgaaaacccgatttttaggcatttcgtcgatggcaacaaatttggtggccgattggaagcagaaggtgcgcactgagaaaagcacaatgaagtcaatggcattaccaaaattggcgccggacaaaaagtcgtctgtggtttccgtcgctgtcaacccaccgccagcaacgaccgcaattggtggtgctcaaaaaacaaagcaaagtgcgccaattaaaagcgaatcgaccactggagcgactgttcgtggcttggcatcagcaggtttccatttgttcagtttatttttggacagcatttgcaaacggaattattgggttcgtaaatcgccattatttcttggattggttcttgtttttgtgtcagtttcttaactaaaacacgatttttatttattgtgctatttcatatttttgaaaaaatgtatttcaaaaagtcgaacaaaaagttgtccactcgaaataaaaatacggctctacacgaatccggcatccatttcgactaattactaaccccggactctttcgaacaataagtcaaggcaccaatttttggttcaaactttgttttaactgcacttcgaagtgaaattcattattgcttcagtaaggaccattcaaactatagactgaaaatggaaagccgaaaaattgttttttattttgttttaatttggacgcataaactgcagtattagccaaaaattaactgttcacaattttgtctaaatttaaggagcaactgcggcaatcggtggtggaatgggaacgaacacatcgttgggcgaaaagacaaacaccaccacccaaccaccggcacctgtagtgaaaccgaagacggcgaaagcaaaagttcgactatcgaagccgcgactcactggtgagcatttttgtggtttattgtgctttcggggggaggggtgatcattttttggttccctctagaaaggcgcaaaaaataaaaggattacttttccaatgatacataacaggcccgtaaccaggggaggcggcatttgccccaccccttccgaaattaaaattcaaaaaatggttaatttttaactcatttcttataaattttgacccttattttttccggagacacataaaggcactgctgaattccaatttttccaaaaatttgacgaaaatttgggtcaattacactgacaaagaattttttgaacgaagagcaaaaattaaaaaaaatacacttcggttaacaaaaattttttctggttacgggcctggacttaatacatatgcattttccgagttacagttggagccctccctatgtcaggaaatttgttgacaaaaaagtttgataataaaacggaaaattgacgaatttttagactattcccaaacacctagctttccacacgcctatcttttttctcagttttaactcccttttctcattgctctcccccttttcaggtacgcttgcactgctcctcggccgaggacgatccattaacataattaataacttgaacatccaaccatttccattttttacattttttgaaaacttattttggatgccatgctcacagtgtatatccctcactctgtgtgctcacttttatgtacatcctcgcacatgcttcacgggtaaaatgcagatgccggtaaaaaatgcgttcggtcgaatttgttttgcgcctttccctcgacataatgggaaaattctaaattttccaacaccatcattaaacccctttctgaatctgtctgtgttcgcgcaattcttatttttatcattatgtcaaaatcatttccatgccgggacgggtgattgatcaattgtttgaccctcattgtcagagccgacggatgctaattaagaaagacagacagcgcgtggctgaatgattgcgtcgtttattgcagcattatttgaataggtggacgaacacgggtcattcccgttttctgctcgtttggcggcacggaaaaaggagtaaatttaagaaaagtgaaacgaagtgctgccgaggcgcaactgagagcaacagatgactttttttttctgcacagttctgctgaacaatggctacttcttgcatttcgcgtaaaccgatgagagtgatttagaagggggtggggcgggtgaattaaggcgtacgcttgtgcttgataggcaatttaaagcttgtgaccatgtccatggtagttgttccctgttggaccagtcggtcaagccgtatgatttgtgatcgggctgggttcgcgatcactcattcactgctctctgctgccgagcattcggtcgcgcgcgtgcgtcgtcccccccccccacccttttcgctatttgtctattttctgtctcttgggttttctattcatttgttgcattatttcatcatttcgtgccttccctttcactgtctgtgagcatggtcaaattggcagttagccgcaagaatttttttttcaagttaaaaattattaatgattaaatataattgcaaaaaaaaaactaattttatccaactttttaggtttggaaggcgacgaagaaattgttgagaaaacggtagcagcgaaaacgcaatcggaaaagggcagcaaaggcggcgccacccaacacagtccgaacggaacaggtggcaaatgttgccattttttgcctaattaaaccaaaaaattagccaaattatgtacaggattaaaaatttaattttcgacaaatcacaatgcacgaaataaaaaagaggcgcaaaatagtataaaaaaaaatttttgaatttttttcccaataattgggtaccatcggtagtattaccaaaaactggttattgagaaaatttctggtgttttcaatggtcctttttcaccctgtttttgttcaaattgtttcatacaacagtttacaccttttccttttcaggcgtttcacccaattttgagtcgccattgacgcgcattttgtccgccaccgaaaaattccatgtcagtcgattttttacaattttttttaattcaaatttacttttttttatatttcccaattttatttgacttttaaaacgtttcccttttggtctaggcacaaaaccgtgctgtccaacccaaacggaagcctgccgccgaggttatgttctccgacagcttcatggacagtttgtgcggctcttcggatgacacgacgacgccgcagaccaaaaagtctaaaatcattcggaagaaactttcggctacattcaaggtactttggaattgattagaaattcgttttttgaattggaagatcatggaattttagggacgggaaaaaatttcaccgaattttgccgttaaactttgaaattttcaaaaaatcttattttttacaagaaaatttgaggaaaaattttgtcaatggttcttttctggaattttcatataaaaatttttcttattgttagattttttcttgaaattttaaaaactttttaaaaaatttcttcggtgaaattatgtcccggctaaattttggggtgcacccggaatttctgtttttttttgcgcggacatttcaattttgtttcagtccgactcgaaccgtgactctgtggaggaggccaaagacccttcggccgctgttcggccggcagttggcggccgtggcgagaaaaagcgggtgcgatttagcgacgaatttggcatcgaattgacccagacgcgcttcttcgaagtggaagagggcgaaagaggtgaaactgtttctgtgtttttgaaata

SEQ ID NO: 1355 - DNA, 1715 bp, Heterodera glycines
tatgctccagcagcaccatcagttcggcgccttttcgtttaccgacccgacgctggtcagaaacctttaatcatttgacaaatcatcattttatttaactgatcacttgtccgacccatgccgtttgagttggacaaacccgaaatacgaaccaaaaaacaccctccaatttgctttcaaacattcatagagggttaagaaataagtaatagcaataagatttttaaactttcttttgaaataaaaacgaaaaaccaaattgaaacttttcctacaaaaaaccgctaacaataagaataagaaagtgaaaaacaaaaaaaaattacggttttttcaaaattttttagggatttgggaacttcatgtacccttttgtttgacagcctctccaattcaattcatttttgaatttcaatttgaagatgcctcccggacacatgcagcggccgacgccacaaattccgctgcatcagcagcaaagtcagtaccgcggtggaatgatgggctcttccggcggtgcacaaatgggcaaattcggtagaggaatggaaaaccttttccgagtaagctaacggaaaaaataattgcataaatatggcttaattaatgttttaaaaaattttgagtggaaattggtgcccgttgacgacgtcatcactttggttgtttcgggcagcaaaagtcagtcgaagaacgtcgaagcgacgcgcattcgcggagtgatggaggccatttgtctgccagaaatgtgagttttgggtgaaacagtgattttatgccgaacatttgtgggaaaaccgtcgcagagaaaagcattggctgaattagtttttttatgtatttcgatgagctttacggggctttaaacttagaaatttttcaagaaaaaaacttcgaaagttttttcataggaaaattctatgaaaaaactttttcgaaaaatttaatggttaattactgttttttcaaaaaaaaatttccataaaatcgctcaaaatttcccgaaaaaacaataagaagaaaatgtctaagattttttcttgaaaaacttctatttgtaaatttaaaaaaaaattttcgacgggaaacgatgcggggaaatgaaccatacaaccgcggacaattatttatttgaaccaaaaaatagaatattgaaactaaaagttgaggaatttactctttttttattttctgtaaagacaaacgaaaactttttgaaatttcagcagtttaccaatatcggacattgacgagaatgactacaagcagcaccaaaatgagacgactgatcacatgccgaaaatcatcccccacgaaatgatcactggtcagtcgatttccactttgtttttgctgggaaaacagcccgttttcgccgacgcactttttagacatcggactctgaaattataagttgggtcccgagtgtccaaattggtgattttgtgaatttttggaaaatttttagtgcgagaactcttggacacggcgagtcaattttgggctccaagtataaatttcaattttttaaagcaaataaataaaatattaataaaaacagaacgccaaaagaacaaatacaaatagtggaaggtagacattatattttacccttgattttattaaatttttttagcttataactttgtcaataatagaccaaataaaaccattttatgctcatttcgaagggaaaattctaaaggatatttctt

SEQ ID NO: 1356 - DNA, 1987 bp, Heterodera glycines
agtggggattgaacccaagccgagaaataataaaatcagaaggtttagccacttgaccacttatgcatacgaacaaatgctttaaatgaaaataaataatttaattttttttttccaaaaaatttctccttcttcaccattccctactcttttctcacccagacccccattcttaccagtgcaaatttttaccggcggtaccggtactagacaaaccggtaccgatactttgatttttgaaaaaactggtaccggtaccggtaccaaaaaaaccggtaattaccggtcggtaccggtaccggtaccggtaccgctcaaccctagttttaaaccctcaaaaattccaaaaaaagtgtttgtgttcaataattgcttaaataaacttaaaaaaacaataaacaaccaaaaatggatttaaaacataaaaatgcaaattttttttattgtcgtccagcgtataaaaaatatttccaagtttgccaaaatttcaaaaaaattcttttttaaaaaaagaaaagttcgcaaaaaatggcaatgacgacgaaaactcaaatttttcggattttttggggtctaatttttttaaaatttccaaaaagtccatctttaggggtgcatttttcgcttttcttgcatttttttttttgtgaaaatttgccaaaaacggccaaaatattgactaaaaagacaaaaatggcgaaatatggaaaacccccaaaatatggatttatatggactaaaaaccttcagcaaatcaaaaaattttaacgtagaaatgctatttttgagcccctttcttcatagcatatgcgcagaaaaaatatgtgtaatccatataatttacaaccctattaatgattgttctataaatcaatgcaaattttttttaacataaaaattcataaaattgcttaaagtcaatcaaatttacatcacatccttattattagggttataatttgggagtccaattatatgcacatgcatatttttttcctggactgtgggaggcatgaaacgcacgaaaaacatgtttttagcgtgttttgaagcttctaggatgactttccatatgcatgttttgcatatttgtgcatatttcgcgatttatgtgcatatttgcatatttgtgcatattttggcatttcgtgcatattttatgtgcatatttgggcatttttccaaaaaacctctaatagaacggcccccaacagacaaattggcctttttgacctcaaaaaccggaaaattttccaaaaaaataattttttagcaaaattttcacgaaaaatattgaataaataaattttctcaaaaaatggttaatttatgtcaaaaataagcaaaatttcgctttttgggttggtttttcgcaaaaaatgagtaaatttttgctttatcatgtttttttcttctaaaatgatttttaataccacatttagccattttttgaagattttacttaatatttaacaaatttgaagaaatttagagacattacacccttaatttggaaaatttatatgcatatttttcactttttatgtgcatattttgccatttttggtgcatattttatgcgcatattttgcgattttatgtgcatatttttggatgccctgatgataagactcgttatttgattaaaatttactatacttttaaattagacgtgcacatttacaaatattcttattttttaatctttaatatggttccaaaacttccacccgcgaagaatcgaacgaataaactcagtccaatttgatttttttttaataacatttcaatttttaaaaatattaaccaaatgaaaaattaaaagttttgtaactgtcatgaccacaaaaaggacaaattcggggtcatattcttcactattgccctgccagcacctttatcacaatgtttatcaaatgaggagctaaaaatgaggtttcgccaaaaacaatgtttgaattaaatagtgcattgggtatcattcact

SEQ ID NO: 1357 - DNA, 1136 bp, Heterodera glycines
aaaggggctcaaaaatagcatttctgcattaaaattttttgatttgctgaaggtttagtgcatataaaagcatattttgagggtttttgagaataaatgcatatttggtcatttttgagttttgagagcatatttcggtcattttttggagattttcataagaaaaatgcaaaaaaaagcgaaaaatacacccctaaggatcgactttttggaattttttaaaaacacacccttaaaaatcgaaaaaattttaaatttttataagaacttgtggagaaaaaatttatttatatagaaatgtaaatttgttttagaatatataaaaatttataaatttgtaaattcacatttttgcaattgtaagtaaaataaaatgctccttatcccttgttttggtgttttaaaaatcaattcttaattatacacaatttttggcgttttttaaggttaaaagccattttttgcagttttttaaggcatattttagtgcatatttgggcatttttcgggtttttagggcatatttgggggatttttagcgcatattttatgcgcatattttgctttttttagggcatacaactttgaaccctacttattatataaataactttaaattttacaatttagttatattttttaaatttaataattaagaaatggatattcaatatatgacaaacatttttaaattttgaaaaaccaaggggctatcaacatttcaagaatttttattaattgtttattatgcccaatgattattaattacctgcaatccattcccataaaaatggctcaattggtccgatacggtgacattggccaactcggccaaaatgcccgtgtacagcacgtcctccaaataaaagctgttggttttgtgagcttgttccaagacggctttgatggtgcttggagttgtcaaatagcagccaccgtacaaaaacggtgggaaatgttcgcccgggaacatttcataagggacgtacctgaaaaagaagccatagccctaaaataatttaggaaactgtttctgctctgctgctaattgtatgtcatctaattaattcagtatttgaagtctaaaacatcataaatgaagaaaaaagcggaaaaatttcataaaacctaaaata

SEQ ID NO: 1358 - DNA, 2101 bp, Heterodera glycines
  misc_feature (2043)..(2043): n is a, c, g, or t
  misc_feature (2050)..(2050): n is a, c, g, or t
aagtttcggatgccctttctgctgtcgaagccttcccggcgcgacattgtcaatatgagcaacttggtgccattagcgcaaggcttttcaaactgagcccatgcatccaggccaaagtgccggaaatgaatttggaagttgtagctaatttgtccactgttgacgatgtgtgccattggaatgagcagggcaaacatttgccaaatgcaagagatgaccatgctctaagtattggcaaatgagaaatgggacttaggattgagtatgaatggtgcgggggatatttaaatgcatttacaccctaatcactttatttattttacatccatttttgtggcgcggtgccctttcctatttcccccaattaaatggtatcctacgaaaacattccttaattagtgcaataaaatgtgaagcaaatggcgaatccgagttcagaaaatgtctccgcgaatagaggggtgtctaatgagggagtctcactcgagcaaattggattggcaaaaccctaactgatcagcgaaaaattcgggaaaggttacacaaaaaaaggggccgcccctttccgtcctctgggcatttgttaataagttgatatatattatatttaataagaaacctaaaaaattgcaattaaaaaaatttacagtatcattctgtgaaagatatatgtataataatttaatttgttttgagaatgataagtttagtttttgaggctgactaccgccaccaccaaaattggacaaattgtttatgtgatgctacaaataaaagttagtatatttttattgcatagatagataaccccgctaattgagccgaggatttgatacccaattgatcaactggatacgccttgaactcgattaaaaatgggaaaaagggcaataattttgtctgctttattttgtttaatacattaaccactgtaattagtgaaaaaaataatttaatatatcatacaaaaattaaaaataaataattacaattttgaaaactcgtccacttattcaccatcacatttaaagcttatcgtctcattaaatgtcaacattttgtcaccaagcatcttctgcttttcgcttcgtttattcagtattttcctcttaaaactttgaaatcgaaccttaaaaagttcaacggattggttaaataaattacttaattaaaaaaggacaacaacaattttaattttgtggatttaaaaaaaagctaaaaaattatgaaattatcctttttgagtttcctttaatattttgccaattaacggacattgggcagttgttgaacaaacgatttgttcaccaccagtgccattttggccaattgttccccgcaggtgtgcaaatgggtcatgttgaacaaccgttcgtacacacacaacaaagcgccaaaatcgaatgcgggccaaaatctgttgaagaaaaaatgagggaatgcggcgagtcgggccaaatcttcgacgccaaaaatgcaaatgccatgccgaaaatgggcagagggacaggaagtatccggagcccacaaagtctgcctgaaagcttggtaatggggtcatgttaagcatttttttcgagactgtgagggatccaaatgagaatgcgaacctcgtcaaatgttttgtgggcactgcctttttttggttgaagcatgtctgcgtgtatccgtccggcgcgttaagctgatcagccgagtgcagagtgatcagcataatttcgtcccgtccatagccgatcagattcattcgtcggacaagttctgtcaggttcagctccaatcgaatgaagcggaccatggcacgggtcagactaatttcaaaatatccttttgaaagcagtaaatgtggcgaaaagccatggacagaagcagcagccggaacagcagtattcagagtggcttttatgtaaataatttgaacggtttatttatttattgaaattaggatttatgactttaattagccaaattaatgttttgtaaaatgctattaatcaaaaaaaaatcaaaagatttccaagcctataaaaatgtattaagaanaaactanaaatttcgatttttcgcatttatgtataaaaattgttaatttggcgaaatt

SEQ ID NO: 1359 - DNA, 8475 bp, Heterodera glycines
aatttttattgataatttgaagatcattattttatcttgttttgcaaaaatccattaattttgctgtctcctattctttgttttttattttggaacatttgtgttaccttttgtctttatcttattatgtacgttgctcttctattatagtactataagctcattatacacgaacgtgcaaaatgaccttattaattcgcgcaaatattatattctgaactacattatttagaaatgaaattttttttgttattacaaaaaccaattgaatttttccgatttgaaacttatttatttaaaattttctcgttattcaatttacaatatttagttagaattcattcatttatgttaaatttcatgtataacaattttagaatgttttttaatgatacattttcattagcttgtctcgatacaaatttttgtcactatttctacacttttgccatttttcattactattttagttaactatttcgagatttttcattaatattaaaattaaggtaaaaatagatatttttagagagtgggtcaatttttgttataagcattgttttattattttctatttattccactcatttttatttaaatatccatcggatggtccaacttttgttcttttttcgtcattttgtaacaaatttgagggtttttagttttgcatattttatatctttattaattcggatttcaatggcatttgtcattttaattttagtacaatattgcatccattactggtgaatattcttatgcatagtataaaattattctgcttaatccttacgatgcccttttcgtctttaattaaatcgtgcacaaattgcttatttatcactcctttgaacaatgagcgaggattaatcgggaacaaaatttgcatgttccatcatgcaggtcactcgctgactaagccatctgatcagctccatctcttcccggattatgccacaaatggtgaccatctgctgctgctcacaaagaatgagaagaagactatgaaggaggggtcggagatgccatttgcagaaattcctccgttttggcacccaaaaagaacaaactcatcaaaaaggccatgccggcactgacaacgccaatgaatggcactgctaaaggacaacaacgaaacttttggcttcctaatgagctcatctatgagctgctcctatgggtccggcccagctatttttggcgcgttcggcaaatgcttacaaccagtctcattctgtgtcgtttgcttacgggtggcaaacatgcaattacttggcatgagccttacgatgtttgggtaatgcgtgaaagtgtttttaaaaatatataatggaaaatgtccatttacttttgtgcaattgagatcttatttttctttttgaactaaatttggttgagaaaatcgtagatcaaacaattgaaataggctttcttcaagtttaaacttctttttttcaaaaataagttagcttatcttgcttagatctctgatgattgtatttctccttattctctgtcttatcattcatttgcttattgcctagcgcacgcattatgcgctgttaaatgcgggacaaagcgttctcttcacatggctttagctttattaattaccttttttaatattaaaattaaactatcattttcaacttaaatttggtaaaattgctccaaaattgatataaaaatataaatattaataaataatttatggtttttccatccagcatttggagtccacattctcagaccgtaaatttggaccaacaaaagtctgtgcgtatttgtgccgtaatcattcattgctgttgccgcgcaatttcctcaattatttacattgttcggaggactatgtcacgctttatgttctcattgttttggatagttccaagttttcgtcgcttgctcaactcgctctcgcggtgggtaaagtttaaaataaaaggaatattattaatttatgtatttagtttattatacaaatatacaaaaaatataaattgctttaaatggcacaatttattttttatatcagctaaataatttgcatttttgtttttcagcgccagggttttgacggtcgtggaccatgccgcgacactggactttgtgagagcgggtcttttgtttactgcccggacgaagtacgttaattttacaattcttaatttaattggtattaaatttgtttaaattctcttaaactagtttaaattctcgcgagtaaagctttctgcattttttaaatgacctcctaaacgtggttggcgccacctcacaaaaagtgcaaatttcggcgcttcacaaaaatgtgcaaatatcctatttttcctatgattttttatcgattttttattttaatttaaatttaattaaactatttaaattagtacttaaattttttcttctatatgttatgttgtatttcgaataaaaatcattaaaaagaacattttattaaatagaaccattagccaaattattttaagtaatctggttaatgattttatttaatattaaacaagttatacttatcctttatttgaaatccaaccaacatttttagaagtatattttgcatcatttcattaaatttaacatctttataatctaaaaattgttaaaaaaaaatcataggaaaaccgaatttttgaactaaaatcttccaatttatttgccatgttcaaggttacaaaaagatgagaaactttaaaaaaacccaaatggatctgactctcatcctatttttagccttttgatttgatcaagctcaaatttcaaaaaactcaagacgttggcgtcattatgtacaatcttcaaacgttgctcaagcaattttctaattacattgacgttattttgccaaaccatattcgagggacgcatcggctggggggtatttgaattgttttgtgtattgttgccatttcacccaaaactacatacattgattggataaaagtttgttacttctttacaattcggtccttgaactgatttattattttttctttgtttgtcagttaacaaatatttatgcgtttaaagctaattctaaccaaaatttgtcttttatttcacaaacttgctatctgaaattattatttttaaattattcaaattttacatttttttttgtttatttataattattaggggttccttttttaggcacaaaaaatcgcgaaataggcacctaataaggcataaaaaaatcgcaaaataggcactaaaccgtccctggtaaaaacatacagtttgccaaagttggcagatattgaattgcttcgcggtcatcatcatcatggtcaccattttcttcactttttttcggtatttttgctcatccataatgatggcagtatcagaagagcctttgaaaaaatgaaatttttttaaatgtttgtccaaaaaaaattcaaaatatttaatgccaaaagttcaaattggtaataatttttattgtaattagtccatggatttgttgagtgttgtttttgttaatatacacctgcaaaaatgccaacatcaaaaaaactgctgtaagcggaaaataggaaagaaaaaccgttttccttcaattgaattggggggtggagaccaaacacacgaagacaaagccacacacaatatttttttttgaagtccgaggagatcaccaatgtgaagcaaattgagaacgaaatttagagaggaaattttggaaaacaaattaatgagaataatgagaagtgaaaagtaccaaacataaattaaagaggtcaacaaacataaaataaatagagataaaatgccataataatttaaaattaaaacaaatatcttaattaaattaaaatctccaacacccccgaacaatctcgagaggcgtcctcgcctcaaaaacatcactcgtccatcgaaaggtgggtccacgagcagtcaacggcgaaaagggcgagagtcggacggatcggaacgacgattcatcggcggtccatagcgattggtgttgcgccattgtccagcatacggatgatggcgagtcgaagtgccacggcgattttggggcgggaacggtccaatccgacaaggatcgactcgatctcttgcggtaacattcggggccacaacaaccgtcgggttcatacgagaatcggctcgattactcgtagagacaactgcagaattgacggtccgaattttcaaatcctgatcgcccgggaatttcgtctgggagaaaatccaggccttaagcattttgcagccattattacacattttcccctcttcggaaacagtgtgtttgttgaaattttccccgaatcggaaaatttccaaaactgatcggcctttgtcggtggtgaaaattggagtgatcggcgatttggtgatgatggcgtgcattttcgtgatcagctcctcgcattccgttgccttggcgtgcacatacggtggagggcaccaaaatatctgcacgtgcgggaagcgctggcacaggctgacgatcatttcgaattgggccgcgatcgatttttcggtttcgccctgcatcagagaatcacgtccagccaaaatgagcagtgccttgacacggcttgacaaaacgatcggctgaaattggcggattaagtcggccatggaactctctcctccgatgcagtaggagctgttgatgtgtttggcgagcatttcggccgatgagtctccgagcagaacacggtcatgtgccaaaaagcggctcgctttatgcacaatcgtggcccgcacacgttcgagtgcccatgaactgtctttgaagacctcgtgccatttgtttttctcagaatcgggcagcgaattgactccctctggcatttgcatcgacaagggcttatatcccgactcggttaaagcctgtcgagccacaaagcacgatccgacccacttctccaaagcctgccgttggtcctcctccgttgggtatttgccggtgctgatttggtccccccttttccctgtgtacatacacaactccagcttcggttctgctccaacaattgtctggaccaaagtttgggctgccgtgagcgaagaagccacgcccgttcggagcagaaagatgctgagaagggcttgaagcggtgttttgactaccgccgatcccagattcgacatgttcaggaccgggtcgatacttcccagcgtgattttctcgcacagctcgtgccccgagccgcctccactgcactccgaagtccatccaaatccggcactgacacttccgacatccattggctctgaaaaggagtcgcttttccaatttccccccaaacaatctgaagcaattgtccccaattgcgattcgctttttcccccaatttcgcggcacttatttccagtcatttcgcaaatttctgaacgaattcctgcgtacattgacaacaattttaggtcgtttttaaacggatttttccctttaggcagtgtcgaaatgtctgggacgccttttgggaccttaaccaatcgttcaatcggcacttttattggggtgacctcctttttgtctattggtaccaaatttgccgatgaatcaccaatttctgtgatcaaatatggtccaaaatgtgaccaaagtaactttttgtgaggcgaacgacgattttgaccaggaaagacgaccataactttctctcctttttggaacttgttggccgtgacttttggtcgggaatcataccaaattttcgactgttccctcgcttcttccgaatttttctgggcttcttccaacatgtttagcaaattttcccggaacaattgaatgtattttccggaatctatcgtgtaaacaggattaaccggaaatggtacgtgtttatcgagcggaaattttgcattccggccaaacattaacaaaaagggtgagtaccccgtaacatttgacggtgtaatgttataggcaaaaacgccatacgccaatctctcatcccaagtccaattgctcgcggtcgactttttcagaattccgatgataattctgtttattctttcggccaatccattggcctgagggtcataccccgctgtgaaggacctttttatgtccaaaacttttgaaatttcttccattgtcgcattcaaaaattcctttcctctgtccgaatggatcttttgtggggtgccataaaccaaaatgaatttttcgacaaaaacttttgccactgattctgccgacttatcaggaattggttctgcgaccaaatattttgtgaaatgatcaacgatcacacaaatatattttttgttcgattggcttgggccgacatctaagatgtccatgcagaccaattctaatggttctaacgatttgacgacgttcaacggcggttcattagcccgtgaaatgaatatcataatttaatggtaatatttaattttttcataaatatttaaaatatttaaatttattaattattattttaaatttatttcaaacgggtgtgaagcaatcaatttccacgcattccttggcaatgtcgtcctttccataatatttaatttgtacgcaattaaattttaaaatttatatattacttttttgtcactaattgtgaatgctcttttcactttaaagtttttcacagtttccgattgattgccaagttgaagcaatgcctggtaacagatcagtaatctaaaaattgcattgggacatttacagacaatttcaagaaaaaatgaatggaaaagtgtgccgcattaattgcgcacttcctaatttcagatagaaacaaaaataattttaattttaatctattgttgcggtttttcaacaatggagaatgaatcaagacaagacttcgccgaacaattttttacaccataaaaaaattattgaatttttcttaaattattaaaaaaaaactctccggaaactcatgtaaagacactctctgcgatttggaatttgaagagacgtacttacaaggccaaaccttcagaaaattttttcttaatttgtttttccaaaaataatcaacaaatgtcccaatgcgctaaaaagttaacaatttaaaaaattatttgccattttaattcaataacagttcaaatattttctcccacctttcgtcacaaattcccccgtcatgtgcaagccaaaattcaatgccatagggcttttttattgcttcatccgtttcatttgtggcacgaagctgtataagctttactccgtcagtgccattcgtcaaatgaaaactttaaattagagtgccacgggaccgggaccggaaattcccggtcatccgaggtcccggtcccggttcccggtcccgggttttgaaaagctcaggtcccggtcccggtcccggtagggcaaccgggaaccgggaaaaacaagcactggtaagaatggggtctgagtgaaaaattagtgaagaaaattggagtcaaagggaaaaataaaaaataataattaatatattctttaaaagtaacactgcccaagtgtgcaaatggcctaatggctagtctccttgactttcccttcttctttcccctggttcaatccctctacagaaattagattattttcaatttttttttttttttgtatactcgtgggtttcctataaagaaaatatgattcctcatagtttttttttaaattgatacatattttatcattttttaaatgaaaatcctaccaattgagcttaataatcgcaaaaaccaacctttttttgttgaaaatctgttaacaaattgcacccaaatttttaaaatttcccccggcggcgcctatcggcaccgccggaccccttctttcccaaaagttttttgaaaaagcgctccgaaaaaaagtgatgtgaaaatcaaatctgaatttctattaatattcgatgatttagtcaaaaatgattaattgtttgaaataattgaagaaaatttgtttgaaaattttcattaatttaatttattaaataaaaaaacaaataattttgtattattttcacttgatataaattaaaatttgaatttttgtttaaatttttaaaatttttttgaatttttaaaatttcccggttggtcccggttcccggtttttcttgcggtcccggtcccggtcccgaaaaaaaatcgaggtcccggtcccggcttctcaagtcccggcaagtcccgatcccggttttggcaaaaattcccggtcccgtggcactctagtgataatattaattttcttttatttaaaaatatttaaatgtgcctttaacactgataaaagtgtaagctttatcggctccagggccatgcactaagtctacaatgatctatgaaaatttattttttacccaatatttgaaaattgtagcaaaaagaggtttaaaaaatatattttgttgatttattcaatgacataattatacgcaagttattttagaatgcttcgcgatttttggtcactttcgcgttatttattattaacttagaatattcgatacattaaac

SEQ ID NO: 1360 - DNA, 1793 bp, Heterodera glycines
actaacaaaaaagtttgccattcttctaagacagtgttatgaaagaaatgccctatagaaagtactgggaacaataaaagataaatgaaattttgcgagttatttggttaagctgaaaaataggcgcaccaatcgaggacggaaagaacaaaggaaatatccgaatacaaatctctccaataatattttatttacttaaaataaagctatcttctaatgaaaactgcaaaaatttggctactttttggcaaaaaatggctaactgaaatttttttttaaattttggttcgaagagcaacccctcataaaaaaaaaacattttttggctacgggcctagttcagggcgattagctcaataattttgggcgaaatgtcggcacacgtaataaataaagcaattgatcccgagtcgtataccggaacagaccaacaccgccgttccctatcctttaaaatttttttgaaaaaacggctaaaacaggtcatcgctctgccccccccccccacgaaggcaagagtctgcctatatgcctttgctaaaaaaacaaacaaaacaaaaaacatttctctatgtttggttagtcgccgtttttacagaggtccttcgggcgagcctacagtgccgcgatttttgcatatgaccgccacgacgggggcaatttcttcagggagcacaagttggacatttccatcccgcccctcaatgaattcaagagcgggccgtcgtacagtgccgctgcctttgtcctgctgatgtccatctccactggacggagcatcagaacaaattggacggtcactggcgaagtgaccataaatgggcacgtggaagcgattggcggcgtaagagcgaaaactcttgcggccatccaagccgggatgaccaccattgtcctgccgcgcggcaacttgggggactttcgtcgcatagagaaaaaacaccgccgtattactgcaatttttgttgaccatacttttgatttgttacaaatgttgaactgattttgtttggttgccagtgaaaaatttttcaaaaactctgaccaataaaaatcagcacttgggggtcataaacagaacccgctgggtgaaattgaaagaaattttgaccatttttaaacaaaagttcagtgaaaattatctattttgaggttttttttaaaaaaaaacatcataaaccatcaaatttctcaaaaaagcacttttaaaaagcatatttgatcccttgaaatcaacaaaataaattagcatatctggaagccttgggtttatctcattgggtgggaattcaaaaaaaaccatttcataaaaatgccgccctattcatcaccaaacatctttggcagctttaggagggaaagttaaaaaaatattgctagcctagttttgcattcaacatatttttaaattcgaaaagccctaccccggtgctgagcccgcacaaaaatttgagcaacttcgcccccgaattaaaaaaaaaaccggtctctaattttcacgacgcatcaaattgtccaaattttcatcttctcgccaattcgccgtctccccaattagacactgcctcctcaactcatcatcattcatctgctgttgtcccattcaatttccaatgctttcttcagtgtcagtttttcttggattcttcgttcattcaccaattcaaatggcacaattggcgttggcgtaaatatataaaagatgatatacaacggctaagtgaaataaattaaatgctatacataaaagtagagagttattttactcggtactaattgcgtttgtatcctcc

SEQ ID NO: 1361 - DNA, 7555 bp, Heterodera glycines
  misc_feature (13)..(13): n is a, c, g, or t
  misc_feature (31)..(31): n is a, c, g, or t
  misc_feature (39)..(39): n is a, c, g, or t
  misc_feature (42)..(42): n is a, c, g, or t
  misc_feature (51)..(51): n is a, c, g, or t
  misc_feature (58)..(58): n is a, c, g, or t
  misc_feature (62)..(63): n is a, c, g, or t
  misc_feature (68)..(68): n is a, c, g, or t
  misc_feature (70)..(70): n is a, c, g, or t
  misc_feature (73)..(73): n is a, c, g, or t
  misc_feature (80)..(80): n is a, c, g, or t
  misc_feature (86)..(86): n is a, c, g, or t
  misc_feature (89)..(90): n is a, c, g, or t
  misc_feature (95)..(96): n is a, c, g, or t
  misc_feature (100)..(100): n is a, c, g, or t
caaacacaattantaccttttactctttctntacatttntcnttttattanatccatncccnnttttnanccnatttttntatttnccnnttatnncttntttataaattaataaattccaccacttgtttatttaataaacatttcgccaaaaatatttttaaaaatatgaccggcaatttacaagataccaagggatgacacgttccgctttccgatttatttggcatctatttcgaccaatttcgaatccggacccgaattcgagcaaaaagaagaaattcaaaattttcggatttcccatttatagcagggtaataaattggaaatgaaacagaaaaattatcctaaataatagcattttcaaaatttttatatatttttaaaaattttctacataggcacctgtgccgagatatggcgtgccaaaatttgccaaaagttttactttttataaacaaacaaatgcaatattaaagattttttgcatattttgccatttttggtcaaatattttccgattgagaatatcccttagttaggaaaaaagatttgatttgattatgccaaaaattaaatccaaattttaatggatgcgcgagtgggtcaacaacgacttcactgccgaaaaccttgcgaaattttaatttgaagttgcaaaaaaaaacgacagaattacgaggaataaaattttttaattaatttgcacccctaattttcaagatttttgtgcatatttggtgcatatttcacgattttatttgcatatttatgcgcataattggccatttttcgtataatgaatcgttcgtatggagtcgggtcgacgacccccctactatttggaaacagcttttgctttaattaccaattaaaattgcgcttaattaggccatgtctccacaagacagaaaaatttatgtgcatattttgcaattttggtgcatatttcatgcgcatattttaagattttatgtgtatataattcccagccctattcatcagatgacggacaagcagaatgctcaaacagcatttacacatttgcgccaaaatttgtttgggaaccgcccattagctacggccatttcagcgcggacagttcgcctcggcgtttttttcgccgccgggtttttcggcctggacgttaatttataaattaatcaaacagcagaattatgctcaaggttgtcagatgtaaattttcaaaatcatcattttgcgaattacgcgattcgaaaaattaaaaaaattaatattcataacactgacgttgacttggctccctatcatttcgtcactgatcgtttcgtcactgttcagttcgtcactgatcatttcgtcactgcgaacattttttaaaaattgtttggcacattgtcaaaactgaaattttaaatttaacaaataaaatctgttttacatatgtatataaaagaaatgcatgcagcacaaaaattgcaattttggcaaagtttaataaaaatctttaaaattctgacttcaaaaagcagtgccgcgaagacgatgtgcggagaagtgcttgctcgagagtctcaggaaattttctgtttcaagcagaaatagtgcgggcaaggacgggcgaagctcagcttagcactcgaaaccgaaagcgaacccaatttttttcgaagctcgaagtttcgcccacccctggtgcggtgcgggtgcctcgaaaaactttcacaaaagattatcgtaaatatcagccagccctgacctggctccccaccccccccccggccaattgtacgtcgtactggaatactgctggttgaccccttacacacttgtggtcataatcagggctaaaaattttaaaaattagtattttaccgacaatacacagcaattggggtcaaagagcagcttataccccttgaaaacagcaaaatgctgataaatcagcagagttgagagccctttgatcataatgaattacgtcgcaaaaaaataaatttaagaaataagcacatttggaagctaaaattaaagatgagaagctaaactaatctcttttaccccctttgttccccaaaagttttttggaaaaagcgccgcaaaaaccatcttcttttctaacaaaaaatttctcaaattttgatcatggacaatcagaaatataacattgaacattttaagcctgttttgaataaattttgtaaaaatgaggtatatttgcctgccaaatgaggctttttaaaattgagaagctaaattggtctctttttttcagagaagttctctttcaaatctcacaagcaaaaaatttatttatttattttttgctagccatttgtttttaaagaatttttgttgtttttaaggcaatgtgccaaacttttttttaaaaaaattctcagtgacgaaacgatcggccaccgttgacttcacataaatatgagttatgtgtttattttttcaaaagatttcctcattttagtcgaaattacatattcttttctaaatggcaccgcccgtcaaaaaaaaagaaaaaactttcctccgtcgaccaccaaatgaaacggtgagcaaaatttttggaaattcgattgggaatttgatgttctacaatttcagttggattcgcaacgacatttggatggacattttccctcattttgaccgtccacaactcggcctcaaattggcacttctttcgccacgtttcgatgagctggtggacaaacacttcgatggcaaaacagaattgacaatttggcgcccgtttaaaattgaaaaaattggaactgaagcaaaaattgctgttgagacgaagcgaaaagccaaaattgtgcattttccgttgcccgaccgtccgatgcacaacaaaattcgctttaaccgccttcagattgagtaattcaaagaatgaattattaactgataaaagctacccttttcaggtacatcgatcattccgtcgtcacatttctccgtaccaaccagcaaatgtttgacaaaggcaccaatttggatttgtatatcgaggccaaggatgtcaagccgatttgggatgtttttgtccgtcaaatttggcccatttttgcgccaaacattcgccacttgggctttgtcagggataatcattttgactatttgcgtcgtctcatttcgccgtcaattctcaccgacctcacccatttggattcaatcgatgccgcttatttgttgccaacggtgatcgctgatgatgggccaaatgcaactgatcgccaagcgctgtccaaatggttgaacattccgacaaaagacgggaagccgaagcaattgatttgttgtgctactactactacgtcaggaaccattgaattgatcaacaatttcaaagaggtggggccacattttcgtaaaacattttggattaattgccattttattttcgtttccaattgctttaggcatttctccatgccaccactcctgctgccaactacataattcaacttcaactttttgaaccaacgccaattgagccatttgaattgacgaacgaacagaccaatgaaaagttgacagtgaagaaagaagacggtgatgaaaacatggagaaagaagacgaagatgactatatcgtggtggtgaagcgatgccaaattggggcgacggttcggtgggaggacaaaaagacgaataatttcagcaatatcaatttctggcctcttaatggcaaatactgtattgggtgagtctgatgagagaaacagtttttgctttaaaaatcaaatttaaacattttatttcatttaggcgaatgtctccaccaaagtcgggccaaaagaacacaaaaaatcgtctgaaaatgaatcccgggcccagcggacagcaacagaagaaagagtgaatgaattgttgggaaatgagaaattctgatcgatcattgtgaattttaattgagctgataatcgctcgtcgcgtttatttgttgcttcttttagttaaatgaaatcatttaccataaaaagaaacgaactttgaggaaaattgtgagcaaaatttttttattgtattaaatagggatcatttatttatgtaagaaaaatcgcgaaatatgtaaataaaatatgtataaaaaacactgaaatatgtttatgaaatatgtacaaaaatcctcaaatatgtaggaaaatatgtaaatataattttttaaatgctgttttttggaaaaaaaattcttcgtaaaaagtgaaataggcacaaaatgccataaaaatgaccaaaataggcttagaatcacatttgaatattttacaaattaatttttgatatatcattttttgaaaaaaatcgattttttagggatacattttcaaaaaaaattttttaaattttttacaaaaaatttctataaattctcaaaatttttgaaaaaaaacttttggatatttttgggggtatttcataaaaaaattccctaaaaattctaaaaaatgcaaaatatgtacaaaaaaatgtgaaaaagtccaaaatatgtataaaaatatgtacataccgtatttgctctttttatgtgccagtctccattaatctgccggtctccaattatataccccgttcgaactaggttgaaaaataatctcccagtctccatttatgtgccaggggggataaatagaattttttaataatttagttggcacatttttcaaaaaaataaaatcaattcaacggtagggatactacttatagttttttcattatttttttcctgagctccccgtggcctgaaatgctgtttttttcggctgttgttaagctacttttcgagttgaaaaaaatccaaaatatgtaagaaaatcccgaaatatgtaaataaaagtcccaacttttgttcgcaagcacaaaaaagaaagtgtttttcctactaattaggctatggagaatccaggaaaaaatatgtatttacataaaaaaaatgatccctagtattaaactattaaaatttattgaaaaatttttgatttttttgaacatatcgctaaaattgtcatcgcggcaataataataattttttattgcattttgttacttaaagaaaatttgtcttataaaatagtgggtcggggtcggtttagtacgggccgttttagtacgagcgcaagtttttggctataacttttttcttgccaacaaaatccaacatttttagtatcgttcgatagccctaagtgtcctctattaatctgaaaaattgcgaaaaattttgttaagcttcaaaaaagttatggccagaaaaacacaaaaaaccagattttcaaacttttttggctcaaactttttttaaacttaataaaattttttgaaattttgcaggctaataagcatccgaaggactctcgaatgatatcaagaaagttggatttggatatacaaaaaagaatattaattttttcataagtaattcaaataaaataggcatttaattgatatagaagatgctgatatgggatgaagccttttttgtgtgtaattcttttatctgaatgttctcgtcatgtttttgccaaaattttgattttgtccttttatatctaaagttacagtccaaaaaattgggtaaggtcaacaaaatttggctaccattttacaccaacgtccataacttgagttaaaattgtcaaaacgacttaaaacttggtcagattatgaaatttgatgagcttaacaagaaaaagcctgaaagaaatttttctgaaaaagaaaaaacaaaattttttggccatgtttattttggccaagtttccaaatctattggccaaaccgaaagtcaaaaacaaaatccaaaataattccatcggggttttgaggctttttatgcccttaaataatataaaaaattacagaatcgcacaagtttccaaaattgtgttatgggcgattattcgaatttctgaaaacgaaggccaaggagaaaacacttgtctttggacaaaggatttttcttatattttttgaacacatgcaaaattattccagcatagtttatccgtaggaaatccttgttttaaatcttttttaaaattttaaacaacttccctaaagccttttttggccatttttcaaaaagtgggaaaatttgggattttttggccataacttttttaaaaattgtttgagtgcattaaaattgacgccattcaattcatctcgttattctgcatcagatgatattaaatttattagaatttgttacacttttaataaagttacactcaattttctggttattgccaagtccctaattttggcaccaaatttcattggcccatggctgacaggagaacaacttataggacatgctacgtcacccgtcttattccctggaccctatagacttaatttatggctaaattatttctctcaaaaattccttatagggtaggctctttaaagaatatggcaaggtcgtggatccagtgaaaattacctaggttcaaagaatggcacagaattttacaaaaagggcattgttaaactcccatctcggcggcaaaaggttgtagacagtcagggcaattactttgttaagtagctttttgatcggctttgttatgattgttatttttcattttttgttcataaatttttttccttcaaaaagcgcccttttttatgcaacgacctagtacaatttaacaattaatattaacttatattaatttaccaaaactaaataaacggaaaagcattaaatttttataaccaaacatagcattaaaataatttttcaaaagattttttttaattgaatcaacttcataaataaatattttgttatttgatattttattctttgctatatcacacggctaattcataagaatcttcgttttttaaaatgattattttaattaatgaaatgtattcaaaaatctaattaataagaaaaactcttttttatattattatttaattaaacattttcatcaaaagcaacaaatatacaatattttggaatttaatatatatatatatatattatttaaattgatattaattttagttttgatatcgctttataaaaaataaacatacatatttgtaattttatttgtcaatttagtgttcatttttaaaatctttaggttttgattgtacgaatggccatcactcctaaaaaggattaatgcgatgaacatgtgctttgataatattataatttatttattatcttttatatttttgaattatctcgcaatttgattatgtttttaatttatttgaatgttttatttaagaattaaaaaaaaatattaataaataaaacgctttaatatattcgaagttcttgctattagcaaatagaaatttataacatattctcatttttaaattttttaagtcatttattttttatgctttcaaataattagttaagtttcttttactttataaaggaaatggaacaattcgaatgcaatttaattattcaaaatttattattatattcataacagaagaaaatttaataatttttattatttatttaccttttttaattaaaaattataaatttgaacttcaacaattgctt

SEQ ID NO: 1362 - DNA, 2789 bp, Heterodera glycines
aagtcatcgtcctgccgttgtgtcgagatcggctggtggacaagccctcagcgtactcgttgaatgcccgcagatgatcatccgtttggtcccttaattccttgatttgtgacagtttatgagtcgactcatacatcaaaggacggattcgaacatcccgtctgcagactgggcacgtgcggtttgtcgccagccacctcctgatgcacatcgagtggaagatgtggctaactgacggttgacaaggcagaacgctgatcagctgaccacggagaagcgacaaatggcagatgaggcacacgctgtctgctcttcgatgcctttcttcgtctcttcttcccagaatgcgcatgttcacagatgtgaagtgcggatgcgaaccgggtccttataaaaacaaatcttacaaaattttttactcccggctacctctgttgtcgtcgcctttgttagctggcgtcatctcaccaacatagtcggcctcttggaagttcaagcgccgatctatgacctctcttgcgcgaattgcctccggcggcatctgcgccactcccacttcttgcatgatgggcattctgtcggcttgacggacattgtagaacaggtcttcatccgaccaaccctctgaaattttggtctcgaacgaaactacaaattttgcttttaccagattctggtgaatcgtagaggccaagcaactcattgcgggctcgcgaccgtgcatcttcctcggctcttctgatgttacgaagcctggcctgctcttccgcatactcaacatcaatttgctccttctgctgtcttatcttctcgagctcggcagcaagcactgggtcttctcgatatgcccattgtctgtcttcgtctaaagttgtttttaaaagcaattccacttaatttgttaaccccgccatgtgctaagcaatttttgtcgctgccgctcctcatccaaggcccgctctcgtcgctcgagaatctgctgatgttcctttattgccttttgaacatcctcctcagcatgatgattggcatagcgaatgatgtcagcgcaatatgcttcaacagcttggcgagttggcagaactaaatatttgacgctatttgataaaataattattttcagctgacatatgtcaatttctgtgaagttcatcgactcgcgtgcagatttccgtagagcgttgacctcagccttgagcttctccaaccgctcattgatgtatcgctcgtatgcggcttgcctgccccagaccagattccgctgcttaagccgcttctgctgagcaagatgttgcttgaggaattggtcagcctggcgcaatctctcttgcactcggcggtctgcagccatgcgcttctgggcctcgattcgctccgcctccaacgcctttgcttgttcagccgtcatcagaatcgggcgttgcattcgttgttctgctgcctgagcggccttagcccgtcgcttcacgcttgtctcacacgtcgccgatttgtcctcatttcgtcgttttttgccgatggaattggcccgcggtctttgttcttcgtctgttgtgttttgagcttcttcctgctttcgtatggctgcttccagctggaaatgtttttgacgcaggtcttcaaaaacatggtcgagcaggggatgccgttcaacccttacagccttcttttttgacctcttacgcacaagccttaatagttaaataaatttttttgtaacacattaatatctctactttagctttgcttggaggaggcctgtaagttggccaacggacataaagctcttcgtcatcttcgccttattgcacttcttcacacaacttttgatgttttcgttgatgagggccaggtgttcgacccaactgtcggccaaacgcgccagttccatgccattgacctcagcactttgaagccaatcctgcattgaatccaacgtcgccgtgctgggacagatctgctgcaatgagtgccagagcaagagaaactgcttgatgatgtcgtaaagctgttcttcaagcgcttggatgagcaaacaatgctgctcccgtattattggagccttgttgtttgtagcctctttcaaagagtcgcaaagttgctccttcacacattgccgatgtttggcttgcgcagtagccttcaggtagtccttcatcttaagcatctgctccattgcatattgatgccgctttgttgacgcattgaagtcccagaaaaggcttttctccttttcggagcacaccctcaattcagccagcatctcaggcggtggtgtcggcctgtttctgtagcagttgttcttcgcacgaatcattgcattataaactgcgaagtaagcaatgctggtgttgtcatactcagctttgatcggcgtataaatctcctcgttgatgttcaaagcatgatcaactgcttcagatagctgctggttttctggctcaattggttcctaaagtcagtaatcccttgtctatattttttcttgaatatttacatcagaatgttcagatgaatcagagcgatcgtctttggcaggtgcagtggccgcgtcaacagacaatggcgaagcaatgcgcctgtgacagttgggacagttgtcatcaaccccatcgtagttgtgaagtcttttcagtgcgtaagatgacgggctttggttcctaaaaatacagaatttgctcggcatgcaaaacccaaagtgtgaccatttttcgaagcatctcagatggaaatcgccgcagcacggggtgcttgtgtagccgtaaaaagcaaactgttgtttcagatga

SEQ ID NO: 1363 - DNA, 1861 bp, Heterodera glycines
  misc_feature (38)..(38): n is a, c, g, or t
  misc_feature (69)..(71): n is a, c, g, or t
  misc_feature (81)..(82): n is a, c, g, or t
ctgcttgatgaagtcgtaaagctgttcttcgagcgctnggatgagcaaacaatgctggctccgtatatnnngagcctgtgnntttgtgctcccctcaaaagagtcgcaaagtgctcccttcacaccattgccgatgtttgggctgcgctgtagccttcaagtaggcctgcatcttaagcatctgctccgttgcatattgatggcgtttagttgacgcactgaagtcccagtaaaggcttttctccttttcggagcacgccctcaaatccagccagcatctcaggcggtggtgtcggcctgtttctgtagcagttgttcttcgcacggatcattgcattgtaaactgcgaagtaagcaatgctggtgttgtcatactcaactttgatcggcgtataaagctcctcgttgatgtttagagcaagatcaactgcttcagttagctgctggctttctggctcagtcggttcctaaaatcagtaatcccttagctattttttttgttttaattattcacatcagaatgctcagatgaatctgcgcgctcctctttggcatgttcagtggccacgtcatcagacaatgtcgaaacaatacgcctgtgacaatttggacagttgtcatcaacaccatcgtagttgtgaaggcgcttcagcgcataagagggcggactttggttcctaaagatagaagtaatttgcacagacttgaaaaacaaatgcgaccatttttcgaagcatcttagatggaagtcgccacaacagggagtgctaatgtagccgtaataggcaaactgttgttttagatggacattggcgtcttctaatgccggtggcacaacagcgctattacagcatttgcaggactccatcttcggcaacgattcttccaggaacacatcttcttcttcagtcactattgatggagctgtgacggtggtcgaacgcttctcctcaattccactggacgtcgatggaattggcgcagaaggggcagcggcaggcgctgcaatttccatagcttcaacttcttcaccgaaaaggtgaatcgaaggaggaaactcgcggcgaagtgacgatttcgaccgcaaagcgagaagcaggcgtcgtgtccggcttaaattgttaaagtaaaaaacgataaacactattgttagtttactgaccagcaaaagggtttggaaatgatccgtgccgttgtaccaaatgatgatgggatcaacaacttgtcgctggtcgccacgattttgcgttgccgtaaaattgcgcagttgatcatccgggaaattttgacgcatcatctattttcaaaatggaattgtgccaagtaaggaatttctaccatttgttggccgtcagggaaatagatttccagcctgtgctcatgttccatgttgaaaaagctgacaccttcttgcacttggccaggcggcaatcgtggtagcagaggtacaacaacaacaataggtcgttgcagtaaaattgccgcaagaaatgcgtcggctgacgccgcccaatcagtgggtcccatacgtctttcgatgtattgcgggaaggtgacgtttgcatccaagaagaatgcttggatgaaatcgaggaagcgttgtcgactctcgaaccaccctcttggatagcagtttggctcatcaaccatgcggcccagcgtcaagaaaagatgtctgcgcaaatttgcagcatactgctcgctgtcttctcccacaagcgcgaaaacgatggcgctgttaacggaataaagccaattattatctcacaacaaatttttattaaccggaaaaaagcagagccatcgccaataacattctgaactcgcacttggcgagacagttgggaagcgacttgagcgg

SEQ ID NO: 1364 - DNA, 1051 bp, Heterodera glycines
caaatcgtaaccacttttggaagattatattcagtccctattgctcatttgtttcccataaagcacttcaaacgttcgttcgctgcattggcactgaatggcatcggcacttacacttttggcacgcccattgttctcacctttccgatcaacaataggaacgacaaggtgttattttttggaaaattgcaactttttctgtttttacagacacaaaaaaccgacaccgttcggccgtgccaattgtacgccatggtcctggaatatatgcaaaagcgttaccttcgcaactcgcaaaggcatttgctgaagaacgactctggcggtgggaaaggcgaccgtcaccatcatcatttgttcaaccgcgcattggacgcgttcgttttggaattaaatttggcaaaaaaaatctttttagaaatgccgattctgcccatcaaaattcctacccctttgaattggcactgaccaaaagcgatgccatttggtgctacaaagtgagtggtggtggggcggaggaagtggtttaaatttgcttaatttcccctccccaatttcagtgtcattggcaacgcttttgtcgcgggtgtcccatcgatgcgaattcgtccgattgccttccgttggacgaccttttctcatggcaatgtttgctgaccatcacttggaaaaacaacgctgcgctatatttgctgtacaacaatttggcggaggtgacaaaagggatgaattacggggagggaccgaactcgcaatgaccgtcatcagataaaatgtttgacaagaattgcagagttgagaaaccgtgaccgataccgtaactccatcatacagaacactgtgttttataattatagtttttgagcatcccggatcagttcttgagtccgaattcgtctggccattcgcgtttgatttctcgactttcagaactatttttgcccaataattttctttataattttaagtttttagcgtttttctgacgactcccaccattcgcttttgtcaaatgccaatagtgatttgtcatcactggaccatgcccccc

SEQ ID NO: 1365 - DNA, 1734 bp, Heterodera glycines
atatgattgttgtatttcttaagaatttatgagcttgtttattttataatgattttaaaatagaattaagtgacaacacgtatggaatttttaaaatgaccaattttcagaggaaatctgtaaaaaatgatgaaatttcaaatgtttccaccggagactgcgccaccgataccaatacacggattttattaacacagaggcccataataatgattgctgtgattatcccgtaattacgtgattgaccgcaactgaaaaaagcgcctcaatttgcgtgcactcctgctgctgatggtgtgccgggggaatgttctttataattttaagtttttagcggttttctgacgactcccaccattcgcttttgtcaaatgccaatagtgatttgtcatcactggacaatgaccccccgggggtcaccgtcgacgactgtttgtccgatttcactcgtactgaacgcattgacggttcgcattgcgaccagtgcagcagcaaaggacagtcgccaatgccgccgctgaccaaacaattgtcattcctacgattgcccgacattttggtgagtgatggcactgatcgaccaccattcaattgtccatttaatttgcttgggactgcgtttgtccggcttcttcgggagttcattccccgttttaaatcaaaataaaacgccttccatttatgatccattttttgttcccctttaaaaggtcatttgcttcaagcgcttcacctttgtcccctccatgcagcaattcgttaaacaaattgtgcccatttcgtttccattggacaatttcgacccgagcaaatatttgtcttccgacgtccccgccgaacagatggccaacttttcgcgctatttttgcattggaattgtggtgggtgaaaagggttcaattaacaatggtttcttgctctatttccccttcccccacctcatttagactcattatggccaactgaactttggccattattgttcttatgtgcgggatttcttttccgacgaatggtttttctgcaacgacaacaaaacctttgtatattctttactaattacttaattagttgcaattaattaatgaatttttttattacataattagcccgtcaaaagcagtgaggtggacacgcgaaatgcgtacattgtcttctaccaacgcgtgacttcagctgctgcagccgatcaccgcacaaatcagcaaaacccatcgcccccggggaaaagggaatgaatggccaacgattggacggacggatcgaaaatgaataaataatagatagaaaaaatatcccataattttggtcatatattataacccaaacgccataatatatcacttttcataaaattttaagtatggggaattagacaactttttcggatacttacaattaagcatcattttgttgcttaaattgtcatagtggttaaactcacactttttgtctgtgtatgttcttaatctgtatatatatacccagttttgtgttttcaacactaattactgttaccatatcgcgcactaccgtatacattcgggttaaaccaatcatttatttattacacattggttggagattgaagtgattctgcataattgtcatcgtcatattacgtgtacttacgtcactcattgtcatcccagcaaatgctttttttgttccctttctgcctcttttgcttcaaatttattgaaatgaaatgttgtttgataaattattaataca

SEQ ID NO: 1366 - DNA, 1773 bp, Heterodera glycines
tgtttaagcaccgtttacggcttaaaaatgaaaaagtggaaacacaattagaaataataaagaaattattttaccgaattcgtggtcaaaaaactgagaatttcacgtatcgagaatcgagccgagactctcgcagaatgacacgtttaattcccgcccctttgtttaaatttttcggttattttcgttggcctgagcggcggaaatccttttaatcctcaggctaatcccatggcctttccttgtccccatttgcccccccccctctctctctcttcgcctaccgttcagtcagacgaaggcgtgccgaaagtgccgctttgcgctccctggtgatgaatttgccaccattgtcgaactcctgctccagctccagtcgttggcattcactgtacaccacgcgataagtgtccttggttctaacccgaacatctgaaagggaagcgaacgatgggcaaaaaacactcacaaaaaacattatttttttattcccaaatttggcactttttagcattttaatcgtactgtttgtgcccggccccaccgggtgccgcggctgcgggcacagcccgggaaaagtgccgctctccgcccgtcgactcactgccgccgccgccgccgctgctccgccaatggtcgccatcattttgagcctccgttcctcgccaatggtcggcgctcctctccacgacgtgccaccaccgttggtcatctgctgatgcgtgcctccaccgccgctgtgttccaactcggagcaatttgaagaggacgaagcggagcagcaattgttattgttgttattggccaaaacgacgggcggcggtggctgcggcaccgacgccgccgcgacggcaccgccaaaatggtgcagcaaagagtggtgatggcattgtggcacatgggacgactggtggtagtaggcgtagaagtcgttgttgctgctgttgttggcggagtacagctggggaaaaaacatcgcggcagcgccggaagggacggcggcacaattggaggaggcggaagacgggttgaagcaggcggaggacgaataggcgccggacagagacgaggcggaggaggggtcggacgaggagggggacggagcggcgcgggacgacgccggcggatgatgatgggccagcggagagacgaagttgggctcgtacaaatgctgaaacggctaatcactactgatcaatcattgaaattccaaaatttgcctttttctcatttaaaattttatttttagagggcgataatttccgtcccatttgccctcctcccattgctcctaccgaactgctcgaggctgtgttgccgcaccgttgctgctgttggctcatcgccgcatttggcatgggatacgaagctgaggctgcagcagcagctgccgctgctcggtgaagcagcagttcggggccaccagccgaagaagaaacagaaacagcgggggacgaaagttgggggacggcgccggccgaggcaccgaacggcacgaaaacggcggacgaagcggcacaattggaggcgaagccgtactgctgggccatggcatgggccatctgagcagcgacggcactttgggcactccgttggtggcacttgtgaaaagtttttttgagaaataaaaatgaaatttttactgaaatattaaaataattaataaaattgaaagattaaaaataaaaattgaatttggaattagcagggaaagattatcagcgccagtttctgtacgaaaattttctaggtttgctaagccatttataaatt

SEQ ID NO: 1367 - DNA, 1537 bp, Heterodera glycines
ggggggaagagacccccgagggacgacagagtcgggaagaaaaagcacaggaggaaaagtaacaataataatacgccccttcattgctcatccaccaacaccaaaaaaacatccaatggtcggcgtcaattaaatttaatgaatttttgaaatgccttttaatgaaatcagacggacgacgacgcaaattgggacaaaaaagggaacatcggacgaagagaaagcttatcaaaagcagcacaatcggtgttatcattaggacagcaattaagcagcgcctaattgctttgaaatttgataagggcccaatttttcgtgtgcccacaaaaaaatgcttcgcttggccttccgccgatcgcagactttttttgtcccttccgccgcctcctttttcgatgattcgcttctccattagcctaattaggtcatcattttgttgtcccaatgttcaaataaatcccaaaaacattcatcctaattttatttatttataattcattcgtcccctcccatttttggatgattttctgcctataaatgcgcctaaaattgaattttccgtcgccccgtcgtaaatttgtcaaaaatgcgcaaaaagcggagaaacagtgccggaggcaactctcccaaagagaggaggggggggggcacacaaaatttgaacagtttttgtggaagaagaacagacggacggatgggcggcgcattccgtggcatagggagggcaatcggaacggacggatcagtgacgaaatgccaacgaaggaagtgaagtgacgacggacaaacgaacgattgggggtgggggggggcaacggacggaaaaattggggcgacgggggcaatcggtgacaaatggatttgaatagcatgacatggaacaacgtaatttaatgtacaaaagtaatacagattaggatgacgacagccattttaaatggggggggcaaaaagacggcggaattccacggcaaatcggaaataactaatggaaacgacaaatttcttaaattgccgttatgtgacatgggcaattttgtaaaactgataacagtaattgccgcttttccaaccatttaatgaacaatggcggaaagattctcgaaacagagaccaaagggacaagagaatgtcgggattatggcattggcactggtaccgtatgtccctttggggtgcctgtgtttttcaaattcaaaaagggcactcgttagctgtgccgtgccctccctcaatggattggcgggggggggggggtcacttccctctcaccgcctcttttctcgaccactttcacctttattggtgccaaattttatttgtttattgctgctgctgcgatgccttcccgagttcgtcttttccttttcccttttttccattgtctccgccgttccttcgctccttttccgtcaccaaaatatatcatataaatggcggcatttgaaacagagcaaaagaagcgcaacaacaacaaaagaggcgctaatccctcagcccattcctttgccaaaaagggggggggggggaaacgccc

SEQ ID NO: 1368 - DNA, 8521 bp, Heterodera glycines
  misc_feature (6)..(6): n is a, c, g, or t
cccccnccccattcattccgtcagtgtttgggatgaccaccgccgtcgccgcttcgaccactcccccccccccttcattcattcattattcttccggaagtttacgatgggaaggaaccccaaagaatccccaaccaaagcgcattttcaccccacccgaccatcgccacgacgcatttggacaatatcccaaacaaaaagagagcaaatcccaaaacagaggaaaagttcagcaggacgtaccacccaaaagtgaattgaaaaaagaaagaacctaattttgtttattgtttcactcgaaggatgggttttcaaaatagaacagtaacaacttgaattggaaaatgtacggtcgaatacagtaacagtatgaaaatcaccgtagaaaataggaaaaacaaacgaagggaatggtaagacagcacagtgagcaaaaggggagaagacaaacacaaaaacaaaacacaatttatcagcgaaattaagaaagaaaacaatgtcaaatagagggtcggggtcattttggcgcagacaagtttaattcataacttttttttaattcgaccaaataaaataatgttgatattaatcaatggtataaatgttctttattagcctgcaaaatttcaaaaaattatattaggttttaaaaaagatatggcgcgctgcgccaaaatggccaggaaaatgcaattttttgaggttttttggccataacttttttgtttctcagctaaattttttgaaactttgcaggttaataggcactatcaagccacttaaaatcataccaagattatttaattttgctgtgaaatcaaaatgatatagagtcttgcgccaaagtggccggttccccaaatagagggatttaaaatactgtaaaatgatagaaaaataatcgattaaattaaatttcacccattaattattgttttagggataggctttttattagaaaaaatggaataattttttgtggacccggtttttgaccttcaaccgacttcataaaccaaagaatgatcagaaagccccgccgatggattctcctcaaattctctgcacaaatgtcaacggcaccagcccactccgtccgcccaactttcccatggcccattcgctgtccgaccgttcggccaccaattcgatcagatcgcccgcccggaagcacagatcgccggccacttcgctctggggaagaggaatttgttggcacaaaaaggaaaattttaattgcaaaaagaagccaattcggcacaattccaaaaaagtgcataatttccgtcatgccgactcactttaaagtcgtacaacgccctcagaaattgctgtttcggttgctttgtgctgtccattccgctgtcctcgtcctcccacggcaaacggctcaattccttgggcccaatttgcacataattaaccgggaaaatgccacgcagacaattgccaccactgtttggcaattcaccgcgcaaccaatcggcattcacacgcgaaatgaccataacccaatcgtttgcagagaactgtaatgaacgggtaaggggagacggtacaaaagaaacacgatggatttgggacaaaattgaaagggaggaattgggacaaaaaaacattggacaccttcaaatccccgggcactccgctgtcgtagtcgtacaatgccacagcccgacattggccatccaaaggaacagaggccggcgttttcaattcgatgagcggagagggaggcgaatagcggtccaaaacggggtaaagcggggcgttggcggaatgggcagggaaagaggcggccgaatcaaacggacgaaggggtgccgattgagctaagcattgaagaaaaatttgaattaaaaatgccgaaggaattcaccggtaaaaaaaccgtcggcaaatgcggcactgcccccggcgcagggcaccgcccattgaggcggaggatgggcggcggtggacgacgacgacggcattttgttggacgacgggccaagggataatgggccgaaaatgtcctccaattccttctcggccaagcattggctgctgctcaattggccttcaaaatgacggacattcgtcgacaaaaagccatagatttattagaaaacatttaaaaaatgaatgacactctaaaaagtgatgccgcttttggcgaccattaaaattcgaaatttgccaatttcggattttaccctctcacatggccaagttaaggaacacaatccaaaccaaacaaccaggatctttcgttcaagttttaataattccctttcccaatgaatttttccaaattccggggcccttttcatcccaaaatcggttctctcacaacgtacggttcgctgtcggttgtgctgaagcagtacgaccaccattgctattgttgctgctgctcatcactgtccgttgtggcattgttttttgattggtcgcagcggcgcctccgccgccaaacgccgtcgacgttcggccgacgaactctttgccctgctgccggaccattgacaccaccgcctgtttgcccaaactttgcaccatcggattgttgcacaccgactggagcagctggcgatttgcgaacatcgcagacagagattggtcaacaactgaacgcagcgagagtaatatgtaaaaggcaaagggatggacgaacgaaaagccaaaccgaacattttggaatgtaaattggcggagacacccgccaaaatccaccaaaatgcaatcttttttgttcagaacaaggtgttaaaccataccaatagggggctattcgaaagaccggtttatattttcgagtgaaatttcttaacatattattgttttttgagtctctgtcccggatctttggcttggcattttcgagactctccaacaattacaatttttttgcgttgcattgtctccggcagcggcgccaccgctcggacgagttcgaaacgcagcggcggcgggggaagggccggacaccagcggcacatttctgctgggctttcctttgccaggcggcgggggaataaatgccgcatttgacggcgtaaaggacattttggtcaaaacttttaagttataaattccataacagtgccaagagaatttttaaaaagtaatgtgttcagacagctgataaacagagaacttatttgttgacatgcaaatattcgttttttcaaaattaataggtatttaaatgtcattttaaacaatttccacgatgattctcccccccccggcccaatgactgtcttccatcaaattatcccaaactcattctcctcccatttctgttcagtatcgcactttcgtctctttccctccgcccgatttgcctccaccgcttcggctgtcccatattttgctgatcttctccaactccctgtccaacttgcgctccttggccgccgcgttgcttttccgcgtcttccgtcctccgctcgttttcaccccaaactgataagccgccttcgggttcgcttcgcgcgcactttggtaccgctcgtagtcgtcctgcgattcgaagtcccaccgtttgacgggccctttccgatttccctgtaaaaatagtaaaaatatgagcataaatgccaagtcactttaccatgtccatctgtgtgtagtccgcctcatcgtcgctttccccgccagcgtcgagcattccaatccctcctgaattgccattttaaattaaaaattaaatgagttaattagagcagacagacaagactgtcccgagtttcatttcggatgttgggcatttttctccgtttttacgggtcgaactacaagattcccggaattggattccctggcatacaaaatccccctggtccatatgtacgttaaaactctgtaccaggatagaattcggcgtaggcgtcctcctgctccaaacgacgcttcttcagcttctccaggtgctgctcttccgctgtgtccgcgttgttcgctgcgttcgtcggttcgtccttttccctctccctcttccgctctctgtcttttgtctcgcggtgtccccgcttgtccctctcgtctctgccgcttctgctggaaaactgggagtaattaggcaactgtctgacaatttgcaaatgtttccttggggcgcctatcggcaccgcggactcccatcgttaaaatttggatattagtatggaaatttggtcttgatcagacccgtataccggaaaaataccttccattttaaatatttttcaaattttccaaaaatattacctgtccctgttgtcagtgtcaaaataggaagaggccgtcgtcctcttctgctgtccttcttcccgtcctcgtctcgtctcctgctgcctttccttgctcggctcgtactcttccaacccctcaaaaatgctcgtttcagcctccccttttgccgcttctgtcgtgccatcaccagcgcccttccgtctttttttgacgtccgtccgaagataagcgagcacttgagtgagtttcttaacacaaaaattgcaaattaaaaaagatatccaatttatataaaatcaaattccccagaaatttattatgatgaaataaactaaattcccttattcagcagtttccgactatttttggtcaaagaaataaaaataataatttcagaatataaattattttcgcgttttgttcagaatgagttccaatgtcagtgaatgtcccacacaaacattgatcagcagattgtccgcgttgatgttctcgctggattggtccagtgggcagtcgaccaccgaacggagcaaagtgctgggcacgtccgtctcctcgtcctccaactccaccacataagccatacgtccacgcgcaaaaagctcattgcgtttgggcggtttactctcaaaaagcaatttgcaaatgtttgccgccaatttggagttggccgctttactgctctccgacaacggcgcattcgcttgagaatcctgaaacaatttattacgtttaatcgttacgagaataacattgattaaatttattgactaattgtaagaaaatataaggattgtctcattcattttaaattaaatttcggtctttctaaaatccttttggtgtccgttgtccttaattcaatggttgggttttgtttatcccatcgcatggctcccaacgatttaaagacggttaaaagtgattctatcacccacttgttgctcctggtctttgtccgtcacatcgcgctccaatatttccgtcctcactttgttcagcagcgaataatccaaacccttgaccaaatgagtgtgctccatgtctccgcccaaatatttcgacttctaaacgtataaaaaataattctaaaatgggtttttcttcgactgggattgtccaccccaaaccaaacaagacctgaatttcaattcgtcgtgtctcctccagcgaactgttggcaaggaaattgcctggcaccgctttgtatgcgcctgctatcagccgttgtctgatttcgtcgtccgtcgaactgacgcctttccttcgttccgccgcccggtcccgataattcttcattatttcattcagtctggcctgtgactcgtcgaagaggtcgtcttcctccttgccctcgacgggcttttcccggtgaaaattggcaaaattccgtttttttggcgcttttttgttcgccacattcccagtcgaagcagcaacggacacaacttgacgatgggtgaaggtggccacggaagacgaattgacagatactctgtcacttgaagagtgcgaactgcggaccgaggccggaacagccaaaagttttcgaaaatcatcgttattcattgattttattattctgcaattaaatgatacacaatttggcgttttcgcacataaaaacgggaccagagcgtttgggcccccgtttttgggccccgcgtttgggcccccgtttttgggcccccgtttttgggcccggggtcgtttgggccccaacccaaaaatagaaaaatgtgcttttttaaaaattaagattctaaaaactaagcctgagggatccctcgccacttggcataagttaggtttaattacattcgctcattttttacttattccaaatcctattattttttaatagttaaccaatttgatgtacattctgatttggacatttttcagaaatggctaacccaattgcaaccaaaaaacaaaaagtaaaattgactctaatgcactttatgagtccaatcaattgacaatccatggtttttatacaataactttttccatgttcgaacaaaccctatctttttggtatcattcgaaagcacaaagtctgaataatgtaataatacgagaaaacaagagaattctaacatttcaagaaagttacaaacgaaaataatcagcaattacttaattaatcaaatcttttgtggtaattgcaaattattgttgaatttatttttaaaatgtttattttacatttttatgctgaaatttaaaaagttgtttttactgtgatttttcatttttctgtacttggggcccaaacgaccctggggcccaaacgaccctggggcccaaaaacgagggcccaaaaacgggggcccaaacgcgggggcccaaaaactggggcccaaacgcccccgactccaaatttcataatgactcaaccaaaaataatccgctggccataaatattttttatttatttatctcttcgtccatttcactcagtgaataatgaatgagtcactcactcatttgtctcccaccaattttccgccgctttccctttgctttttgtgtaaacaaatttaaaaatttcagtgccagtctctctcttatcgttgtcattattcgttcattctttacgagtaaaaaacgaaatatttgcacatataaaaggccacaaattcctcggaaaagtgaagtcccaaccgaaagataagacaccaaagattcaaattttcattttctgacaccatttctaaaacattcgttgcttaaattccatttttaaaatttaattaatttaagccattaaaaaaaatctgacaaaatgaatttttctccgatcactctgtttctgctctcttcactcgccattttctctgcagcggatgcattccgccaacaaacggtcgccgttcgcggccgtttaatgtgtggggataagccattgacggacacgaaagtgaagctgtggaataaaaacaaaattggtagaaaatcataattttaaattcctatcaatatatttattgatcaaaaataggccgtgatgatcagctggcggacgtgaaaacggacgcgcagggaaatttcgcattggacggcggcgtcgggtccattttcggcatgaatgtgcacctgaaaagttgggcactccatttttgtaaatgcgaaattcgagcgaatccctaacattttttgccagtttatcacgactgtgaccgtggcatccttccgtgccaacgcaaagttaacctcggcattccgggcgagtacgtcacgcggaccagcaccgttcagcgatggttagacgccggcacaatgaacatgcagctgaagtttcatgacgaatcaacttcatgcatcaactaatttaatgtttaagaggatgagataaaaaaaattcaatttttgaagcccttgaaaaacgttataaaatttttgactttgtcttcattatataaacttattaacaactatttgcacttaaatgataaggatttcttttaaatctatcggacaccgtcgcaacctataaatccgcaaaattaataaaacttcgaaaactgcggaaattttgttttaaatagagctattaacctctggaatatcttcccctgtgatattttaaattcaaaaaataaatcacaaggctcttcgttcatctctctccaaatttcttgatcttcatcctgaactaattaactctttctcttaatttgtctctggttaaattcgaatataaaattgaattttaaaaatctcttaaatgatcaaatattcttatttggccattttctctttgctcgctgtgtccatttcctccttcctttataaattttgtatttgtacaacttttctgattatatctcacaatttatagtattctcttttgttctttgacctcgtttcacttctgctgtcattggcataccaagtgattgattttctttgccctttatgttgagtatattgaaattatgacctttccaactgtgacacatacatatgttgcaaaacaaaaatggcatggcatcaaaacaatgcactccttttcaaaacatcacatttatagcacgagagaatttcaattaattgggtcaaaacagcagaatttaaaaagttatttggttttggtttaaattggcgttatatttattttttcattttttgttcgtctgcggttcatttgtacgggcctggccgttttcgtacgggccgttttcgtacgaacacttgttgttggactataacttttttatttgtcaaccaaatccaacattgttggtatcattcgataaacgttctgatactctattagcctgcagaattc

SEQ ID NO: 1369 - DNA, 1453 bp, Heterodera glycines
acaaattaaaacacactaaaatctaatggaaatagcaatcttttcttataatttcggatgtcgtggtgaatgccgcctccacaattcgctcgtccttttcgccggccgccagtgtgaacagtgagaaaatgttcttccaacccgagcggattttgtcggcatgcgaatggaccatgtgagtgacgcaggagacgatcatttcacgacaggacagcgacttgttgcgactcattatcacttgaattgtggagggatatttcgagtaaaaatgaaaggatgagaaaattgtgcaccttcaaatgggtgcagaaattccttttggaaacggaagttcggcagttcgcctttttccaaaaacttcatcgaaagctgtcgaagagcatccaacgcaaagtgagaaatgtcctggttggaactgcagccggccaagttgaagtgttcgccgaggacggaccaaatcattgaccatctgagaatggcaaaccacaaattattgaagaaacagcaacatctcttcgcacttactctatacgaattcggttcatattgtagaaggaaatctcgacgatcttctgcaacatgtacatgctcggcccaccaggactgcacaactcttcgagcagtacttggcacaatgctcgcacaaattcgataaccgcttcgccggacagtttactcgagtcttggaatatcctgcaaaaacaaggtaaaagtctaaaccccatcagaataattgctgtcacctgtctatggccaccactaagtcttgggaggatgtttcagccaaatatccctgcacggtggagaaggacttgtcacggatgttgaacatgctcttcagattgtctttaaggaatgggatttggggaaccatcatccagtggggtttagcatcagctgaatccgttgtcatgagtaaaaacacgcaaatccatcctaattaccgtggtttcccgtgccgatggaatgaaccagttcaagctgactgatgcatttcaacacgtcgtaccagctttgctaaaaaaataaaatttaaaaatttgaaattagccaatttgccagtcaattacgtccaaatggctgccattttcaaccccaatttggatgagtagctttatcgactccacattctttggccgaatttcggacagtgaactgttcgcggtgagcagagtgaatttggtcagcgtctgcacaaatgctttccgctgaatggccaaccgaaagaggcaagcgacgcgaatgccggcggaaaagccgtgcagacaacggccccaaatttgaggttcgtcggaggattgcaggccgatgctgaaggtggccaagcacggggaccaaatcaactgcaaattgaataaaaacatagtcagtcagtaattaatttgtgatattccaatcatcccggctatgagaaacctcaaacatcagttggacttgctcaaaatagatgcac

SEQ ID NO: 1370 - DNA, 7822 bp, Heterodera glycines
actcactcaatttcggccgttttaaatttcccggcttcgttttgatttcattggtggcaatgtcatcgtaaatttgagacaaaaaatcgtccggcaaatccgattggtcgttgataccccgattcatccgaatgtattcatcctttgtcattttccgtttcacctgaacaaaatgaaccaaaatgttattttcataaagctccgacttgtgggttgtgcaggtccgtggtcagcataataatcgaatagctgagcacataagcagtgtccgcagaggcaaaaatgtggttaagctgcgggttacaagcacaatatctgcaacaaaaaaaacattaaatgaaacaaaaaccgaagattctgacctgctcgcaaacttctccattattcgatcgattttctgtgcctcgccgggcaaccgaaatttgctgagcaaagtgcgcaacgcctgcacaatgctcacgccggtgaagtcaaagttgtccacgtaggagtacatcacgcgctggttgaactcgtcgccgtcgcccaaatagtcgccgatcaccgacttgtccaatcgctcttccgcgtggaaaaatttggcaatgtccgtcggctccgccccgacgaagcccttctcactcagaaatgacaagccctgcttgggtttcttggcaaacagctcaatgccactctccacaatgcctttttgttgtttggcctgtaataagctcaggaaacggctccattttgaggggtgattagtgattaatgaatgacctgtgctgttacgttcacgtccgacccattcccattgcacgcggagggcgccgcgttcgcagtttcgtcaccgccatgaatggactgctccttgccgaggttcatctcctcgtaccagtaaaccaagcattggagcaccttcaccagacagtccaatgccaactcgcgcattcgcctctcgcgctctttcaacgcaatttggccatgggacggagaggacgaatcggcggagtaaccggactggaaaaggcacagaatggcatgacataaatgtacatgtatgaagacagtacagctattttggacagatgcgtgaccaattcttcgaaaatgttggcggatgtcatgtgacagtcgtagttgacgtaaatgtccaccacactctgcggactgtcacaaattttggcaattgtcgtgagcaccacccatttgtgttcaaatgaactggagctgctgtccaaaatggaaatgatgatctccttgaagaacacttcgatttgcttcttcagatggatcttgaaaaacaaagaaaataaatactttaatcagtccgaagacaattccattatatgaaagatttgaatatgtaaaaaatagaaaacagtttatgtgctaaaaatcatagctatatttcgttatcttttcaaaacatttaaattttttacgtctaaaattttcataattttaagagttttatgtattttcgtattgtcaatcatttttgtcgatattaaaatatgaaattataaaatggtctctatttacaactaccttatacttgtcgaccaaatgaacaaaaatgtccagtgctttgctgaacacgctgatgttcggagagacggcattgtgagtcaaagccacgcacagaaagtgccgaatggcgtagacgaaactgtgcgtgtcgggcagtgcagcgttgaagttgcgcacaatcagcaaaatcatgtccagcgacaacagcttcgaacgcaattcgtgactccttggggagatgagagaaaattccgctggggaaaagggctggctgattgttagccaatccaaagctgttcctagcgggtccgactcgaaaattggattgattctaaacacagcggctttaaataaaatatttaattttattggagcatctgttgccgctgactgtcattttccacattacttttgcataagatagcaaatatattatccgagaccatggagtaaaaaattgtcattcaaaatgcattcagccaaacccgtacaattagattcctagaaataaaattccccactcattactccgtttcccccacctcgtatcctggtcgtccggtgtctgtttgatggacaatttgcacaatgcgcggaagatgagaaaggcgtctttctcctccaaactgtgaaactccaattttgacggttgctgcggcgtgttctgtccgccgcccattcccgccgaactgtggtcgtcttccgctgtcgtttggtcaaatgaatgagtagccgaaccattgggcaccgttgggctgtacaacccgttcacactcagccgctcatcggtcgaagtgtgccttgaacggggaggaacgtcctgaagaaagggaggggaggaataagcaatgataaggaataaatgcatcggtcaaaatggcatacttttttctggtttggcttttcgtgttcagtggaagcagaaactcggtagaccagggaatccacaacctcacggacaaccttttgattgagccaaatggcattattatatattttatggcatttaggtaattttactccgttttcccagtccaaagttagagcattgccgcctccttcaccggttgcgctgtccatggccagttccgcgtttgtgaacacaaaattgatggtttgggtgagaatgcctttcgcggtggactgattgattggacttcggctggccaaataaatgttgaaactcgtccgaactgcgagcagcaaagagccctcatgaattttgcagttattgttgaggatcagtgccaaaattccctgttccggaatatcgttaattagttcaaaataaaaatgggcccactttgattatctgaagttgaatggaatcatcagtgtgtggaccttggaacggagagcaaatggtttggacaacctctggaaaaagagggaaaatcaaaaattgaaaagccacagaagtactgtcaatgagtagctggtcgggattgacagcatccggcacattcccgaccaaatggccataggaaatcagtttctaaattgacaatatttagataaattgatgaaagaacagtaaaagacttctaacgaatccaaggcgttcaccacaatttttgtggaccgactctgacaggcctaaaaacattgttcctccaataattgattataaaatatctagcaaaaaatgaattaaaatttgattgactcactcaccaattcaaagggaagaaaataatggtcagcgagaaatttgttgttgttgttcggcaaaacgtctgatgcgccctcctctatgtcaatgccatttaaccgtgaatcgagttgctctaaaacattacaattaatcgccatttccaattcgaatgccatttcttaccgattgcttcttcacatgcttttttcaatgcgacgtgctctttgcgcctcgtgcttgggtcatttagcagcctctcaatgctggcttttaggaacatctccaacaaacctacggaattgtcttttgaagtcgccaaaatgtcggtttgatgttaatttaggtattaacgcatatctgatcagaatgatcaattagtaagttacctctcacttttttacagaaaaaaacaacaacaaagaaaagttaaatgacgaaaagccaacaaaacaatgcatatctacaaaacgccataaatgccttttcgcagcaaaaggatttaaaatggtagagggcagttggacgagacgagttgattgagcgcttaaacaaatgatgatcgaccattattttggcgtagaaagattttggacaaaatataattggaaaatatttatttcttttaaaaataacaattttttgtgcatgacaatttatattttattaggtggcggaatttaagaaacgcgcagcacgcatttgagtggcattttgggtaggaactcaatttgacagtaattaaagtgtaaaattctctagatcaattgtccgtctttttgatcattcgtccgttccctttaatctctctgttgttgcgttttcgttttttgtttcatttcctttggccatcgtctttttgtttggcgttatttgctctgcaacaacagaagtggcaccaatgtgggaaagtcgcgcgtgtgtgcttaaaaaattaaatgtaatttaacaatttcctaaattcgttttacaaattttccacggcgtgccaatcgccacaccttttacatttattggcaccggcacttatcaatcaatcgtcaattggttgatctgaccagtaaaaaaacgcaccgaagtccacgcactgtgaacgcccggtagccgcactcggcacaaacgacgggcagtgagtgctgctgtttctggtggtggcccagcagtgcgttggtcgccgtttggaacggacaatgcggacattggaccaacggcggagaggcggacgggggcgaggaagaagacgaatttgcgatggatttgaggccaagcgaagggtgtgcaacttctgctaattggccattgggcgctgttctgttggctccgggcgaggaattcgaagtgtcgtcgggtcgaagccgattccgactgaaggagaaaaggaagcgggtaaaaaatgccaaaatcgatgcccccggcaaatgtaccaataatatttcttatggccaattagcgtctccatggccaaaaatgatacatcaccgcacataaaaaatgaaccgaacgacggtttgaaaaagttaactttattttaataatttgcttccaaatttattatttttttttgtttatggtttttaattttcttatacattaattgttttttgatttattttgcaatgaattccgtatttcaaaatgtcggtttatattcattttaacccgttaagtattcaggggtcgctgatcacaaaaccagtatttcgatcaactttgaccccggaccagaattctgataaaagtcgaaaaaaaatttttcttcaacaaatagatattggtttgtgaacagtgatttagaaatatgaaaaaaaattgtggcggttaaactatatagaagcaaaaatttctaatttgtacaaatccttatattttttaaatgttatctaattctttaagatattaatggtacgaacaaagcaatcttttccttccgaggctcagtgttcctaatcgtctttacaaaagattgatttgcctacttcaacaggaaatcaaacgggttataagctaccggtcaaaaaagcagtcaaaccggttcaaagctccggtgaaaaaaaagcggtcaaaaattttgaattattatgaaacagaacatttgaacaagaaaaggaaaatgaaagaattattttctgaagataatgaaatttctaaaaattttttgaaaaacataagaaaataaatataataattcgttcgcttgcgcttctttggcctgtaataaatttagttttacatcgccaggcccaagttgttttaaaatatcaggacaagtttatcataaatataatccaatagcacaaccgacagaccataattcattgccaacaaatggacagttgtattttctcgatagttgcgaagcacaaaatgtaattacattctcataatttagatatatttttgacagaaaaaatagaaataattcttagaaaaaatttccctttgctaaagcttatgaaatgatgagaaatgtagtagacgaacaaaaacaattaacaacaacaaataaaaacaatgaaacacaggaagttaaaatgttgttgagtttacggaaaggttttgatccaaatcaatacaatctccagcacacaaatgaagtagctgcgattattgtatgcaatgcaaatgaagaaataccagcggcaaatataattgttgttgaaaagggtagcaaaaaaattaaaaaaaatttatcctttgttatacccaatgggaacaaaaggatggagctttgacataaaaatcaaaacggaaaaaagatttcattttgtgattttattaaattcaagctattttacagacattcttattttttgcctcatcatttttctaatcaactttttcaacaatggatttttgaccaagcggcccgtgttgaatgggatagactgaactatattagaactcaccaagaattaagagcgtgtagttataagggattagaagattatctttttaacaaagctgaacaaacgggagtaattattggaaaacaagtgattttaccttcgtttttttaggagggccaagaaacaaatatcaacattttatcgattctatggctattgtgggagaaaatggaaaacgggatttatttttgacatatacaataaatcctgaggatccggacataaaaaaatgtttaataaaaaatcaaactgaagataggccggatatcgtagcaaagattttcaaattaaaagctgatacgaaatttttggtaaagttatagcttattgttgggttgtagaatcccaaaaaagaggcttaccacccttacattttctaatcactttacatccaaaagataaatttaaaaatgcaaatgacattgacaaatttattcgtgctaatcttcctgataaagaaaaagaaccttttttacgctcttttttagagaagagacccaaataggagaagatggatatgctttatataaacgtcctaacaatggtgattttgaatttgtaaaaggacatcgcttaacaaatcaaaatgtcgcaccttataatccatatttattaatgcgattccaatcacacatcaatgtagaattttgttcagaaataaacgctgttaaatatatttacaaatatatctataatggatatgatgcagcaacagttgaatgtgtaaaagaggagccgaatggtgaaaaaattatgttaaaatacgatgaagttagccaatatcttgaggcgcgttatttgagccctgtcgaacatgttatcgattgtttaaatttgagatatagggtaaatcacattcaatcggacgattataggtacatttagaaaaacgaacagaccatttatattgataaaaattccgaaagtgataatttaaaagaagctatgcaaaaagctagcaaattaacggcatactttaatttttttaaagaatatccgaacgcaccggaatttaaatatatagaaatgccaatttattgcacttttgaccattggaaatggccactaaaaagaaccgataaagttattgggagaatatacacaataaccccaaaaatagagaattatattatctccgttatttattgctcaataagcacgctaaaagttttgacgatttaaaaattgttaatggtgttaaatcaacatatatgccgaagcgtgtttggcgttaggattaacacgagatgattcagaatggaacaaatgcttagataaaacaagccaattcaaatttcataaaggtcttcgttcactttttgcaaatattttaattaattgtgaaccaaaatacccacttactttgggaaaaatataaagataacttaagttaggatcttaaaaaatcgtatactgatcagattgcttatcaaatagctttatcattaattgaacaaaaccttctaaaccatcaaaaatgtttggacgattttaaagatatgccaaaaataaatcaaaatattcagaatatttcagatgatcagataatgaatccacaagatgaattaaacattgctttaaaaaaaatattctttaatgaactgaacaaaaagtaatttttgagcatataaaaacaatttttgaatgctctaatgaaagctcatcaattgcttttacattgatggaccagggtggacaggaaatcgtttgttcagaccgctatttatcatatagccagaggttttttaaaaaa

SEQ ID NO: 1371 - DNA, 4272 bp, Heterodera glycines
  misc_feature (4262)..(4262): n is a, c, g, or t
gggggtcaagaggtcaatgaccaggtgtgaaattcacacctggttttggatgaagtggtgatgaatcggtgagggaggaggggggacggacgagttaaggtgtgaaattcacactttttttgaacggtggcaaaagttggttgggggggggcgttcggacagtttaaggtgtgaagttcacaccttgttgctgagaaaggagggaaggggcgatgaaatatggtaaaattctcactaatctgacatttgagatcgcgtaattgatgatttatctgttgaaattaaaataaatgattataatttgagtgaaagttcatcaatatgaatctgtcactcattagatttttttattttcggtggggccagttgttccaatcctcttaaaattttaaaggacttttgttaacattttaaaattacccgcacacaggtagaagcccaatagatactttcccttcacgagtacccacagctcgttgtcttcgactttcctctttttgacagctggcgcttcttcagcatccttttgcacaggttttgcacaattattgccccagcgactttttttgatcatgctgcgggtgtttggtttgggttggaccttgtcagtattcacagcttcgctatccgtttgaattccatttctttcagcttgcaacggtacattatcgttcattgaagacatttttatttaagaaattattaaaatgatttttggttttgagcggatgaacttgtcgagctgaaaagtgggcggagcctatccgatttcaaaagtataaaaccggcacatttttgaatgcccgcgtctttttccaaatcattcttaattttattcaccaaaatggccattaacatgagcgacaaaaagggattagtcaaacaaatcctgggcgaagccgatcttaccattaccacctctggtattacagttagcgggccgaggctgtcaacgccacgttttattccctttgacgagagcggcaaatgccggtcatgtaaggcaaccgaggtggaggtcgacacgatggtgacaaaagagggcatcactatttggtgtacgcgcgtcgacaaagcgcagtttgtaccgtttgatgtgatctacgatctgccgggacattgcttttttcgagtgaagaacaagtcaagagtgttcaatgttccctacagtgagctaccctccgacacgtgtgcagacctaggggtttcaattgaagagaaggacttgaagagaaaagcaaaagtggctcttgatttggttgaggcaggaatggtgtcggacgcaatgcaggggggagcacgttggaagaaagcaaagactgcgatcgatgtgttaggtgatcttttgcttactgaaccactgagcgaacatcaaaagaacactccagattcatacctaatgagcctcaaagccgacaatcatcacaagtgaaagaagaaacaacttcagtttccgcttctgcagctgggagccctcaaacccacactgttgaagagatgaaggaacaaaatcaagaagatgttgaaaaaaagatgccgcctgcactcccggatcctccaactatgagtggcgaaaagaaggtggaccctaaaaaagaggatctcggagacattgataaaactcttgatgaattttttgagagtattaaggcagcaaccaccaatatgtaatgatatttaagtctttgcttttgtattcttttaaccacaataaaaatgttaaattcacaagcgttttccaccaaagatatttgctttaaattgccctttggattaattatttcggggccctcctcctcaggtaaaacccaattcctactaaaatttattgctgagttctccgagttaatctcacccagcccggtctccattctttattgctttggtgaaatgaactcagcggtgcccgtacttcaaaaagcgggggttgacgtttatgcgggagtcccgtcagaagattgatcaaacgcttgcccaagcctcttttgttgatactcgacgatcttatgctctccatggacgagcgatacctgtcagatttgttcaccaaaaaatcccaccaccatcaatttgcggtagtttttgtcactcaaaatttgtttgagaaaaagatcaaagtggcgcgcctgtcctcccagtacctggtactgatgcgagcacccaactctctgttgtcgatcagaaatgttggaatccaacttttcccgcgccaactcgacttctttctggatgcgtaccgccaagcgaccgcccgtccctacggctatttgctgatcgacatgcatgcatcatcggacccatcgttgcgtctgcgcacaaacatatttaaggaagagcaggaggaagacgaaggcattgttgttttcattcccaaaaatggcggaccatagtcaacaataacaacagataataataggacagctaataaaagacaactcggactggctatgtgctttggcgagagtccggctagctatcctttgaggataggccgcagtgaattaagccttatgaaagcatgagatatgaaaatgttgagaaaatgcaaaaacatatgacaattcagcgtcccgggccaaccgaactccataggcacaggagtccggctagctatcctttgaggataggccgcggtgaattaagccatatgaatacatgagatatgaaaaggtttgagaaaaatgcaaaaacatgtgccaattcagcttcccgggccaaccgaactccataggcacaggagtccggctagctatcctttgaggataggccgcggtgaattaagccatatgaatgcatgagatatgaaaatgttaagaaaatgcaaaaacatatgacaattcagcgttccgggccaaccgaactccatagacacaggagtccggctagctatcctttgaggataggccgcataaaaaagcaccaaaagaaatgagaaattttagaattgatcgagactgatgaataataataataataataaattgactcaataaaatgagaaattacgaggcaaaaacgccccatcatccgctgtcgacagaggcggattaatttgcctttggaaaattacataaaaaagaatgaattcatatataaaaaataaagaattcattcaattattatctaaataaataaattcaattataataataatttagcattatggctgtttgtaaatgcaaagtgtgcgacgagtgccgtcgaaagcaacggctgcatgaaattagcgagcggaaaaaaattattgaaagctgcggtggggatcaccactatataaaaatgattgaattacggatgcgcgacttagagctatataaacgagcttataggcgaataaaatctgtgatcgaccaagtgctggaaggttggtaatataaggagggtgaaatttttaaaaaaatttagggccattccatgtaaaatgcacttcaaagtgccaagaagaatttacatattatttgattaaatgggaatgttgcactgaggattatggacggggagtgggctgcacatattcagaaattagtgatatagtaagaaaaaaaataataattaaaataatatttaactgttagagccaaaatgagttgttggcatattacgatcgggaacgggtggtcggcgagatcgatccgccgttggctgataacaatgcaccgttggcaatggctggaattatagccgagttgcgcggtggaaagttaccgcagggaaatttggctcaagatgatttgacccaaaatgaggacctaattgcggcgggggaggaggtgattataaaagaaatttttaaaaaataataaagttaaatagtaaattttaatggataaaaaaatcgaaatgttgtgttaattgtaggccgcagggcaagatgctccagttaaatagcgggcgcgacgcaaaaacaaaaagaggggcggtaagaaggtaaaaaatgggatagaagaggaggaggaagaagaagaagcagaagatgagggggaggaggaagaagaggcagaagaggagggggaggaggaagaagcaaatgacagtgtgcagggtagcagtatatggtccgggtcaattgactcggccattactgccttctccacaatgtcggccacgcagcgaaaaaaagtgctagggaggagccgacaatggtggcaagagcgcaaagagcgcaaaaaggctgaaaagggaagatgcgctaaaacagtaggagcagtggaaaatgataaattgaattttgattaaaattcatttttttatggtgttaaaanataaattttg

SEQ ID NO: 1372 - DNA, 1263 bp, Heterodera glycines
atgccactatttttttttgattttggcattccgttttcgtcgcgtcgtaccctccgttctgctgctggtcaagcaccgaactgctgctcaacagtcggctcagctcgtgcaccgtgtcccggtgctcatccgcctcctcgtcatcatctccaaagtcgttgtcctcgtccatttccatggcattttctgccaatcgtccgccgccacaattttgccgttgctgctggttgtgttgctgatactgcttcccgtcgttgttactgtttgctgctgctgcggctgctcgtcttctcatagccgcttcctgttcagccgcttccttgagcttctccaaatcttgcgcacacaccagcggcttcttcaacagggaaattttaagggaggaaagagggggttggaaatttcccaataaaatgcaataaaaccgcgaaaaatgggcgaagaaacgatttttctttaataaatcctcaatacacttagaatttttttttttttaattcaatggctttggtaaatttttaatttaattttctcgactttcaacggaatgccggacggtcgtgtcgacgatgattgtgatccattatttgtgccaacaccaactgctgctgctgctgttgttgcatttggatagccagcagcaccaccaccaccgttgcgactttgtgcctcgaaaagcttcagcttgcagctaaatgatgaggcggtgggcgacggtggggactgtaactgctgctgctggtgatgagccgaagaagacgaagacggtgccggtacggtagtcgaagttgttgtctgctccgtcgtggaggcctgtgataagtgggaaattttaataaattttaaaaatttcgagaatttaacgcaaagcaatagaaaatttctaggtttttaaaaatttttgtgagaatcctgtcagaatcacattttggggtgcacttcatttcccccccccccggtccttcccccgagggcaccccaaaacgtcgccggaagactttttggaccataactttgttcattgtaaatcaaattaagcattcttggtgttgttcgatagctttatgtgtttactattaataggctaaatttaaaaaattttcgttaagtttcaaaaaagttatggccagaaggaactcaaaaacccagtattttgaactttttttgctctgattttttttggtacatcaataaaaaattttgaaaaatttgtagattaatagagtttttcataagctttggaacaataccaagaatgtttaa

SEQ ID NO: 1373 - DNA, 1701 bp, Heterodera glycines
cggcgaaccggccgcgacgaagtgtccgcggcgaaccgaccccgaccctcttttactgccgtttttcacatgggttggtcgttatttgaccaggtcaaatgaccatggttaaatgacctggtcaaataaccaccttctttgactttatttcagatgtttttcttgccagccaaatgagtgtgtaagaagcacatttaatgatgcccttcctcacttttggtttgggtgccaccggaggtggtggcactttcggtgccgttgtcgtttccggccccgtcgttggcgaattaagcgcgaccgggatgtgcgacggttttgcgatcggcgccattgtcgatggcgtcaccgatggtggcagcattggcacgccgtggggctgatggtgatgatggttgtgattggcatcaatgatggtactgctgctggtggtgccattctgccgaaaaatgctacattaagcctaattttttttacgcgcatcctcctaaaggcacggattgattagcttaataattaccccattttgatagtgataggagccgctaattgctgtgccgttgttgttgttcactgtcgcaacaattttgggtggcaacggaggcgacacgttggcattggcactatcaccagctattgttgtttttggtgttgtggcggcaaattgacgatgccgatcatttgcgttatcattgttattgttgttgttgacaatgtccttgttgtcaatgcgtgtcgagaaggaggtggaggacggcgaggagttcaacatttgtgcctaattagttaattaattggcatcaaaaagtagtttcaaatttttttttccatttttaataaggcaattaatggcccaatgagttcctcccggagatggcgactgggaattattttttaaattttgaccagatttgcaaattgtaagaaattgttccgttatcaatacgggagggaaagtacaattaaatttttaataaaatcttaaaaatcctcctggtattacccaaaattttaagtttaaggtgataattaaaaatttataagaaaatttaagaaaaaaattggaaaaatttttggaaaaccttagttaattatcataaaacattgaaaaaatcgctagaaaaaattttcggtggagaaaactgataggggggggggggacgaactgatccctcccagaaattatcaacaaaattttaactaaaattcaaattataaaacaattaaattttaaaaaaaattttcatccgttatttgcacattttgctgctgtcgcttgtgctgctgctgttgttcatccccaacagcagcaggaaaagcagctttggtcgtcggacttgtcgtcggattcgtcgtcggttgtcctgggtaatcaatgggcgtcgaggcgcgcaacatttccgactttggctgttgctgctgctggtgctgtactgcttgaattcctcgtccaccacttttactgttttcgttgtctttgttgttgttgtccatcaacagcaaattgttgaacgacgtacgatgttgaagctgttgttgttgttgttgttgcggttgtggacggtatggcgacgacggtgacaaatggttgttgcgtacaactccagcaaccgtggcgacgccggcagcgacggcaacaggtgaagacgatgacgctggcttttggtgatgggcaaccggggaggaggaaaagcctagaaaaca

SEQ ID NO: 1374 - DNA, 1427 bp, Heterodera glycines
tccacacggtcaacagtgaacgggtcgtcgggccagcggccagcgccggagacggtgaagccgggcaagccgcacttgttgcgcacaatcattgtacaacagcgctcgggcgggcgtggcgctgagatggcggcggaggcggacgcctcgggcaaaaaacgaccctggggaatggagaggggttaaaactacaacaaaaaaaaaaatacctccaatatttatttatcccccccccccattgtggtgtgctctcaaaggtaaaggacccacaaagacaaaagacctacaaagacaaagatcctagaaagacaaaggaccgacaaagacaaatgacccacaaagacaaaggacccacaaatacaaaggaccaacaaaacaaataataattttataattaaaaaaataaattgtgaaaaatgctgaagacaaggtaagtttcccccatatcatggccctcgtaccaatttttgaaaattaatataatttttttttaaagaattttcgaggaaaaatgaaattttctaataattttttcaaaatttaataatggattacgaagctttttcacaaaattcccaggagatcgctatttttcaatttatttttcttgaaattttcctaaaaaaagtttttgagatttgggggtcaaaggtcgatttagaacgggtttgatccggatttcgggcatttgaaaaaaataggagacaaatttgtgccctcggcattttgacccaaaattttatttataaatattcctaaaaaatggtcgtcgcgtcgcttcccctcactcacatcgtcaagcagtagttggcgctgctcccgctcaatgaacagctccaagcggtcgcccgccgtctgaatgcattggatggcttcttggtgggtgaggccgcgcaggtcgttcccattgaccgccagcagagagtcgtccacgcggaagccggccgaatgcgccacaccgccgggcaccagctgggagatgaacaagcccgacttgccctgccaatgagagggggaggggggtgggtgtaagcggagcaggacaaaatgtcgtcggccgaaacgtggtcacaggggcgtatctagaaatatttttcgggggggggggggggacccgacctgaacccctttttttttttgctatttaaccaataactttttttccactgctgggtaacaactgcactttttcactaaaaatgaccaaattttggccgttttaaggcaaaaaacttgtaaaaatagtggaaaatgtaggtccggcggtgccgataggcgccgccgggaaaaatttttggaaatttgagtgctacttgttacgaaatttgcctattaaacttttttattttcgtttggggggggaatattcaaaaaaaatttccattattggaaaaattttttaaaaatttctttttgggggggggggg

SEQ ID NO: 1375 - DNA, 3127 bp, Heterodera glycines
ttttgaaaaattttttccccggtagggctccccgggaaaaccaccccgggtaagaatggggtattagctaaaaaataatgagcgaaattgggggggggaaaggaaaactttctgataaaaatcacttataaaaattattttttaaataatatgcaaatggttcaggggttaatctttcctgttggtctcttacctagttcccttgcatcaatcccacttcagtaaaaaaaatatatctctctttctttaagtaatcaatcataatgtaccttcttgcatcagcaatactatagtaaagtaatgatgaaatcgaatcgtcccgacgatgcctatcggtaatgcgtctctcaaatccagcataattttcatggtttagtcaaattttcaagttaccacacaagataaggagatttatcaatatgctgcgcgaacaaaagaataaattaaattaaatcagaaataaaagttgatcggactcataaagtgaagtagagccagcaattccgcaagttttttcagtccatctccagcatgttctctgataagtccgcctcgctcactgtgtcgcgcgccctcacctgcgcagctcattcttcattttctgtacttgctggcgcagtcgctcgtaccgccgcttccattcctcatgtagcatggcgctcgccgtgaccgggccttttcatagtcgaacccattattgaggtttttaggacctaatcctcgcttagccagctctaacacctaaagatagccgtagctcgtagcgctttttgccgcgactatccgacccattactcaaacacatattattgttattataccattacagacaaaaaaagaaatgcctgcaccccccccccccctagatacgcccttgcgtggtcaaacgaatttttggattatgagcttttgattcttattctgtaatagtccgaatcttattaaaaatataccaatcaaaatgaaaactaaaaaaaaaatgaattgaaaaaacccaaacgcactttatacggcaatgaattggcaccgccgacaattgaccattcaaagccggacggcccacgtcgcatttgcatgttttttcgcaccatttttattgaagcctttgggggaaaaatggggtaaaattatgaggtatttattattgcagcatttttcctggaaattatgaaaatctatgaaatttgtgaaaatttggtaccaaacttggcaattttggaagattttttgggccaaatatcgaaaaaatttaaaaaaagaataaaatttaaataaactccgtgcccttttccatctaacggtaagcaatttgatgggtttaggcatttaaaacaaaaaatatttttgtgcacacttttctgccaattccatcggcaccaatgccaatgccatcgtcggcgttgttcaacagtgacaacagttcgggcgttgaaaggtgcgcaatcacggattggggccgccgtttgagcaccgaacgcaatggccgactctcctccaccggtggcacagtgccgccgggggcgatggcacccgtaattgtggcattcgccggtgattggttggacagcgaaaagccagcagcggcattctgtgaaggaatggtggattttttacggaataggtgccaactacgtccgggcattttttaaattttttcggaatgacccaactcttccaggcattttccgaaatgggctaaaactccgtctcggcaatttaaattttttttttctcggaataattctacttcgtcccggcctttttagaacgggtcaaatcagtcccggcttttctttaatttttcggaatgatctaactctgtccttcgtacccaatcaattcaaattattaaaattcatagaaaaacgaactcgaaattatggtgctagggcgtttcttaaaaccgccagggcgtttcttaaaaccgccagggcgtttcttaaaaccgccagggcgtttcttaaaaccgccagggcgtttcttaaaaccgccaactcatatgattatgtatgtatatccgttaaattaaatatacaataatatctattaatttttatttgttgtgcaagtaagtgtcagccggaaatattaattagtctagcagtgacagactaaaaatctttattaaattaatttacaattatttacttaatttttaatagctcctgtaatctggttttgcaactttcaaaaaagtaacaaattacgaattaacaattttatattcgaaaattttgcagttgataattgttgctataaccacgatgtgtgctacataaataaatatcagaaacgttacgattgtgatattaaattttgcaattgccttaatgaatatcctaattgctttctaacaaaagtctgttctccaactcatatcttaaatattttattttttagaatatattatgctggtcagttcatatttttggagaatgttttaaagaagggtaaaaataattattttattttaccgtcaatagatatgcatatgtattttaaattttttattgttatgtaaacttctaatatatatatatttatatacataatcatatgagttggcggttttaagaaacgccctggcggttttaagaaacgctcaaagtggcggttttaagaaacgcccacctggcggttttaagaaacgccctggcggttttaagaaacgccctggcggttttaagaaacgcccaatgtggcggtttttaagaaacgtcccagcaccccttcggctccttctaattaatgaaaatattttacaattaataaactaaaaatttgctaaaatttattttctattatattttacctcttttatgggaacacttagacatgttgctgttaatatgaataataaaagtaatttatgcctcattttcttatatttcacaaaaaaaaaacttattactattatatatggattcttaaaaaaataaataaaatattttataatcttatattcatttattataatattgttaatatttaaaaattcttatattcatttattgtaattttattaattttttggatttacaactgattattattatataaaatgtttggtgtaatagaattgaaatcaattgtacaacgcataaaaaatatgattaaaattttttta

SEQ ID NO: 1376 - DNA, 1341 bp, Heterodera glycines
aagaaggataaaaataattattttattttaccgtcactagatatgcatatgtattttaaattttttattgttatgtaaacttataatatatagttatatatacttataatatatatatatatatatatttatatacataatcatatgagttggcggttttaagaaacgccctggcggttttaagaaacgcccaatgtggcggtttttaagaaacgtcccagcaccgaaattatgcccacaaatagtgggggccaggccgttttatagtgggggccagggcgtttctctcaactcttaccgaacttggccgtaacctgccacccaaagcgattacaaaacataacatcaaacgaatcgaccgattgttatgtaatcatcacctccacaaagagtgactcgctgtataccgttggcatgctagctttatctgttcgggaaatacgatgcccattgtacttgttgactggtctgatattcgtgagcaaaaacgacttatggtattgcgagcttcagtcgcactacacgggcgctctgttactctttatgagaaagcgttcccgctttcagagcaatgttccaagaaagctcatgaccaatttctagccgaccttgcgagcattctaccgagtaacaccacaccgctcattgtcagtgatgctggctttaaagtgccatggtataaatccgttgagaagctgggttggtactggctaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccataaccgaacgagcagctcagagcgtttcgatatcatgctgctaatcgccctgacgcttccactagcatgttcacttacgcccgtaccgggagtcccggcaaaatcccggcgggatcccggtcccgtccgggctctaataattatttatctcaatactggtttgacttaattttgttaccttttttggtaaaattttacgattttacaccccctaaatttgaaagcttttagcaactattttc

SEQ ID NO: 1377 - DNA, 5202 bp, Heterodera glycines
  misc_feature (3750)..(3750): n is a, c, g, or t
  misc_feature (3760)..(3760): n is a, c, g, or t
  misc_feature (5051)..(5051): n is a, c, g, or t
  misc_feature (5102)..(5102): n is a, c, g, or t
  misc_feature (5130)..(5131): n is a, c, g, or t
ctgcgccgcccgcccgttgattttgctgttgttggccattcgtcgacggcggtgacgatggttgttgtcctgctccgttcccatgatgattgttggccgattgcggtggcacaatgccggtgaaatcgcccgagtttcggctcaaccgattcttcggcgcgaacggcttcggatggggcgtgtcatagcgttctgtcaaagtgtatacaatttttttgttgttgaaaaatataccgtaatacaaatatttttttttaaaacaataccgtaatccctatattacagtataccaaacgggaccggggtgatggatttttgtccttaaacacctatattacagtataccaaacgggaccggggtgatggatttttgccccattatttttaaaaggattttgcgttccaaaaacacggtccggatataatctcgaatccgaatgaacctgatccagaataggcctgaattttttccaggaaatccggtcccagaggtataagtgcaaaacatggaaccctggtccagctccaaggcattttttataattgtcaaattcttagtaaaaaatatctttttaaaaagttggttttttttttgtgcccaccaaatttgccgattggcattttgtcctcctcctccggcggactgtcaccggcgaagcacacccgggcaccgccgacgcacgatttgttggtggaggaggccatccgcgtaactgaaacaaataaaaacagttaaaattttaaaaaataataaacaaaataactttttcattttcccgtccgaaaatcgaaaaattttccgatttttagggcttaaaaattccatagaaatttgtacaattttttgtgtcaatcacaaaaatcaaatcaaattaaaatttcctcaccatctgaatgttgttgctgtgcagcagcacccttttgaggcagcaaatagcatgtgagcacctgaaattttgccaatttattacaaaaaaaaaaaaaaaatttttcatttgaaaatccccaagaaaattgcaattttttttttcaattttcatatttcgttccaaaactttgcgaggtttcttgaaaacagctttgttccctctaccaaatgctcataagttttcataatttattattttggaaaatttttgcgagttttgatggcaaatttttgatgctagccgaaaatttttctaaaaaaaaattgttgaaattttccaaccaaaaaaaaatttttcaggaaaaaatgctaaatttaatttaattttgttttctaccttgatgttcatcaccggctcatgcgtggtggtcagcttgggcagcggcggttggttgaaggagagccaaagggcggacagtgttttggccttgtacagtacggtcagcgtgtacggtaagtactgtagactgttgtccgctaggtccagcacttggagttgctgaacaacaacatttcaacgaaacccaccccaaccccacccaaaaaattgttggaaataatctcaatttttatcggacaaaaaatagtaaaaaaataaaaaaactattaaaagaatttccgaccgggcgcaaatcggcttcaatgataaatttttaaaatgttttaaattttcgaaaaattgccaaatttttgaaatgtatcttcgggggtggggaaattcccaccccctggctatgggcatgacctcaagaacaattttcatttttaaatagacgaaaaaaaacactgaaattggtattttttgttaaaaaaaactccattaattttaataatattttaatttatggttctcagtcagtctatttttattttaatatcccaaaaatcaggtttttaaaatttcgcaaacacaattcttgtttaaagatttgagttctgtgctccttggcactaattagccaattaattaattaattgcccacattcaatttgccaatttccattggcaactcgctgagatggttgtgccgcagtgagagaattgccaacgactgacatccaccaattgttggcggaaaggcgtgcaaattgttcacgttcaggtccaaaaatcgtaaccgccgcaaattgccaatgctggaaggaatttcctgaaaaaataaatattatttataaatgtaaagcaaaaaaattttaaatattattacaggtattatggggaaaaaagaaaaaaggaaaatatttggaaaaaaatgccgtgcgttcgagcggactcgaactttcacgtatttaattaagaggatcagcgtgaacgactgcgctatagcacgacgaaatgaacaatttatttatttcttttccaatattccatttactactagtaatggcttttttgcaattttttgtatcttttttatttaacatttgtgagggtcaatggctcattaatggtcaaaaaaaattggcgtgcgctcgagcggactcgaacttgcatgtatttaaacggctgcatcagcgctaccgactgcgctatatgcacgacaccacaaaccaatttaaatccttttcaatgattctttgctcagtgatggagtccgtccatacgtttatgataaagggtggataatgaaaattcactaattagtaaatttgatgattagattctcttcctttttagacgtccaatttatttaaatatcactcttgtgtatttcttaacattgatgagggtcaatggtagggaaaaggatagaaaaagttatgaaaaactcattaggaagctactcaacttgactgccatcgttcggtagaatttcttaatttttacaatattgcgagggacaaaaatgggaatgcctcaataaaaaaaaaatcagttttttttaatttaaaaaataatgaaaataattagccgtgcgttcgagcggactcgaactttcatgtattaattaagcgcctcagcgctaccgactgcgctatatatagcacgacgaaatgaacaatttatttatttcttttccaatattccatttactacttactaataatggcttttttccaattttttgtatcttttttatttaacatttgtgagggtcaatagctcattagtggccaaaaaaaattggcgcgcgctcgagcggactcgaactttgcttatgtttaaaattttattttattattatttgttaggacatggagggtcaattgctcaatcattgtttagttaaaaagtagagaaccaacgaaaattcaacacgtgaatttgatgattagttttgccagcaacccatttgagccctcatcattttttaattttttttttgccgaaaaaattgagactctcaaatcataaaagtataaaatttaaaaatataatatatttttaaatagtaaaaaaaatgttcacctgcagttgattctcgcacagaatcaaatcggtgagcagtgcgcatgaacaaattgacggggtcagcaccgtcaaattgtttttggccgccttcagcacttccaaccgcttcaattggcctgcaaaaatgggggccatgaattttggacttttttaaattaatttaaaatttggatttaattttattgtggattttgtttaaaattccaaaaattaattataaaatcaattttattaaaaggaaaacaaacaaaatttcatccggacccgggtttttacaaaattccggtctcaaatttaaaaaaatactattactaatatcgtatttcctaaaataatagaacccccggtggttttggttttcaaccctcttcaaaaggtgaactctatttttaagggggggggggggagngttactgtantttttataggaaaaacggtaatataatttttcttaaatgcattttttaaatataatattattaattgatgaggcatcaccgaccgactgagctgggcaagtgccggatttggttctcgcacagcaccagctcggccaggttttgcaggtcgccaatgttcagcggcagttccgtcaattggttcccactgatgtccaacgtgcgcagcgcgcggcaccgcaacagttcgtccggcaaccgggcgaccatgttgcagtgcaagtcgagcagctccaggctgacgagacagtccattttggggggctgcaagtatttttttatggaaaattttggaaaaatagttttaaaaaaaataatcggacagtggaacaattcgagggattaaaactaaacaaaaaaaaggaaacacattaaggcaacaaataatttttggggattaaaaagagatataaaataattaggtaattaattctcttatacacatattgtaatggaccttatgattttttatgtggtaaactgtttattcaaagagattaaaaaaatgaaggtgtaagttaattgaaaaacgcttttttatgtgttgaaaatgattttaatattgatttcagaccatgtaatttattttaagcaaatttcaaaaaatccacttcaagacctcgaggagaatgaattttcatgattttccaggtccaatatggaacccaaaaatccagacttttttcaaaatataataataaaataaataaataaaatagaaaaacaatcaaaaaccgaccaattcggtcagataattgtcgcacaaatcgagcacacgaagccgttccaagcggacaattgaggggggcagcagacggagctcacattgggcaacatcgagaaactgcaaaaaaaaaaaggattggaattttcgggaaattttttgaaaattttattgaaaaattgcgaattttccccttttaaaaagaggataagtaaaacagagtgagactctccgataattttttttttgctaaaaatggtttaggttaatcagtgccaaaacgtgcgtgccacgccgagggaatattcccccaaattcgggatattgcccaagcccaactattttatgccaaaacaccaaaaatgccaaaatttgagcatttttttgatgctggaaaatgttttttataattttaagattttaaccgtttaaaagaattattttaaaattcaaaaaattttccctttttgatgttttaaaaacgctgatagttaattaattattgagtaattaatggaatttcattanaaattaataaaaaactgtgcctgcaaattgacgagccccatcatgtccggnggcagatgagtggatggattgttggacnnagtcagactggacagctgagtcaagtgacaaatgatttggggaaactgaaaatggaatttcaaaaaaaaac

SEQ ID NO: 1378 - DNA, 1399 bp, Heterodera glycines
ggggggtctgacctggcgcatacagagaaaagaatatagaaaaagaaatgataaattttgcggaggaaacttggaaaaataaaatatcaataaaaataaaaaatatgaaaattaatccactaaaaaattgaaagaaaatttcaaaaaatatgtgggattacattttttaaagcatagcctagtagggttgtgtccaaaaaactcgctaacgagtgcttaagtagagaaaaactcggaactttttctcgtactgagtcttaaggccaaacgccggtcacgagctccatgtggaagttttcggtctcgaaataacgcaaatttccaggccccgcaaatttccaggccccttcgttgctcttggcagagagaaaggatggattaatttcacggggacgacgaacgccagcagagtaagtaaatcaatttgtcctgtgattcctctccgatcagcagtgatcagtggagaaagaaagtccgatcagcagtgatcagtggagaaggaaagtccgatcagcagtgatcagtggagaaagaaagtccgatcagcagtgatcagtggagaaagaaagtccgatcagcagtgatcagtggaggaagaaagtccgatcagcagtgatcagtggagaaagaaagtccgatcagcagtgatcagtggagaaagaaagtccgatcagcagtgatcagtggaggaagaaagtccgatccagcagtgatcaatcagtggaggacggggaactccccgggcgcgctttactacaaaaagcgcgcttcactaccaaacaaaaataaatttgttgcgattgtgtgtgtgactgatgtgagagtgacaaggagcgagcgagtaaacacaagtttatatatttgtgcgcattctcaatcattcatttaccaaaatgacacgggtaattagggaaaagatcaaataaatacgctgggggcaaggaaattaaaatggaacggatcgtaaaaatttatgtaactaatttgattggaaaaaaaagaaaattacaacgtccgtccaccaaaaacggaaccctgggaggggggcacttctgctgctgctgactttgaaggaacagcatggggaaattggttaattaattgactttttaatctccatccaatttaaacgggtggaaaagttataaaatttatttttgtcgaactttcggaaaacgaacgaccaatttaatttaatcgcaggtgccaatcagcaaagattgccttttataaatgaatgctggaaactaatcttaagatttttttttagaggtgcagccgggaccggggaaatttgggcaaagaccgggaaccgggacttttcgggttgaaaacccggggactttttggctgggaaacccgagaaaaaagccgggagtttcccgggcccggtcaaaac

SEQ ID NO: 1379 - DNA, 9736 bp, Heterodera glycines
ttgttttgataggatttagttatgttaaattgaaccttcagatagaaggtcttcaaatggctttgaaattacaccaaagtctttgcacaattttgccattgaacatatctggctgttacagctgttcaaccggagcacaatttaagtatgtgtgctcaacaaattttggcaatgcatttgctgaaattacatgcgacgatggaacacatttttccacaaaatgtgattccaacgccacaatttaccaaacaattttggctttcgataaagccagaattcaaactaagtgccaaacaaaatgtttggcaggaaaaacatcatttgaaattgctggaacattgcattatgtccagtatcaacaattggaagattttaattctaatctttccaaaaaacaaatcggccattcaaattggctgaattggaattttgattggaaggccacactttggtccttaattggcctccaatcatccttacattcttaatgattattggtgtaggcattatttgcctcatcattttcattaaaatttcacccttctataggctttggaaattaatttcctggtctctgatgagaagggactacggtacattaaatacagcaataatgatactgtatttggcggggggaggatcctttggatatgatgatgagtcacgtccgatcagtcctatccccgcccacattctgaaaaatcctataaataggatagaatttgactccaacacatcattcacaatgtccagaactccattaaacgacatcacaaatcaccgcagccctggtcaaaatcagggaaatgcggcgcgaactcgttcagcaatgggtcgagaaaatatcgacccaaatgtccctattgagggacataatcttcccctttttgaggaagaaattccattggagaatccatggaattggagaaatttgactgaatctgattcagattcagtgactgagatcgcaagggaatttagtccaatgtctttggactcggacccggaatggacgtggaaccctccacgttccatatggccaagaaatgggagggagccattgagtcaatggtttccccgtgtcatgggaaatcactggcacgaaagagaaagacgatctgctgaagcgctccttagggacttcctaaggaacagcgcatttttaactaccaatcacctggccactaaccgtgaaatcatcttcgatggattgtcacgtagcggtgcagaacggaccaacatttatcccggattcaccgtcctcaatcattttgagggacggggaataaccatcaatcctcttgtaccattggtacaagagtgtggcgggtttagtccccgccgcggcgaaattcacatggattatttccccactgaagtggtggacttatgttattttgagagggagactgaaatcccccaacaaataaaccaacaattacgacaggacgacacggatccgggaggaaaccggaacctccgggaattctcagagccaccagtggctcgagaccgataatcggatcggtcaaccactgatcaggattggaccgaaccacaggaaaccccaaatagtcagaactcggattttggtccgagtcaaatcgagaggtcgggaagcctgagcagcattccgactatttacattatttttttcactattttttattgaaaatgtaatgtcaattacggacactttggaatgtccgcttaatcatataattaacaagcaaatggttgcctgtgttcctcagaaatgattcagtgaatcatctcatacttactggaaacaccagtgagctcctccttcattcagagggtcgggagcaatcggaccgtatttaagcagaaaagtgaggagggagaaatcacttctcctttatttccaaaaatgactaagtcctcctcttcctcctctgagggagaattgtccgacgcatcattttcgccaaatgacaagattcccctttgtcaaagggggatcaaaggaaatccgctggagctggtggacgcggcccgggcggtaagcaataccacccggagaaaggggaaggaccttcggagtctcattgactccgaagcgaaggaggtggcacgaaagccgcctactgttccgactgcgggaaggaagggcatcggaggggcgctaaaaagtgcccctctccgaaggaggatcgggcggaatcctcccgaccccccgtaatttctcctaaaattaaggatactctgccgaaaaaggcagagggtcgcgcacgattgccgatccgagggccagtttcgatcgcccctcggaagccctcgcctccatcgccaaaggtcaaggccacgacagaatcgagcctgcgccgtcggcaacattcggatttatccggaatggcatgcccggatttatccgggttagccaggatttcaacggacgggagacccgggacgagcggctacggaggattagcaggatctctacgaatgagagacccgggactagcgggtatggccacagaaccgctagtgccgtcgaaagtgaactgattgaggccgtgaggagccttcaatcagtcgtggaagaactgcggaagagcatcccgccaaaattgacgggaggcaacagtgaaccattaggccaccgaaagaagcgccgacaccatgactcttcgtcctcctcgtcgtcctcctccgactcggagactgaaaagcggaagaaaaagagaaagaaggataagaagaagtgaagggaaactttggccgcggaagtattgtcgcggaaagcgacaaatgatatattttgataataattaatattttttcctttcattaatttagtatttttctctattttttattttgtgtgttactggttctctccctctttctttctctctctctctatgcgcgtacgcatgcgcacgcgtctctagggctataaaagccgcaccattcgcctattggggcacttcttctcacttctatttaatatttatatttaatcgtcccttctccatttattcacacatttatttgtgactaataaaggaattgaaaaagggagtcaaaaatcgaagagaaagctcttctcgcataagcatacaagggaaaggccaaagcctcttcctttgtccaacaaatcaattaacgttccaaaggggaacgttgaaagggatcgaaatccctttctcttttttgtccattccgcgacaaaaattggagccccgtaggggtcaagctccagtcgtagcttaccccctcaattgagagaagtccaagctttgaacaaagcttgtccaacattcgtaagagatgagtgaactcttacgaatcacaatcgcgccgattgtgaagcgtctcaagttgtacattgagacggctcaggaaaatctgacaaaagatttgactgaggaaatcagaacagatttgcttgcagagagacaaaatctctgtagagcagtatcattgttggagaaaaacaatgacaagtgggaggctgtcttccaccgagttaaaggtcctgctcttcaggaagaagagcagaactacaaggactacaaacctgaaggaaaagccttcatggaatgggccgaccaagcccgagggcttgtcgacaccattgatggggctttaggcctctcagaacagggggacgatgtcgttcaccctgcacaggtccaacagcctgttcaaaacattcagccacaagtggttgtggctccgcagcgacatgaagtgatgttgccgcccatttcgcttccaaaattttcgggtgaaccccgagaatggcctttattttggaagctgtttgagacttccgttgaaagtcttcaaattgaagacttcaaaaaacacatttatctcttgggatgtcttcccgagaagtcagttgctcgaagagcaattgatttgtacccgccttcagatgaaaactacccgcgagtggtagaaatcctcaagaaaagatttggggatgagaagtcaattgtggagacactccaatcagagttgctccatcttccaaaaccgtcagattcggttcaatctctgaggcagttctcagagtccattgaaaggatttgtcagcagttgtcagattttggagaaaatgaacaaaataagttcatggcctccacgataaagtccaaattgccataccatctcctcactcaagtggtggagaaggaaatgcgttcaggtggaacatttgattgttccgacctacgcaaggcaatcacttccattgttgaagtgaaggaagaagtacaaagatgtacacaagtcttccgtggggaagaaaaaccccgaaattttcctcctcaaatgcagaggaacaatttccaagggagaggaacaaatttccctcccaaccaatttcgtcagggtcattggcgacccaataacagaaatgagtctgtggggatgatgtctccccaaatacacagatcatttaacactgtcaatcagagggaacaaacacacttttctcctcgagaacgaggaacgaacccactttgttctctttgtagtgacatgggacacgcaccaagcaagtgtccaaaatatccaacacctggagcacgcagaaggcggcttgcagatcaacaacgatgttttaattgccttatgcaagggcacaattctcaacaatgcagctcatcaaagaggtgcccaaaatgtggtgaaaaacaccacttcatgatctgctattctgaaggagacgctccgagaggaagcactcctcaacaaacatccaaaggaggggctgttcaaaagaaacagtcctccaatagacgaggagaaccacctcgtccaacacaaaatcatttttcggcattaaatgaacccttaagaataagggaaaatccgtctgaaatatcaatttttgacggaaaaagaacaaatgttttaaccagcgttgtgacaaagaagtcacacgcgtttttgatgacccgacgattgagggtccggtcaagtcgcgatcctcgtcgaatgatcaaagccatgtttctttttgacccggcgagccagacttcatatatgtctgacccgctaatcaaaaaactgaaaccacataaagtgacttccgaagaaatggaagtctacggtttcggtggtgaaaggaatggaccaatacggttccattcacctgtctactccgttcaaattcaacggagtgacaataagtgggaggaaatcctcctcaatcgaaccgagcaaatttccactccattcaaaatggtggagtggaattcacatgattacacatcggaggagcaggatgttttccaagctctaagtttttctcaggacgaacctgagattctcataagtgctcggcacttttggaaatttttccaaagcaaaaaggaagttttgcctgggttgtttgtcatccaaacaacactgggtcctttagtcaacggagaatcagactttggaccaaatgttcaaaatccaggactgtcaatgatgaccattgatgagtccaatcaagagcagatgccagctactaaagaaattgaatatttctttaatttggaatcgttagggataaaagaagaccctaacgaagacgatgatcaaacagcaatgcagctgtttgacaaatcaatccgtcgtgaaaacggcggacgatattcagttaaatggccatggaagaaagagacaccgaatcttccctccaactacagaatggctttctcaaggttaatatcgactttgaataagctcagacattctcctgaacttatacagcaatataacaacacaatccacgaccaattatcaaaaggtatcattgaagaggccagggaagcacctggcactcttgagcactacattccgcatcaaggagtgttggctaagggcaaaaaacttcgcgtcgtttatgacgcgagtgctcacacaaggggtacaaacagtttgaatgactgtttgtacagaggtccggtacttttacctgatctcatcggaatgcttttgcgattccgatgccccacatttcctcttctcgcggatatccaagctgctttcttgcagatttatttctttggaaccagaagatagagaagtcacaaagtttttgtggctcaaagacacggaaaagccactttcatcggagaatctgataatatacagattctgccgagtcgcatttggggtgattagttcaccttttatcctagcagctacactacaatatcatctaaaaaattgtcgttcgattttggctaaagagttagccgaatcgctgtatgtggacaatgcgctcatggagtgtgaaactccagaagaggcattaacaaaatataaggaagcgaaggctatccttaaagaaggctgttttaaccttcgggaatttattacaaattccaaggaggtgatggaagccatcccccctgaggacagactcgagaaagccaaagtgaaagtgctgggacttatttgggacattgacaaagacgacattgtctttgaattcccatctgtcgattcattaaagatagtgaatcgacgtctcgtcctgagttttttggcctctttattcgatcctttgggattgatgggcccatgcatccagcctttaaaacttttcttccaaagtttatgggaggaaaagaaaggctgggatgatgccctctcagaagaggactcgactcgctggaatgctttccaagaatcttggaaagacaagcgaatccgagtcccacgaaggacaatgatacagggagaatgctcccttcaattgcacgcatttgtggatgcttcgatccacacatttgcaaccgcaatttatctccgagtggagagttcaaataaaattcaaaattggttgattttctcaaaaaatcgccttaagccaaagagtgcttcgaaagcactcactattccaagaatggagctgatggccattcttattggaattcgaggcttaaaattcatacaaactcaattgcgccgagcaattgaacactcctatttgtggagtgattctcaaattgctttaaattgggtggcttcaaaagaagcccaaccaaaattcattgaacggcgaatcaaagaaattcgcaccataacaaagtgttcgtttcactttgttcgaacagctgaaaatccggctgatctggcaacaagaggagctacaccagaagagctctcaacccattcttcgtggtggggtgggcctaattggctcacaaaggaccaaaatcattggcctcatgaactcttcttcgagataaaagaggaagagttacatgatccaccgaaagaagatgaaaaaatatttttggctcatacatgtgcagagccaaaacagcaattatttaatgcaaagaggcaccattcctggaccaagttggtcaggacagttctctttgtaatacggtttctccatttgaaattattaaatggaagagacccttcagagctcacaaaaaagcaccggaaggaaatcgtcaaggtttctaaaaccggaccattcacagcagaagatgttctgctggctgagtaccttataattcgtttggatcaatttaatgatccagatgaattcacaaaatttccctcactaattgatagtgaagggattctcaggctgagaacgagattaacaagaagtgaccaaccttatgggttttcacatcccatacttcttggaaagaactcggaaatccgagatcttatcattttgcaatgtcaccaaaaaagacatcacctaggggtggacagcacccttacggaatttctcaacaattattggactcctcagtctcgaacggcaataaaaagggttataaaaaactgccgtcgatgccgaaggatgaaggcataccaatttgccttaccaaaaatgcctccactgccggaggaacgagtctgccgacaaatgccctttaagtcaattggaattgactttttggggccaacagagacacgattggcaggagtgaaagtcaaggcatggataattatagtaacttgcctcacaacgagagcagtttacttagaagccatgcttgacacaacggccgaatcttttttaaatgtcctccgacgattcattagtcggaggggaaaaccagacttaatttggagtgacaatgccacttcatttaaattgtctcaaaaaacgattgagcaattgacaactccaaagggagttgagcaaaacaaagatgaatttcttgcacttaataaaattaagtggaaatttatcgctcaaattagtccatgggcaggtggcgtttacgaacgcctcgtgcaattatgtaaaaattgctttaaacggacattggggagaaaaatcctcaatttcgatgagcttaacacttttgtggccgaagttgaggccactctcaaccatcggccaatcactgttgtgtcagagggagcggatggcattcagccactccgcccccatcgacttacttcaacccgatttacagataaattgggagacaacgacggaagaagccgatcccaacgacaagcaaatctcatcctcggagaaattggctgctttatttaaagcaaccagagaagcccatgaaagcttctggtacaaatggcataatgagtaccttctccttcttagagagagatctaagtgggatcacaaaggcgctcatctcctagataaaggagaaccaaaagaaggaatgatcgtcctcattcacgaggagttcactcctcgaaatcagtggactttgggaaaaataattgagcttaatggcagaccaggtgccattagaagcgttcaattagaaatgccaattcatggcattaaatcaaaaaggtatggaaccatgcctcgaaaagtcgttattacacgaccagtcaacaaaatctttccattagaggtaggatttgaaaatcttaccgaaaatggcaaagaaaatttgaaagttaacgaagacgaaactgcgaacagttcaacagaaaatacaactcctcatttgggaaataaattgccaaatgaggagcaggaaaatgaggacaaaaattctcatttgggtgaaccaaaagccaaccaaaacaaacatggaatgattacccgcagtaaagcaaaagtgatgacagttcttaactgtctcactattttctgcatttttggattggcaggagcctatccaacaaatcaatgcaatgagtgtaaactcatttgctcaaacaaaggtgttttggcaaaaattccgaaggaaattcggaaagtggaactttgctgctctgagaattgttacattgatgagaatgtacacaaactcacatatgagttgccaaaagaaatcctcctaaatgactaccaatgtcaaggtcatttttggatggattcaaagcacatgtttaaaaaggacattttatgtccagcagtcgatgagtgcgtactcatcgaatgctatttatgcatggaacaattggcaaatccaacgtgttatccgttggtgtcctccatgttagttggaggacttttcctttccttaatgagcataagctttatggtttattccatattgaaagttcttttttctggacttcacatgattatttggctgataatccaattcatcaggccaatagtctatttcgccgtgccaaaccaacatcaaagagaaaggaggcaaaggagaacgacttcacacaattggacttcacagcgtgtcttcaggacaacagcattcattgtcctttttgccgtctctctccaccaatcagtggagcagagactgtagcaattatgccaaagcagaaa

SEQ ID NO: 1380 - DNA, 3305 bp, Heterodera glycines
gctggtcacagattttaaaactcgattaaaaagtaaaaaaactgaaaatcgctacaatagtaattagataattcattacattggaagtaatttaaagattttgaaaatttgagaatttctatagaaacttgtttttgtcttgcttagaaacggaaaaaatgaaaaacaaaaacaaaatttgatgaaaacataatccatgtgaaatgaaaaaattttaaataaattcgatttccgtcgattaattccaaatttttgatgaaaaacaaacaaaatgtgcattataaatatcgtatatttttgttttcagacacttttttctgttgtaaatttacattgaaaataaatttatttaatattttttatgaattaattttttataaacagctatatatacctattatgcatattgtacatttcatcattttaattctcattcagattataaattttgaaatgatttatttttcgatttttcttgccacattaattttatggtcaacaatttttcatgcgtcattaaagctaataaaaaaaaggaatttgcattttgtttttttctttgtttcactgaaaatttttctggaatgcgcatgtcaagcgcatcacaattgtccacttctgtccaaatgacttcactgtcgtaatgtccactgtccaaatgtccacttctgtccaaatgacttcactgtcgtaatgtccactgtccaaatgtccacttctgtccaaatgacttactgtcctaatgtccactgtccaaatgtccacttctgtccaaatgacttcactgtcgtaatgtccactgtccaaatgtccacttctgtccaaatgacttcactgtcctaatgtccactgtccaaatgtccacttctgtccaaatgacttcactgtcgtaatgtccactgtccaaatgtccacttctgtccaaatgacttactgtcctaatgtccactgtccaaatgtccacttctgtccaaatgacttcactgtcgtaatgtccactgtccaaatgtccacttctgtccaaatgacttcactgtcctaatgtccactgtccaaatgtccacttctgtccaaatgacttcactgtcgtaatgtccactgtccaaatgtccacttctgtccaaatgacttcactgtcgtaatgtccactgtccaaatgtccacttctgtccaaatgacttcactgtcctaatgtccactgtcgtaatgtccactgtccaaatgtccacttctgtccaaatgacttcactgtcctaatgtccactgtcgtaatgtccactgtccaaatgtccgggagcctggctatttttgagaattttttccaaaaatcaacataaatcagtaagatttaaaaatcttgcgctttaaagtcataaatgtactgaaaaatggatgaactaattaattaataaacaacctaagtagggcttccttttttaggcacaaaaaatagcgaaataggcattaaataggcacaaaaatcctcaaataggcactaaaataggtaattaaaaatttttattaacgctttttaggtaccaaaacacttaaaaacataacaatttcaattgtataaactttttttcgaataaggatataaacgaaaaatttttgttatgaagaaaatataaaattttcgggatcaattttgggaaaattttttcaattcttagggggagtattttctgaaattttttcgggccatttcttaggggtgtatttttggtttttattgcatttttttaaggattttttgcgaatatcctgaaaaaggcacatttaaattccacacatttaaattttttttaaatcaattctacctcagatgcataatcaacccgcaacgagaaagtaaaattttacccgcgaagatttggtctagtaaaagcgcattaaagccatttttcaattttacctatgtatgaaaaaaatttgcagaaataaaagtgttattaaacaacagattttaaaataaaagaaatgtattggcaaaatcaaactttatggcaatattgcacatttttttccaaacaaaagaaattaaaaatatattaaaaatataataacaaaattattcaatgcagaatttttcagttcttaaattaaaaaatttcaagtatacttttcatattcatgtaagttttttttaaatttctcggaactgtcgaaatcacatttcaccgtttttagtccatataatttataaccctagtaataatgtaataaaacatggttagatgaaaaagttccaaaatttgctctaaaaagactaaattgattatttctcctgtttataaaaagggaattttggaatgccatgcattttttcgtaaaacaacccaaatttacatctgagggaaaaggaataaattaaagtgcgattaaaaattcagtgattttgctttgggtttcgttaaatttttcgtttcggtttagtgctaatcctggtctgatttttcaacaatttccgattcgttggaagcccaattcatcagccccattcatttttctattatttttggctttacatatattttcttcattctcgcatttgcttttgaaaaaaaagaaaaacaaaatttgatgaaatcattaattcatttgtgtgggggaattttttttggtgcattcaattttcatgaacaaacaaaaggtgctgggacgttagtcaaaaaccatcaaatgaataatttttgacagaaaattattcataatttcgtctaaaatggatcaaattttataatattgatatttttcgatagccctaaatgttttctattatcctgcaaaatttttaaaaaattctttaagtttaaaaaaagttatgacctgagaagctcaaaaaaccaagtttttttgaacatttttagtcataactttcttgaaacttaacgaaactttttggaattttgtaggctaatagaaaacatttagtcgtatttaatgatatcaagaatttaaaatttagatgcttttgaacaaagttatatcaaaaaatattttcatttgatggtttttgactaacgtcatagcaccaaacaaaatgtgcattaagaaatattgaatattcaaaataattaataaatatagcaaaaaatgaccaaatagtggaaaccgtagtgtaaactctgaacagaataatgcttttaatgcaaaataaggtgctaggacgaagtgacaaaaatataaatgacttcaaaaaattacgatcaaaattattcagtctacattttttggaatttatgtttcattatttagcaaataaaagaaatatagctggggctcccgttttttcgacagcaaaa

SEQ ID NO: 1381 - DNA, 4925 bp, Heterodera glycines
  misc_feature (3642)..(3642): n is a, c, g, or t
  misc_feature (3672)..(3672): n is a, c, g, or t
ataaacagctatatatacctattatgcatattgtacatttcatcattttaattctcattcagattataaattttgaaatgatttatttttcgatttttcttgccacattaattttatggtcaacaatttttcatgcgtcattaaagctaataaaaaaaaggaatttgcattttgtttttttctttgtttcactgaaaatttttctggaatgcgcatgtcaagcgcatcacaatgccctgccccccccctttttcatcatttatttcccctttcattttaataaaattatttccaaaataattacaataaaattaacaatcgcttttttacaaattctctttaagaattgcaatgccttcatttaaatttgtatgtttccaatttttgctaatttttgtgctcacggaattggcacattcagagaaagggtgcccaaaaacagaaggtacgtaccgtaacccattttttttgcgatttgaaaactgttaatatcgatgttgattgtatttctatactaattgagctgaaaacgttttcacagatttaattgaaatgaccaaacatttgctgacaactgggaagaatgtaatttctggtgaagcagcttcatcatccagcgaaggaaagtgcagtgatacggtaatggaaagtgttgtaacaaaagttattgaatttgggtgttatgacgaaatggaaaagaatgacgacgaaagagcgaaaagcaaaacgaaaaacgcatttattgaaagcattgaaacacaacgaaaaggtttttgccaactttggcaaaacggcaaaagcattggggagaaggagcaaaaagatggcattttgaaaatagtgaaaggattgggaggaattgagctgaagaaaattgaacgaattcttgaaaatgttcaaaacattggattatcgctcagtaatgaaaacaaagcaaaaatgccaacactgatcggtcatttcgttaatggtttcggcatgttccagttgctcattaatggtctgtgtaagcagcaccaagctgatatgataaaacaaaaatttaaattttatggcactaaattagtttaacggtttctctaacagtcttttattatcctaattaatatagattggtgcagggcgggtttcccgcgcgggattgcgtgatcatagtccgcaatcatgcatttggaataagcccgcgagatccggtcccgcaaaaaatttctgtgttcaaatcccgcagcggtacacgcaaatttgaaatttccagtctctatcaattagcaattaattgttggtaattaaaacaattaaagaggaaagggtatttttacgtaaaaaacccataatatgtcaaataaattgaatatatttaaacagcatgccaacttgtaaaattgatcacaaaatgcgcagctcccttccaaattttagaaaagcaaatggttattccgccgttagcatcatcagcagcagaaaatgcgttggtgacgcagcaaaagcgacgcacaaaacggggctttgaactgttccgtcgacacgacggctgcgccggcaattggagcacgggccaagaatgcgcaggtggagctagtatctttgtgctgtccatctttgtgatcattctgtgcgcatttcgactgtcgcacgaggccaaattgcacacgatgtcccatccggggaccatccaattaatcgcattgctctcactgattgccttctgtgtggctctcatcatcggcctttacatgatgctccgtggctgttttggcgcaaaattagacggaggttcggcatggggccgaatgtgttagagaagaagatgaaaggggtggggatgaactgctggcgacgaacattttttttgtcaagggggattttcgaattttctgtttttcctttttcatttggtctgtggaaaatttgtgccgaaattttcggcccaaacattttcgcctttgctttttttaatcattggtagcataaaaaacattaactctactcattgtatgtcaattaattaaccattaattaagctgcagttaatttgtgctacatttttattttcataaattttttgtttcaaaccgaccacaacacaggcgaaattggcctgctgctgatacgcatgttactgaatgggcgaagcgggccgttgcgtctgacaataagcaaagtttaaaaccgtgctgagacaaaccgaaaatagtttcagtgtcaattaaaatattaattatacaattcaaatagatgtcgaaaaatatgaatttaattatactattaatattaaaaatataaacagaaaaagatgaaatcattccatctccgaacaaaaaaaatcacattgaaacgaaaatttaattccaattcttgaacacatcaaattgattggcaagtcaacttactagaggattgttcatttttagaaaaaaagcaacaacaaatctactaattttcttcttaaatttcacccaatatttattaaatttaagttctttattcgattctccagaaatttcatgtgtttttccataaattttccttcatccctattctttttccactaatgttacaattgaaaattgttctccatttattaattgtacgaaaattatcatttatttcgagaactttttgttttatttatacatttcgatagtccaaagatttttctattattctgttaaatttcagaaattttttattaagttttaaaaaagttggggcaaaattagtgagtcaaaattttttggaattttttggttacacctttttgtaaatttataaaattaaataataattaaaattaaatatttcaatcattgatacttttgtaacttcgtcctagcacctaaaaattcggtaattgaataagatattaatttattgcataattttaaatgatatttattttgaattaaaaattttttttaattgataaattttctgtgcgttattaagcggtttaaagaaatattaaatatcttatcaattaaacaacatttcgtcacaaataaaattttatttttccaattccttcatgtattaccgttcaattttttattaatatatttagatttctttcattttatatgttatttttaattttaattattttatatggcatcggaattataataaacggcgttgtaattttggtcatattaacttttaacaaaatgagaaaatcctcgatgaatttgcttctgttaaatttggtaagagctctaaaaatatatcagtttttcaaatattgaaaaatctccgcatttatttggggtttttctcatattttttttcttccacaaaatgccactgttgccaaaataatgacagtccctggactttgacttggaaattgtggcaccattcccttccccgccatccaacggtgctgcaatagacgtgccgaagaaaattttgaaattatagagatttgttaacagtttattacaataaaactggctaattttggagtttgaaattacaaaagtttcctttttcccttaaaactttctatctcccctatgggaacattaaagagggccattccaaaacaaatttgttttgaaaaaaatttcatacatatatttttattttcagggcttgtccgatctatgtctgctgtcaataactcgcttatctatgcccaaatgnttgacgaccattcttgagttttactgattnattgcatttcaattttttgaaccggggttggggcctgccccattctgcttaattggcaccgggggggaaaggaagttcaatcctgcaaagggatgaaaagggggggggggggggggggggggggggggggggggcgcggctcctttttttttttttaaaaaaaaaaaaaaaaaaaaaaaaaaaaaaaaataaatttttttttttttttttttttttttttttatatgggggtaaaaaacaaaaaaaaaaaaacaaagaaataaaaaaaattttttttttttttttttttttttttttgtatgacaccacaaaacaaaaaaaaagaaaaaaaaaataaatgttgtggtgtagcacaaaaaaaaaagagaaaaaaaattttttttttgggttttttttttttttttgttttgtgggaaaaaaaaaaaaaaaagaaaaaatttcccgggtggtttttttttttttgggggggagaaaaacacacaaaggagaggaaatttctctcggtttttgcgccacacaaaaaaagaaaaaaaaatttaggtttttttttttttttttgggggaaccaaaaaaaaagggaaatttccccggtgtttacccccaaaaaaagggaaaattttttcgggggtgttttttttgggggtgggggcaaacaaaaaaccgggaaattttcccgtttttttttttttgtgaaagggggccaaaaaccgggaaacatggggccacccccgaatgggaatttctccgggtttgggcaccaagggaggggggaaatttttccggggggttttttcgggttatgggcacccttaaaggggaaaatttttgggttggtttttttgcgtggtggcaaccgggaaacggagaaataattcggggtggttttttcggtaggtgggcaaacaaaaaattgggaaatttcccggatgttggcaacatgcaacgggaaaatcttccgggtgttttttccgggtgttggggaatatgaaacgtgaaatctttcggtggttttttcgggtttgcaacatgaaatgggtcattttatgtattaatcattggcttgaagcagttcaggcgcggtaaagccaccgattagtccgaaaaattatccttgtcaatttccttttttgtccattcgaataaagaataggcgcttaaaaaacatttgactaaaaatgaattattatttacattaaatttattagtaatatatttaggtacattacgctcaataagagaagacaaaaatcgcc

SEQ ID NO: 1382 - DNA, 3448 bp, Heterodera glycines
tgaaatttggggaaaagatagattgtgatgtggatgaatttgaaaattttaatgagattattttatttaaaagaggtgtaggagggagaaaattttgtaaattttttgttattttttaataggaattttgggtttggggttaaattatgaaatttaaatgaaatttttgaaaggttaaaatttgtttaataaaattttgtttttattttaatgaattggtattggtgataaatattttataataatgtggagaaatgttttgtaaatatagggaggattgtttggaatttcttggggtgttatgggaagaggggtggatgataaagaattaaaagaatagagagatgaaaataggtgtataaaaaaaatatggttaatgttggagtttgataattatataagttagttttttatattaaaaagtttatatgtattttatggaataattagagagggattatgccaacagaatgtttgaaataaattgcatacatatatttttaatttcacggctccgtccgaaccatgcctgctgtcaataaactcgctttatcttatgccaaattgtttgaacgaccaattctgaagttttcactgatttattgccatttccatatttttatgaccggcgtttgtggcctggtctctattctgacttatatggccatctgtgtggaaaggtaagttcaattccatgtcaaaagtggggaaaattggctgggaggggggggggggggggggaatcccgcatttttgacatgaaatgaaaatgcctagaaattagaattttaatgtggcatttttggttttggtggcgacgatgggggtgtttttctgtgctatatttcaatcttcaaaaaatttcccgtcattttttcgtctcgaatccctctttttttctgcccgtggtaactctgttcgacaatgccattacgtcaagaaaatgccatcaccaaagttctcgaaattataagaaaattaaatgacctccgcataatgaccaaaaaattacattttaaaatgtgttttaaatttcaattaagatacattgtaattatttgtcctcttcacgcatccaattggtgcacaaggagccgaattttgcttgtgataaattcaatttgggcatttgccattatgtacagactaccgtattttgatcttattggcacagaaaagcgtaagaccaatttccaattacaacaataaaagtgaccgggggaaaatcactccgggggatttacagtggtcgttggttggcctctaatctgacacccatttgaccaattcagaattcccaactcgcacttatgtatgtcagatcacttctttgattttaatagaattccaaatcagccatttttaaataacgccggatattaaaaaggttctcgtagataatttgagtgatttctccaggtgccagagatagtgttgaaagttattagttcgtcgtgataaaattaaggtcctttgcctaaaaaaggattaacgtagatgatggcgattgctgtcccattcttagaattttaagaacccatggagacactaaactaatagaggggatacggtaaaagtaaatattgtgttttttcattcccagatgagtacggttgttttttggagtttcttccatttcattgggtctccgaatttgcgtttatccatctgtcagtgttcatcatatcagcaactctttactacaaaacgtgcaaagtgttgtggtcaatggaagtgttggattacacacggctaaatggtcacagtttaattacctaatttgtatctcaattaattttaatcaataattgcattaattttatccgattaattttcagagcgtaaaataaggcaacgccgaaaagtgatgaaagtgctcattttctgctttgttttatattttctgtgctcctttggatcaatttcactcttcataatatggttctttttatattttacattttaaattatcgcaaaagccaaaaaaggcaaaggaaattttcaaggaaaagcaaaaaaattgagcactttagtaaaaaaaaattctgtttaaataatgcaaaaatttagtgaattgtacgggattgacattcttcggtacgcaattcgactgttcgcaatgcaaagtgcgatcaacccattcatatacacactgatcgggaaacaattccgtcaaaatttcaccaattttttttctcgtatttttaaccataaataatttttttttaaatttctttatttgtattttcatttatcgctgatattccactttttattgcaaatgacttcattaacacctaattgtatgattgatgaaattccatgaaatgtaataatttattttatttttttgggacattactatacattaggcattgttaattgagaaaaaaatgattcaaaaattgaaaataaatatctatgtaaatgaaatgtataaaatgaaaaatgctctgcacatatggacaattaagtcgtttattattttcaatttgatttttatagtgttttggtgtcagcacactctccacattttgatcactccctcacggccggcggacacgagcaaatgaggccataatgtggccaaatcggtgatgctgtcccaatgggcttctggggccttaaaaatggatttatggaatgaatataaattgtaatttcggcatatgcacaacattttggagcattcgttgtgcgtgcggttgatcgcccagcattgggttaatctcagcctcgggactgatcagctgagaccggtcttccacttgaacacgcaacacactgtccgtgatttgaacttgccgataaccgatccgattgggtgatttcaattgctgaaacaatgcaaaataattgttcaataatttgcacctagagacctccccccatacaataataggcttcatatcgctttttatacgcgtccaaccaatttttagtaccaccacctcccttcaagccataactattttttaaaatagaaaatggctaatcctacctttgttatcaatcaaaacttattgttatcaatcaaaacttagattttttagccatattctggcattaatttgtaaggtaaaaagaaaagtgtacttggaagatcaaattcgaattactctttgtatcaatttgcaaaaactgaccgtttttgtttgtgtttaaaaagtttgagcttttaagctttcgattaatagcaccagacagggaaaattaatggcctaaaaatgagagcggtaagttgattgatgcgaaatatgggaatgagtgataaatgctgtttaagggcaattaggggcgcaaatttctttgtttcaataaatttctgaggcgggataatttaaatcccgcgatcccgaaagatttagaattagcacgcacttgcagatcgccaatgtgcaagtcgctggatggcaaatgcctccggtacggaccgcacaaataggcc

SEQ ID NO: 1383 - DNA, 1052 bp, Heterodera glycines
cgtgatttgaacttgccgataaccgatccgattgggcgttttcaattgctgaaacaatgcaaaataattgttcaataatttgcacctagagacctccccccatacaataataggcttcatatcgctttttatatgcgtccaaccaacttttagtaccaccacctcccttcaagccataactattttttaaaatagaaaatggctaatctacctttgttatcaatcagaacttagattttttagccatattctggcattaatttgtaaggtaaaaagaaaagtgtacttggaagatcaaattcgaattactctttgtatcaatttgcaaaaactgaccgtttttgtttgtgtttaaaaagtttgagcttttaagctttcgattaatagcaccagacagggaaaattaatggcctaaaaatgagagcggtaagttgattgatgcgaaatatgggaatgagtgataaatgctgtttaagggcaattaggggcgcaaatttctttgtttcaataaatttctgaggcgggataatttaaatcccgcgatcccgaaagatttagaattagcacgcacttgcagatcgccaatgtgcaagtcgctggatggcaaatgcctccggtacggaccgcacaaataggccgacgaatttggatgtcgcaaattccaacagcgcaaactcccttccgagtcaccagtgaaaattatgttgcttccgtcgatcattgagggaaccacggcggttgagaccaattcggactgcaaaaaatgggggagaactgaataaaatgagaggtagataagaggaatggacgacttaattactataattgcacactcactaggatgactaattacattcactaattactttataagtgagaggagcttcagtgctcggccaaagcacatccgtccgactgtgtgttgacaggtcccaaatgcttctgtagacaaaacattggcattttttaagattattttgaataaatttgacggaaaattggggcacagggagagatttaagcatattttcgaaaatttcatgatgaccgtt

SEQ ID NO: 1384 - DNA, 1435 bp, Heterodera glycines
gggaattattcggtctgatggatgcgaccaactggacacttccaggccagcaaaactgtgtaaaatgcggggggattagtacagaaataaagtaatgaaaataaggggggggggtggaccccgaaccatttgcttgcaaagggaccaaaaaattgaataaattcataaaaaaattccataattttcacggctcggaacttaaaacgcatcaaaaattttaaagtttgacccaaaattgccgattgttggagttaaaattgggggaaatttttcaggcagcgcatcgcccgattggccccaaaactcccgaatttccataaaacaggctcaaaatttttggataaaaatgttgttaacaaattacattcaaatttttcccggcagcgcctcaagtttttttgaaaatagtgcaaaaaatgaatgactaataaatgcctcaccgtaaatcccacaaaagcatgtttttggtggtggccgaactggcggtcaacagcatccaatgctgcttcactgagtcaatgcaaaaggatgtgatcaggccataactggaattggagttaaatgaatgcaatagtcattggttaagacatccatcacctgtttttgattctccgttgccaaaccgaagaaaattcaatggcattccgtccctttttgggcgcaactctggaaaataattcctcaaatatttgaaaaaaaaatttttggttaacggtttagacagccaataacagattactagaatttaggtgccggatcgttactcaaaacccatcaaaaacatttttgttcataacactttcttgaaacttattttttattttgatggttttttgattaacgcccattttgatggtttttgagtaacgtcatagcaccttattttaaattacaataattaatagttgatgaagccagataaaggaaagagagagcgagagagaaatgtggaggaagctagagagagaaaggagagagagtgcgaggaaaaaaagaaaggaagaagagaaaaggaaaaagagaaagaattgagaaagagtggaggggagagaaattgcgcatatgagagatagagagagagtgagagagagatagagaaagagagagatagagagagacagaaagaaagtcgtgctgcttcatttctgattcactttttcacactgaccacctcaaatcgtagcagaacactgatgagtgatgggtcagtgcatagatcagatggtcaacgcagaacaaatcgctgaccgccccctccgcgtcgcggtccaactgcaccgatttgagcagcgttttgcgctcaatgtcgaacatttgcagggacgcgtccgcacacgccatcaccaggtgcacgccctggtcgcccatgaagccgcaggcgttgatcgcgtgcgaatagcgcagcgtgtccagcgacatggcggccggctgcgag

SEQ ID NO: 1385 - DNA, 3482 bp, Heterodera glycines
ccagtcaaatcgcaaacctaaatttttttaaaaattttcctcctcttaaagggctgattgtgagatttaactcgggtatatttttttaattaccgtgccgtgggtgtaagtcactgggtaataagccaaccgttcgtcgcccattttgcgagtcggcgggttcagctggtcaaaatgtctggcctcctgaatcagtgaaataaataatcagtttttgtaaccgaaaatgaaaaagtttttaaaatggttagaaattgcaattatttaataatggtatgaaaagaggcttttgtttgaacaattccgtattttgaacccgaattttaatcaaagtttgaatgtgttcccaaattccacacgctttgagttcaacaaaaattcgagtggaagggggagaaagcggcaacaaattattcgaattttgggggtaatagcccaaaaaacggaccacttcagcgttcatggccacaaaattgcccagaaagtactccgtgcgcttcttgctctccttgtcctcgtggtactgcagcacataccgtccatggcacagctcgtagttccagtacggctcgatgcgataggagcagatctgctcccggtagatggattggatcagttcggccggactcggcccgtggtacgacttgatccgctttttggactaaaacaaattttaatccaatttaaaaacaaaaataggtaaaaataaatttagaaaatacgcacagacgaggccaacacgggcaacacgcattggtattcctccgcgtcagcagacacaattttgaccaatttgggctgttccgcagtggccgaactgctcgaaaaggacgacgacggagaagacaaaggcgaagactgactttgctgttgttgttcacttccatcaatttcattatcattatcttcatgctgctgctgcaagactaaaacaagaaactaaacaaattaatttaataattgccattttaaaaaggagtggtaaatttaaaatactcaattaagtcggcagtttgaaaaacaaattcgttttatgaaaattacgtcacgcttgaccaccccataacagagggaattagcaaacaacaaaaatttaaacaacaacataaaaaatacttaaatttaactaatcccccactaaaaaaacaagttatttgtagcaatttcaaaatttgaaaaaaggcattcatcgtaaaacatgtttaaattagggacctttttcatgttctgaaattggttcttgtgccgctgtcgttgtctttggagaagcggtcgttggacttattgttgtgggctctgatggaagaaattgctcaggtaattcgtcaaatggcctaaattataaaaataaagcaatttacaaaagtaattaaagcatttattattgttgaaactgacttaaacacgactctgtacgaaatggaatcgtcgagggcccgcaaatattccaattctttaatatcgacgaggcaataagctaacggaagagcaatggccaaaattaatatggccatcaaaaaatgccaatgcattggcaaatggaaaaactcgaaggcaaaaaaaaagaacaaattagcttgattaaataattaatttttgaaatttggcaaaggtgtagaattgcggtcacgccgatgtaaaaaaaattggaaaatttcaaaaagcatttatatgagatgggggccttgggttcgagtccgcttggctgcaaatttatttttttatgttacttgatgaatatcttagacaaaatgaaggttcttgaaaaatcagagctcatatttggcattttatttttcgaattcgctacaaaaaaaataaataaatgtaagtacacgcgattacaaattgtcagttggcactattggttggtccattactcactacactatgggtcaagcccagtgttagacaaaactcatttcgccaaaattataaatggcgtaattttttgcgagctaattcaaaattcacacgggtaaataaataccttttttcttttttaattatttattttatttattcaaaaataaaaataaccaaaagaagggcatgtgccacttacacttttggtggaaatgaggtgaaatggcaagcagtggtaaaagacaattgaaattttgagtggagaagcagaaagtagaaagtcagacctccaacaaagggaattggtttttttttatatacataggggttggagaaaaaatttttgtggaaaatttttaagaaagtttgaactaggtagtttagtagtttttaattttatttgaagaaatagttggaggtctggttgaactatttattgaaaagatgagggtgttgttttttgagcgattgaatttggtgaacaattttgtcggttggtggcaatgaatttaatgtttcataacagacgaggattgttttatcgaaaacttccggcggttgggaaatgtcttcactggtcttcttcttgtttggtccttttgcaacaacgggagtttggtcgtttgtcgtttgtgagaacttcgtcgcagaagccaatggagctggagtctgttgacgttttcggaggcgttcttcgtattcctccttgagttgctctttggtcagcgctgggcggacgaacagacgcgccaggttttgttgagaacggagtcgagcacgctcacgcttccatcctccgagtgccacgtgttgttgtgtgggtgtcggcatgaccaccttgagcgggcgtggagttgttcgctgcgggtcgtaccggccgagtcgaaagacggcggttggttcggcctcaacttcaagatggtccaagattttggtggtggcttccctgtcttcctgaacacgctccgatgggcgaacggcattgctttctgggaggccaatgaacaccagtgtacgttggcgttcttgctctgcgagtgcggcagtgattgggtccaatgccggtgccattgagcgtttggcgcgaggcggagtgatgtttgttgcgttggttcgcttcatgtcgaataattagaaaggaatatttgttttttgcgatcttaattggacaactacgtgtcaaattgctttttcattataaattttatttgtatttattaatttttgtctacaaagtattttaacttttaattgatgataatatcttcgaaaataaaaaatgtatcaatattttatatgtttattttattcaaattgaaacctctttgagcatacaaaaacacgcatttcaatgaattggattaattaggtaaaattacaattagtgaaaagaaaaaaggcgacatggtacgtcgttttttatcatgtggctgaaaaagaaacgaatgtgcaagaaatagtgcatataactgtctttcttccctcgcctgttttacaccccatccaaaaaagattaccaaagtttcccgcttatctataaagaacagagcgtaacatgccatttgtttcctaagccgtttttcactcgctgttcgctgctgtcgacttgtgacgag

SEQ ID NO: 1386 - DNA, 5180 bp, Heterodera glycines
aaatttggcaaaggtgtagaattgcggtcacgccgatgtaaaaaaaattggaaaatttcaaaaagcatttatatgagatgggggccttgggttcgagtccgcttggctgcaaatttatttttttatgttacttgatgaatatcttagacaaaatgaaggttcttgaaaaatcagagctcatatttggcattttatttttcgaattcgctacaaaaaaaataaataaatgtaagtacacgcgattcaaattggcagttggcactattggttggtccattactcatgggtcaagcccagtgttagacaaaactcatttcgccaaaattataaatggcgtaattttttgcgagctaattcaaaattcacacgggtaaataaataccttttttcttttttaatgaaaatgcctaggcttgagtcccattagttcatgccattgtttgctgcatatacctttcagtgcatcaatgtttttcatgataatttctatggagttctttcgcaaaacaatgacacttttggaatataaaaaatagtgacaaatgactcctggtaacagtaacggcttttctgtgcgcagctccgtatcattaatcttaccctttggcaaaaattatgaaacgattatttcaaaatgccactcacaatgtttcggctgacggcatataaataaaatatttaaaagagcaacacgaaaacttgccgtgacactgcaattaatttttttgatttttcatttgatcatatgaaaataagtactatttactgtcataacttatgttaaatttgataaattagtttgaacttttgcaagctaatagagaaaaattctggctattttatgctactaagaatgcaaaatatgattgcctttaagcaaagttatgccatatgctttgtcgaaaaaattgccaggttttgcgcaccttatgaaagaatataaaagtagtttctttctccttattttctcataatcataatgtcctcaattattaatttcataagaagtttttttggcgtttttttgggccggcgcgccccccgccccgtcaattgggagcggcatcggcccttgtgcaaggagacggctgtcaagcggcttcctggttccaactgattttcaggcatgcacggcggcatctccgataagatccgcagcctggaccagctcagcaacttgcttcgctcgcagatcgacccgccgctccgttcgctggaaattgacctcctctgggccgacccatcgacgagcatcacaggcgtcaggccaaatgtgcagcgcaaggctggcgtcctgttcggcgcggacgtggtcgagagcgtgcgcaacctgctcggcatcgactacatcgttcgggcgcatcaggtgagtttttttcgcttttcatttcacattgatttctttcattaatttttcccattcccttttttccagctcgtcatggacggcgtggaatacttcgcggatcgccacctgatcaccgtgttctcggccccccgctacaccggcaagaacaacacgggcgccacgctgctgatcgcgccggacctgagccacacaatcacgcgcttcccgccggcctgaggacgacgagacgaacggacagaacgcgcgcacacacacacactaactgcacacagagggatggcggaactgcccgaagaacgatgcgtgtggagaaatcggatcgtctgccccccattgttgtattgtattgtaaacccccattcacatgatcaaccccccaaaaactgttgtcatttcaattatttgcgtgtttgaatgtatgtatttgtatgtatatgtatgtgtgtgtgaataaacaaatgtaagactaatggtttcgtttttcaatgtgtacagagaaagttctcctgaaattttgtgatttttttgttcaaaatatgtagtaatcagttctccggatagcgaaaatttgagtttggagtcgtaaattagcatcagtagggccccagaaataaacgaaattcgagttttttttcaaaaatgtgtatgtatgtgtaatcgttggaggtcagtttgatggtgagacaaaaccaaacaataacaataaatttaggcgaggcgacttccggcacaatgggaccggccgagcgcactcctcctcacttcaaaataagcgggctgtaccagcaattgggctttttgttggtggtatttgacagtgcatgtccattattttttttttgtgtctgcgggtatgggccgaaacacagccaattaacacacaatggtcggcgagaagatcctctgtaagttttgggggagggcaatttttggggttaaataactgattttcaggtatgcacggtggcatctccgacaagatccgcagcctggaccagctcagcaacttgcttcgcccgcagaccgagccactgctccgttcgctggaaactgacctcctctgggccgacccgtcgacgagcatcacaggcgtcaggccgaacgcccggcgcaaggccggcgtcctgtttggcgcggacgtggtcgagaagcatcaagtgagttttttttttttgcttttcatttcacattgctttcatttcaataattctccccttccccttttttcagctcgtcatggacggtgtggaatacttcgcggatcaccacctgatcaccgtgttctcggccccccgctacaccggcaagaacaacacgggcgccacgctgctgatcgcgccggacctgagccacacaatcacgcgcttcccgccggcctgaggacgacgagacgaacggacagaacgcgcgcacacactaactgcacacagaaggatggtggaactgcactgagaacgatgcgtgtggagaaatcggatcgtctgaccccccattgttgtattgttctcattttgcatgataaactactcaaaaattgcactaaacgatggggctagctcttttggagcaaaacaaattgtagcaataaattttgacgaggcggctttgggcataaaactatacggaggaaaattcagtcgagcaatcccttctcacttcaaaattgagcggggataaggtttactttattagtcttcctgatgcaagataacaaacaattgagcgcaattttatgcacaaaatacattcaattctaaaatcatatgtaaaggtttcctgtcaactaaattttttccaacaatcttggtattttgctagccccaagagtcctctattagcctgcgaaaacgaccccaagccgtcaattaggtatgtagtgatgaatgcgaaccgatgccatctaagcatagtgacaactgagtcccagtgaaaattgataccagtactcaaaaaataattcagagaaaaaaagagcattttaaattcgctttgaacgagattctccttttcaaaaactttttacatatcaaatttgttggtttagttggagatgaagaaagttatggctgatcaaaataaacaatacaaaaatggcacggcaattgtgcagatcattggtcccacaaaaaaaaaaggaataaaaatccaaaaaacacatttttaagggttatttgatgcgctgagcacgaatatgacatgcatttcgaccaatttcgaacccctgacccgaactcgaacattttgaaaaattcaaattttcatttttttttgcaaatgttgctgatacactgattggtactgtaactacaatatgagtaaaggaaatcgaattgattcactaaatttacatacttagatcaataatttcgaataacaaggatggagtaggttggtggatgaaagtgtaaacaaaaaattatgaaaccaggcaaacatttgaatgcatagtacccggtcaataataatgaccagcagatcaaaggcgacaatgagaataatttaaactacttttaatattatttggttgtttgggatgtatgacgtgcacaccaatattggagttgtccgcatcgtgccagacagatctcgcgccacactcttgccgataattgaagaatttgtggtgccggggtccagcatacattccgatcagtgggcagcctacatgggtggcgcaattccagccatccctgtcatcccaccttatgtccaccattctgtaaatcatacaatccacttcgtggatcccttgaccggagcccatacaaaccatgtggaatgtttttggaagaatctcaaaatgaagttcaaggcgatgtccgggacttaccgcgagttgttgccaagttattgtgatgagcacatgtggcggcagttcaacgggaagaaaaccatagtggcatttgataatatgattgatcatattgccttttattaccccgtgaataattaaattcgatttcctttactcatattgtagttacagtaccaatcagtgtatcagcaacatttgcaaaaaaaaatgaaaatttgaatttttcaaaatgttcgagttcgggtcaggggttcgaaattggtcgaaatgcatgtcatattcgtgctcagcgcatcaaataacccttaaaaatgtgttttttggatttttattcctttttttttgtgggaccaatgatctgcacaattgccaaatggcacttgtcagtgtaattttgaattagcgcgcaaaaaattacgccaattagctctttgacgttatgagaaaattttgtctaacactgggcttaacccataatgctcaaatggcatctgatcaacttctttcatcccgagatagatttttctcattcagagttttagattcataaataatatatttgtcctggtccatccacaaaaaaataaccacaacatgaggctaaatcttaacatttgggtacactgataattttattgatgaattaatttccatctatttttcatgtcgattaaggcatattttggttaatgtacctatttatgtcgaacctctactgactccccattttcgcgcatctccaaaaataaaatttgaaaaatacgcctccaaaagacgacagatgactgtgacatcgacaaaaaacaattcttttccgagctcatttaaagacattactctacacgacgtatgggccagcaatttggaggccgaatttgccaaactgcgcgacctcatcgacgactatccattcgtggccatggacaccgaagtacgccatttgcttttttttataatggtgagaactcttcaaaaaaccacatctttcagtacccc

SEQ ID NO: 1387 - DNA, 2902 bp, Heterodera glycines
  misc_feature (2883)..(2883): n is a, c, g, or t
atattatgggttttcacgccttttcaggtcggcttcactcttatgaatgagaagggtcagctgccgcccgcccgtgacattttccaattcaatttgcacttcgatccgagcaccgattcgttcgcgcacaattcgctggaactgctcaaaactgcgggctttgacttcaacaaacaccaggcaaaactgcgggtggagggctcgcaaattattgccaattaatttgttgtgtcataaaattgcaccaatttaaaaagttgttttgctttttagatttaaattggttcgcgtaaactaatgtaaaataatgagggaaataaaaatttatgaaaaattttataaaatttttctaattgtaagattcatttattttcaatatttctttgggcccaataattttttaaatttgcttattgagggtttcatctttttcagacggagggcatcaaattggaggactttggtgagctgctgaccacttccgggctggtggttgagccgcgcatcacctggctgacctttcacagctgtttcgacttcggctatctcatcagggttaacaaattggcgttggtttgtaacaaattattctatttgtaataggccattatgctggtcaaactgcccgaggacgagaaggacttcttccgctaccatcgcaaattgttcccgaacagtttcgacatcaaaattctgttgcgacagcccgggccgcgcgacgccatgctcaagggcggacttcaggaggtacggacgccacgggcaattttgcagttgaaattgggtgaactgctccccccccgcccacaaaatttatttagttttttaaaacgggacaaattatttttattgtcataatacttactagttttgtacatcgttatataaaacggttttgttagcctttcagctggccgaccaactgcacgtcccgcgcattggccaatgccaccaggccggctcggactcgttgctcactgcgatgactttcttcaaactgcaggaattgtttttctcggacaattggagggaggtgagcaacagtttcccaaccattgtttacggaccaataaccattggactacgaactaataaatgaatttcagatttctgccaaagttcaagggcacatggccggtctgtccaatagtcagctgaatggtggcactggaatcacgacgaacaacaacgggttgggttaagggcgccggaagagggttttttctgtccattgtctcttttattttggctgcacaaatctcgcttaatcaatggatgatgatccgtccgtcatcaattatcatatttattgttattcgtttctctttctcgatttgatgttctttatccatttttctttccttcttcactcaattttcattgaaattgtaaatgcactccgaaaaacaacaaatttataaaaatggaaatcgactattctttgactcgttagtttatgttttgagtggttgatgaacggtagcgaaatttctgtaccatgcaattcgcccctccccgctctaacaattctttatgaaaaaaacaccgtgaaaatctgaaaaccaaaatagttaggtaaattcaaactttggtttaataattaattactgtttgtgacgccccgaatttttttccataaattgaccctggcttacaattagtcagaaacgagatctgcttggtcattcttggttctaaactcaattctatgctgacttatccctgtgatttatatcaaatctaattcataaacaatagaaatttatttgctttaagtaataaatctgacaatgagattaatggggaatgtatccaatgtaaagcttaaagactctgaacagtcagagataaatggaaaaataaatctcatattttggggctaaatctcaaatttatgggcgaaatgccactccttccagtgacgaatcagcgtgagcccggcttggcaaatgtctaaaaaccaaatttgatcaacaatttttttagaaaaaaaaaattacatcgccacgaattttgcggaccaattgcatatcctttggcatgattgtcactcgaccggcatggattgcgcacaaattggtgtcctcaagcaacccaatcagataaagttcagccgcctcctgaaacaaatcattcggatgaaaacaaaaatgttggctctattgccgttgacacaatcataaaaaaacaaatttcatgcatcataactagggcgtgtaattatatggaaatccatatttttttcctggattattggaggcctgaaacacacgaaaaacatgtttttagcttgctttgaagcttctaggatgaatttctatatccattttttccatatttcgcgatttatgtctatatttcaatattttggcattttcgtccctattttatgtccatattttgggatttttccaaaaaacctctattagaacggcccccagcagctaaatttgcctttttgagcccaaaaaccggaaaattttacaaaaaattattttttcgctaaattttctcgagaatattgaataaattcaaattttcttagaaattaataaatttatggcaaatataagcaaaaaaacgaaaattttagctttcgtgttttttttcttctaaaatgattttaataccatatttagccatttttgaaggttttactttatatttaacaaatttaaagaacttttgggaaattataccctcaattggaaaaatttatgtccatatttttgccattttatgtccatattttgcgatttttggtccatattttatgaccatatttcgcaattttatatccatataattacacgccctaatcataactttttctagaagcttccaaattcaacgttcttggtatcattcgatagccccaagatntcctctattagtcttcaga

SEQ ID NO: 1388 - DNA, 3828 bp, Heterodera glycines
cttgcatgggcctgcaggttgagatgcaagttaaaaaattaaaattcgaaattcaccgcttttgaatttacattcaaattcaaaaacgaaatgccaaagaaaaaaaaatatttagttttcaaaaattttttaattgatgtttacggaacacgaaaatttgcattagacaatttgggtttataaattgttttggacataaatttgccaacattgccttcgtttttcctggggatgaacaccagcacaccgcgcgatgctccgacggcgcaagacgcacgaactttgcgccaaatggcgtcacttcgccggtccatgcgcagcactctgtccccaattgtggcggaagagggggagagagaaggtgggccttttttatcggacaatttgtcgcaatataattttttttaagtggggacttccgccgccgccgcaacccaacggcgttcaaccgacttggctcagtcgttgctccaacgacggtcagtgctcagccaatttggcagtgcccagtcgtcggtgtcttcctccgtcgggaggtgagaaataatgaaatattggtgaaccaaaaccttatcatgcattgtacatttaccagagttaagggtacttttggtttttggggaaaactatgtaaatatccatgtttttacggaactcattgtcagttacactccgtcaatgatggccagcaaaattgacaatcggcccgccattgtcatcgaaattggcactcgactgaccaggcaattttttcaaaaattccctttctaatcatgggccgtgaaatttatttttccttttgtccaggattggctttgccggtgattttttgccccaggagattttccgctccgaattcgttgacccattggacggtccgtccccgtcctccccaattgcactgtttgaccggtcgcgcactgagcaacagcagtacgaagtgctcgtcaaattcttcaaaaacatcgttttcgggtcgcccaaaagtgccaatttaactaaaaatctaaatttttctgacatttttgtggatttttaattaattttaaatgaatttaaaccgaattttcagcaaattgttgaccactatgagctcgcgtcgtgtggtggtggtcgaatcgcttttggtgtccaattggcaacggaatgccattgcccgtgccctcttccaatgcccttctctaagcgctcattccgtaattaaatatctgttgttgttgttgttgttgttgttgtttaaatatccgttgttgttgttgttgttgttgttgttgttgttgttgttgttgttttgtattatctttataaaattgcagattttgttcgctccgtcccatttgtgctgcacttttcccttcaacacaaaaacttgtctggtcattgacatgggtgctgacgaagccgtgctctttccggtcatttttttgtaaaaatttgtcgaaagcattcatcgacattccatcaaattaattttattctcgaagatagaaaattcaatgaaaaattttgaggaataaaaatcataattttttgactaattttatagtgttggaagaaaatttgctcggcatatgccatggaattctttagttgacgcccttttcttaggtagctgaaggggtgctgatgctgaacagtttggagaccagtgtggcgccctccgcgacggcgttggagcaaaatgtgcgtcgtttgatggcccaatttggccgtctgcggaccgggggttggcaaaaaatataaatccgaaatgtaagacaattaaattattcgaataacatttgacagccgaagacgatgcggagggacggccgctcactgagactgagttggaacaagcggaccgaatgcgactgtgggaggacgtggcggtgcgcttctgtttcgccacaacggccgcgcgcggaaaacgcattcagacgtattgtgcgtggggaccggtgaaatgattttcccttcattccaataacctggactgtttagtgaggggggggggtacgtgcccacttaaaaccattaaatttcccaattcgcttttttgagtggccaataccgattccgctgcttcttcgtctgccgattgttccgctgcgtttgacgcggcttcggctgcgccggcggtggagctccaatttggtgccgcccatctactgacagtgccgggcattgtgcgcgaggcggcggccgaagtgtttttcagcgccggcgacgaggaggacgtccgatcggtgacccaaatgattttggacagtgtggccaaagtgcgtttgtaccgataccgagtttcaattcctctttttggcgttcttctatcgactatagagcgacacccattcctctttatcagggataggatttattcaaaaaaaaaaaaccaataaagatagaaagcccttaagacgccttcttgaaatttaaaaagaatattttttgattaaaacaacaacaataacaagaattaaatttgctttcagtgactgcaaaataatttttagggaaaattcttaaacgagaaagcatttttggtttagacttttgccttaatttggcttttccatttgattttccccttttttaggccagcatcgatttgcgtcgtgatttcttgcgcaatttgctgttgattggcggtgtcacgcggttgcccggctttctcgctcgtcttaaggcaaacctgaaaaacaatgaggatgtcaacatttcccaaacggaaactttcgtttagtccgaattgctcggcgcaattgctgacggataccatccgaaattgtcgcggaaattgcacgacatcagtttctaccaattcccggccgaattcaagggccatttgttctgcgcatggcttggaggtgcggtgaatatacatatgcaagggtgtattcgttcgtcggccatatgacggacaatttacccaatgggtaagggaaaggaggaggcggcgcctaatttttctctgttctacattcgaacttttcggcacttctaagtggggggggggagaatccggcagcggtgcctatttgcgccaatgaggagggaaaatttttttaaagccaactgatttggtggagaaatcattgaatttcaggtgcaatgtttggtgcttttgaccacagcttggaccagcgttctctgacacgggacgaatggatggagacgaaaacggtgccggattgacagagagaaacaaaaagaggagagagtgacccttttgtgtattcgtcaaagcattatttatttattgtatgtgtttgtttgatttttgccatgcgtttacagcattaaaggccattcattatgcaaatctttttattactgatgcttttttgtcaattatttttttccgctaattacaacattcctttccttataaattttgatttgcaaaggaaattatgaaattctcgttcagaaaaaaatgctgtgtagatggaataaatgttttgtgacaaactgatgttgttggggatttcagtgcctaacaaataaggcagtgttatttcaattgtctatctatggagcccggacggggtcggcatcccgtcgggtttttcctttgattccggtcccagttttgaaggcctggatcggtattccggtaaactggaattcgaatccgggtaattctaccacggcctaatgtcaatcccgatcccggcgaattgtggtcgggatcctaattagagttgggaccgggaattttgggctaaaccgggtactttttgggttgaaaaaccgggacttttcccggtcaaaactggtaaaaaccgggacttcggtactcagttatacgtatttttcagtaccagctcccggtcccgtacaact

SEQ ID NO: 1389 - DNA, 1266 bp, Heterodera glycines
ggcggtttttggaaaaatctggattgaccggtgttctggattaccggattttgagagatcggacccggaaaccggtgatttttgaaaatgccaatccggtccggtccggcgagtttttgaccggttctttccggattatgaccaagccaaaatccttcacttttgttaatcttcctttgaaatatctcatttggcataatgttttattttttttttttttgataaaatccttttatcaattaaaaaattttctccggcggtgcatattgaaggtgcacttcatcccttccaaaaatctttaaaacttttcaatttttaattcttgaaattttgtttaaaaaatttctttttttgtttgaaaaatttaaaatttaaattctctgattactcgttgtttgtctaattctctctcaatcgtaaagtgtttttctgttttacatttttatgcatgttacaactcagtaatggattctcgcatgatttcaattgaataattatttaattatgtggcattattattcgattttttcacaccgcctcatcgccatttttccgtcatttcacattttaatgtccaaaataaaaatattttttcaatttttgtagtgaataatgcctgtcatatacttcgacgacgtgcttccgagggagccgatgtggctcatccaattggtacatccgttttatttcttcttttatttacactgttttgtccggttttcagcccttctacatcacttcctttcttgtgctgctcgtgtttatgctctgccctggcaatatgtttctctatactcttatcagtgcgttttgaggagagagtgccgtttttgtgcagcctctgctaactaatcgctttcctttgtttaagctgtggcctacccaatgtacgcgagcttgttgaccctcaacactcaaaacacatgtgggttttctgctgtgctttccctccgagtacaaagccaattccccaatttccagcggaatacacccagtggctcgtttattggtgcgtgttcgccgtgttgggccagttggactttctctttggctctatcaatggctgccttctgctgctgtacgtgcctttgaagaccgtctttctgctctccttggcctttccgcaaatttatggcgctcacaacatgtacgtgaagccggacgtattggacaagatgaagaagatgttgtgatcgaggagacaacgtatcactgtgtaatgtctgtaggatgattctttgttgtgattcctatattgtgtgtatg

SEQ ID NO: 1390 - DNA, 1063 bp, Heterodera glycines
  misc_feature (36)..(36): n is a, c, g, or t
gcattttattatgttctaaactatgggtataattanaactattaaagaaaattttgtaattaatgcttttatatttatttttcattttttaattcattaatatatttttctttaagtatttgaataaaattaataattttttaaatttattagtcctatattaaagttactaatgcattttattatgttctaaacttatggtataattaaaactattaaagaaaatttaattttaaaagataaaaattaaatttaattatacaaaatatatagttaaatatttttattgttaaattatagtatttatttaaatttgttttaatgtttattttttaaaatcatcttttctttattcgcgttctgtcagttcatactttcattaaaaatgataataccttcggcgaattttccatatgatttatatttatctataattttttttattaataaaataaatttaatacatatttcgattatatttacatttgtttaaattctgtttccataaaaaatgtagatgacatccttcagaactgactttgaatgggaaattattaaaataaaattttttatattaaaattttcatagaataattacctgctgcataatcatttaattcattttgttacatttaaatattatttttgagaaataaattattttttgttttatttagttgatataatctagcatattctttcttggttgtttgctgttttttatgattaatattagtatattcttgatcattcaaataattttataaactatttgttcatataatctttatttattttattaaatttacaattttggcgttagtcggtcataaaattaacttaattttctttttctaatcgcttctatgctaattttaattattttaaaattaacgcttttgtagatctgtttctatcccgtaaggttttaaaatcagtttattgatagtttcaataaaaaataatcataaaatgagaaactaataagggctaatttaatttaattacaaattagtatttgttatatttatttataagaaattaattaatgtatattttattt

SEQ ID NO: 1391 - DNA, 2826 bp, Heterodera glycines
tgcactgtgtattttcttttatatatataaaatcatattatgtatttgtactttttataaagtcatatgaaatccttatcattactaaaggtaagaaattatatttatacttactcaaattaaaatattaacctatatttcctttaaattctaatagattttgattgatttggttaaataatttattattttagaatttttaaagaattatttaaattaatagtataaataattcttaattttaaattaataattattttcgttctgtttttcttattataaaaataaaaatgagtatcgaattgcggaattctatttaaataattttcattgattaaatcttaagtaattatgagtattttaaaaatattttcaataggttcatcataaaattataattttaataatcatttaattaatgtaaatgcttaataatggaaagcgccgatggagaaatttcaaaattttaccatatttcttaacagattgaacaacaaaaaggctaatataaggttttttgctcaaattaaaaaaaattcgattttgagtccattggtgccgataacaggcttataaataattgtttgccattaataacttacttttttattaatttttggttttgtcttcaataaaattccttaaatttattaaatttatttaccatttcaattttttaatcatgaattttataaaagaagttaacttttatattcactgtttttcgatcaagaaagttgcgagtaagaaatttcagggagcaggaccgtgaatccgtaaaaatagtgtctcccgtaaaaattctctgggctaaaagtatgaaatcgtgagcgagattcacgaaaaattgcagcgggaatcttgaaaactcgccggactctctttattttttcccaaaatttatttattaatgttgcttattagttttctatgtttagatcatttaaatttaagtttttttattatggatgccttttctagagcttatgaagttcgatttttcgatataaaaaaacttaaatttgtttattttttattcatttttgtgttttctattcattttccttatggtttttgcattaagattttcgattatgtgcatttttcattttagatttcaagatttttacaaatattttaatgtttattttaattttaaaaatttatatttttaatttttcttgttctcatactccgtacgtcatacgttaatatgcgcaaagaaataggattagtatttttatttaactattttcataattaataaataatcgaaagttcgtataattctttgttatgtgtttatttgttaagattatattaatattttattttcttgtatttttcaattaaaatacttttttcgttaggttgtcgttaatttttcaatgttaaaaatgatttaaattttatctttaataaatttgataaaatataagacgaataattactgcgtttaaattgtacatgaagcgcaataaaaaaacaaatttttttgaaatattacttatttgttttgattaatttatcaattttataattactgaattaaaattaaaattatcatacaaagctcagaccaaaagtttcaaaaagctggatatttgacatgaaatgaaacaaaaataaaataaaaacaaagatatcgctttaagtaaaaaaattatataaaaataaataaatattaataattttttttgaaatagaatttccaaaaaccatgcatggaattttgataatttttttttgactgctgctgcagataatttcgaaccatgcttgggttttttcaaatttttattgcagatcattatcgaaccacgcgtgggataattttggattttttttgattcccagggggttgctggtgcctgatcaggactctaaaattgattggcgacttgcacaacacaaagacatcccctgaaaagtcggtctaccactcgaatccccctcttcccatggcccaagccctgtaagcatagggttggaaccatccggtgctaccagtaaagccgtgaggtcccgctacccagtgcttatgagggaaatagtccagaggagccctcttacgcgtccgtaattaggccccgcagggcttggaagggaagggatgttgatggatgcctgggggcgcatcccaggcggggatcgattggccattccactgaatgactcccgactgaactccgattgacccctttggctggttatccattgccttttaagcgcccctcgggatgggaggagccctatcggagagataaaatggggggggggaagagggtaaaggccatttccggtcccggccttacacctccggccctccaaaagaccgtccctggtcgttaaaatgtaaataatttccaaatttgaatgaagtcctcagactttttctttctttttcattttttaattaacaaaaaaaaacttactttttacttttaataatactaagatttaaatttaattacggtaatttaaagacattgaaaaaatatttttttcaactttttataaaataatatcaaaaaattaattttaagttaatgtgttaaaaataaaggcaattaaagtcttatttaaccgagttttcggttccagaacaagtgaaaaaacaaccttctacgagagattaagacaataaaaattaatcataaaacaaccataaaaaaaattgttgactaagaaatatcgcagtgaaaagatttttatgagaattaaatgaaaaaatccaaaaaaatataattatattattaaattgacaataaatataatattcttcaatacaataaattttaaataaaatcgcatttataaatgaag

SEQ ID NO: 1392 - DNA, 4022 bp, Heterodera glycines
ccgaaaagcccaggcaagattaaaaataatgggaaaaacaattttggttttttatttaagaaaagcctatttcgtgaagaggagcactgcttagtttggtaagctaataatataaattgtaaaaattaggcacaccagtccagggatggtcccaggcggggggaggggtggcggggtacgtaccagggatggcccaaatcgaaaaaaaatgcgaaacgtgaaattcgcaaaagcaaaaaatgcgaaataaaataaatgcgagaagcgaaattcctctaaattgcaaaacgcgaatgcgaagaaagcctatccatggtacgtcctacgtacccccccctcccccccaggccccaggaaccaaggtgccgacatttttcttatttccaaaactaaaaaattcttaaattctttttgacacattgtcagattttgccatttgttcctccgaatttgtgccgatatgtttcgacatgtgtcaatgtttcttgtggtcgcgtgcttgacttgctggacacgccattcttatgaaaattgtaagtgacaaatttaaattataaacaaaaataaaccataattttgaaaatttaagcaaaatttcttaattgattttatcaaaattaaccagaaagtccaactgatctgaaaataaattttttttttcttgtttgatgttttagcgataatcaataaaaataggtagaaatgcacgaaaaaaattgtgctacgttgaaacttgagaagaatcgtagtatatagcgaatattaatatttttaggtggattcggaccaactgcaggcactgaaagaactgcaaagccaaattgcatcggaattcgaagccgtgggcaaaaaaattgattacctcgttgtccaacgagagtacactgagtccatgcgagaatatggaagggtgggtttgcgtacataaaaaaatagttaaaattagggtagcacggtaccgatacttttgacgaaaaccggtaccgatactagccggtactggaaaacccgagaccggtaccggtacttaggttttcaaccgataccgataccggtaaccggtactaaccggtacttttttgaggtaaaaatttttgaaaaaaattgtaaatttataagcaagaatattttaataacaaatcatttttcttcttcaatcacttccaaattatccgagtctaacatttcttgctcctcttcatccggctccgtagacggtgccaagaacactcgatccatattggccttgataagcaaaagattttcggccatttctgcacctaggctaaaataaaaatttacaaaataaattgtgattttatactccaaataccgatttcttaatttgttgctgtaaattagtcctgcctttgagaataatctttccgaagaaacagaagtggcaggaattgaatggacaatccgagccaaaataattaagtcaggaaattgattgccgatttctctccaccaagtaaaaagatcagcgttgactgacggccgatcaaatgccttgtatgcagctaactgtagctgaatgcgcgtcgtttgtgtcgaatgcgaagttcctgaaattgtagacggaactgaaacacatccgggcgattttggcttccaaatgtcgtctaaaaataaaggactaattaaccaacaataaccataaccattataaattttacattttatgctttcatcactttgttctccattgaagtctgacaaagactcaagatcactcaatgtcgtctcattctgctcttcaaaatttgtggtgtcttcattgttaactgtaaaatgttattttaaatatttttgaaaaaatccatcatttacttttcccatttgcaaaatcaattaagtcttcttcaataagattccaatttgcttttgaaaacatagattcatcataagcaaaacgcgggtccattagagaacaaatacgaattaacatattctggaccaatttcttcaccctttcatttaatgagtccaccaaactgtcgataaacggttgaataatttctggaaattttccctcttgcaaaaaaacatgaagtcgtttaagagtcggcaaaatcactgacgccgttgacacctcgcgcgacagctgaaattcattagttattggatataattgcttatttgctgatctcgcccactttttgtgtctcggtatcaaatatctttagtacaggacaaatgtggcgcaaaatttcaaaatcatttggtgcaatggtgggcaatgaagcaggtattgtttccatctctgccaggcgaggccgctttgacaagcacaaaagtccggcatttcgttggtcacgttcaaattgcattgagaacagaacttttttctgctctttgaaggcagcaagcatgtgataagtggaattccaacgggtgggaaccgacttaaaatttgtaaagttatgatgttttttttattgtattaccaaaataagttgttttttgggcatgttcaatttgtcttggtgtcgctcaagacattttcttatctttgcttttcgcactccttcgtccattctttcgtcttgaaaataatttctgaaaggcactctgtcttcattgcatcactgacaaccaaattgagaaaatgtgcacaacattgaaaactaaagatttcatccatttatcactgatttccttggcatacctctccttttccaactgtctgatggcagattgcatattcttcgcatcatcacgcacacaacacgccattttgttcaatgtcaatccattttgattcaaacatagtgcaattttctccgagatcagttcaccagtgaacaaaattttccatggaaaaggcagcgagtacggcatcgtggcgagagaaacttttatcaatccaatgaacagtgacactgaaattacaattaaaatgattaaacattattaaaaaataattatcaacctttgtaattgtggtgacagtgtcggcttagaccaaccgtcactcgtaattgcataatgatcagatccaactcccgattgaattaaacaacggatttgatcggacatcctgggaatcacttttcggcgaaaatgttctcgtgcaccaagatccttcaaaaataaattcacaatgtataagatatattatgatgtacaatgttcggatgtgctttttgaaacaaatcctttaagtctgggtcatagaaaaaatagaatgaattgttttgccggaccattattcgcacgatgcgttcttcagcaatttccgtctcattcttttttgtcaccaaaaaagattgtatttgcttttgtttctaaaaattagtctatattacaataaaaatcacaataaaccttatcctcccccatttgccctaaattttctgtgttttttaacacagaaaattccttttgatgctttgcttccaaatgtttccacattcctgtagtagagccgtcacttcgggtgactttttttgcgcagattttgcaagttgcaccagtcaaatttttgttgtaatgtttccaaatatcagcattttaatcaattaattctaaatgaaaaaaagtagatggaaattaaaaaatgaaagaaataaatgaggtggacaattgcttgacacacaacccactgactgtaaaatttggcgaaatgttattcaaaatacaaatattttcccatttcccaaccttctctctttcttttgttctcagaactccattcttaccagtgcatatttagtaccggttagtaccggtaccgccgatactcaaaaaccgggaccgagacttgacttttttcaaaaaccgggaccgagaccggtaccggtacctgaaaaaaccggtaattaccggatcggtatcggtaccggtctcggtctcgtgctaccctaatttaaagcataattttctcaatcaattttaatgtttaaagttaatgtagtattcagaattaaaacttccattccaattacattttaaataaaattcaacattaggtaattatcaacaaattttactaaaactataaataaacgcaaatgaca

SEQ ID NO: 1393 - DNA, 932 bp, Heterodera glycines
gtgccacccgccggcacccaatagtcccatttcatttttaaattgagtcaaaaaccgtgaatactctaagaattataaaaatttacaaaatatattggtcaaaaagttttttatatttatttatcgaaaggggttggttagtctctagcaattctgtcaattgattaattttgtatttaaccgaaaattgtgaagaaaaaatttttggaattaaaaaaaatttttgaaaaaaattcggcttagaaaatactagggtcgcgacttttagtgacgaaaaatctcgaaatagttaactaaaatagtgagtaaaaaggccaaaatagcgacgaatagtgacataattttcagccaaaaattgagcaaaaataattttattcactgattgcagttgaaaatgaagtaaatttcctttctaataatttcttggcaaatattgacattttaaaccaaaaattttgtcaagaaaaaaaatttggggaaaaatttttatgaaaattttccaattcttagtggaattttttgaaaaattttttaggtcaattcttaggggtgtattttttgaaaattttttaaggtcgattcttaggggtgtattttttggttttattgcaattttgttaaggaattttccaaaaaatgtcgaaatagtgacaaaacgccaaaatagtgatttctagtgaccgatagtgacaacataatcgaaaaatttcaacgcagaaatgcgttttttaagctcttttcttcaaatcaattgagcaaaaaatttagttaacccctaaaaatcgcgaccctaatcattacaattaattaaatttccaaaattcatatttttaagacttaagcaaaatatcattttttcttcatattgactcaattttgttcattcatactttgaagcgatacaagcaattgatcaccggacttttcgacag

SEQ ID NO: 1394 - DNA, 1207 bp, Heterodera glycines
catcagcaaaagggtgacgagcacgggaaggacaacgaaagggtgcggatgtttggcaatgaagaagccgtacctgtgagtcggtggtgttcggcaaattcggattaggtatggtaattgaaaagccgtaattacggttttcagtttcactaatttttaattaaaaaatattttaaaaaacacatagccacaaaaattggatgtgagccaggaaaataaaagctcatttttaaaagtcagagaaagcgtggcgatcacatcggttaagtgatcaatcacagtcaaactgatggacagacaaagaaaaagaggtgaaatggaaatgatagacagttcaaaccaattaaaaatgatcaacagataattaagataataaatattttaatgaagcaaaagcaccgcaccggaaaaaccaccgtgccaataaatcctgcagggcgccaaatgggttgatcagctggcggttgacgaacaaatcttttggcattttattttgacgaaattaaattattcagccaattaattaattattgtaaaacgccctaacaaaaaaaaagacaataaaattggagttgcaatttgtgatttatcatctgtcaaatgcgctgtttttgatttcttctccaattctcatccaatttaaaaaagagaacggacaaataaatgttttgcgatgacattttttgtctttgggcagcaaaaaagcggatttcggatcggaagagtgatcttgcggcgcggatggaacactttaggaatggattataatattcttcgtcttcttcgccactgtcttcgtccgtccattcgtgttctttcctctccaattgggtggtggtgagggggggggagaaatcggtgggcgatgtgtccggatgtttgcgaatgtgcgcagttcaactcagctcagcaactgcttgctgacgatgatgatgatgatgtgaataattgatgaatttggaggagggccttggcggatttgggattggatgagtaaaaagtgggcaaaaaatagggagatgggaaaagggggggaagcaaaaagggaaggacgcgagagggatgaagcataagggggataaagaaagcagggggaggggaagaaagacgggtcggaagattggctggggatggactttttgttatgaccccgacaaaaatgaaagttgcaattttaaaataaaaattaattatttgaaaaagattt

SEQ ID NO: 1395 - DNA, 1993 bp, Heterodera glycines
  misc_feature (316)..(316): n is a, c, g, or t
gtgctgatcagtactgagttgtctgttctgttggttacacgtcgggtggggcgataagttgggcgagtgatgcttttgttggggggggggaggggcaaagggacccctcggatcgattgccgcttctcatttcgcttcccggcggcgattgcccccgggttcggtcgcattacgcgcccggaggagtccgcgatgaccgtgggattagcggaagtcattgggctcgatcgataattgcttgttcgcttattcggcggaggggggggggagatgcggggaaagctgaccattcattcattttgcaaaaaaaaagtantggaaaaatggcggagaatttgttgaattccttaggaataatttatttttagcattatttaaaaagcggaatgaaccgcccttaaacaaaaaaaggaagaatttcattatcatttaatcgtttctcaagagtaatttttacaattaaatgatttgatttttcaataactttataaataacccaaaatattcattaatataatttagcacaaattcagtacataaaatgtctttaaattgcattagcacacaatgttcccccaattttaatcacaatacattgggaaaatgttggcatttttcgaattgttgcctcgggcgacaaaagtgccgaaaaggtgagaagaatgcttttccttctccttccgctgcttttcttttgcttttgctttcctccgctgtttttgacccctttccatcgccaagggcaccttttctgttcagccgatgcgggcgaaatccgtgctgacaatgcgcggcgatcattgagtgcgtttttttcgttcggatttgggagtgtttcagattttccggaaccccaaactgtcgaaggaaagtgaaagtgaaattgtaaatattttattattctccgattcaaacattgcctctgacatgagagagttcatttaatagaaaattcaaaaagatgaaccaacgaaaattagaaggaattaacaaaaattgtctttatttttaatgaattaaatgcttaaatacgattttttttaaagtatgggttttccaaaaaaattcagaaaacataacccagaaataactcaggcggccaagtgcctgggcctgagttcaggaaaaactcaaggcctggtccctggcctagggtgagctctaagattgttttctgctgtttgtttccttcttttgtgttcttgaattgcatcattgttatcggagttgtgatttttgccacttttttatgcattagctaaccgacaacaaacacataaaaaatgccccgagcgacggtttttcgctgttttgtgacctcagtcgccccccccccctgcccattaattgcaccctccagcggagttcattcattcggcttttgcttccgtcatcgtcctatctcagaaattgccactgccacggccaattttcttcggggagtgacggggtttactcgggtaattttgttgaatttttctttttgaaaaacacattataaaggaaatttgtataaaaaatggttaatttattttataaatacaccaacatagctaaataattgttagcattagcaagtaaaaatggaaaaacattgtaacatattcaaatattacccatgagcgaagacgaacccttcacacatttccctttttggacaatcgatgttattcatcttttccatattcccccgttcatcatttcattcactatttctcttttctctaactctcgcaaatccccgccccttttcggaaaagatgatagtcggaagtcggagcgatcaaaatacaaattaattatttatttattaattcatttatttattcacatatttcgcgcattataatccgacaataaagagccatacaaacgattggaccctttggacttcatggggatcagggcccgattcctaagattaagacctttcagtcctgggacaatccgtctcctcccatcccactctggcatggatcctcacgtcttacta

SEQ ID NO: 1396 - DNA, 2705 bp, Heterodera glycines
  misc_feature (2481)..(2481): n is a, c, g, or t
  misc_feature (2531)..(2531): n is a, c, g, or t
  misc_feature (2596)..(2596): n is a, c, g, or t
  misc_feature (2623)..(2623): n is a, c, g, or t
  misc_feature (2646)..(2646): n is a, c, g, or t
gcgcatgtgcttaagttgctcctcaagccctggggcgctttttgccctccttcttgagggctcatttctcttttcctctttatccgcggatattggtcccccataacggagggacaaaggaacagaagaataagagatgagggagaggggggtgcgaggggagtgggaatcatctctggagtggcgcccggccgacattcgagactctcagagtcgtcacttttacttctttaccttcgtgggaatgccgagcggacaatgaagccgatggcttactcaatttgtggcccaaatgccaaaatctaatttcgacaaaatcgcattaacgaattatcctccattcctttgcattgttttaagtaaaagtgaatgaatccaaatttggcattaccatttttagcggcttattaatttgtttggatgtaaaatccttgggccaaaaagggacaaagccgcgctattctctttttagttttgataaacttaattgcctagttaaaatatacttcatttttagtttttataattttaattcactaataaatcatttggttttctttgtccgtcggttatatttttcccatttccccgaattgttttggaaaaattttgcctcgggggtaaaggcggtaaaagtttgtctttggcatggcccgaaatggaaggggacaaagccaatctccggtttggtggtcatgttccattttcgtcaaaattcagcacaaattcgattccgaggaagtcggcgaggcgaacaaactgctgcagtgcaaatgcgatggcatttttggtcgtaaaacattaatggaaattgtgccaacttttgcggacgtaaaaattcgttgtttttttatgatgagatggaaatgaaaaaattaagcttaaagctatacgattcaatactttttctaattaattatgttttttttgtgaattgttgcatcattttttaaaacccaaaatggaaaaaggccccattaattcgcttaatggcacccgcccaaattggcattccgctaacaaatagtgccaaattcattcctttcccatgccgtcgttgtacattttgctgacgtcaccaaaggggcgaccaatgcccgaggcattcattaggcatatttaaattgttggagaaatgcacacaaagattttttttatctccttctgcaaacaaacgttggacaaagaaagccgaagcattattacacatttttttcattccttggccaaattattcgctaaaattctttcccttaattaaaatttttattttttccatttttcctcattaattcaaatggcacattcgcttattacttattgttatcgtctctttttcttccttctcatttttccaattcttttgcttattcaaaaaatgaaattgtcatccgcctttttaattgctcattttgtcaaagtacggcacaattattttgcagaaaatccattttttcgcggaattattgggattcttttttaaaatatgtatttaaaagtgcctttgactcctcccccacctctgaattccgtttgtttttcccgacaatcccttcgcccttttcgtcaatgttttatgccatcgcccggcacctccccggaggggataattgttgtctcgcatttccgtcacgctccccttcccccttaacccccccccccccctccccgccacacttggccccattaatctttcattcaccgagggccaattcgtcgccatgccgggataaagcaatgaataacccccgcccctccccctccccctctgccccaacaaacacacaattggtggcatttcagggcattgggggaacgaacaccgcccgccatttaatccccggcaaactgtgcttctccaaaggaaggtttattataaaaatggcacaatcacttaaaaaaacactccatcatttctaaagaatctaattgggtaaaaaatggagacatttgtatttgaaaagttgcgtttttatctgaaaaatgtagatttaaaaaaatcccaaaatgggcgcttcttcttcgacagccgctggtataaacggaaaagaacggcggaaaagtacggaagaaagcggtgcggcacttttggaagcagacaaaagggcgcgaaggtgagcagagaaagggacagatcatttatttatgaatcaatttcagattacttcttcaaaacgggctccttcgacgcaaatcaaaggctggcaacaacaccatggcggaggacgaggcgggaggaaacagctggcagacgaaagcccattccatgtacgatctgcagcagatgcgcggaaaatcggcggaagccgaagagcagctgcaaaagggggacgacgctgcggggcacgaggcgacggaacgccaaaatggggcggggagcacaaatggcaaaaagcatcggttgaacaaaatcgtcataaggtgccaaaccaaaagccaattagctttttggtgtccgcttataatgagtgactgctcaanctttggtttagtctcagcaaatcacttggctgagccggtttctccgtccnaagtccgtctccatcgacccccccctcgccgtccccttcgccccggtagcggcacttcgccccangcaggaaaatgcggcttcatccgccgncgttgcagtcgcaaaaaagtgcngtcacagcgacggcggccgctgacatgggcatgggatccgcgggcacgacgtcaacctt

SEQ ID NO: 1397 - DNA, 2306 bp, Heterodera glycines
attttgccaattttcccgtctttttcagccgactctctgccgaagggcacggcggctgtcagcgccaaaacagtgccaacgcggccaattcggccgaatgttcgaccaccaacggtggcccaccgttgggccgtcgctgctcgcatcaggcaaatgccaccacagcgacaggacaactgagcaacggggggagacaaaaagcgggtgccaatcgccggtcggacgcggggttcgcggcaaatgccaatttgaacccaatcagtgccaacgggcgcgagatcatccaattctgttttgacaacccgcacaacgaaattggtaaaacggagagagatggacaaaagcataattatgagaattgtgtaaattgtaaaattaaataatattaatggcgataattttcaaatttccaggcagtcgaatttgctcgagactgctcgagaaacggaccgattttcggcaattcgtcttctcaatgggcaaggaacgatggcaacaaatgaccggcagactgaaggaatttttggagtcagtggtacgaaaggtgagaagacgcgaattctgcaaattaaatccaacaattgcttaatctcaggtggacaacatcgaaatggtcgaacgtttgtcgcgcaaatacggcgaggagcacgtacagctcaaatgctttggcttcaagccggacttttgggtgagtctggcggacgcaatggtaagcggataaattgggaaggcttttcaagcccattttaattcactgcttttaagactgtcgaatgcgtcattttggaccaagccacgcatcaggtgaacaccaaaagttgacaaaacaaaacaaaaaatgggggggggagggaatttgtggcatttaacaccaagaaaagagatagtaagagaagggtgggactgatgtgccatctcaacatttggggccagaaagtggaacatttcgcttcatccctggtagtgaaaacaaaacgaagaaaagagacccatttggcccatactctcgaatatcgcctgacatcaaaaatgccctttttggaaatcaattttgaacactcatattctctgttcatttggccgatttgcttagccttcggacacgatcactgcttggtctctgctcgtctccgttatgttcagctccgtccgggacggctattaccaggcattgcgcgctgctcgcatctcgcaaaggcatcgcaatgtgcagcagcgcgaaaacactcacaatttgggcaccaaccaaacaccaaattccccctcgggggtaacatttagtgcactatttatccattatttttttctgttaaaaatgcaaacatttgcccttccgccacaggtcgaaaagagtgcgtcagccatcgaattgcagtcgcccgagcggaaaacttccggcaacaacaaacaaaacacattgaggcaacagatggagcagaagcgggagaagtcggcttcgccaaatggggcgagcggagtcattgtggaagaggtgggcaggcaattagcaattaattgcgcattcattaccaagccaatgctatctcattcattaagaagtcaattccggttcaattcttctgaagaacatttggattcaaacatacattttgacagcttttaaagtgcacgaaaattgggcacaaaaaggcaaaatataaaatgccaaaatttactttgataaaatggaaatgctattgctcgctttttggcactttttcgatattttttggattcctttggccaattagtgccgcccaatttgcgtgacatccctttgaagtgcgtgattgaacctttgttttgatctctgttcctaattattctgattatgtccattcatttatattttttcgtcattcaatcatcgcattaattaagattaattgatcatcatcactttccaatattttattgtctaaaataaaaaaattttatatggcaataatttatttgttaacgagtcatttattactacattagtggaaaaaaccaataataaatatatgtatgcaagtgtttaattaagcctacacccaacccgattaggaaaacaaaaatatgtattcgataattgccattttattattgaatataaaagacattaaattctttggctttcatttgtttcataaaattattcgaccgacgaaaagataataacaacatatttgagggctattaattaaggacaccttggtgattaatgagaaaacatggagatcaattagacttatgggaatatgttgaaaagaacagaataaaaagaagcgggggcattaattaattaattagtaattaattga

SEQ ID NO: 1398 - DNA, 5169 bp, Heterodera glycines
  misc_feature (1693)..(1693): n is a, c, g, or t
  misc_feature (1700)..(1700): n is a, c, g, or t
  misc_feature (5153)..(5153): n is a, c, g, or t
attttgctgcttatgtgaacccggaatgctgtagggtatgcaccacaaacggactgtttggcattgtgccaacattgtccgtcatgtcaatgtcgtcgttacagctgtcctccgactgcttccgatcggcccccggcggttgagccaccagcggggaactgtcggtggtgcccgacctgcgcagcagcgcgtgcagcagagaaccctgcgaaaaattggctttgattacaccgtaattgtatatttttgagagggtaaataggttattgtagtttttattgttagggtttgaatttattgggggtactatattcaaatatttttgcaaattgttttggggagatttgcacaagggtaaccgagtgccattaatctgagaaactgctcaaaaactcaaatatgtgccagattttacttcttatcgcctgtatgcaaaaagctagggattactgtaagagtcaggtgcaaaattaatgggattgtgtatactgtattatacagggagagatcaaacaatgtgcactgtattcaaatacctgccaatggcactgaaatgtctgattggtcctaacaaaataaataaagaaatgatgattgaaagataacgaatttaaaatgttttttttatctgcagtgttccccctaaaggattttcccaatttttacacacttttgaagttttgcgtgacgcggcctgatgaatgccgtccaaactgcctctgctgaccatcgaacaagcggatttccgacggaatctgagaataaacaatgatcaattaagcacacaatttactaatcattagggaaaaaccttcagtgacgaaaaatctcaaaaatatttaacattaattattaatggaaagtcaatggagtcaattttagcgatgaaaatgccagattagtgctttagtagagaccggacaattggttcgatcggttttttcgatacaaggtcgtaaaaagagcggaatcgaaaaagagcatcggttttttcgaccttttttcaaaatcaaaaattattttatgtatttataaaatcaaattttcaaggcatttttgcagcgataattcgcaaatcatcagtgtcagatttggctcatggggctgttgagtaagcatcgatttcatttattgttttggacatttctatgccatgttcaaaattgatgattgcttttggtgtacctgtagtgtcccctgggcaactccaacactccgccatttggcatatggctgtggtggttgtggtattggtaatgcgcggcggtgacgcacggatatatcggcacggaggaggtgggcggtcgcggcatgccattgttcgtgtcgacggagtcgccgctgaccaacggcctctttttgcccggggggcattcctcgtcagtggtcgcctcttcgatgggaagccatggctcaacggaatgcggttcggtgacgtcgaaaagatcataattgacctgacaattgggaagaatatttaatttgtataaatgaataaaatgattttttaattaaattaaaattttaaagcggtccaaggcttttccgacctcgaattgattggatgtcgaattcagcgtgatcattggcacaaaacgccggccccacaaaatatcttccggcaaaaagctcgtccgtgcctgaaatgccatcccagtggcctctacattccttccaaggtcatgatcagttncaatggncacgaattcagcttgtcctccgtgatctcccacaacggcgagtcggggtcgatgatatgacggattacgacgggcctttatttaaattcagataattttgaaaatggatttatattttttaatttgcccaccacagtaaaagcaccctgtccatgcccgtgtcgtagccaacgttcatgtcctggacaccgatcaattcgcattcaccacgctaaaaggttattactagttaatttcagtcattaattcaatgagtttgtttctcgaataaacaactttgttgatttttgttgtggccatatacaaacgaacgtgggactcggcaatataaaggcgatgctgaatatcggctagccgaatcctataattaaaaagataaaacttttttgaaataaatattttccgctttgtcatacattagtgccggccgtgggtcctcgtcgtccaccggaccgatcacggcttgcacgctaaaccgcatttcctgcttgcgcttcttaggccgcaaaactttggccgtcacaatgccagcctaattgattgattttttgcaaattatcgaatactttattgattttgttataaattctgaccagcaaggtttgtagcagtacgccgaaaatgcactgaagggacagcacagcgtatgccaatggacaaccctcggtcatgtatcgggtaccgtagcctatcgtatgctgagtttcaaggctgaacatttaatgaaatgatctgctaattatttgagccaaaaatcacctgaataaaaaggcactggcgaatgattgaacgttggcaatgcattgattttcttcgggcaatccctgcgaaatttctgatcaaattcaaacgctaaatgtttttttaaatttattactgacttgatactcaaccaaaaattggacgatcagaaaatagaagaggccaaaagtgagccatgagcacagaaagccacaggcgaacagaccgaaaatgcgacgccacgaatgttcaatgatcaaatggaaccagttgcgcatactgtaacggggaagagggtacggtaggggggaggaagaaatactgtagaagaagcaaacaataattctgaacaaatcaccgaccaaattgtgtacgaattgcgtaggttgtttggtcgaatgatgcattcgccgtttttggccacaagccgaggccattgcttaggtgccaatttggccatgcttgcggtgctgttcctcggttttttggaaggccgtcggttggggtggggcaccggtaaccgcgtaaatcctttctaaaattggctttaataaatcctttttgtggaattggaatgtttgtaattttggacatgttttttgctttgttcacctccatttcgttcatggcacagttcaacaccatgccgtcctgctgctgctttttcggctgatggctgttgtagttgtgcaccatttggttctgtcccgtgttgcagttgttgttgttgtttggggttgtgtttttcgcacaatttgccagtgccgttgtcgtcgtcgcccgtggggacgacgccagcagcacttccgcttcactttcggcacaattttccctcattctgtgcagcaacagcagcagcaactcgtgagcagcgaccgcaagcggacgaaggcccaacagtttagacgcgtgacggtaggtgagtacggtggcagggcgcgaggggtttgctgtgggaagggaggtaccgtagtggtacgagattcagcggagagaaatggtaaaggcgggggaatactgtgagcaaggaaaatgccgctgaaataaaaaattttatggaaatggtaattaaaatataaaaattgtaacatttgatggcatttaatgagtatttattgctttattatcgcgtttaatgaggccataaattactttaaaaaaatccgtcatatgacactgattagttatgaatgattatgattgatcattacacattcattggaccatcgcctgcagaaggaaaggggaggggagcagcaaattgaaatggacgttaatttcatgcaaaaagcgggcaaatgtttgaaataaagaaatgaaataataacaattaatcaattaataagcaaaggaccggcagaaaaattaaaaaaataaataatttctttaaaattttgtttaatcaattttaggtctcttatttaattcatttgaaaatgggcctttttctaaccatcgtgacaaattaagaaggtattgagcttgtaaaacaagaaatattcaattatttatttcaatagataaagcgtcaaattaggcaaaaataataaaagtacaaaattggggtttggcatggagctgtgaattcaaatagaaaaagcaatgtacatataataaaatgaaaaattattattttagccaaaaaaaggtaacgaaaaataaatcaaattccaagcaaattatgcgacgaataagttgtgccggctgttgtttgattttccaatttttaatgacaaaatgtatgcaaattaattaatttatttactaattacgccgttacgctggaagggattcgccaaagcgacggtcggttcataacaaagggtccgtcgtctgttcgtttcgccgtttttttttttttttgtcgatttttggtctctttttctttagccaattgttttgtgttgcctttgtccgtacgtgcaaaaagtgtatggaatggcaacgaaaaagagaacagttttgccgttttgtgcgtcaggacaaatgccaacggatgacggacattggcacagaaaagcgcccgcgggggacggattatccgggccaaataatcgccaattgaacggacggacgaatggatgaatgaatgcactgtctgagtgcccttctccccaacggcaaatgattgcgcaaaaattagcacgactattatcacaataatgggcaataaatgtgatgggaggaggcaaatttgaaatgttgaaaatgatcataaaaacaaatttttatgaactgaataaaattttgaaaatagaaatttaaggacaattgcaggaaagataaaataattaaaaaagtaaatgcattttaatggacaattaatctcttttgaatcgcataaatttgtttactctttttctgcttcctgtaattacctcatcaatacttcattaagcaaagtgacagtgattagtaaaggccatttgtcaacggtttttgtcccccataaactttagcaagaatttgttggtacaattcttgccatagtctttgagtacaaaaaatagatagataattttttgaaaatgcaattttatgccataaatgcgttgggttggccgattatcggccgccgttctttggcggtgcggtggggggggcagaggggttggggggcgttcgtcgccgttttggccgcgttttgtgccggacccttcagaggggccgctgcttcagctgtaccttgacaaccgcaaaacggaagccgancactgaaagataccca

SEQ ID NO: 1399 - DNA, 1773 bp, Heterodera glycines
gcggcggagcagagaattcgcttctccagaggcatccatccactcactccttcgactcaatttctcatactcatttcgctaaacgtcgattcaaaattggcaaaaatcgaacattttttcattgggtggcattcgatgaacggcaaaaaaaaaatcggacggagagtttaatcgataatcgggggagaagaagaagtccaacttgagaaaaagtatgacatgaaattattaattaaagggatgaaaaaattctttgaaaagttattaaatatatttaacattgaattgaaaataccgaccaaaaatgaattgaattatattcaatcgaaattcgttcaatttttataattgataaataatggtttaaaatgcaataaaaaagattgattgtgcgctatttaattttgagttttacgccataattttcgcaaattttctagcattgattcagtaaaaacattggcgctaaattcgcataaatttgttggacttttcgccttttggtgagtggcggcttttcgtttaacagagttgtgtcttttccttttcttttctcctttttttgcgcaccaatttgaataagtacacactttgccaagaaaaggcgacccccgcggggcaaaacgaatgccaacgaacgaaatgagtgaatgaatgaatgttctgttgggccaaacgaatgaattttgttgggcgttcatcgccgacacaaaatgagtttatttcttcccctcaaggctcttctccgtcacacaacacaaattgtgctccgaaaagtgcgctccgaatgggctaagttaatcggcaaaaaaccactcaaaccttcgccggggccatgccaccaccgaccaacggcgggacaaccatcccccgcggcattattttgtcatgccatcccccgggggtgggggaggaatcggcaaagagtgcacgggaaaacaaattttaaggctgaagaaagaggtgaattaagcgggctccaaagttgaacatttggatttgaaatatttgcgcaaaattaaaattgatttaattggagcaaaaagagggataaaaagacgaatgggataaaattagcaacggattgaaatgatgggatgatgtgagataaattaatttaagatccgaaatatttgcagtgaaaatttgatgccaaaaggtttttttcttttatttttgaaatttatctctccgccggcgttggttttgtgcgaattggctaaacaaaacagcacaaaaagtgtcgggcaaagggtaagccgatcttttgttggccgacacgacacaaaagcattgaacggcaaaaaaaggggtacagagggggggggggggggggttgtggcgatgattgtatcaaattttaaaaagtaaatttagacaatctcacgtggccattgccctatggatcacctctgctgcgcaaattcacttgcatgaaatctctgaaaaaggtctatggccctgctccatgtgcacagagctacgacccccgtattctctacatggtaatgccactcactaaaatccgaaaaggcataaaggaatattaattcaaatagaaaaaaggacatcggatgaacagagtcagagatattgattgagaaacaaaaggagcaacatatatgtatgtatgtagtttcccccacgacggagcaacattacgctatttatgaaaagacaaagggtgtcaaagaattgatggggcataacaaatcaatggggacggaatgccgatataataagtaaatcgaataaccaggtccatcacgaaca

SEQ ID NO: 1400 - DNA, 778 bp, Heterodera glycines
aaagggagaagcgagcaatttggtcggatttgggggaaattgtcagatagaattggttatacgtcgcttctcccccccccctcccccccgccatccccggcccaaataaataaaagtgtttgttgtgaataatgggattttcagacaatgaaaatgcccccgggggttattcgaaatcggcgaacaaaaacagagaaaatggcacccaatgaaaaaaaagagaaatcaattcaaatgggcgcaattattatttcctaaataggcagagggagcgaaaagcgacggcggaaagccaacgaaggcgggcgcagaaaaagggacaaaggacggacaagagagaaaaggacggacaaattagcaaaaaggtaggataaaagagagaaaaggacggataaattagcaaaaaggtaggacaaaagagagaaaaggacggacaaattagcaaaaaggtaggataaaagagagaaaaggacggacaaattagcaaaaaggtaggacaaaagagagaaaaggacggacaaattagcaaaaaggtaggacaaaagagagaaaaggacggacaaattagcaaaaaggtaggacaaaagagagaaaaggacggacaaattagcaaaaaggtaggataaaagagagaaaaggacggacaaattagcaaaaaggtaggacaaaagagagaaaaggacggacaaattagcaaaaaggtaggacaaaagagagaaaaggacggacaaattagcaaaaaggtaggacaaaagagagaaaaggacggacaaattag

SEQ ID NO: 1401 - DNA, 7165 bp, Heterodera glycines
  misc_feature (106)..(106): n is a, c, g, or t
cctccgaaatttcatcacgcaatgtgccaacgccgcccgccgccgcacattccgtgccgaccaccggcgcccgccgcctccgctgccattggtgagcgcgtcaaancggagcacaaaacgttgccacattttcagtcggctgtaggcgggcagaaatacgcgccgaaattccttgaattgtgccaaatgattagttggattttgcctgggtccaccaggctataggaatgccgaaaagcggtgctagatcgaaccgaaaaaaactcattgtgggcgttgcgaaaatagtctaagtgattgatcaaataattaaatttaattatgcgaatcattaaatttcatataatattattttcaacaattatatggaaatattttttaattatgtataatattgataaaatttttaaaaaattaaaaattttttatttgcttcgtggttataattgaaccaggaaaattaaagaattgaataaattatggtttatacgacggcttgtttaaagcctaacaagcggattttacataaatagaaaatcaattgatgtaatttattttgatttgacacggttccacataaccggctaatatctaagctccaaaacattggtataaataattccttattaaaatggattcagaattactcagaaaaccgaaagtttttcgtcaaaatcgggtctgatttctctgacgaatatccctgtctcagtggtgtgccgcaaggctcaatattgggaccactgttatttcttatttacatttacgatttaccaaaattctgcgaaactgaaaatgttaaaattaaactatttgccgatgatcttaaggcctatcatgttctttcaaatatttccttttctccactccaaaattttattaacaaatttaatcaatactgtaaattaaacggccttaaaatcgcttcaaataaatgtttaactttacatttaggacacaaaaaccaaaaaataaattattttattgatgactttcaaattcctaaaaatcccggaaacgaaccagtcagagaccttggcatttattttactaatgatttgaaatgggcagaacatattgacattatctcgaaaaaagcattacgttctgctttcgctatactaaagtcaatcaaaactcgtgatacgaaaatacttgtaaatttgtttaatatttattgcagaccaattttagaatttggatctccaattttcaatccttatttaaaaaaggatattgaaaaactggagaatgtccaaaaaatttttttgagagtaatatttagacgtaacaattatgctgctgatttacctaattatgctgaattgttaaacatttatgatcaaaagtcgcttgagagtcgtaggttaaaaatagacttaaaactttttcatgaaataattttaggtaaaataaatttacaaaataatgaatccttttctttttccaaaaaccctgtaaaaaatgaatacactataagaacagcttattgctcaaccaatgctagatacaattcgttctttattcgaacctctcgtctctatagacttttacctaaagagacgagattactaaatccaaatgagtttgccaaacttcttgaaagatctgatcttaatttgttgatttctttgccaccccaactccaaaagtgaccaattgattgttttgacattattatttctttatttttcggcgtcacgcttttgcgtataaatgattgattgattgaattgaaacatgcgaccatttttctttttattaaaatattttcattttatcataatatgtcaattatttctattaatctattactttttaaaaggtgctttttaaattgaaagctttcaaaagcccacaattaaataattaaagaatgggcggcttcttttcttgttttgagactccgaccgtttcttttgtttgtattgtttacaattagtcgggtcattagtgaacagtcgtcactttgaagtggacaccatcattattctgttctcattgcagacaggaaatcccacacattttgttgcaattagtgatgatcaatttacattaattgctttggtattatggtcatttctgaatattcaaaatcatttggataattttttgataaaattgccatgaaattgtcgattaattatttctgtatcattcattttgttaccgcgtgcactccgacggctaaaattatgggaggagaaataatcatgacgacgatggaaggcaataaaatgaatattttgacaatttttcattgtttcctccctttttcctttttagcatttgcttcacctgccccaattaccaataggccaactgacggcaatcaaagtgtgccgatgccaatcatttcgccaacaacaaattcattgaccacaaccaccggtggtgaatcatcaagcacatccacggggatttctacaatggcaatatcaggaagtacaacgacaatggcaacaacaacgacgacgacaagcagcacaacaaaaacaacaatagcaaaattggctacaacaatggcaatgccacaaacagaaatgccaacaacgacaatgacgtcaacggaaatgccaacaacagaaatgccaacaacgacaacaaaaggcatgggccagcaatgtcaggttggctgctgactgttggacaattttattttcgaatctcttttttctgtttgaatcttgaaaaataatttatgtccttcctttatgttttggctttttctggctttcatttttgttttcgactttagccttttccacttttgccggttcgtcgcgaggatataaattcgcgggcgatagcacaaattgcgggaacagctgcaaacaatgcatgtaaagcataaaaataatatgaatgaattaattaattaactaattgcttattccctccctcccttcggcagtttcgctttcactgcgatgcatcggccgttcgccaaactcggcactcattctaacggtacttattctttttaatcattttgtgattttaaattttgaaatttatattcacagtattttgggccaaatggtgccgacattgacagtgtattcggcacaggacaaatcagtgccgtgctcagttgtacaacggcgggtcaatgggcagtgggaaatgtgacaaatatcgtcgaattggaatgcatttcaggataaaaacacaatcatttaacaaaatataatcctgaattattttattatttgaaaacgaatggtaaaaagaagagtttacgttgttaatgaatttgagtttgtattttaaaacaattggcatagaaataattttaaaataaaaaaagaaaataataaattataattagggtctccatttttaggcaaatgcctaaaatttctacgcacttaatacgcacagataagcacgaaaaacgcgttttccgcttggtatggggtgtctacaatgacttttgcaatgcctaactttgcctattttggactttttgtgcttaatgcctaaatgcctatttttgtgcctatttcgcaatttttggcgccttttttaggattttcgaaaaaatccttaacaaaaatgcaataaaaacaaaaaatacaccctaagaaatggcctgaaaatttttttagaaaaacacccctgagaattggaaaaattttcctaaaaattaatcgccaaaatttaatatattttttcttaataaaaatttttgttttaaagatttgtcacttattcgaaaaaactttcaaatatttaataatttcatttacaattgaatttttatgtttttatgtgttttgctacctaaaaagtgttaataaaaaattttatttgcctatttttgtgcctatttaatgcctattttgtgattttttctgcctttttaggtgtctatttcgcgattttttgtgcctaaaaatggagtccctaattataatcaatcaaacgcaattggatggattccgttgagagttgcgattcatccctaaaattttattaaatttttacgtcgtctgcttttttgaattcaatcgccctctcccaagcatttgtttatcctgctttgctaataaacctgttcccccaagtggaatatctttgaatcttcactttcaagaggaaatcagttaaaccgacgaacattcgctgacccttctcaattatttatttccatttttatatttcgtttttatcgcttaatttaagtcatttttgtgtccaaaatgccttccgatacggccatttacgtgccgttgttaaaagaattcccaacgcgaccaccgtactattatcggaccccaatgtcactgatgtaccgtattactgtgacgacattttccaaattacaaaattgcgccggttttttgaccggcattttgtttggactgattttggctgcttcggttgtgcattttgtggacaattttgaccattttgtactgatgcccaaaatgtcgaaggagctcaaagagttcagagaacaatttaggaaaattgaaaaaacatataaatacacatataaaagtaagagaaaagaggtggaaaatgaacaatcaaaagcaaacaaaaataccaaaacagagaatggaactgttgccgttgaacttgctaagaaagtgcgcgttttctgttggatattcacttacgaaaaattccacgagagtcgcgccaggtaattaattaattaggattaattaaatcattcattaataaattcattaatgaataattaatttatttattatgactgattaatggaagcaccgcccaattcaatttaacctcctttgtgcccttaaggcatgtccgtgccacgtgggcccagcactgcacccgctatttgttcttctcctcaaaggatgacccgactttgccggcgattgacgtcggaatgccattgggcagaaaatacatttggcgcaggacgcgatggattttaaaatatatttacgacaattttatggtaattaaaccatttgagtttaatttgtctttcttaagagcattccttttttccagaatgacttcgattgggtttttcggattgacgacgatgcttatgtgatcatggaaaatctgaggttgatgcttctgccccattcgccggacgaactgatttattttgggcacaaattgcatacaaccattttcaaggaccacttgttcccgcagggttagcaattttaaaattaattgaaaataaattgaaaatgattgatttttatatttaaattgtataatgattgattttcaaatatcttttaaggaggcgctggatatgtgctgagcagaagtactttgaaattgcttgtggaaaggggcctcaatgacagcacaaaatgttgggatggagatgactctgaggaagatcaggttgactgaatgaccgtcacaatttttcaaatattaattacaatttaattagtttgttgctgtctgtttggaaaggttgggagtgaaatttggcgattcgcgcgattcacaaggccggcacagatttttcggcgattttatcggcaaaaatttaccaccgataacgctgtgggatccatcttattattggatacaaaatttgacgtattatcccatgccgcaggtgatcattaaatgttattttcaattgctgctttttattcctttttttcgaattttctgcctttttagggacccgaatattgcagtgactacgccatttccttccattacactgatgcgcgaatgctttatctgcttgaatatttcatttaccatttcgatgcttacggcgcgcgaacattggccacagatcgaccaaattatttcgaagaagcgatgcgaaaggcatttgataatgttgggccgggcgacattttgagcaagtaaagagaaggaaaaggcgggaatatttcaaaaattggaaaatgggccggtaaatcatcaaaatgccaaaataagtagagaaacggataaccttttttcgataaattgaaattgcatcaaaaatggtgaacataaattttacaaattaaaaattattatttgttaagtcatattttgatcacaactgacaaattaatctttctcatacatagaatagagtgaatgtgcaagagaaatggcattaatttaaaatgttgaaataacaaaattggcaatttgaaccataagctttatatatttttaataccaaataatttgtatttaaaaacttattaagaaatacttctcggcttatgttagacatgaggaaatgaactcactgccaaaagtgccaaggaaacgaaatgccaaattggaaaacaacgggaacaaatgaatgcaccactcatcaatcattgtcagaaaatacttctaaatttgccgttttaaggcattttaatgaatgagactctcaacagatgtttatctcttttctatttatttgttagtcatttttgattttaaatttatttatgtgttaacggaaatacgataaaaggaagcgcaaaaatgctttgctttagttcaatttgttatcgtttccttaaatgtccttgcgttaattaccatatttaaataatattctgtcataattagaagtattaattgtttttgcaaattaatttattgccaattattagtccatcaattcgcttcatcttccgccggttgggtttgtaagcagacattcgatgtcgcgcaccactaacggcggattgcccatcacccaattgccatttgcgttacaaatgccgtcaaaagtcacagtccgtggaccaaccacaaggaaattgttggtgttcacaacaattgcggcattcagctcaagcgctgggttgggttggctaaaaaagcacagacaaacaaacaaaacaaaaaaagctaatttcagcaaaaagacaaataattacgagcaattagccgtcactcttgaccggcaaacgttgctgtcatagacaaaggtcagaacgccatcggcaaatgcggttgaaggtgacaatgtctggttcagaggaggacaacaacctgcatttaaacacttgcaattcaattaaaaaacatgattaatttcaatgaattggccgaacttcgggttttaaattgctaccaaaagcgcacatttatcggatggatttgttttaaaaattatattttatttttgttgcctggaggcactggcggaccaattgtgcttgtggttaagcaggcaaaaagctggcccgag

SEQ ID NO: 1402 - DNA, 8363 bp, Heterodera glycines
tcaaagcgaaacgaattttttctcatttcggaacgataatccgccgttgaactcatcggcggtaattgctatggtaatccttcggaatgtggtcacgccgaaaaattgaaaaagaaagttcaattttctttcaaatgaaaaatgcattgatcacaattcttattgattttgtcaattattttcatcaatacttgattttttaatttttccgttcaaacaatatgaaagcatttattatttttgatttaaaagggaaaattagagcccagaattttgtaattaccaggaccgggtcttggaaagcgacccggacgggagtttctgggccaagacttccattttccgcgactcccgatcccggtctcaatttttgggccggagcctcgccgggatcgggaaataattaaataatgggaaaatttttttttgttagatgccaaaaaattagttttatatatttgagcaaatcacagactcatcagtgctcttatgtgggccataaaaatcgaataactatgtcaaaagaaaaatatatttaaatgaaaaaataattaaataatgggaaaatttataaaaaataattattataaaaaattcttaattttttatttattcatgaaatttaaagcaaaaatgaaaaaagataataacaaatcgtacgtaaatttttaccggtaaaaatttttaaaacttttttgactgtatgacataagcaaagaaaacccccaatgcctgagtaatttatgcaatatattctttcttttaaagtcaaaaatgaacaataaatgacaagtaaatcatttgctcatcaacggtttcatttcgcactgatcgacggacacaaatcactcaaaaagtgatcaattgtcagacggcggtcggttggcggggcggttaaatggcaatggcattcgtccaaaaaagggcaaaaaggcaaagggcggcggtgccgaaccattggatgaagatgggccaaaaggcactttaaatggcggcattcgtccaaaagggggcctaaagccgaagggcggcggtgccgaactgttggacgacgagggaccaaaaaatggccgaaatttgaatgggttgaactgcagctcctcactgcccgactcttccgaattgctctcctccgatgccatttccgacgaattgttcggcgcctcactttgtccattgacaaaaatggcaattgtcaaaataaaagcagcaattaaaaatttgttggccatttttgcgataaattaattaatgattttgacaattcggaagcacagtcaaattaaagttgaataatttcactgattcattcgctccttttatgtgctttcatttcccattcaaatcacagaatcacagctaagcaaattaaattttcattttttttcgttaatccctcaatttgttcagtttgacaaatgcgtcattttgtgaaattttgaaacggaaatgttttaattttattaattaataaatgttgcgttttaaagtattttttttttgctgttaacattaacaaaaattttttggccgaattactgcaaattgagcagatcaaataccttttttaatttcattttttcatttgcgtaaaatcgcctgaggcgcatttgccaattggtccttgactttgaaaattggggggagttaatcaaaattaattaattggtcctaatcaatctatttataaaaatggcaaaaaaaaaatattgaaaaaatcaattttaatcttataatccgggatgaacacatgtattcaaataactgctgtccggtcaaatttagtgctgacaagggaacatcaaaggcgtagccccagacctttggcttcggcggggggggggggggaagtcaaaaactcgattttaggggtgtattcttttttcttcgattaggggtgtatttttcgttttttgaaatcccgaattatgggtttatttttcagtttttcgccaaaaaattactattttttgccattttggtctccaataaaagtggtttgaaatgtatctgaaagcacttgttcgaaataattcatcccttgtcaacaattaatttaacaaaataagcatgcttcgaaattttaaatgtttttctttcctaatttctaagctcgaattcaaactgttttagcatattttgatccataaaattttgaagttttttaaaattcgttctgcagaggagtttgcccgaatcccatagacatttattcggtccttctttataggccattattcagaattcagaatatcatggtaccaatgtccgtgcccacgactctttgttattacatactgattggtgcttttttgtaattatttaacggtatttttggtgctgttttagcaaattggcaacaaaaaatacgcccaattttttatgtcagaaacaaaatggaccactaaatttgttgctgcacgaggtttaaaaagtgatcagcattttgagaaacgaagcaattgatcatcgtcataattggcccactcattcattcgtttgttcgtcttcaaatgattaaattgagcaaaaaatggctgatgatcaggcgatggatggaatttaacgaacaaatcaaaaaatataccaaaattgccgaataaaaaatgacaaattcgtaattaattatgaaaggaattgacatttgggggaaaaatggggaagttgggacaaaaaagcgcaagtgtcacattcgttcaggttctattattaattagcaaaagtttgccgtttgcagttgctgaccaaagttcggccatcaaccggttaaatagcgtacaaaatggggagggaaagtgattagggctcattccattattatgtaattattaatttgagaaaataagttttttaaaatcattttaattatttatttcttaaattaaatgatcaattaattttgatcaatcactttagcgtacaatgggcagcagcaccagtgtccaaagcacgttcattttgcttatttttgccctcatcgcttttggcaattttgccgccggcggcggaagtgccgaaaggggcgggtcatcagcagaaaacgcggcgaaaacagtcgtaagacaaacgttgcagaaatcgtacggatacggtgaagtaccggcaacgtacggagatgagaagccggactattccgtgtgcagcggattgccaaaaaggaacagaaaggcgtgcaaattggtggtgcaaattgcggttgaagcacgaaaggtaagaacaaaaataaaaaatatacggtaattttacgaacaaggcatacggtaacgttcctttgatttgtcaggcagaacgacgaggacttttggaagacgacgaattgccgccgccctcccagggacttggtaagcaaaaaagcataatgattaatgcttggctaacaaaagtaatacgcctgaaatgtcattaaggactgccctaccttcgaaaaccgaccaaagcggaggaggacgcacaaccgccgccaaaagttgtggcggaaagatacgcgtgcatgaacatgacatgtctatgcccatatttgggaggtgaaccttaaatgctgtttatacaactctttttagcgtgtcgcttaatgccaatggttacaaaaaaatgaattggatttttatagtgaaatttgcccccggggagagaaattttgtttgtcttaatcaacagatgcattttagaagctaattgggctacatttttttgttgagtaggcgaaatgtttaacatttggtagtggaattcagcagggagagaacgtttactgatcagagatcaatttgagatttggggctagaatcaccgattttaggcagttcatctgagcccgatcagtgcatttttggcgggagtgctacgaacgaccaagcgggccgagcgcgtcgccagtcgggcaatgcgaacccaaatttggggagggtcgttcgcaaggagtaccgaatgttaacagacaacgaaagggcacgatatgtaagcagtgaaaattgggatgataacaagggaaagaaataaatattcgagaaaaattggataattaaagtaaatgaggcaattaaaaatacctaattaattaattggtcgccctttgcagcacgccgctgttttgcaactgaagcgtggcaccggttcgtacgagtacaaccgaatcgcttacctgcacttcgacctgcgcgcgatgccaggtgctcactccgggccgactttccttccttggcatcgcgaatatttgaaacggtgcggcattttccaaatcaaaacaatttaataataatgcaaaatggacaattaagcaacagtgattcattccttttggctttagttatgaaatcggtctgcgtgccgtcgacccttcggtttccattccctattgggactcaacgttggaccagcgactgccgaaccccgtaacttcagttaaaagcaattttgcaaaattggttttcacaaacagaccgattccataatatggagcgaacgtttcatgggcacacccaacacaaacaacaatggcattgccgatggctttttggccgactgggacaccgtaattttgcgtaataaattatttaattatttttttataatttagatagagggaaggccaattcaacgtgagctcggagtggacggcgaattaatggcggaggacgcgtgagagaaattaaatttgaaaataaaaaaataacatttttgaaatgtttcgaataaattgagatataattaaattaatttgtttgcgtttatttaaattggtcaaaacaatttcagagttaatgcgatgataaatcggcctgaaatggagaacatttacgcctttccgagcgtaattctaaataaataaacccattttccaaattaaaattaatttggttcatttagcggactggcaatggcgcttgcactgtgccgagacccaaccgaggaatgtggttgagctgggccacaacaatgtccacacttggatcggcggcgacatggtcagttagttagttgttggttgaacgtaaaattcatagtatcaaaatggcacgaatagacaatcatgtgcaattttattatattttttagagcggtttgcccacggcacctcaagaccccatctttttcatgcaccactgctacatggactacgtacgtgcttaatttcaattaaatttacttgcttttcaaaaaagtttatcgacttatagttttagatttgggaacagtggcgcctgagatggcaaacgcgtgcccagcgcgagacgcaatttccatctgatcagcaagttgttgcggtgagtggccgtaaactgctaacaaattgctcttattattaccttaattaacctcccgactgcgtaaggcgttttacttttttactgtattttacagtgttccggttcaacaagctaccgtatcggcgaggtaatgcgtccattccaagacccggtggtgctaaatcgaggtcggtcataattgacagtgattagtctgatcaatcacactgcttttggcgtttagccggccttagcaacgattacaccgactttctgtacacttacgcccctcggccgacttgtcgcgcagcggggggatgcggatcgccgtcagtatccaaattcaaaaacattatctatttaataataaaaattcttaagctatttgttttgcgacacaacaaaacggactccgttgtgcgtctccaaaatacggcccgggggcaattgctcaccattcacacgaaacagtgggtgtttatttgatagaattgccaaatgactgctgataactgactgttgaacaattgtgcagctgaacaaccgtgctaccagtcaacgtgtaccaacggacggtgttccgcggcacgaccgagggtattgagaagaggaattaaatgcaaaattagccattatatggacaaaacataattttaatgtgccatgtaaggcaatatcataatgctttatcaaaaaatcacacttgacaggtggcgcgctccaaagactcatcatcgccagaagtggcggaacacagcggcgaaaaggccgaacgtggcgcaccacgaaaagcatacggacacagtagcgaaaggggcggacaaagtgccgaaaagcgcggacaaagtggcgaacagcgcggacaaagtggcgaaaagcgcggacaaagtggcgaaaagggcggacaaagtggcgaaaaggcaggcggcaacaaacgaaaaggatacggatacggcggcaatgttagtgaataagacgggttgtcaaacacctcctaagtaaatttgcagaattctccaacaacggcggaaccaccgaaaccgacgacagtgccagcggacgaatacacaactttggcaccgatggtagggccaaaaagggacaattaccaatgaatgccttaattaaagcaattaaagcacacattttaaatttaaatgcttttctcagtacacaccgccaaaagaacgtgtctgctacgataatcacgagtgctgcgcagtgtgggccaccaaaggcgcgtgtaaaagtgcgccccgttacatgaacacgtggtgtccaggcgcttgccgctacgatggatgtcttccgcaggcggtgaaacgcgcggcaggtgggtcattaatggattttgttggctgaccaattagtgaagcctattatggataaatgaaaaattaatgagttaaggccttgactattattctcaatgcaagcgttggtccattttccatgaaaaatactcccacgccgaggggtggcgttcgtacagaccgaacttggtgttacgaagggagaagttgcgcaacgaatgtgagcgcaacccgcattggatggcatgcaactgtccgcaggcttgcagcaaagtgaagcgcctaaaggaggactgcaggtggcacttggaaatggcattggcattttgatggcattttgtttaattaacctaatttagccaaaacatgccaaaggattatgtgctggaaccagtggacaatagttgataaaattgccttggttgtgatgatgatgccgcttaagcaaatgattttttatcgtagataaccgattattaaaacatatagttatttaattgaagaatactaaaagtaaatttaaatgctggaaattgttttgaaaattattggtaaaatattaatttggacatcaattcattttagaaagatttatttattggaaggtgaaactaaaaaagttagcaaaaaaaatatttttataattttctaaaaattgatatttaattatccgtaatttaaatttcttttttgcttttgcattggcacaaaatttgatcggaaaaaatgaagaaaaccatcggattaaaatcatttttctccctctgtgataatctttcggtttggcgtctaattattttaaattatctctaatggacaaacaacagtcattggtggtcactggcagtgacagatggagtcattcacctcaaacactgagctaatcacaacaatttgctatttaaccaccaaattttaataagtccgtccctcccttattattgctattataatacatttttttattaattaaaatttaagaaaattatttatttattaaattcattatgttcattaaacgtggccatttttttgcgatattttttctcacaacttttagtatatcaaaagcaatgtttatggtaaaaaaattataataaattttaattgaaaattcgacaaaatttttttaaagcccttcaaagtgtccgttcgtttgttggtgtacgataatgcaaacgatattttttgggacttaagcaaggggacattgcacgaggaaagtgtgccaacactgatcagaagtgccgaaattgaaattggaaatgatcggacgacagtccgtgaaattgtggaaaaagtggcgaacgaattttgcaagcaacagcagcaggtgattaaggatcgagaaccattaaataccaattaaacaatttttatgaaattttgtttattaaatttataatgtatcgatttatccttaattatttgcaaaaaaaaacagctgttggatgaggagggagacgaaaagccttatcggataatgacgatttttgaggacaaacaattgaacatgcaaattcagcgggagatggacgccgagccaaacactgaatacaccgccattttattgctcaaaaatgggcaaaaggattcagtgggtaaataaattgcaccttttatttttcaacaatttagtggcttttctgaagaattggaaataatgaagagattaagtgaaagacgatcgaatttttgaaaagaaaaaactcaaaatccgatgaaatattattaataatcaccgaaatatgagtattttaaacaataaaataaatttaactaaaatttatgtataaaatttatg

SEQ ID NO: 1403 - DNA, 1280 bp, Heterodera glycines
aattaatattttataatttgcctaatcaaaaagcatttattatgtaaaaaaaaatcaaaagcacattaggcaaaagaaagaaactttaagccttgtactgtaaatgttcatgataattgttttataagcagcagcaaatggcatctaaaaatgctgttggcactttgtttctatcctccggcaccttttttgaatttggcacaatgtctttttgtactccgtcatttcgtgggtttggcactctgtttgcccccccccccggcattgtccctctctccgttcttctcatccctgttgctgcaccaatttggtgctgcccttcgcatccctcacacacttccaaatgccttggctgtccctaatttggccattcaaagggattcggtcgcctcgtagcgaaaggcatccgaccacctcaaaaggggtaattaataatcattagtgtcaaattgctctcatttttccaatttttcttacccgcgtctcccaccgattgtaattgtaaaatacaaagcagcgcataatgaacaaacggttgacaatctgtttttttaaagaaaggatttcaaattataccagttaattacgcaaaattttccaaattttggcccctatttatttgctttatttgaattatatgccaaactcacccattcctcgccctctcggtattgtctgccttggtggacacacgtgccatgggttgcgcgacaatcgatgggcccgaacaatgccaaaatgccagccaaaatggcaataattttgaaagcaagcgattgatgcattatttctttagtttttctaaaaaaaatatttatttaatttaagtgtttaaaatgcttttcttttgaagcttttggcaattatcagtgagtataaatatttcacaagtgaaatttgaccaaagaatcattcgctggcaaatgaattttttgtgttcaaagcactgacaaattgacgaacacaactgacggattgccacacgcttcccactcaaagtttttggccctatttttgttcgttggcttatgctttttgtcccatgatcaatcatttgtggccgcgggcgatcgcaactgactttttgccgtggaatttggcaatgaaaaggaggcacacggccaaaactttgaaggacataaaaatgaatgaatggcataattgagaaagttttgctgctaattttagacaaagtttgaaaattcaagaataaaaaaaaaaattttgaaatgatatattatttaaaaataatatttaaaatgtttaaaccattttaaatt

SEQ ID NO: 1404 - DNA, 2353 bp, Heterodera glycines
ggcatttcgcttctcgcccttctggtgtgtccgttgtcggcactttgtcccttggcggcgcctcttctcgcagtgcctccatttgccgcgttaatttggttagatttgccgtcagtctggtgataatcgtgtccaatgccatccgttgcaacccctcgtgaatatttgagcagaatgcgaccacctgttcccaggtcacatacgaattgttcgcagcagcgaatttgtcgatgaactcaaccaaacatttttcatctgaaaaattaatgggaatttggcatttaaaaagcataaaatgccattggttcactgaccctttgcgatgtttgcagcgggtgaatttcgctgggtttccgtcgtgttgcaagaaaatttcacccagtccatttccgagaatgacgaatggcacaaaatgcttccgtaacagcccaattggtggagcaacgagcctgagtcacagaattagagaccgaatgggacaggactctgtacggaatttttcagggtcatagtctggcatgttttgaacaatgcaacaggacaatcctgctaaaagaggacttttgccatgtttgtcctactgccctgtccgtctcggaaggggaggaggagcattgttttcttgaaacaaagattgttgcactcatcgcaaaacaaattaaggacgatgaatggatggattgctgtataacgatgagttaaccgcagaggctacggtatctgcgatttttattttttatatcagcgaagaaatggcgacattaaatttgggctccggaaagtttgggcaccagagcgagggatttcaaaaaaatataacaaaataaaccatgcaaaatgttatatataaatcattaaaatttagtaaatttaacaacccttgtgtttaaaaattcatgttttcttacaaattaaaaaaagaacctggcaatcttattatttaatcaattcttacagcatttaaacgtagatttaaacgtgtactacaatagtttctgtttggacttgaccttaatacccggcttagttgggcccgaaatatcaagagacccgtctaattctgtttaatcataaaattttaataataatacgaataatataatgtatgacattgatatagaatgaatgataatgagtctagcaaaataagcatggttaatcgagcggatattcgttaaaaaactttattcctaacttgattaatttactatgcttttaaattagatggttgcaatttatagacaattaaaaatatttttattttttaaatccttaatttggtgcccaaatttcccccgaaaattggtattttgagtctgaatcaaatgtaaaattttaacaaaaaaaggcattcacttccaaataatattttttgctcttttttactccgacattttcaacaaatatcaaagtgcattttgcaaaccgccggttaatttccgaatttgatttttatattaatattttttaaaacaataacaccgttttgtcatcccttttttacaaattttttccttgcattatgctaatgattaagttatttatgtatttttataaataattaacactttaacaaaagagaaataaataaataaataaataataaaattgcctgatatttttatttatcatttaatttatatgcttaaaaattttcgatttattttttaaattctttttattatttaactttcgtgccagctgagcgaaccgacaaaacattcattcatttcccattgctttgtgtcattcggctgtcatttcattttatttcaatcaatacgtaaaaaataaaaaagataatgataatgtgttcattttacaaattgccttttttattttattccagtattttaaataggtaaattaaaattcaaaattagacaaaaataatctaaaaattaattaaaattatcattcatttaaaattaaatcaaaaaaactttaaaaacttttataacttcataacattatgactaataaccagggctgcaaaaaatatgcatgaaaaatgaccaaaatatgcacataaatatgcaaataaaattgccaaatatatgcatcaaatatgcacaaaaatcgcaaaatatgcaaaaaatcagaaaatatttacaaaaaatggcaaaatatgcataaaatatatataaaacccatgaaatatatataaaacccaaaatatgcataaacacccaaaatatgcaaataaaagtcccgatttttatacgcaaacacaaaaaagaaagtatttttcctactatttcagggtttctatatgttcttatttataagaaatgttcttatttcggggtattgttcttatttcttaaaattcttcagaaaatttgtaatttta

SEQ ID NO: 1405 - DNA, 1727 bp, Heterodera glycines
  misc_feature (63)..(63): n is a, c, g, or t
atcatcaccgagtcctgcgtttgcagtgggtttggactggtccaactcctctctgttagtcgngagcaattggggttcactgtgtgacgaaatagatttccatgatagttgttcgtcgggcaaggtggtcatgtcgttctgatacatctccaacgccttttcccattcgcctaatttttcgtaccaacgacccttaaacacagttgaatcgttgagcaacgaaaaaaggcattaaaacccatgttgagaaaagaaagtcacgacttaccgatatttccatgttgtgacgtttggcatactgaacaatgccggcggcgccttcttccagatttaatttgttgaatagcattatcatcgtttgacagtcatccgcgttcggttctccgttgccgcgggtgctcaaaatttccatttctttgtaacgcaatgcttttgcgtatgcacgtgtcttctccgccgattcgctgagcattcgatgtttaattggaagaggtcccttaaagaataaacaaacaaaaagatttttttttttactgcgctttgtttattgccttctcagaatggtccatgaattcggccaaattcagtatggtctgaatgggttcggcatgggggcagtgcctcaacacatcgatcagctgattggtcagttcgttctgttcccgctccggcagttcagtccaaacggacataaaagcggcattgaataattccctgtaaattatttcattaaaaatagaaaagtaaggggaaaaaagaacgactttgagagtgactcgcacatttcggccaacacagcgcaggcgcgaagtgcggacgacggactctgacggatgaattggttgcgcaaagtgccaacccactgaagccaatcctcacgcgagagcagtggttggaccgtccaaaagcgacgcaattggtccaaattgatggccaagcgggaaagatcacggcctaaacccaaccattcgtcccggcattttcctgttcgccttacccgaagacattctgtgcactcgagacatgtccgcactgcttccgccgggcccgggtaaaaacccgacaattccgttgtgtgcgtcgggcaagggcgaagtgtccgttgtcgccccgccgttttgcgtcggcggtggtggtaaaaaagacacttgacgcgcgaataatggtgatgaagtgctggcactgaatgtgccctgttgttgttggtaaacgcctccaccactgccaatggcattctgttgttgctgctgctgttggcgtgcgtatgaaggcgcctggagaagtgccaactgttcctggtactcatggcacagcattggttcgacacgacaccgcaccaaggcggcatttacattctctttgtacacagaaaactgagtccatttctgaaaatgaaggggaaatgaactttttccgccaaaaagcttaaatgaagacggactctgacgatgatgccgagtaactccatcagtcgcggctgttgagacttgatgccaatgcaacgaagccatgtttgcatgacgggcaaagcgtagtcctcgatggaatgtcgacgggccaactcaagcaaagtgtccagtgccgacgtacgcactttttcctccgttttgcggtcgtccaatacggacagaattggcggcagaatcaaatggagatgggagccaagacaagcagaaattgtacgggcgcatgagagtgcctgacaaaaggtcatttaacacaacata

SEQ ID NO: 1406 - DNA, 6881 bp, Heterodera glycines
  misc_feature (6811)..(6811): n is a, c, g, or t
  misc_feature (6826)..(6826): n is a, c, g, or t
gttgcctttcgcgagaattactccttcaaaaagtgtttaaaaatatgttaattgctcctcaatttggcattgattgcctcgacggcggtggcaatgcgatcgttggaatcacccgacgcatcggcgaactttgccgccccgtcgaaacgtgaaaagtcggaatgacggcactgacggaagagggcgccgttgttgtgggggccaacgacaaaggcaaaatggacggacgacgggccaaaagggcactgccaggggcggaaaagacataattaacatcacccaaagtgttgatgacattcgactgcacattctgaggcgaagaagagctgctgctgatgctaataaaagggaattaaaatagttaatcgttttgaaaaactattcataaattgaagagagtggcatattatgcgtcttcctaatttgaattttatgcgctaatttccgctttaatttcataaatcgaatgttggccgtcgcactggcgtttacccatttactaattagccttgattaagcgctttattgcccctttacattttattgttggcattagcactgttcatcatctgctgctgctgctgttgtcttctgttgctgttaattgtcgcgtataccatcgactccaacaaattggtgcccctgacattagcaaagcacatccgaagttcattgatcgccatgtccaccccaaagcgtcgaccgttttccgtcgatgtactttaatgaagtgcaaaatgatagtcgacaaatgaaaatggttgcatatttatacagaaagaaaaatcgaaatgtcaaaatcgaaggaagttcaaatttcaccgaacactttttgaaaatttgtttgtgcacgtttgttttttctttagtataaaggcgactcaactcaactcgcattatcatttctcgactttgttaaattcaaaacgctttttagacccctttttgttgactaactcacagaccctaagacgaaaaatccaacttaattgtacttggagcccaaaattgaagcgccgtgtaaaatttaacaaattcggacgattttccctaaagcctcattttgaaaatttagcctcattgatctatcaaaaaaccacaaaatgaggctaaaacctcagatctgggccctgatataggtacctaatcacagccctattaatgaagataagattttgtgtgttttttaatcttttgaaacttattatttcaattcgaaattctcaacccattattttaattttgttttcctttaattaatcatatttctatttccttttctgtgttattatgcaaaattcgctaccttcgccaatgcttgcacccattccaataattgagcccgcaactgtcactgttccgcccaatgaagacgttgtgggctcagatgctgagaatcagcaaagagaagaggaactcctggtcaatgaatttgtcatcaattcggaagcgatcaagcgcatattggacgacccgcgctacgctgacaaaaaggtccacaatattttcaattaaagtgactctgacttaatggaattttttcattaataatttatccaaacttttttttacaaattttggtaaaatgtcgatgagctctatttttcggcaaaaaaatcattaaaaaggtgaaaactatatggctaaacacaaacatagcatttattttagccctattccgaatttcacttcttaaaattggaacaaatgccgaaaatatttatttacggataactcgataaatacaatctcaaattggctgtgattcggaacaggccaaatgaatgtcacatttgtcttttttgccatataaaagtaaccatttgttttccttttaggtgtgtgtagtcagcgtggcgggcgccttccgcaccggaaaatcgtttattttaaacttttttctgcgttatttgcgttggcactcagcacctgttgctgacagaacaggagattggttggaaatggaactgacgttggggggattcagttggcgaggcggtgacgaccgggacaccaacggtattctgatttggccagagccgttcctactcgaagaccgcaacggagagcaggttttggcaggatggggttggatttggagaaacagcacacccaaaatttaattcccgagaaattcattggtctatgtatctatgtatttattcggatgatttttcaggtcgctgtcctcctcatggacacacaaggcattttcgacagtgtcagcactttcaaaaattgcgccaccgttttcgcgttgtccacgatggtttcctctgttcaggttttaaactgaaaaaaaaattttcgagtcaaatttaagggattccatccgttttttcattcatttgcttcccagattttcaacatcaacaagaccatccaggaggaccatctgcagcacttgcaactgttcacagagtacgcccgactggcgctggacgagtacaacaacagcaatccgttccaggcaatgctctttcagctggttgaccatttcgctaatttcagtcgcttttgttccttgtccgtgactggagtttcccttatgacgcggagtacggccaaatcggtggccaacgcattcttgacaaacgattggaggtactcaatttgactagtatataaaatcggatgcgtaaacggatgtactacatccccaggatcagttcccccgtattttattcacggcttgtcgatggatttgttaaaaaatatgtttaattttgccaggttacgccccgacaacacccggaacttcagcagctgcgccatcacattcgctcgtccttcgacaacattggctgctttttgctgcctcaccccggcctcgacgttgccacaaatccacacttccgaggcgaacttgacagtgtgtttgtttgctctttttgtgtgtccactgaattcaaagcatttcggttttccctttaggaatggaactcgacttcaaggcacagctccgttcgctggtgccccatctgttctaccccaacaatttggtcgtcaaacaaattggcggtcagcccatcacttgccgagagcttgccgtctacataaatgtgctctttttgcgttgaattcaaatatttaagttcaaatttttaggcttatttcgaggtgttcagcaaggctgaactgcccgagccgaagacaattctaaatgtaagcattttgatgctttccctccttatgaatgccaattgcttttatttttattaggccaccgctgaagccaatcatctcgcggccgtggtgagcgcaaaagcggtgtatatgagggagatggaagaagtgagttttttgactgattgttggggcgaatgataccgaaaagcaaatttttttgagatggcattgggtacacggcatacatggaaaaaagggtcgaccctattccctctttttcatgtacggttggcagggttccattcaataaacagaccaaacccagaaacattcacacgactcttcccaccccactcattcgaactttaaccaattcagtcgtgcggtggcgacgcgccctttatgagcggcgcggaactgcgaagcgagcacgcgcggtgcagggcggaggcgatgcgcaccttccaaacggcgaagaaaatgggcggtcccgagttggcggagcaattcgcacaaaaattggagcaggacatcacggtgggctttcaaattcttccattgaaatattaaattgctgaaagttatgatatttttgttaattcgctttctgtgcttttcaggaggcatttgaatcgtttgagcgcgttaacaactccaaaaatttgttcaaatcaatgcgtacgcccgccgtgctcgtcgcttcgatgattgccctttactgctgttcgttttgctttccctgggccattgtttgtgttcaaaattattctcaccaattaatgcaatgtttcaaattggtattttggaaggcccgtaaccaaaaaagatttgataagactttgtatgaggcaaaatcggctactttttttcctttatttttttgctcttcgcctgtaaaaattatcattgtcaatgttagtttaaccgaagaaaaaatgcattattatctcagttaattgatttaatgcaaaaaatttgacaaatttttaggtttttgtcccacccctatgctcattttccaggccaagaatttttccaactgctcggcctcgacaccatcgcctccattttctccctcttccacatgctgatttttgtcgcgcttggcatttggacatattcacgctacagcggccaattccgccatgcccaagtgttcatcgacggacgggtgcacgcgttgttgcacaatgtgttggcgcgggcctttttcaaggccttcaaggccgctggtcgcttggcgctgaacatgacggtgattagccatattttgttttcttatattctctgaaccgttttttaggcgaaacgcaataataatttgaagcgaaaatgaacggacggcgaaagcgggtcaaagcaacgaaacttatttggaccgaccgtaacaatttatttgatgctcatttatcccataaataattgttggttgattctttcgttcgaatatatgtttgtttttgtgaggcaatttcgactaatacaaccaaatttaaaaatttgaataacttatttttcgacaaatttaaatttaagcctttttttatcacaattaacaacattcaatatatacaaacaaaactgggatttgttagaattacaaaatgtgagtgttcttttgcgtgacttattaaatgcgaagatgaaagggattgaaatgatgtgaaattaaacaataaattggaattattcattggaaaagagagttgccgccttccccaattccgctcgcgtccaacagattggccatgatgcgcgacatggtcgcttttctggagttcgtcgcgacggaggacgagctgttcgccgccgccccagccgctgcatttaaaattgcgctcgtttggcttaggctgtactccttgaatttgttaagaataccaactaaaatccctgtttttttctccactcactgtatgattcaccatccaattttgaagctctccaaacggcaaataaaatgctttgacgaaattttcgacgaacggtcgttggggaagaggcctaatttcgggaatttacaataaaataaagggatgattgtgaaattgcctcagtccggtgatctcctccaattccccacataattgctcgacatccaacagttgcagtgctcttccctcaatgctgcacttttttacgtcggcgtacctaaaaaattacgtttttgtcaatggtgccactgaaacaaattgggcgtccgcgtacccctggaccaaaatacggaaaatgcacagcaaaagcatggaccaaatggcggcgtacaattcgtcggaaatgtgaacgtaggggaaaaggcggacgaacttttgtttgaattgcgaacattcctaaaaaggaacaccagtaaaacaccttatggaaaaggctgacaattgttattttggccattttttcctttgcttttggccaatattcacccccccccctctgttttccccattcacttggacaattgtgtccacataaggcgaatgttgcgaatggatttccccggttgtccaatcggtcgccgaaatttgcttcagaattgactgaaagagtataattttggccgccacacagccaaacgaagcgtcgcccaaatcgaacaccgccgcaagggactgaaaatggggtaaaatgcatatgggggaaaaaacaaatttgtggcataaaatgggcctggacctggattcaatgttggacttgggcaaaaaaccaggtccaggaaaaccccaggattgggtccaggtccaatcgagctctagtataaacgtttaaatcaaacaaacacgatagaaggagtccaaggacaaattgctgtcgctgcctccgccgctttttggcaaaagcgcctcgaggaaaggccgaagcaattccatttgtttggcgaggaaaacactgcggaaagcatccaaattttgatgcataaaaatcaaaagaacagaaaggaaaacatacactgactcaacgccaacaattctttcgacgagcaaaaacaatttgtccgagtcgtttctgtccaacgcgtggcaaagcgacgaccgacggcaaaacaacgaaagctaaaacgttggcatgtgccatatttgtaataattggtttgtttctgtgtgtctgtcacctccgcattttccacactgtcttgcccaccctctgtcgcccccgggccattcattttcttttcgattgattgcacaaattggcggaggcgaaaagtgacgaaattggtgccgaacatttgctgttgttgttgtgcatcaaaatccgagcaaaaaaatgtgaaaatctgaagagaaaaacaaaatggagaggaatgagcgataggaaaaacgcaaagtgaaaaatttaccgaatggacgtaacaattgaacaaagcgacaatcgactcgacggagagttcagcggacgaccgcaaaacggtggccatttgaaggaaacggcctaaggggggggggccattcgaacaatgactaaggaaaatagacaattgccatgagagactaacaaaccaaaggtggaaattttgcttttacttttttgtttatgtgcttttattagcaaatgagaaactcagaatttcattgtaaaacccttttaagtttcaaatgtcttactttagtaatttttagattttttaaaaaatgcgatttcgctattcgaacctccaccaaatttaaatcccaaccatacctgtacnaaagggggtggtcangtgaaagggtcttacgttcgattcgactttgaccacctggggggggggggggggg

SEQ ID NO: 1407 - DNA, 1326 bp, Heterodera glycines
gacaattcaatgtaattcgataagttttttaccaaaaaattattaggttttttgttattataaaccaacttttttaggaaaatatttgaatttttaatgaaatctttaaaaaaaagaaagcaaaattttaggaatttttcagcctctcctcttacgttcgacgaatattcttcagcagaattcgtcgaacgtaaggaaagagtgtcgaacgtagctgaattggaaaatttcacggcactttccttgatttcgacgctgccttttcccttttttccttcatcttttttcttctttttgacccccccccccccccgatttcttacgtctgacgtcatgaccctccccctttgactacccccttgcacaggtatgaccccaactctaagcaaataaagcacttgccaatcacacgtaaaagattcagcgcggaattgcataaatttggcattgcgttgtgcggcgacggcgccagtgattcgtcttcaatggaatttcgagtgccgtcatcggacgacgaacactgagagacttcgccatttttgcagattatccgtcgtctgtcaccaattcgtcggggctgaattcgtttttccatattttttgtttatttcaaaatcattttttaatgctttctcttcgcaaaaaagtttttcatgtccattttttgtgcctttctcctcacactttcgtcgaattgttcaggcgaataagggaatatttccgtgtccatttccgaagaatgtcgaaacaccgaaaaacggatggatttgccgtggacaaatgtctccactgagttctgttcagtctcttcctccgtttgttcatcattttgctgtttctgttgcaactctttgaggaagaaaaattcctaaatttgaaaagcattttttaaaatgcaatccattgggaaaacctagggaaaaccccgtcaaaagtgtcaatcattgacttaaaaacgaccaattctttctcaccggaaggtcaaacagtgtgaattggacgggcaccgggcaaagagtgaacgtttcgctctccaaaaacattttaacttcctccattttctcggcatggtatcgctcaatatatttgcgcgattggtccatcaaagtgtgtcggatgagttggcacggattgccaaaatattggcgaccgaaggtccggaatctgagcaaatggaaatgaggaggaattaattgaataattattgatagtaaatttacaaattcaaaataaaaatgataaaatatgggacctttccgccaactcaacaactttgatgaactggtcgaaaaagatggcactcatctcggcatggccaaaagacaa

SEQ ID NO: 1408 - DNA, 2986 bp, Heterodera glycines
ttaaaaattagaaagatttgtggtagatcttaatttgaaaaatacccattttcaatcaattttctcctaatcaacgggcgcaatcttttcatagaagtgcatccagcacagcggcaggtgggggggggggggaacattgacgaatccattaaaaggtgaacggaaatttagtcgggggtcaaatggtgaagcgaatgagtgggcaggggtcagcgaaagaaaaagcgggaaatggcggaggggggagggggttagcattgaaaatttggggctaaaaaatggattaaaattaagttcgctaatttatttgaaagagaaagccctatcctaagcaacgtttatttaaaatttgtgaaattaaataaaaaatagagtacgataggaaaaaaataggttcaaataattaaaggaaaattatatgaatcttttttttcgttattattttccgtatttccatgcgtcaaaaaatgggaggggaagagtcaaaaatttgaatcgattaaaccccaaagaatggagggcggcgcgggcaagtggtcggatggcaagggatgttcataaaagggagctcggtaataattggacgggtggggggtttgtctaggaagggccggaattttacaacgagatttgtggacatatactactgacgaatatctaaaaaataaactaaaaaagattactataaaagcattccatttccaaccaaaaaataaattaaatcggaaacgaaaattttaatttcaaatcttgaagccatcaaattgattgacaagtaagcttactagaggatttttcatttttagaaaaaacaaatcttcaaattttctactgaaatttcacccaatattttcgtaaatttaagttcttcatttgtttccccataaatttcgtgaaattttccttcatccctattctttttcaaataattttaaaattcaaaaattattctgcatttattaatggtacgaaagctagcatttattttgagcggaatatttgaagaaaaaacattgaagaaaagttgaacctcgaaattatattattgttatttgaaaattataattaatgtgcaataaaaaaacattgatttaaataattaaatttaaatattcttattgacactgagactatttttcggttcgccctagcagcgaataaaaacacaatgtccaaaaatgaagataaagaaaggcccaatttggaaactgacagaacagtgaaaaccaacaacaagtgtttcaattaaaaatgattaaataaccggataatgtcagacatttttctgatcacctgatcaattgatcagttgaccgctggcatattaaaatgaaacacttgagaaaaactttggcactaaagtcagatctaccgtaattgtgtgctcacgcagaaaatatgcgtgacccaacacggtagatacaatagaaacatgaacaaaacatcaatgcaaagatcgccccaatggttaataggagtgcgaaaatgacaaacaaagtgtgccacggattaatgttgttgtgatcaggataatgatcagaatagacagtgaattcattagaacgtaaattgttgccctcgatcactaacttagaataaccattgttatagaaaattacaaaagtgctgttgtagccataaaagggtacggtagcgatcagtgctaaaagcaatccaaagaagcagccaccgaagacagaagcacgctttttccttctggccatgaaaaagtttggcttttgttggaatgtgggcaactttattgctgaaaacggaaattgttttaaattaaaaaataaaattttacattcaattaaattttgaagaatttctatcattttgctggaaaaattgacaaattttgcaaacattcgcttgttgttctcattgagaatttgatcttttgccaagactgtgtccatttggcttttgtcaaattctttcttttcaatttttgtcgtttgaaacatttccatcgcattttgaaaatttccagttttaaatgatttacagaattcattttgcaattctttcaaatttttatccattttgaattcaaattcgctattacacaaaatgccaatcgcattttcctgtatccattcaatggccgaattggcaccaaagtttcccttttttatttggttaaacaaactcgttgcttggtcaaccagtttgttagcttctttgagttggtctaaaacagataagagcagtgacgcgataaaatcgaacatgagtatcagggctgcacgcaagtggatttacaattacggaaatccgcaatccgcaattgcgggggtccaaaaaccccgcaatttccgtaatccgcaatccgcaattgcgtgcagccctgatgagtatagaatgtcataattgagacctcctatttatttattatttactgaaaaaattgaacttagaaaaagcaaaaaactaaattttgtaaaaaaaaacattacgcgaattttgctcatcaagaatttttgcacaatttttgtattctttccgaaatttttcgatttaagggagtccaaaattttaaaaccctgaaatatggaaaaatatggaaataaaaaatgcatcatagaagcattaaaccaagctaaaaatacgaaaatttggagaatttttaatgatgcttaatatgaaatgacctttattttattaaaccggggtttaagcgtaaatttaaataaaataataacaaataaaagttgaattgcttttcgacgaggaatggtaaccattatagagaatttttttttttgctaaaatacgttaaaacatttataaactaaaaaataaattaaaaaaggcagtatataaaaataatttgctattagctgtaatcatcttatttatgagcacagttttagtgggcgtatacacttccaaggagagcgccacggaattccgacggaaatgccaaaattcaattcattaaattgactgtgttggcaacataaaatgattgattggcatt

SEQ ID NO: 1409 - DNA, 1233 bp, Heterodera glycines
  misc_feature (1182)..(1182): n is a, c, g, or t
  misc_feature (1209)..(1209): n is a, c, g, or t
aaaatttgtccgaaatttttaaaaaattatatttcggtaacattttaagaaattatggtataaaagatttatatagtaaaaaagcgtcaattgaatatttttggaaggttcagaaacatcaatgaaatttaaaaaatcaaaatttgtaaatttgtcaatctcgatttaaaactcgagattcaagcggaggtggctgcgccgagaatctatataaaaagtgacttttttaattgattttttttaaacaaagtttgttctattcgggtggtgttcccccgagaatttgcattattttcgttttgcttttgtgtttttctcttcctctccatttccccactctttcattattgtatctgtctttcagccaaaattggcataataataggagggccaaaattggtatggcaaaacgagggccaaaataagcatgttggaaagctgaaattttgatttaaattccgaattgacaaatgcatatgaaggttttaccccccccccccttcccccttatctcgtgccaaaatatgagacacaagactaattcccgacgagaatttgtctccgacttttctttcccaaaagtcggggaaaaccatagatggcacacttgatgttggtcttttattcacacggacaatttaagcgaattacattgagataatgaaatgatagtaatgctctctttatgttggaaattaaattaaaaaataaatatttaaaattatccaaaaagtgcaacatcccactggccctggttgaccaatctttgcaaattcccatttcaaaactgcgcaatggaagtgggaaggacatttttaattttacatattattttattctgcctttaatagtgaggaaaaggcccgcagacggtggctccgacctgattaaaaaaaccagaatttttcaaaatctaagaatgtagtaaaccttccggatttaaggaatttaagctttttttcgtttttaaaattcttagcttttttgtcgaagtattttttagaaatttactgtctcactgacgcattttctattgacgcattcaaagcatatgggcttttagggattcttttttgtcgatttatgcctgaaatttagagcccggaactgggatttaggtattgagtcgagatttcgctagaactcacaaaattctcaatgaaaaataatgaaaatttcccntcacaatttttccccttattatcattnagggcttgccaaaatatgaacaaa

SEQ ID NO: 1410 - DNA, 3309 bp, Heterodera glycines
tacaaaaaaattgcaaaattgacattataaatacatgaaattccgcttttttctaatatattcaagaatatttttttgtctgttgtttttactagagtgccacgggaccgggaattttgggcaaacccgggaccgggaccttttcgggttgaaaaaccgggaatttttggctgggaaaaccgggaaaaaaccgggactagtcccggtcccggtcaaaaccgggaccttggtactcagttgtactcaattgtccgctaccaggtcccggtcccgtggcactctagtttttacccagaattaaattaaggagaaatttctataggctttaagcttcattgttaccaacaatgtaggcattgaccaagtgagaaaaaaaagttatggccaaaaaaactgaatatggcgccattgattaaacacctaaagtgcacttgggcctcctttgcatttatccatcattttccgtgttttctgatgcccatttcatccacattgcttccaaatatttgtcaaaactgtgtcgaagtaatccttggaatggtatgatgatttatgcttgttatgccggccgatggcaaacaaataatcaatatttatttggagcagggaaaagaagacacaaataaattgggaggaatattcaaataataaaagaaggaaataacataaaagaaagaagtgaacggggagggtcaacatcgcgggtatttatgggcggaaaaaggggcgtgacataatgaagggaagagggaaatacaagcaaagcaaagggtcaaaatgggtaccggacaattgggtcccaaccctaacatctccccccttaaaaagtgtcaggcctccgtccatcatccgcatcctcaggtcggcgttcttatgcctcttgttcacagtcggaagctcggagatcatcttccaattaatctcgtcggccgtcactgccgatttggtgcttcccgacagatccaccggatgaggcgctcttcagtccaaatccgtcaagaagaaaattaaaattttcatcttcatccggcatgtacggctgtacactctttgccgggaattctccggtcgtgccgtccgaaaactgaacgtcgtaggtgcctcctttttggctgatcacacgtccggcgcgccatggctcgtctcccaagctggcgatcacattcgctccaacggcgaagttctgcttcttaccacgtccgtgttttccgaagaatttcttcactttcttcttgctcactccgttcattttggcagtctcagtttggaacttgtccttcagaccgatggagtccgacaatcccagtctgtccatcatgtccattccgagtaagttctttgatccgtctttggaaacaaagaaatgcccaaatgctgaacgatttccgaacgaaaatgttgcatttcctttgccaacaaacggtcgagttgttccatcatggtacagagcacgttcttcacaacggctcaatttcaaagctccgatttttcgcacggtgtcctcacgaagaatagttccttcggtgccaaaatctgcaatgaaatccacattcgttccgtccacatcaatcggaacttcgatcattcctttcttcctctggttctcatctttaaccaggaaaactcctccaactcggatgttgttcaccgctttttccttctttcctccgttcttctttagccatgcctggtgcttggcacacatcctttccaagtgcccattcctcttgcactttcggcaaaccgtttcttggtgtcggcattccctcgacgaatgcttcccaccgcatcgccagcattcgcgctgcgatcggttgctgctccgagttcctgtcgacatgctgctcgcattcgacgaatggtccgagttctttctcttttggcccttcaattttgctgccaacaaatgcttcgaaacatgtggctgctccaatgcttggcttcggcgatggtcgacatgtagatcttcaggtcgtctaccacaccgtcatacttgacattgtcaccatccgctgccaacttggccaaaattcgcgaccgtaaagtagcatccttcggcgatttcaaagaaatgagcaaaaccatacagttgaattgcccctcattcaatttcgtgaagttgaaatcccgcagaagcttcttttgccggttgatgaaggtgccaaaatcctcgtcgtcgtctttcaccgagcggagacgcagagacactcatacctgtcaatccagacggattgaggtcggctgaacaatgccttcagcttctccgcagtctccacaaaattgaagtcggtcacttctctcggtaagacggacttacaatattcgctgaacgtcggtccaaacaatttggtcatcaacagcttcaccttcaactcgtcctgaaggttcagcgcggcacagtcaagagcgaacttaaatcgcttgagccagtcctcaatttcacagccactatgctgactagcatcaaaacattccacgtccggaagtgttggcaattgagaggcattctctgccggtggcgcgttttgctggtgtgcattcaacaactgctgcaaaatatccgtcaatcgttggattgatgcgtctcccattcttgccgttcaccactctattgctaacagcgcctagcttgttaacagagtgggtgcgcgtggatgaactgaaaagtgtcgccaagacacaaaatcagcagcgcaaattttcaactactaacagtacctaactgttagcaggtccaacaaaaatgttgtttattatcgcctagataataaacaaatgcagtccagcagcgatgactttcgattgctgttgacctctccctccaattaagagtccaaagtttggaaaaagtttgttggttgcttcaagcaaaccaataaatccaaaactgcttccacatttcaaataaataagcccacagtgcaatacgtacgggcgtcgctaattgttatgccggccgatggcaaacaaataatcaatatttatttggagcagaggggaaaaagacacaaaataaatggggaggaatatttaaataacaaggaaaaataacacaaatgaatgcagtgaacggggagggtcaacatcgcgggtatttatgggcggaaaaaggggcgtgacataaccaagggaaaatggaaatacaataaagcaaagggtcaaaatgggtaccggccaattgggtcccaaccctaacatcattaatattttaagtggcttaattaagcattaaatttaaaatataaatttatttaatttttatattgtacttttaatttatttttttatggacaaatttcacaatatcaa

SEQ ID NO: 1411 - DNA, 3760 bp, Heterodera glycines
  misc_feature (20)..(20): n is a, c, g, or t
ctgctttctggtttgaattntggcaccatttttcggcacaatgtcaatcccttcgcatcaaatgcaaactgccaaggtgctttacatatttttgtgtgtaaaatattttgtttgtttcatctacagtttgcctcagattgtgccgagttaccgtatcaaaggcatactctaacacatacataaaattggattgccctttcacaaacatgaggaatgcttcatcatcaatctatgtttcaatgaatttatcttttatttttattatttttaagaaaaaataataatatcatttaatttttgatgaaaaaagctgtgaacaaattttgtgtctttcaatggcctcttaaaaatttttagactaataaaaaaaacaattaaagttaaaaacatttacagatatgaatggaattaaaaaattggcataatgccgaccaccctacaaaatttatggccgtttttcgctggtttacgtccataaattgcaggcggtaattacaattttattattaattttaccacgctttccactttgtacactagcaaatgcaaaattgctgcatcctttttcttgccaaggtttttgtcggcactttttgattttttgtcggcactttttgatgccaatgatgatgatgttgatgaagccaataatgatgatgatgatggttgtcccatttccatgtctaataattgtccattgccaagtagaaatattttctcattcgtttcattttgttccattttttctttgttttctacggcttttctgtacattttctccatggttttttcaaatttagcacgtgcaattgctaagtttttttttgatttaaaatgaaaataaattttctttccacagtttttttctcaagcaaaaaattaccttcactcataaagtttgaaagctttaagatatagacaaaaaaggcttgaactttattcaaacagaattagtgtttctgaattgggaagcctttgaggcaaaatctatggggcggtccgggtttgaaccggcgtctccggctttccggaccaatgttgtacaagctaaactaccggccttgccctctcctgcctccacaatttgctcgctccttacaccctcctagacctcctgcacccaaatttctcaaaaaagtttgctaaatttttccaaaaaccaacaaattaacaatctttggtcaaatttgttataattggtaaaattttgttttccgcccgggggcggtagcttctccaagctaaacgaaccccgggggccatccctgtgctgactctgttcggtctgctgcactttctgctgcgaccgtttggcattcgttgccttaaaatagcccatcagcgccgactcgttcaaaatcaatggcggttcatcaaacgattcccatgtgtcaaacatcatggccatccgttcttcattgtcctcaccaaatggccaattaaaatggattttcgagactctggccatgcatttgatgtcatcaaataccgtagcgaagcatctgtccgaattgtcataggtactgtagagaaaaatgggcttcaccgcgccgttgtgtccgatgtgctcgcggaacaaatattcatacaaagcatccaaacacttttgaaattgacagcgctcatttttattctgatgaattttggtattggcattggcactttgccattgcttcctcatgcggtgcaaaaggccaagatgtgtgccataaacttgtgccaacatttccttgctttgtgcgcttgtgatttctttgtccgcacaaaattgctcaaacgcggtaggccctttcacaaaggcaaggaatgcgttgtcgtcagtctaattagagataatttaatttttaattagtgtgtgcgccgtccccatcactcaaaaaattgacttttttctgatcattttaactagggttaacccaacatgtttcggggaattacgaaattcgtaaattgcacttgaaataagatggaagtatctttaaatgagtttttaagacttttttgttctggactttttctttttgtgtttttttagactttttatgaaaatttcctccccgacgaaggtgttgctccccgacatttttttaatttcttcagccatccccgacaaattttttcggggaatttccttcccgttccccgacattttgctccccgagggtcggggcttaaccctaattttaaccacaaatttttaatggaaagtctcgaaactaaattgtattttcaatgtaaaattccttctaataattaaataattgaaaaagtgtatagtccacgatgttttgggctccaccggcgtgccccacccgcctggattcggggtaggaatgtttaggcagggattaatcgcggccgcgggattggcactggggctggggtgaagaacaaaaagcatttttttgaaataataattttcaaaaaaattccgtcaaattaattaaatcttgcccaaattataattaccggagatgaaaaagcaattgcgtaaactgacaaactaataataataataatttgagcaaaaatattggaaaggaaaaaattcatttgtaatttttcagagaattaaaatatgaatgaataaaaaattttatggatgtatgcttttccaatttggtgaatgaatttctcatgtaaaaagccttaaattttttctttatttggcaaatcaataaattttataaaaataatactttgaaatgaaaaaaagaattttctttattttgactttttcaaacaattaattttcattattatctctttcgatatttaacaaataattattactttttaaaaatttgcaaaaaaaaaaattttaaaaaaagctaatgaggtttttctttttactataatttaagaatttttttaatttttgcattcagccaaaaaatgaacgagaatatcaatgaccataaccaacaaaaaaagcaagaaaacatatgaaaaaaattgtaaatctttgaaaatctccgtcctcaactgggcaagttttcctttcttatgcccccaggctctccttttcggcctgctttgttgcggtaaaaaaataaatttcgattttgaaaaatcacttaaagaatatgattgattgcgttgagacaaaacgaattaatttttttaaatttttccctcggcaaataattcaattgaaatctttctatttttttcttggaaaatttccgggtcggtcccggtcaaaaatagaggtccctggttctggctgatttggtctcagttttgcacaacattcttgttcccgtattattattctcaattaaccaaaatttttgttattttttgtttgctattattacaaattaataaaaaaaatttttttttgaaattttcttttctcccattattggaaaggcaattaatgtatttgatggacagcacagatcacttacatatttagtcattcaatgataataataaatgtgatgattcagaaatgtatagcaaaatgtgtggggaaatcattcaatgaattaatttaatttcgttatttcgcattcacaattttgaaataacggataattactataaaatttgtttgtcaaatttagtcataatttaaaataataccaaatttatttttaaaaaatgaacacaatgccatcatactgtatcatattctttggtgttcttctgttggcggtccatttttacggtaagttcaaaaatttaatttcacacaaaaatagctaattgttgttttcatcctagaaatgacgaaagccgaagaatgggtttg

SEQ ID NO: 1412 - DNA, 975 bp, Heterodera glycines
cttccccagtgaaatttaacaaattcaccaaatggcgtgtgaatttcaattgtaatttctgaaattcgtttcgactgtagacgatgaaagtactcggtgctatatataacttcactaatcgaccctgggtcattgacgacgttaactattcttaagagtggagccatctggttcccgataattgtgttttctattaaatttggtgcataaatgtatagctgccttacgcctcccgtcaaatctggcatataattcgcctcttccgcatgaaataacctgtgttcttaaaaccaagcacataggcgaggtgttttgacaaatctatgtgggagacagcagcggaaagatagacaataaatttttgatcaatgctgtcatattgaaattgaacatcctcattggctagtctctctcttttttgtggtcctttctcagcttcagatacttgtctattttcaatatctttacgtttaatatgctcacccaaagcctcattaagcctattcactattccgatataacccttttccgatttatcattatattcctcgagagttgatgaatatttgctttttgcctgtttggctattccctttgcgacgtcagctgatttctttgcttctttcaagtcattcttttccacatgctctaatgttgtgtttttggctttatctacttcatcttgaaaagatttaagttcatttcggtatgtttgaatttcggtccccttctctaccattttgtcaaaccacacttttatatcaggctcttctaaaatttgaggatttacttctcttagtgtgcttagtttggtttggatggaactcgatacattgttgatatgattgagttgtctttctacatctctcccggcgcgttctgcggaccctctttgcgacatcaatttttgagtctttggtttcttcagccttggcttctctcttcccacgttgttttttgattttgtaatgatgt

SEQ ID NO: 1413 - DNA, 947 bp, Heterodera glycines
ttgttgggaagggtactgatttgtcccgcctaagttatttaattcttttctatctcttcccctcctactctctctctgctgttccctccataaatacccccgtccctttgaccatccgttcattccctcatttatttgttgtatgtgcccaactccctcaatcgatactcctgcccccatttctcttctttatttaattgtgtcttcaccaaaattggaataaataaatatttattctttggtcaagtgcaaaggcacaacaaattggcgacgcccgtggcagatatttcgacatttaatttcttcaaagaaatttcgtctgttttggatttgttggatttgcttttagcaccaacaaattttttccaaatttcatcggagcgaacttcagccagtcggcatttgaattttccaaattgttcgtcatccctactgattagcttttagcaatcagtagaagttagcgctgctgataatttgtctaggcgacatttattagctcatccacgcgcacccactcagtttgtatctaggcgctgcaaacataagagtggtaacgacaaaaatggcagcaaatccgacaattgatgaattgacgaaattgctggccaagcagcagaaactagtggaacaattgctgattgctcaacagacgaatgccgcgccagctcaatcaactcaactcccagctctttcaaacgtcgaatgttttgatcttgatgatcaatctgggaagaacatcgaaagctggatcgaccgttttgtgttggccctcgactgctcttcaccaaacatccaggaccaactgaaagtgaagctggtgctgacggaattgagcgagggagcatacaacgaatacagcaaattttgtcttgcgaagaaggcgaccgagttcgacttttcggagacatcggcacaactgaaaaagtttgtttgccaacccccaa

SEQ ID NO: 1414 - DNA, 7725 bp, Heterodera glycines
gatgagggcagactctttttaaggggggagatgttgggaagggtactgatttgtcccgcttaattattatttaattcctttctttctcttcccctcccactctctctctgttgcctcctccataaatacccccgtccctttgaccatcgttcattccctcattttatttgtttgtgtccaccatttccctcaatcgatatttgcccccactttctcttatttaattgtgtcttctccaaattggaataaataaatatttattcattggacaagtgcaaaggcacaacaaattggcgacgcccgtggcagatttcgacatatgaatttctgcaaaagaaattgcgtctgtttttttggttttttgcattgcttttagcatcaacaattttcgccaaacttaatctgagtgtacttcagccagtcggcatttgacattgccaattgttcgtcatcgctactgattagcttttagcaatcagtagaagttagcgctgctgataatttgtctaggcgacatttattagctcatccacgcgcacccactcagtttgtatctaggcgctgcaaacaagagtggtgaacgacaaaaatggcagcaaatccgacaattgatgaattgacgaaactagtggaacaattgctgaatgctcaacagacgaatgccgcgccagctcaatcaactcaactcccagctctttcaaacgtcgaatgttttgatcttgatgatcaatctgggaagaacatcgaaagttggatcgaccgttttgtgttggccctcgactgttcttcgcccaacatccaagaccaactgaaagtgaagctgatgctgaccaaattgggcgagggtgcctacaacgaatacagcaaattttgtctgccgaagaagccgaccgagttcgacttttcggagacatcggcacaactgaaaagtttgtttgccaagccccaatcggtttggatcgaccgatacgaatgtttgcgggcatcgaagcaggacgatgaagactttcgttctttcgtcaaccgccacaagcggctgcttcgcgattttgattttaagaagctgaacgaagagcagttcaactgccttatgcttctgatcgctctgaaatcgccgaaagacgccgaactgaggaagcgaattttgggaaagctgacagcagacggcgacaaagcaaagtacgaaaatgtcgtcagtgacttgcagatgttcctgtcaacaattgctgaagctaaggccattgagcgcccatcccattcgaatgttttggcgatcaatcggagaccatttcagaagagggaaccaaacaaaagcccaactcagcctacttgttggcgttgtggcggtggacatgaaccaagatgttgtcctcatgcgaaagcaacatgccgaaaatgttcaaaagttggacatttgcaaaatatgtgtgcgcgtcatcgagaatggctttcgaagcattcgagaaagccgacgcaaggaaaacagatgaatgctttacaactgggaggtatttcagtgaacgcactgaaccaaccgagccgtcttgtggaggcaccagttgatgtgaatggcaaacccattaattttgtgttcgatccgggagctgagataaccgtgatcgacgaagaagcacatcttcaaattggacgtccccgactaattctatgcagcgaaagtgccaagtaccacgatggaactgaatgcaccctgctggggaagggttttgcgactttcacgttcggaggacacacacaccaaggacaattttatgtgaccaaaaagggttcactaaatttattgggaatcgacattttggacgcttttggcttattggacacattcagagccaaagttaaaatggcaatgaaagtgaatgtcgttaaagcgggagggaaggaccgaatgaagagtcaaatcccaatgaagaaggacacgactttgctcgaccttcagtcaaattttccgcatgtttttgcagaaggcctgggccactgcaccaaagccaaagcccatttggaactgaaggcagatgctgttcccgtgtactgcaggccacgtccagtgccattcaacacacgtttgattgttgaggccgaattggaccgattgttggcgcagaaagtgatcagaccgatcgatcacacccgttgggccgcacctattgtggttgttaagaaggccaacggagcagcacgcgtttgtgcagatttttcaacgggcttgaacaacgcgttgcttttgaatcagcatccattgccgttgcccgaagacattttctccaaattgaatggaggacgaattttttctcagatcgaccttaaggatgcgtatctccaggttgaattggatgagaaatcgaaagaactgtgcacaatcgccacgcacaaaggaaatttccaatatttgcgcttaccatttggggtgaaatcagcgccagggattttccaatcgatcatggattcgattttggccgattgtcagttcgcttttgcttaccttgacgacatgatcgtggtcagtcgttcacatgaggagcatcgaaaacatttgaatgaagttttcaaacgaatcggaaattttggattccggattaaacccgacaaatgctttttcaatcagagacagattaaatatctcgggttcgtcatcgacaaaaatggaagacgaccggatccatcgaagattaaggcgatttctgaaatgcccgtccctacaaatgtttcggagcttcgatcatttttgggaatgatcaatcattaccaacaatttgtgaagaacatgcgatttcttcgacagccgttggacgaacttctgaaacaggacgtggcttgggtctggtcaacggaatgccaaaatgccttcgacaaaatcatcgaagtgctgaaatctgaccaactcttgacccactacgacccggaaaaggacatcattgtatctgccgatgcctctgattatggaatcggagcagtgatctcccatcgttttccggatggcagcttgaaagcaattgcacatgcttcttgctctttgtcgcctgccgaaatgaactactcccaaatcgaaaaagagggattagctcttgtctttgcagttcaaaagttccataaatatctttttggaagacacttcgtcctgcaaaccgaccataagccattgttgaccatttttggtaacaaaaagggcattaaagcgtgtacagcaaatcgcttacagcgctgggcactcatacttttggcgtatgattttgagatcgaataccaaaacactgccgattttggtcaagccgatgctctttcgcgcttaattgcaaaaacgccagggcccgaagatgaatttattgtggcaacaataacggaaagccctaatttggcaactgtgaatgcctttacggcacaatttccaattgtccacgaggacattgtcaatgccactaaagccgataatttgcttcaggaagtgaagggattcatcctgaaccaatggccaaacaaagcgaatatgtcagaggacattttacaattccatcgaaggcgagaagctctttcattcgaaaacggatgcattatgtacgccgaccggattgttgtcccagcatcgcttcagacggaagtgcttaagatgctacatcgcggacacccgggaatgaagcgcatgaaaagtctcgcacgccagcatgtttactggcccggaattgatcaccaaatcgaagaagtggtaagaaaatgtgagccttgtgccaccgaagcgaaggcgccaaggaaaacggagctaaattcttggccaaaagcggaagggccatggaaacgtgtccacatggactacgctggtcccttctttggaaagatgtacctgatcattgttgacgcacactccaaatggccggaagtgttcgaaatgcgttcgaccggatcagcagcaacaattgaacaattacgttcattgtgcgctcgttttggactgccggagactttggtcactgataatggcacccagtttagctccaacgaattcaaggaattcgtcaaagaaaatggcatcaaccacctcttctcagcgccatacaatccgatgtccaatggacaagcggagcgctttgtcgacacctttaagagggcatgtcggaaactgaaaaaagagggcgcgcaaaatgtggtgaacacatttttgacgtcataccggacgacgccgaatgacgctttgcccgatggcaaaaaccctgccgaacttttccttctgcgaaagcctcgcacaacattggatttgctgagagcaaaaccatcggcaccactgatcagagacgaggcgatggaaaagcagttcaatcgtcgttttggtgcaaaacctcgaaaattttgtcttggcgataaagtttttgctcgtcatcgccaatcgcaatcatggcgcgctggaatcgtcagccaatgtcagggagtcatttacgaggtaaagttcccgaatgacacttccaaccgattccatgcaaaccaaatgacggcccgtcatacggatgatgatgaccatggcaacgaagcgttgaacattttcaacgacgcttttggtcttccgttggcaccgccggatggtcccaacgaaacagctctgccagctgatcaacaagcggcacctgcacaagagacggacgaagcaaatgctgaacgaggccatgtccgtgtcgatcgcccgcaacgcaatcgacgtcctcctcaacgctattctccgagttgagcggactgatcactgatcaacggaccgatggatgaggacagacttttattttttttaaggggggagatgttgggaagggtactgatttgtcccgcttaattattatttaattcctttctatctcttcccctcccactctctctctctgttgcctcctccataaatacccccgtccctttgaccatccgttcattccctcatttatttgttgtatgtgcccaactccctcaatcgatactcctgcccccatttctcttctttatttaattgtgtcttcaccaaaattggaataaataaatatttattctttggtcaagtgcaaaggcacaacacgggttaaattttaaaaggggtaaaagcatgactgcattaattttctggaccggtaaagtcgtaattaccggaacaaaaaacaattctgaaattgatgaaatgtatcattatatacttccctatttgaaaatggcgcaaaagaaaataaaatattcaaatgaaaatagaaaatgattaaaaatgaaaaaacgggtggtaccccttgtcttggactgatcctcaactgggttcattatgcattaccaccatgtccgagctgggctcgtccctctcagcaaaggtgcgcatgggggacgttcgaaggcgtgaaccccaaacacgccatcccccgagggggcttaactcgaacaccagcgctgagagagcgaaccgagcgcataaccactacgccacggaacgctttgatggcgaagaataaatgtgcaatttgaaggaaatttttgacgagatcaaaatcggagataatgcgcgagcggcgacgaggggagggcagaaggagagggggggggggcaaaaaaaaaataatggagaattgaaaaacgggagaccaacgaattgattaaaaatccaatataaataaataggaattggaattaaatttgcaaaaatataattgtatttccttacctgccacaaatgtgacaggtggaagaattggaaaaaaaaattttaaatttgcaaaagaaaaattcaaatttcctccacctgtcacattggtgacaggtggttgattgatgaccttccgcggcgctgcgcggcgcggaaaaaaaaatacccgcgaggatttggggaaataaatgttgggcggcaacttcaaaggacacataggtttgggatttggcacacgcccctcccataggctttggtttgtgcgggaaaatgtccggggcggcaacatcaaagagctgcacccctcccataggcacggtttcgtgcgggaaacacccgcgtgaaacccgcgaggtttcggggaaaattaaaaaccgccaggcggcagacttcaaagaaacagaccctcacataggtttcggttggcacgcacccctcctataggcatgggttcgtgcgggaaacacccgcgagaaacccgcgaggttttgacgctctatactactatcatggaaatataaattgtataggcgtcgcagaaggatcgagtcgataagcgccaataattttccatttattattttggtttggccagcttgtataattcttacaatttcagctcattacccccttaaaataaactgtataagtgttgcggaagtatggagttgataaacgctaataatctccgatttacaatttacttaagcaaatttttacagatacatttggaggaaaatgagctgaaatgtgaaaatttcacaaagatggtcgtgaaaataataagtcggagattattggcgctatcaactcaatatttccgcaacgcagttagagtttatatttagatgataattagctgaaattttgagaatttcacaaggatggtcgtgaaaataataaatcagagaatattattaacccgatccttctacaatattgctgcagtatttatttagagattaagtagctgaaattgtgagattctctatttacatttcattatcactttgaaattctcaaaatttcagctcattatcatggaaatataaattgtataggcgtcgcagaaggatcgagtcgataagcgccaataattttccatttattattttggtttggccagcttgtataattcttacaatttcagctcattaccccctcaaaataaactgtataagtgttgcggaagtatggagttgataaacgctaataatttccgatttacaatttacttgaacaaatttatacagatacatttggaggaaaatgagctgaaaatgtgaaaatttcacaaagatggtcgtgaaaataataagtcggagattattggcgctatcaactcaatatttccgcaacgctgttagagtttatatttagatgataattagctgaaattttgagaatttcacaaggatggtcacgaaaataataaatcagagaatattattaacccgatccttctacaatattgctgcagtatttatttagagattaagtagctgaaattgtgagattctctatttacatttcattatcactttgaaattctcaaaatttcagctcattatcatggaaatataaattgtataggcgtcgcagaaggatcgagtcgataagcgccaataattttccatttattattttggtttgtccagcttgtataattcttacaatttcagctcattaccccctcaaaataaactgtataagtgttgcggaagtatggagttgataaacgctaataatttccgatttacaatttacttgagcaaatttatacagatacatttggaggaaaatgagctgaaaatgtgaaaatttcacaaagatggtcgtgaaaataataagtcggagattattggcgctatcaactcaatatttccgcaacgcagttagagtttatatttagatgataattagctgaaattttgagaatttcacaaggatggtcacgaaaataataaatcagagataagattaacccgatccttctacaatattgctgcagtctttaaaggagattaagtagctgaaattgtgagattctctattta

SEQ ID NO: 1415 - DNA, 3065 bp, Heterodera glycines
cccaagcaaagcataaccgtggagcacgacggaatcacggagattgacgaagagaaattagccgaccgattgccggtgattgtcgagaacttccggtgcgcttactcctcaaggtgggtgctattgccgcttcaatttggctaattgccctaattaattaattggttcataaaatgcttttctttctcttttcagggcttacgccgcctttttggccttcgaatgttcattggtcatgtctcctctgctgcttctgctcttcgtccttccgctgatgatcggcggtgcctatcgctcctggggtttggacatcgctcgcgcgtggtgggagaggagagattggtcggttagcaacggattacaaaattctcaatttctaaattagtttcggctccgacaattttttaggattcgagactattttgttacatacgggtgcattgcgacccctcctcccccgcgggttccccccgtatcaattccctacccgtgaagtttaaaaaaacactttttaaacagaaatttttcaagaaaaaaaataacaatttaaaacaaatttaacgggggagggtgaacgaactgctcccagtacaaacactcaccccccccccccccaagggagtttcttaagaaaaagacaataaatggctgaatgacattttttcccccgggtgcccccgaaaatcctcagttctaatttttaaaaaacgtcacattttcctacccccccatttctccaacttcaaaaaattttgagaaaacaaagtcaaaaatttttaaaaaatgtttcccaaaaaacaaaaaaaaactttgcaaaattccccccaattatcccatttttttgggaattaataaattaatttctcccacttttctcttccccccctttcgggaaagggtccccgttgggccctttttacaaaatcccaattggggtctccacccccccccccgggggccttggtccccccgaaccctaatggaaataaccttttttttctgggggaaatccaaaacccaacttttccgtggtacagggggcccattggccaggaaaaggacttttttcctgggaaaaaaaataccatataccccaaaaaaaaaataaattttaaaaaagtttcggggttttgcttttttttttgccacaaaaaaaaggagaaattttgttttttttcaaaaagaccccaccaacaatcttctccccccaccccccccggggggcccacaaaaaaaagaaaaaacacagaataaaaaaaaacaaaaaaaaaagaaaaaagaagttgtttctccaaaaaaatacaaaaaaggaccgctcctttttttttttttttttgttgtaggaggaaaaaaaaaaaaaaaattaaatatattttttttttttttttttttttttttttcttcccccccccgccggtgttgggggggggcggggggggaaggaagaggggcggggggggggtgagaaataaaaaatagtatttgattttttttaaaaaaatgttattagtaaaaaatagttgcggaaaaattttttgttttggggaaactgcaaataaaacaccacattttcccgtttttttaggcttttgcctcgggcttcatctccttccaatttcatcattgtcttttcgtctcttcccccttttgttgactccgttgtgccattcgttctgaccaacgaattcactcgtgaacaattggcattcaaaagaattaaccatcgtttgctgctgatccgttgtccaattgcgcgagacgaaagcaaatggacaaaatgggagaaggaagcgattgattggcaaatttataatctgaagaacagaattgacattgatatttatcgtgaggaccaaatcggagacgggtcagagaatgcttatttaaaattcaaattgattgcttttctatttttaggcttctctacgcaactcccggcccaagtgatcagcagtagaagtgaatgattgaattgttaagaaatgatcgatcgatcgataattatgaattgtaaaatgattttttgacttgctcataaaaatgcttttgttggaatgatcagttttgcttgtttttgtattctttaggataaaaaatttagtgatttcctgaaaccgaaactaactgaaagttttttattcaatccaatccacaccataaaaggaatggctctactccagtttatgcgtccaatcgttttttatgcgtccaatcgacttttatgcgtccaatcgctttttatgcgtccaatcaaagttttatgcgtccaatcattttttatgtatcaaattatgtttttttgccaaaataaaggttttatgctttcatgagtcaaaaagtttgccacactttttatgggcagccgctgcctttttccattagtcggcattgagtcgaccctcgtgacagacaagtgcatacccaaggcattgaggctacgtgggggtctctgaagacatctcttcgccatttgcgtggctcaaatgaggatatgttgccgacatatttgtatcagtatatgttcagacgatttcacggaaattccaaaatatatcagcatattttggaagaaatgagacgcaattatcccgtgtagtgtaagagatttttttttacaaaaactggcaagggataataattttcacatggtaaatgttattggatgcataaaaaatgattggacgcataaaactttgattggacgcataaaacgtgattggacgcataaaatgagattggacgcataaaaaacgattggacgcataaactgaagtagagccccttactattacccaaatttttttacaaattacattttatgcctcttattagaacattcgcaaatcgctggccgtggacgtggatctaatctccaacagaagacgggtgacgctaacagcagctaatatttaccatcaacttttgttgtttagaacacggacgcggctacagcaggggtatgcaacaacagcaactcagagaactttcaccaatgcttgggccccgagggggccgaggacacggcgtctcaggacatggcttagaccgtcatcctgttgcttcta

SEQ ID NO: 1416 - DNA, 2960 bp, Heterodera glycines
ttttttgcggttattttaaggcatttctcggccaaaaaatatctcttcatatctggtggcctcttaaaaagctcgtaagagtgggggttctcagctgggtttgatctctgccataggggacggctgttgttgctcatttatccgcaattttcattgtgatgaaggggtatgatgacatgtgttgctgctttttatgtgtgatatttttgacagctatttcgtcaaggaataaacaaaaattgaggagtggcatatagcggagaatgtatttaggatcttttttgttaatctaatgacgtcttgattcagaggcaaataacaaaaaacgtattcatgaaaattgtgaaaaactcgaaattttgaagttttttcttaataaaaattttttcaggcttgaaaatctatctgctttttgtaaggctaatagagcatgttaagagctttcgaatgataccaagattgttagatttgaataacaaataaaaaagctaaattggaaaaacgtgctggcgcccaaccgtgagcgcccaactgacgggttccgaaaaattatgatcaaaaatgttctaaaaatcaagtttttttttcattgttttctgccataaatcataaaaatggccaaaaagtcacaataccttaaatttccatccccaatcattagattatctaaaagttatattaaaaaaacactcaatattcaaaaaacttatagagccaaaaaggtgtgaaaaagcgaatttttttatgcataaatcgtacgaatgaaagaaaataggaaagtagggagagcttttataggaccgtttagtaaaatgatgaaaaaattggcaacaaccaaaaaaattagtacatataaaagcggttgctcctccgtcacttttcgtttatccattcgccatttatccatttgaatctctccgaatttgtcgccctgacaattccttcaaaaaatgattttgtacgttttgctcatttcttcccaattttttcctgtttcttctcattttttagtctgtacggcgtgccaatgtttgttggctgttgtgccattctttggatttattggaaccgccccaaaaaaccaccaaaaccacgaggacatcgcaaaaagaaaatgtaaaaataaaaaataattccatttttcaatttattttttttttaaattttcagtttcatttccggcgacgttttgctgtcggtgttccaatttcttgcgccttctcaattgggtcttggaattgcactggtcagccaccgatttgacaccatcgtcgacgaacagttcaaaacgcggcgttgggtgctgaactccatggaaatttggcgccaattttggaagtttttcacgaaagaaatgggaattgtcgatttctattggaaaacattgccaattccgcaagtccaattgccacgcaacgtcatcggattcaaacgcatcaccatctcgtaaaattgagcgattatgctaaaaattttaagctaacatttccccatccattttcacagtttcatcgaccaaaatgtcatcgcttttctccaccattttcgtccacttttcgccgcctgtccaatttatttgtccatccaaacgtttcgtggtaattatcgcatttggaagttgattttgcgcaacatttggccactgctcggaaacaacattcatagcatgggattgtccgtcggaacattccaccgtttgcgcaaattcgagccgtcatttctcgacgattgtgcatcgcttcgcgttgtctccttggacaatttcttcatcgaattcccggccgatgacagtgccacggcatcggatggacaattcgtggccaaatggctgttcactccgcgcccaaacaatgtgccgaaggtgttcgaatgctcgttgtacatggatgatgaaatgttgttgtcgatgattgacgccatcaaaggggtgattactagggcgtcaaattatatggaaatccatattttttttcctggactgtgggaagcctgaaacgtacgaaaaacatgtttttagctttgtttgaagcttctaggatgggtttctatatccatatttttccatatttcgcgatttatgtccatatttgtccatattttggcatttaagtccatattttatgtccatattttgatatttttccaaaaaacctctattagaacggccccaatcagctaaattagccttttggcccccctaacaaataaggatcgaaaaattttcagaaaaaatgatttttagaaaaatcttatttacatttcaaattttcttaaaaaatggcaacattatgtcaaaaataagcaaagcgaaaattttgcttttcgggccgattttcgctaagactgagtaactaactttatcgttattttttcttctaaaatgatttttaataccatgtttagccatttttgaacgttttactttacatttagcgaatttgaggaaattttgagaaagcatacccttaattctgaaaaatttatgtccatatttttccattttatgtccatattttgagatttttgcaattttatatccatattttgcgatttgttgtccatattttatggccatatttcgtgattttatatccatataatttgacgccctactgattactaattgattcatttggcactttgccgtcttgtgattcgctgatctggcatgaatgttgtttttcatccaatcttcctgactcaaaacgtctcctaccacccaacttgtgttttcattcgatcccatcagatcggtctaaaccgtaaagtgcctcatggggtttttttttgtgccccccccccctccccccccccacaaaaagtgtcatttatttgtcatttactatttattaaccgattttttcccaaatttaggcttttgtttgggctacatcacccgccaatttcatttttgccatttgggtcttgactatgaagacaccgtcgtgccatttgatctg

SEQ ID NO: 1417 - DNA, 4872 bp, Heterodera glycines
tgttttttgctgatccgttgtccaattgcgcgagacgcgaacgaatgggcaaaatgggagaaggaagcgagtggctggcgaattcatgaccaatggaacgcaattgacatttcaattatttgtacgggtgcaatcggcgacgggtcagtgcataaattattcaaattattttgtttttttttttaatttgaaggcttctcgacgcaactcccggcccaagtgatcagcagcagaagtgaatgaatggattgtaaataagtgatcgatcgatcggtcaatttgaattatgaaattattggcgtgctcataaattgttgtacatatttttttttgagtattatatgaaaaatgtccaaatttttgttgcaacctttgggtcttatttcacactaaatggaaaagcatttgctttttatgcggctttttttttgttatttatgaggtaataaaaatgaatctaatcaatgatatattcatgatcagcgaccccgaaaactcttgattgaaagcgtataccgtacatactctttttatcctccatggggtattatttttcaacatcctcagaaagggggggggggataactggagactgggggattaagatagagtaggaatgtgatctgaaaatcaatttgttgacagattttgtcgaaaaaatagtctaaattttactattctggaatgttttttaagaaaataaagaatttttaggatgacgccgcaaattttagaaattttggctagtttttcaacagatttttgtccaaaaatgaacaaatttgtgtcaaactttgaatttcttgaaaaataaagacgctatgccataaaatttcaaaattatgaatatattaagaaatccgaacaattttggtcaataccccaaaatctgaacatttcttagaaataagaacatatcaaatccctgagatagagggattatttttcaaacgcctcttagactgggggataattgagctttggggattaatggagattgggggataattagagaatattcggtaaacactggcactccttgataaaaaattaagcggaaaaatttttcaaatgttcaattgaagtcaggggttcgatcgaaaatttttgaaaacaaggtcatagctaatcaaaaataaattttggaccgaaattcaaaacattttgtgtatcattcgaaagcttaacatgtttagaagctttttctaagacattgcttcgcgattagacaattatcaaaaaaattataacataaaaatagtaaaaaaaaaagttatagtccaaaagcatgctggggtcgaatcgtcgaagccgaactgagcaagtccgaaaccacacacattgtttccctgttcatcatcggctgttgttgtcaccaattttgccgtatttatgtgccgcgttcaatgccatccgaaccgcttccggtgcaacacaataatgtacaaaaagaacagattcccatttgcagatgcaatttacggcatttgtcaatttgacaggtccgccaccttcgcaattttcccttttcttatgctttacttcttcaacccgttctttgcatattcgggcacattgctcacaatatttttgaacatcagcaacacacttgtttggatcaagcttatccgcgtaagccaaatgaatgcctgtgaatgagacaaatgttatgagtaggggcgacgattttaaactctaaaaactgcaaaaatagtctaaaaaaccccaaaataggggctaaataaataatttttaaaatttaaattcttatcaaaaaaaataaataaattttggagacgattttgagaatatttttcatttttagcggtgtttttttggaaattttcggtcgattcttagggggtgtaaactcaaaaaagtagcttaacaacaaccgaaaagaaaaatgtttttcgtgcgtttcagactatggggaactaagtttatccataatttgtaaattatttgaaaattaaattataaaattttatttttcatttgctactaaaatttttacaagtttttcaacatacgatttagcactagcataagaaggaacagaagaagcattgttgtcagcctatgaatttttgaggaatggtaagaaaatgaaaataaaataaaaatggaaataaaaatagaaaaattaaaataaaataaaatggaaatgaaaatgaaaatgaaaaagtataaaaataatattgatcaaatcaatatttttttgtatgacgtacattcatctttatattgttggcttctattgattttatttttcttatacattttatgcttgaattaaaatctgaaactcaataatatccatctaacattaccttatttttttggactcaattttcccgaaattgtccccaaatatcagtccgcaaatgtcagtaaggcgctatgaccgatcaaaataagcaaacaatactttgtttcgatttatagaaaattgttttttggtttttgcacaacccaatcaaatacccaatcaacttagtaaaaatttatttaaaaaataaaatttaagagattgaatcttcgtgaaagttttccatttctagggaaagttgggttttatggaacttgatgaattattggtagaggaaatcaatcaccctgttccacgtggacagttcagaacctcacagccatttcggcgccaaaatacttttgcaaatcttttaaaggggaggcgcgaacgccgtcccccgcactcaaaaatttagctgtgggcctatcccagttcgggaccgccctgcgggtcagccccgaccgaaagtgcaatggtggagcctcgccacaggagccctgcctttgtgatcgcaggaactccccagccaggtaagtttagagagcagcaaccagtccaactgacaggcaaattaaagaagaaatgagagatggggtggaaaataggggagagatgaagaggattgtggaaagagaggacactctctccccaggcacactcgtttcttttccaattagctgtgcactatttccttcccatgatcgtctgtcagttggctgaaattcttcactctttttacacgtcgtccttattttctttccctcaaagaaagcgtaagacacatgcacagatgggcaaaaaagaaaagagataataataccaattacggtttcagaaaatcttaaaatgttttaacgaattaaaactgatttttgtttcacacccacaaaaaagacgaaaactattccatttaaattaaagtacagcggaaccgggaccaaaacacggacaactgagtaccgaagtcccgattttgaccgggactagtcccggtttttccccggttttcccagccaaaaattcccggtttttcaacccgaaaaggtcccggtcccggttaagactaaattcccggtcccgctgctctctcatttaaatttaacttttgaatatcattttcccgcttgaatttttgtaaatgaatcctggcacttttcagtgcctatgcatccaatcagtcagtgatcatcctcagtttcttgggccatagcttttttccataattggcattcatcatggttgaaatgaaagcttaatacaattctttgtgattaagaaatacacgaaaataacaaatgctgacattgaacaaagattgaaaagagaaaatccgaaattctgcttttttaaagtatattcacaaattgttttttgtctgttggctttagccctgaatttagctatacaaaaacttggctaaactccaagctttcaattgatacccaaaaatgtgggcattgagcaaatgaaaaaaaagttttggcctaagaaactaaggatagatcactgcaaaagcaatgtaaaagcaaaatcccaatttcaatatcaattttgttttcccttttcttcagcttcatctccggcgattgttggctggcggtgtacgatttgctgccgccgtcacaacttggactgggaattgcgacgatcagcctccgttatgactattacgtggacgaaaatttcaagacgcgcaaatgggcactgaaatttatgcgaattcaaagcaaaattggagcaaatgggatggaaatgcaaattgtcaattcagttggggaagaattgccaattccacaatttgacgtgcctcccaaagtgaccggcttcgaatgcatcgtgtttgtcggctgttgtgccattctttggctttatgttaaaaacggaaaaaaaaattgaaaattttattgttttcctttttcttcagtttcatctacgccgattgttggctttttgtgcaacaacaccaaaaatgcaaaatttgagcatttttttgatgctggcaactattttttataattttaatacctattgtaacggtaaaagaattatttgacattcaaaaatttgcccatttttcgggtttcaagggcgttgatagttaattaattagtgaataattaatgggatttcttaaaaaataaaaactgtgcctgcaaattgacgagcccgtcaatgtcctgaggcagatgggtgatggaattgttggacaagttcaggctggacaactgagtgaggttgacaaacgatttgggaaaactgaaaaaagaaaattcactttaaaaaacggcgaaaattttggaaaaaacggaggcctacccggtcacaatgtttgtgcttatgtccaaataggccaaattgtggcagagaccgatttcttcagccacttcgacaatttctggggaaaaaaggattgggataaattagagagaaaaattgggataaattagtggatggatttttgaaaaaattgaattttaggaaaataaaagcctcctagaggaggggtcagagttttacgtttgaccaattttctgttttttttggtgaaataagcacaa

SEQ ID NO: 1418 - DNA, 5116 bp, Heterodera glycines
  misc_feature (4956)..(4956): n is a, c, g, or t
  misc_feature (5075)..(5075): n is a, c, g, or t
  misc_feature (5090)..(5090): n is a, c, g, or t
aaattcaattgtttggtttgtttatttttatttcaaatggtatttttgtgatgccaatcctgaattaactgctgacaaattaaactgaatgatttaaagcgaaatttaatattgccttaggcgataaatttaaagcgtccaattcagtgccaataatttgcccaattaaagtaagaaaaatgctagcataattaataattaccaaaaattccattttctgtatcaaataatgcaataaatttattaaaaatttgtttcaaaccctttgagcttttttgggaaatcaaaaaaaaatgccattttaaaattggcgaatgccaatttgagtaccttgatgaagtgttctttgagcacttcggcacggggtttgcccgttctccggtcgtaaatgtcttcaatggacagtttttcactgatcggaaaatggaccgcttaaatgagcacaaattttgcaaaataaattaattattttttgacatttatgtaattagtgccaaattttttcacagttattttaatcttttatttcatataattttttggctttttaggagttaatttattaataaaatcgcaataattctttgggtaattagtccgtaaaatttgccggaattcctaatgagcttttttggggatatctttaagcctcgcatccgtttcgatgctttcaatttccggttttaaatgccggtttaatcaattttaaatttttggttttccattaaatgataaatccggctttttacaattgatcacgcgttccgtggtcgaatgggtcggcatagggcgattccgaagtattaattggcccgttgtatctgtttgtgccggatcattttcatttgctgtggtagctgctgaatcggtgccgggcgaagtcatttgctattggcactgcgttttttagggttaataattatcaagatgggttaattagcgcatccaattaattcattaattaattggttaatcgatcgactaacggagggtaataaatgaattagtcaattcaaaatatgtggaaaaacgggtttttattaattgggattcaatgcggaacaaaatgtatgtattaaatgggcctcattaggaataaaacgcatactaattggcagcaattagaggcaaaatgtctgtcccaagagacttggccaaaagtcaaaagaccccaacaaattgggaggcgccaatccttcacaatttgtggggccataagtcaaacagcagataattaacaaaaataatcggattaaagagacggacaaattgtcgacaaatcaagcggaaaatcggggcaaaattcatcgcccagcaaaaatgtgccatgaaaaatcggacaaaacggcacggctaatcggtgccgtcctttggctttcttggcttttgtgtgtttatggcttcttggagtagcagcagcagcatcaccacaaccacggcattggcattttttgcttttacataataaaataatggtgtgtgtgtgtgcctatgggggaggggagtgtgtacattggcactgacattgtgcgccgcgccgtgccgtaatgccataccaaacgcaacgaggaagatccagataagattttactaaaaatagagcacttcaaggattttgagatattttttgagaaataaggaaaatggacacgatagtgccaataggcggaagtaggaaattttgcatatggaggattaattaattttttagcataaattttaaaatcttttattttttatttttgcttaaattttaattattctataattaaattgcgtcacaaaatcagaggtgtacgcatcgcatcgcctcatcaataaattcgtaaacaaaaaatgtcaagcaaaaggcaatcgtccccccattattatccatatcacccatcccacctttagcattgcaataattagctgtcagattaatatgccagccatgtcccgcccaggcagacaaataacggattaataggccaaggggcatcgccacatctcggctcggggcacggcacggctggcaaaatcttatttacaccgttgattttatttaatttcttttttttttttgttactatcatgccaccgcatcagcagcatgggatgcatttttcgtaatgagttgtgttttaaatgaaaaagcatcaatcagcaattggcaccacacacccacctactaaacgccccctcctctcctgaggcatttaaaaccggtacaaaaaagttgcccgagggatttattaatgggcaaattcacaatttcacggacaattagctccagccctatgctggaccacaccacaaccagaagcaagagttgacgttttgcaggcccatcacctcattttcatcaagcgccaaatagcagtcagcagttagcagaaaaagcgcgcggcgatgtgatagtgtaaataatcccccccgcggggcttcaaacggcaccctcccccctcccctctccgagttcgtcctcgttgtcatatccatttaccgcacagccgaccccatcggtgccatcaatagtagtggtgccaatggaatttcacaccccttttagcctccccccacatcagttgagcagcagcaataatggctccacccctggcgggccggacaagtctccccatcatccattttcattattggcatcttcccagcccccagtcggagaatgtggcaaaaatggaaatcccatcccccacccgtaggcgaaatttcagagcaaaaatcagtgaccatgcgcttctgctcgaagagcaccaaaaattgtttcattagcgaaccacaattaaatttctaaatgcggcgtgaaagtttttctgtctgaaatgataattaaaataattttaaagatagaagaaccatttcaatttgttggcaatgctcgtttccgcccccccccccactccatttttaatgtcatttgtacaaattaaatccgatttttagatgagcggttcccgagacatttaaaataattggatcactaatatgctcataataaaactaatttaaaaccgttattttagaacagaaatttgcttttttccattttaaaatgaggctgttaatctgtgacgaggagctgagtttgttcaacctgaacaacagtttgaccgttgcactgctcgacactttgtggcgtgtttccacgtaattttgtttttccataattttaattaattgttcatttacctatcattttccgagtcgtttatcgtgggttagttatgtaattagccatgaaaatgctacttaatgagctaatcccaaaaacaatgcgtgggagggagtgggtgttaaatgtaatttattttgttattttaaaggcatcccaattccgatgaattcattaaaaccaaaagaataataattatggggccataaaaaatctaaaaaatgccggctaaatttaatttaattggtgccatgccattcattgcgcccgcccttttcagcctgtacaacaaagtgcactgttggcttggcctgttcatctgcgtgttcggctcgttggccaactgtgtgcacatttttgtgctgtcccggcccgccatgcaaaagtgtgcggtcaaccgactgttggccatcatcgcattgtgcgacatcgccacaatggcctcctacacagtgtttgttgtacgctttgagtttgccgtggacaacgaagagccaccgctgggctacgacttcttttggtccgcaaattatatatttttttgtataaataaggaccatacaaatagtcaaggacatttggactagaattaagtttgtgagaacatgcgtgcttaaatgtggaaaatccagggatattcaaggacaaataaatgctcagaaaaatttcacggcttaaattatttaagagcattttcaaatcgagatcaatctaattgatgaagttatttttaagaataaggacacaaaaaacccataaaataccttaatgagattatttatgatcgatttatcgatagctttattcgaatttatccaagtttatttgatcagccctgcttttacattcggctgatcaatttgatcaaattcaggattgtcttcctgttggcccatgttgtctgttcaatcgcgcttcacacaatcaccgtgtacttgactgtgatcacagcattgatccgctacaaaacgctgaagcgtgtcagctctttgtggaaccatgagaacattgcttggtaaaccaaaaatgcttggcattatgtgtctaactttttattcaatttttaaatttaagtccaattttcgtcgctgtcgctgtcctgacagtgttcttgtgcattcccacttttctgatccattccatcattcccgtgtctgccgctgatccgatcacccaccaaaatctcactttgtacactgtgggactggccgagttcaagcagttcgacacatgcttgttcttcaagctcaacctgtggctgaccggcatcatttttaaggtggcctagctcattgcgactatttcgaacttttttacaaatctgatccaactaggatattatttttatctatttctcgggtactattgacctatttaaaaacattttaccttttttgaacaataaagtggaggtgaaagttcaaatccgctacaaaactaatatttttatttatttatttatccaaaaaataaaaatgacgatttttagaaatatttttgaagggtttcgggaactaaaatggacaatatagctctctaaaaataatcccatttttttctctcattgtcctgtctaattttgtgtcaaaaaaggggaagcaatgattcaactcattaactttgacgcacgcacatccatttctaatccgggcacaaatatagagggaccacgacagattaaataatggtttctgttagtggatgaggtcgtagtgattacgtaaaaaaatgttaaattacattttcttagcattccaaacatcattttcatgtcatcagcttanaatgatgaaagtgagaagtagtgacataaattaattagtttttgagatagaaaaattatgaaaaataaataaataaatttttaaattataaagaccatttcggcagagaattttttaanaaacaaattctttanatttattaatgtatgtaatgcaaatt

SEQ ID NO: 1419 - DNA, 2704 bp, Heterodera glycines
gtgggactggccgagttcaagcagttcgacacatgcctgttctttaagctcaacctgtggctgaccggcataattttcaaggtgggctacactatttcgaattatagaatggatactaagacttacaatttccgtttataatttaaatcccatttatttttttatgtttttttttttgcttttcttggcacattaaatattcaccccatacaatttcgaagtgccgaattaaatacagtattaattaaattacagacttaattacctcaattaacattctccaaaaattcaagcttttcttttgattaaaagatttttttcgatttcgaaccctttaatttttaatttaacttccttctaaatttgatttgcgtcatttcgcgcacgcgttttagagcaaccctataaaaatttactggcttatttgtgtttttttattgctttgtgtgcggacatgtgccaacggcggaatggcgtgtttgctaagtcccaaaatctaatattgctaatccggcaccgaaatgccaaaagctttttccgtttccgattaaacagtaattatttgggctgcccaaggccgattatgactaattgacgtaattatttttgttattattttcggtgccacgacatgccgataccaaaataattgtgttgagcatttagcggatgaatggataaaaaatggattttgacgtggataatagcaacactaattaaagcaaataaatagaataacagaaatttaaatgagtagaaattaattttaattttttgaattatttattatgttgtccttatatgtaaaaaaagaaaaagaaaatttattactattcataattaatttctgtattaattaaaaaggctttgatttaaaaggatttggatgtttaagttttgctctttggtcaccaaaagggcataagataattatagtttagatcaaaagctttagagataagtacttctggcaataattagttgacaattatttgaaacatcattaaacattgaacggcttctccttcttccattatgtcatttattcgttttcaaaacgtcataaaataaaaatataattaaattttaattttagaaattttttaatcccggatttttcaaggtgatcccatgtgttctgctactgttgttcacattggcactgctgtacgagctggagaagaacagccggaagcggaaatcgatgtgttccggcacaacattggcataccgacggcattcagcccaatctgatcggactacaaaaattttgttgatccttctgatcgtctttttttgcaccgaatttcctcaaggtgtgataaaagcataaaacaatcctagtatttgagaaattattcatttttttatcatgaattgtgccttgtttattggccacttttgaaatttcaaagcctttttatcccgtcattttttaaggcattttggcaattctgaacgggctgttccccaacgacatccatcagttcgtctacctttcctttggtgaactgcttgatctcctttcgctgatcaactgcaacacatgcttcattgtctacccgctgatctcctcccaatatcgggcaacgctgcgcaacttggccgattgcattcgacagattgcgcagggccggggatggcaagcggcgaccgcaaatctcaggtagcaaatttaataattgcagcagatatcatcagatttttatgttgatctcacataagaggcattttttggaacaaataatttaagaaagaaaattttttccaaaattttcttaagaattctatagcaataattttttgaaaaatcaaattgaaattctcgaaattttaaagaaataattatgatctaacactttccttgaacacagaagccgatcaagaatgtcggaatcaaagtttgtggtcactaatcgccgttacacaatgtcttcttcgtccgggtctcctttatccaagtaaaaatattttgcaaaatttttatttttgtttaatttttcaaaaaaaaaaattcaggccatccttctcatttttcttgaccacttcaaacaaatgtatcacaacacttcgacgcacattcaatcaaaatgccactggcgacattagctgtgacattttgcaacaacaacaggcgatccgtttcatggaaggccacgatctgttcctctgatcagtggtgctttatctccctaacattagtggcaaaagcgtgccctgatcatgtgaattttagccaaatttttaagaattgtagttgattatcacaaaatttagtctctgcattcaaaaatttttccgggttcgtccctgatattgtttgcatgcttctgaactgtctaacatatttattgtgatagagtttcactgttacgggttcaaaaattattttgtttggctgattagttttatgtggaatattttttgtttattaattaatttacaaactttttgttctattattatgttttatttattttacattcatttttgtattttcccaaaattattgtatgtattgtaaaaagcgaagataataaaatgaattggtgttttctttattaaacaagtaaaaaaactaattaagcaatttaattatttatcacaatgaagcatcatcgatcacttttctgtaatgcatcggtttcaggctgatcagccaagttcacagatcgcttgccaagataatagtagtacgggtaca

SEQ ID NO: 1420 - DNA, 1433 bp, Heterodera glycines
gatgtcaggtaactcttgtgtcgaatgcgatattcttgagtcactaatcacagaactggcttgggaaacttccggggttcattttctaatttaacgctttatctatattacagtaataaaataaaagacacttaaaaaatttttataaggaattttctagaaaaaaatatttgaaaattttcgaaaaacccttagtaaactataaaaattttcaaaaaatatctaagaaaaatttttaaacttttttttgcatgaattttcttactaacaaaatttctttaagttattctcatttaaaaaaatctaggccctccccgtcgccttcatcgccctccccagtcaacaccaatgccacagcgtgccgtcgaccgacgctgcgcacattgatcaatggcggtgaagtgccgtccatccgttttctggatgatcaggacgtactactttgattgatcaaatattttccaaattcaaataaaatatttttttgcacacatacatttttatctacccagaaatttcacataataaaattgatttgaaaatgatattccatttgtcacaattaggtaattctttgatcagtcccacatttggcactgtgctgatcatccatccaattttcattgtggcttctcgtttttcaattcatcaggtccaaatccagccgatcgttttccatagaaaccgtagccatagtagggccagcctaaattgattttaaaaaaatttttaaacaatttcagcatgtttaaaatgcattaaatttcaaaacgtactccatgatgacccatatgatccatatccgtacagtccgccgtaaagtgatggccaatagccgccgtaaaattgtgcttcactaacttcgaccataacgccaaccaacaagacagcaaagatgaacattgagatgagcttcattttcaatgcggaagtgaagaaatggaaacttttttttttgctaaatttggtttttttaatttttgacaaaaatttttatgtataaatcaggccaaattgggcttctgaggttaaatcaggatttatccatatgccttaattcatgaatacaggttggctgggcgtaatattttgcccaactaattttgttggataattggacaaatgtgtgtcattagtgcaacagaaaaaattgatttcatttttgaaaatttggcctgaatatgatgaattgggcccgacactttatgatgaattgggtactttgaatgttgatgatgatgatctacaatgaatctgtgccacacttctgtgatcgttctgcttatataggaccgaattttgtacatttatttgttttcccgtgaaaaactttcccactcccgagaatatcttctggagaacaacaaaacaaaaaagcagcaagcagttcacgacccaatgaatggaagtgggggggggataaaaagaacatc

SEQ ID NO: 1421 - DNA, 5511 bp, Heterodera glycines
tgtaaatgggacaaaaccttgtacaagtgcgcaaccaattaatatcagcagagaaaatgattttgaaatattgaaaattgtcatttctttaataaatttaaattacattattaaagacataaaaattgcattttcttatttctttaatttaatatgtaaatattttgatttattaaataatgtattttaatttaaaaaataaacaataaatgaattaattgtgaatttttggcctattatatttggccaaatgcggaggcgaacggggaaacaacctgtgcttatgtaatcaccgtaatgatgcttaattacccatttaaccggcggattggtccgatcggaaaggaaaagcttcaccttttgattaagcatatgtttattcatcggatttatttaggtatattttttctcgccgagttgtaaaaatgtttctataagaaaaggatgataaaataataaaaataattcttttaaaatatattctggatttttcattccaaaaatattaaaatcttttatttaaaatctttttttttacgttttttgttttttgtatagataaaaaattttataattttttttattcatatcttctttttcaaattttttattcttttctttttaataagcccttgctaattttagccattggccttggaatttgttttttttttgtttgctttgccccttccgtttcggccctctctaaaatgcttttcacagaatttggcggaaatgttcatacgtagtttggagaaagcacccatcattttgtgttcagaaggactaattgatttgaagatgaatggagaattttaaagaatttggagctcttgaattttgatgaattaatcaaataaaaatcaaaatgcatacaaatcaaattaaattaaaaaaaaaataaaaatttaacaatcatatgcaaattttaggaaaatgtacatatgatgcgttgctttttcaagatcgtcttggcaattttgacgaatttgtaacccgcattggaatattaccacattaattacatcttaattatacaaactttgggaaaaggtgcgatggtttgcttttttcaaggacatcctttggatccaaggacgcttttccatgtcctgttttggactattcacatagtttttttccatctttgatgttttgtcagacaatacaatttctttctttcttttttgtatttgtttgctcaccgacccgctttcattcatcccgacaattgctgctgttgctctcgttgaatttttttttgcctctattgcaagccgagaacagcatgctctcgagtggagaatgttcatgttcatgcaccctaacctcctaccccaacaaaatttccacttgagaatgtatttggagcattttttgaagtatgccatcgcttggagatggagcggagcgcggcacttgaacaacgatttgttggcattttaggagcaatttttgagtggtgtgccaaccgacagtcgcgcatgcaccgccgataagcctctggtggggggagcttggccccatataaaaggcgtaaatcccaaccaacaaatcatcaatttgcgaagtcaaaaaattctttcaatctccctcacattcaattttcttggctcaacaaacaaaatcatgaaattcgccgttgtctccctgctgttcgtcatggcattcttcgtcggcattgccgtcattgaacagtgtgaagcacaaatgtacggctacggcatgtatggcggctggccctactcctcatacatgtgtatgtctttatgttccaaatttactaatttcagcttaattataacagaaaactgatacaaaacatacgccgttaattatttcgtaaaagcaaaaaatttcggaaaaaattgctacgacttttcataaaagaaatcaaatttacttttttttcgtatcattcagtacggtaaagctaaaagtacggtaacccagctctgaaattcttcctatttttggaaaattatttttttcttcttctcagacccctactacatgtacggcggcattggcaagcgtgaagccggctttggcggcccaagcgggcgactgccgctgttggcacgaaagcccaattagatcagttgcttaaagggcaaaatatgtgatgaaaatgatcggcttacatttgcccaactgaaatgtcgcattcatcagaaaaaattttaaatgcataaaatgtttttaaaattatgaaaaatgaccccatcccaatgaccattttataatgagcgcgggggcgggggttgggaccatggggagggtggaacggtaatgcacaccatggttagtgctaggtcatattatttttttaatttccaggttttaatctattttcgggtttagatcgctatgatgattggtcggtctgtttaagttgatgaaaaaaaaaattttacgatacaaaatagctttagcagaataatctgcgttcatcttggcataagagtaagcaaactattatcggcagagattcggtttaaacataaaaatttttttgtttctatatttttgcacctgactgtactttgttaaagaatcaaaaaattataaattaaattaattttaattttaaaatgattaacaatccgtcctgtccctccctccctcttcacccgtttgtacaaccattctgttgttgctttgcctaatccaaattcaaaatcaaatttttgtcattaatgccctttttgggtcacaaatttacctcggaccaaaaaaagagaaaatgacgtagagaattttggatgaaataaaaattcaaaaaaaaatgcttatttattatgccttcatttttcaatttgttccgatacttcgcatatataaatcagagtacaaaaaaaaatatgtatgaataggatttgttcccccctactgcaaatgtttccctgtccattaaatttagagttgcacggtaccgataccggtactggccggtaattaccggttttttttggtaccggtaccggttttttcaaaaatcaaagtaccggtaccggtttgtctagtaccggtaccgccggtaaaaatttgcactggtaagaatgggggtctggtcgagaaaaaaataggaaattggtgaagaaggagaaatttttgagaaaaaattaaattttatttcatttagtatccatgcatatgtggggtgtaatggttaaaccttctgcctttcattatttttcacttaggttcaattccccactcgggatagaatattctccatattttctttaccattattttaattgaaattttaatttaaaaaaatattccaactttttttctttcattttaagcatcctaaaaacccaaaaattaatcaattggccttttttacaaattctgttaacaaagcgcattaaaaaatacaaaatttttcccggcggcgcctatcggcaccgtcggccctccttgttccccaaaagtcttgagaaaaacgtgccgcgaaaaaagcggtgttgaaagcaaaaaaggtcattgatttacattaatttacatggccggagaccccttcgcagaattggaaaattggccgctgatcccttgttttgcaataatctgaattttagtgttctttatcctgaatttgaaaaaaaaacttggtcaccctcaatatacatatacttctgaacaattctatgctaaaaaacaggcactcgcgcgaaaactgaataaaaattttgtatttgaaaaattttgtccaaaaatttttacgttggaaaattaccgttttttaccggtaccggtaccggtgggaaaagttggtaccccggtaccggtttttgcattaccggtcagtaccggtaccggtttttttacaattaccgattaccgtgcaactctaattaaattgtctatttaaatttttaaattcattttatgtgtattaaaaatttttattgtgtggaatatttagttgacaattttatctcaaaatataattgccgtttaattggtggccaataaaaaaaatgtctgacggcctaaatgaagtgccattgaacaattcggatggttcagaagcattaccattgagtaaaaaccgaaaataaatctctattataaagtccaatctacttttatgagtctaatcttcaatttctttggccataacttttttcgaacttggccaatgcctactttgttggtatcgaacgaaagctaaaagtactgggaattcataaatacaagaaaagagcaaacaaattcatcaaaaatgtgcaatggtaaaaagaaattcagcatttttcgagtatattcatgaataattttttgtctgttgcttttagccgagaatttaaatttacagaaaatgctacagacttaaaactttcttttaatactaagaatttaggtattggttaacaagaagtaagaaaaaagttatggccaaataaactgaagattgtactcataaagtgcactagaggttgtatcttcccttttttcagttacttcgaccttaatgttagcacttttctgcaccatttgtgtccacttttaaacgctggccaaatttttttgctaatgtttgaacacagacaccgttctgaccattttatgcaattcattttgctcaatatttggccaatgctcaacgacaacatttggaatatgatgataattgaaatatgcaatttgcgtcgattttccccgtccattctgtccaattgtccatcgctccgctttctttctgtattttctcttcccgaatttccacccgacgaaagtgccaatgcattggatgaccaagcctaggccaaatggctttttacgcctcgtccggacggtttgccgaaggtgttcatgcacgatccatatcgccatgtggactactatttaccaatgatcgaaggaattcaagcggtgattaaattctaattttgaaaatttgaactttcgactttttgttcgaatccgggtccgcggttcggaattcagaactttcttatagaatttccttttttatactgcaatacttaatactacaaaactttatttaaaaacatttgtatcactcacgctttttccactgacgcattttccgccgcttattttacattttcagccatttctcagcgcttcatcgcctgtcaacttcatcattaccttttgcgttatagttcaaccgtttgttgctttgaccgtgccctatgaattgatcaacgaattcactggggagcgattggaactgattaaactaaatgagcatggcagtcatatggtgatgatccgttctccgatttcacgtgataagccaaatggacgcaatgggaagaggaggccattgaatgggaatctctgactgagtggaacaacattgaagtggaatttggtgatgacgacgtcggcgatgggtaaagcaattaataaataattcaattgcataattaattcatttgatgtttttttaatattctgattttttttagtcaaatagatgcaattcccggcccaagtgatcagcagcatgagtggactctagaggtcccc

SEQ ID NO: 1422 - DNA, 1080 bp, Heterodera glycines
ccatacttaaatggcaaaatgacggtttaaaggcggtcaattgcagcacaaagcattgccattaagccacaattcaaagcaaaaatcattggctaaaaaaatttgaaatttaaaattaaatttgaaaaaatcaaaatttaccgtcataattaagtcagcagtgagcaaactgacaaaatttgtgcccgaaatgacaacaaccaggaaaaaagagtgcccaatttggtggaccaattcacaaaaacaaatcaatgccatcagaaaattggcggagccgcggagggaactgaaaaatgagaaaattaaattaattaaaaatagaaagtttaatttaatttatcatttaaatcattataaataaaataagaaaatgccatggcatttacttggatctggcagtgaccactaaaactgtgccgttcaacataataccaaccaatgcaaccaaattgagcgcaacggccggcacaatcaaatcggcggacgggccgacagaacggtaggccaaataaagctgaaaacaataaaaattttttcaaatacctattaaaataatttaattaataataattttataaaataaatttcgaattttcctatttgaatgtttaattaattttataataattttatgatgaaatttaaagttctttttataagaaaaaatatttgtattaacttcaatatttcttttataaattatttttatatttattaaatatttttatatatattaattattattatttattttaccgcattttcggcgctggtgttcattgagggcattttttgctgtaatttttggcttattaatgaattaaaatgtgaataaaatgaatttaaaaatttctttttatattatttttcttcaatttctgtacttaaatttctttttttttaatttaagttctattcccacgctaatgtgagaattaattttcttaataaattgtctccaataaaaatgttcaaatttcaattagataacatcaatatcattctaaattgggcgctctgtcgtaagtcattttatatatatatatatattttttttaaatttaaatttccatattttat

SEQ ID NO: 1423 - DNA, 2370 bp, Heterodera glycines
  misc_feature (131)..(131): n is a, c, g, or t
ttaatatttcggccaaatttgagtcaaaaatgaactgtccagtgccaactagatccccggaattctcggaaaatcccggcggggtccagactcagtccggctctaatgtcaaccttctgaactgaacactntagaacaaaaattgtaaattaattttgaaattttttaatgggatgagtcaatcaaaatgatgttgaaattaaaattagctcttttttatgataggttagattaaaaaaaaatgttttcaaagattctaattaaattatttatttttgtattttcagtgtaattaaaattgtgacttttaaagttgaaacggaaattgtttgaatggaatatttttccgtttgttaaatatcaaacggaaattttaaatttgtatttgtcgagaaaatttaaatgagctaaatgatttaatttcttcacataaaactcaaattgtcaaatattttcgcatccgtttgatgagacggacgtcaactaaaaattaacattttcccacctatttaacatcaatgtaaatctaaaagttcactcaattaaattttccggcatattgttttaattaattaaataatattctaaattaaaatttaaaaaggacaaattccgagtcaaaatgtcggcataattctcctgacctcaattttatgggagcgggattcggcattggcatcaggctcaattatgattaccgggatttaaatcccggttttttcgggatatgaatcgcttcccgaaatttaaatcccggttttcggtccctatcccggcccttttttccaaaaagccggaaacggcatcgggatcccgggagaatcccggcgggatcccgaccccgtccggctctaatgtcaacctttgaactgaacccttttgggacaaaaaagtataattaattttttgacttttgttaatggcgtgaaataaatacaaatgattattgaaataaaaattggcactttcttttctgagaggttaaataaaataataaattttaaaaggtttttatattaaattattgttttttttattttcaatgtaataaaattgtgactttaaatgttgaaccggaaattgttcattgttttaataggaaactttaagtttgtatttgccgagaaaatttaaatttacggtctctttttttaaattaattaaataatattcccatcggtttttcaaaagttaaatgccattatggtacattgacagatttgatttttgatgataaaatttttaaaaatatggtaaatataaaataaataattaattaattaaattgtgttaagtaatcatttattttgaataaaattttgtcattttacacccctttaatttgaaagtttttggcaactattttcccattttagcatctattttgggagtttttagaacctaaaaactaactattttcctagtttttagcacctaaaatcggagctctagttattaattttaattaattcatttatacaatatttgtttgtttttttgtccaccttttaattgaattccctattttaatgtagaacataaaaggtaactcgctcggtgggactcgaacccacgaccccagcaatccgtgccgtgctctaaccaactgagctacgggcgcctcttttagaggttctctcaggtcctttatcccactttctcccacactccgttccttctggcatcacattccgcctccctcggaagaccggtccctcgggctctccttggcccttcaccgacggacttggactctccttggaccagtggtcccggcagtgtggaggggatccacccaggagcgccaggtagaacataaaaggtaactcgtcacggtgggactcgaacccacgaccccagcattccgtgccgagatctaaccaaatgaactacaggcgcctattttagaggatctctcaagagctttatcccactttcacctgatctccgtaacgactggattctctaaaattttgcgcgaagtattcaaatatgaaaaatataggaaaataccaactgactatatgacttacaaattgacaggaaaatgataaattattagtaatagatcccagaaaataaaactggaaaaaagatatgaatttaaataaatttatttatagaatcatttttatgaacaagaaagcgaaatttcattgaaggaatttatgaacttaaaaatttatatggtgaatacaaaacagaaaaaaattgtgaaagatattgagcattgctcaaaagacattttacacggaaaatataattgtttcaaaacaatataaaaataataatttagttgagagagataatagtcattttacaattttgtctgtcatgctttttttcgattattgaatatcatgttatttt

SEQ ID NO: 1424 - DNA, 2639 bp, Heterodera glycines
tttattggtttttgaatgcctttgggtggtgctccttttaaggtattaaaaaatgagaaatacaaaaacatatttcttggtcatcttaatggttttatttattaatttactcttaatgaacaaatttaaagatgagcggagagaaggagaatgccatttgaagtattattttgattgaaagtagccattacccatccattataatcatatttaatctagacatattatgtgcttctgaccatttcttctgatgttgaacttaaactatcagataaatcattttaatctccatttctctgctaattcattctctgttgaatttcgtttactgcgtttttgtgacttttcccactgcatttaattttaagaatgttcgtttcgaacagtgtttttctgcctgtctcccgctttttccattgtcgcgcgttgtccgctgtgaatttggtggttcatccgtttgtcgctaggaagtgcgcctttttgtctacaccatctttgtcttttccatttcggcgtcaatactcatcattggcatctgctacaacgacgggagcgagcaacgacaagctgaatgtggacaaactgttcgaaaaaataaactttgaagtgcgcggtcacgacttcacagtcctcaagtcgtattcgctttttgttatggtgagtgaggacaacgtttatggaaaaggctctaatgcactttatgagtccaatcaattgacaatcctgggtttttatacaataactttgttcatgttcgaacaaaccctatctttttggtatcattcgaaagcacaaaatctaacgaagctaaaatatataaaatcgcagcgttcaggcaattaccaaaaaagatttgattaattaagtaattgctgattttcgtttgtaactttcttggaatgttagaattctcggtaatagtttagatggtatgacaccttttttgaaaaatttttcaaaagtcttaaaaacatgtttctaggggtttataggtacgctgagcacgaatctgacatccatttcgaccaattccgaaccctggacccgaattcgaacaaaaagtcgaaaattcatttttcatcaaaattcacattcatgcaactaaagcaatacaaatgcacgaaaagacgcataaagaaaataagacagactattcgcatgggtaaaactcagaaatatgcaaccaaagcgccttgccaacatcaccccgccacagacaaaaaaacaacatctctctgataaactggcggcggcacaaacaatcatcggtggacttcaacctggacagtcggacggtgcacctcaatgggccaactccctccttggcttctgtgctgagatggtgggaatctgccgcgagcttctctccatggtcaaagagcagcagaatgacaacatggacacacgagagacttggaggaagaacgccgactccactctgtcgtggtcgtgaacctgccggaaagtgaagaaactgtgccctctgctcgtgtcaactccgattttgtgaatgctcaatcaatgctcgacacttgtgagatcgaatgccggccatgtcaggtttaccgaatgggaaagaagtccgaccgcccccgtctcatgaaaatcgaattccccaccaaaaaacacgcccaaaattttctgtggaacaagacaaaactcaaaaatcacaataaatttaacaatgtcttggtccgcccatctctatccaaacaacaactcgctgaacgttcccgacttattggcatttgcaaaaatgaccatatgagtaatcccaattcgaattctgtcatttatgccggccatgttatgtttgcctctgacattccccgttacaaatccaaccccgactcttttaaatgtatttgtcatgtgcataatgttgatgactcttaatgtgtaattggtgaccactgtaacacgaaatctcttaaaacgcaagctcttttacaaactaatagaaaatatgaaccccccatcaaaaatgcaattaccttaaacaaaaaacaaaatcttttatactcaacattgatcaatacgcgatccctaaataataagctaaaagaattttctggattttgaattggtttttgtaactgaaacttgggcaaaagaaaaaatacctttccaaccatatatcactaacaattacaaaatatatgaagctagcagaagcggtaaaaatggtggtggagtaatgatcttgataaaaactaacctaaattctttttctgttttatcctgttctaatttcaactgtgaaatccaaattgtacagataaatggggcaaaaagattaagaatagctctactttatagaccaccaaacacttctgatagtctcactaaaaagattctgaacctcaatggtaattatttagaagaaaattttatcattatgggagattttaacctaaatgaaaaagatataacctggaccagtggaacaccttttgctaaatcggaaaagggaaacattttttgtgaattttttaataagtatggcttattccttatgacgaacggaccaactcgaggcagtgcttggcttgatctgattttctcctctagtctgattttgttaataatgttttaattgaggatatttttagttctgatcatcttaccactaacttttc

SEQ ID NO: 1425 - DNA, 3871 bp, Heterodera glycines
  misc_feature (22)..(22): n is a, c, g, or t
ccgtgcccgactcattacactngtgtaaatctcaacgtcaatatgacccaacccatcctgtgattatattgtctatgcggggcatgtgcttgcccgcgacgacattcccgcctttaaatctgacctcaattttaaatgtatttgtcataacaaatcttaatgtgttttgggtgaccactcacgaggcaataaccttaatttagctcttttacaaactaaatataggaaaattgaacaccccatagaaaattcgaaaactttactaaataaaaaacaaaattttttatactcaacatttatcaatatgcgatccctaaataataagcttaacgaatttactgcgattatagccctaaaagattttgaattagtttttgtaactgaaacgtgggcaaaagaaaaaatacctttccaaccatttattactaacaattacaaaatatatgaagctagcagaagcggaaaaaatggtggtggagtaatgattttgacaaaaacgagcgtaaattcgttttctgtcttatcctgctctaaattcaattgtgaaatccaaattattcagataaatggagcaaaaaaattaagaatagtattactttacagaccaccgaacacttctgctaatttcacaaaaaagattctgaacctcattggtaactattttgaagaaaattttatattaatgggagactttaacctaaatgcaaaggacataacttggaccagtggaacgccttatgctaagtcggaaaaaggaaatattttttgtgaattttttaataagtatggcttattccttatgactaatggacccactcgtggtagtgcttggcttgatctgattctctcttctaaacctgattttgttaataatgttttaattgaggacatttttagttctgatcatctttccactaatttttcattgtcatttcctcagaataagagtaaggcaaatacatttacagtacgcaattataattctactaaacttaatctactaaatttaaacttatcttcaattttaccctacaaattactacaaaaatttaccattgaagataagtttaaccatttttaccttctttttagagaatatgtagaattatacttgcctaaaatcactgtcggtcaaaaatccagaaagcctaactacccattgagtcttaaactgtcaattaaggaaaaagccagactttataaactacaaaaaataaaccgtgataaatataggcatttgtatgatagcatttcattacatataaaaattcaaataaataactttgttactaaaaatgaaaataattttctgaataaaggaaaaaatgctatctacaaatatataaataaatttacaaaaaattttgaacaaatccactctcttagttacgagaaccaaattatttttgatgattatttaaaagcagaaacttttgcaaaaattttccaagaatccttttcaaattcagatgttccacaaattagcagttgtccttccaatcccaatggaccttctatttctgatgttgaatttaatgccgatgaaatttctaaaattttaaaaaatttaccgaatcgagaatccacatcccccgatgaaatttcctttagaatcttacgtaattgccaccttactctttctcctgtaatttccgaacttttcagaatatcaatggacacaggcaaaattcctgaaatttggaaaaaatctattgttatacctctctttaaaaaaggtgaccgaaatgatccacataattacagacccatttctcttacttgctgtctatgtagagttatggaaaaaataattgcaaaaagcatttataacttccttcatctgaataatttaatatccgaacatcagtttggttttgttaaacaccgatctactaatactcaactaattacagtattagaagattggtacgacagcatatacggtaagaaaaatattgactgtatctatgtggactttcggaaagcttttgattcccttcctattaatattttaataaataaacttcataacattggcattaggggaaaactgctaagttggttatctgaatttttaaaggatagattttacagagttaaaattaacaacaaattttctaatttatatccgattcagtctggtgttccacagggttctgttcttggccctctgttgtttttaatatacattaatgacctcccgcaggtaatccctccgggagttagcatcaagctttttgctgatgatgtcaaaatttatgtttcttacaaaactcgtgatgaaagaagcaaattaaatgttgctttagacaatattggaaaatgggctaatgcatttggtttaaacatctcccaaaataaaacatttatattatttctcggcaaaaataattcaaaacaacaatataaatttttgaacaatattattaatgaggttgaatctattagtgatttaggcattttaattgataataaattaagattttcaaatcattatactaaaattattaaagctgcttatttaaggattcgcaatattgccaaaattttaaaaacccgctctatacgtatttggaccaaagtattcaagacatacattcgtcctatttagaatatgcgcccgaaatttggaatccgacatacaaaaaagatataaataaattggaaagatgccaaaaatattttacaaaaattgctttatttaaatgtaggcttccgtatataccttacgaacaaagacttgatttattcaaacttcaaactttagaagaaaggagaaaaacaattgatttagttcaggcattcaaaatcatcaatggtctcactcatcttaaaaaagacatattcccacaattttctggtcacatcccttataatcttagacgtaaagttgtgttaaaaccacaatccagtaaaacttcaaattcttttatcaacagaacggccttaatatggtctaaactcaacaaagatataacagatgctccatctgttgacagtttcaaaaaacgaataaataaatggattgagttaaacaaaaatttagtctgtaaaagagctccttggacttgatattactttactaaaatctaacgtgtaagtggtcaccccttcgttggatatttttatttcttctgaataaataaataaataaatagaagagccgatctcgagttaaaaactagacagctaaaaaataaactgtgattcgatagagggggtcaaactatgggcctatgcaaaatttgaagaaaattggtcaataggaaaaaatttttttcaaggacaaacatttcaataattttaattcttttttagccaagtccacaatttaaggccaaaccaaataaaatttacaatattctccagaattttcccttcaaaatgagcataaaatggttctattttctctagtattcaccaagttataagctaaaaaaatttcataaaattgtcgatgctgtacgtaaccaacgctttttgaatatgattttttttttattaatgaaaaaataattctgccttcttctttaaaagaagaaattgaaattaacacacaacataaggaggacttgaacctgagacccctttttgttgactaactcacagaccactaagacgaaaaaaccaagcccaaaattgaatcgtcgtgtaaatacataataaagtttgcttttaatgtattattaaacgaaaaaattctggcggcgagattgccaaaaaacaaggcgcggcgagttggccccgcggcgagttggcctcgcggcgaaaaagcgcgcggcgagttggccccgcggcgagtttctcgcggcgagatggccgcgccttgaagggcggttcccgttaaaatcaatctaattttggcgtaaat

SEQ ID NO: 1426 - DNA, 875 bp, Heterodera glycines
  misc_feature (10)..(10): n is a, c, g, or t
aacccatccngtcattgcacgttcgtttccaccattgaaagaaaatgtgagggataaataatgccaaatcatttcccaacaaaaaccatttgtttttaattgttttaaggggcataatttattggccgatcaatttggaagaattggcctaactcaaaacaatgcacaaacagaacagttaccggtcactgaaaagtcgagtcaaatggtaaccggaggagcgatggcagtgaaagaacagccgagacgaaatgggacaatggcaataagccaagaaaaagtgcagtgaacgaagaggaggcgaaggacaaaaaagagacattcattgggggggggcgaccgcgacttgaccaatgaatcgccaaaacgactctctcaatcgtgttgtgtctttttctgtcccttcctttatcagtttgtctcggcgctgatggcccattgggtctcttcacattggctccttcccaaccctaattaatattgtaattgccttcctcgtctaagttcgttagacatttgatattaattttattaaatgattcgttcttttccggccctctcttttctcttctcttgaaaaaaccgatggttaattaattaattgacgtcattttcttctgtgtttttaatttccttctaaggattttgacaaagggaattacgacatagcattttatttcacattttcaatcctttgtctgtaagaatttgtccggctgtattttgctgagtttgtcgtattaggccgggacttttttctgtctgtctccgctccctttgtcaatttaactctgtcaaaattcagtcacaaaaatgtgttatgtgatgtgaaccaatcacccggtagaatttttcaaattaattatgttgataaa

SEQ ID NO: 1427 - DNA, 2156 bp, Heterodera glycines
ctctctctctctctccctctctctctccctctctctctctctctttgcactctctctctctctctctcttctctctctccctctctctctccctctctctctttgctctctctctcccccctctctctctctctcctctctctcgtcactcacttgttttccattttcctttgtttttatattacttttgagtgtatacaaaatatcactgctcccctcccatttattgtccatccccacagatttcgactgataattaattaattggtaaacattaaaatatggggttctctccccctcccccgggtgatctttctcctcccatttcattaaatgtccatttgctaattatttcttcaatgatttcccattttgcagatggcccctttgaatgcgattccctccggtgacgcgtcgccgtcgcattccgccggcccagcggcgaatcatttggcacatgcgacaaatgaccggcggaggaggaggacaaacgcgagaaggacgcagaggaaatttttggtgtacccatctgaccaactcaaaatgttgaacaatggcacggaaagaggagcgaaggatggcaaaacgaacaaaaatggcacatgggggaggacaaaccacgacagggaggaggacggaattgggaagaacggactgatgaggactgaagcggacggggcggagaacagctggacgagagaaacggagagaaatggaattagcagaattggatttgaccggaccgaaatgaacggactgaggacgaaactgaacgggacagaacagaacggaacaaagactgaatcggacggaatgtcatttaatgggaagaggacggaacaaaacagaagggaaatgaacggaagaagaagcgaattggaagaattgatgacgaatgggacaggcaaattgggaggacaagaaaagaggcacggaaacggggcggaggagaaacaattttgggggatgaggatgaagacgaagtgggaagatgaggaggagcagcggaacggcatcaacaatgccatcaatggaattgacgaagtgtcgacggacggacagagcacggcacagaccgagacggagatgaagcagaacggcacggggtggggaccgcacagcgtaacggacggactgctgacggaagaggacgccgtcgagtcgggttggacgagctgaatttgacagatttgttgaaaaaggccaaagtttaagcgaccggtggtcaatcctcacaacttcttctcaacggacagcaatcacaacactttggccatgtcgctaaactgcacagtttttgggaagaaatgccaatttcatcgtcgtcacttttgtgcatggacgaggagcaggagacggaacagaaacagcagcaacaccaccgacgaccgaccactttgtcacctcgcgcagtccttgcggcgcacttgccaaaaacggtgccaaagtcaaacgattacgaggaagaaagccacgcgatcaaacgccagcggtgcactctccgggaacaattagtgggagtgccgtcggtggcggcgccgtgggaggcgatcgcagccgaaaggttgggcacccgcagatcaaaagtgatcatgctgggtgactcaggtgagcgatggaaagaaaatcagcagcgaatggatgactttccaatgttaaaggtgttggcaagacgagcattgtgttcagccacaaatacgggccgaaccccgcgctgctcaattcgccgtccaatgcgaccatcggcgcttcttacaccaattttgacatgtgagcaaaatgcgttccctaaactgtacctttttttgtgggcattttgccattcgttcgccatccgttaattttgacgaatggcataaatttttgacatttcatagaattggggagaacattattcacatgctttggtagctaacattaaaagtcaggtcagtgttcaacgccattctcgtgcaattgcaaatttgggacacggccggacaagagagattccgatgcatggtgagaaggacgcatgtaatcagtagtgctgcttgagaccgaaaacttctcgagacaaagaccaaaaaacccgagacttttctcgagtcgagaggttcgagaccgagactttcgagcagcactagaaatcagacgaaaatacggaccaatctgat

SEQ ID NO: 1428 - DNA, 897 bp, Heterodera glycines
accgagactttcgatcagcactagaaatcagacgaatcacccccccgctgatcattagggaggggcttttggtttccatcaatttcccccccccccgccccttaaatctttgatcactgaccaatccgtccaagtattcaattattcctgccacaatagtatgttcgaacatttcgatcgtctcccctcccaattgccttgatcaatcccctcccttttccaaaaggtgccgttgtacatgcgaaatgcaagtgccgccgttctcgtttatgacatcaccaaccgggaatctttcgaacaaattgagcaatggcacaacggttggtttaataaattttaataaatatatagtttggattttggcacagaagtcctgcgttgtcccactgccctcgaagagccgatatttgtgctgatcggcaacaaggcggaccagcaggacgagaaccgcgaagtggccgaaggggagggcgtccaaaagggtgggcacttggccaatgattggtgtgatcaatggcaataattagttctaattaccctttgcgaatttttggaaaagaaaacaaacaaacggacaaaatgttttcttaaaatgaatagacaaagccaatacaaattataatgagtataatgttcctatttttttattttttcctttagcccttcgactgaacgcacatttttttgaggtgtcctccgtcgactctgaaggtaaaaaaggggcgaacggatctgtgccctctaaagtttttttcttatttcgaaatgccaaaaatggcctcccttttcgcttttcgctttttccttttcccttttttctttttccttttcgcttttccgatggtttatccatttttgttttcccttcagtgatccgttccattttcaaattggtgg

SEQ ID NO: 1429 - DNA, 4496 bp, Heterodera glycines
ttttccttttccctttttttttttcctttcgcttttcggatggttatccatttttttttcccttcaagggatccgttccattttcaaattggtggctgagaaaattgtgctccaaagtgccaatgtggagagtgcgcgcgaagcggacgaggcgctttttcggcggatggccaaacgaacggacggcggcgccggcggatggaaaaagcgatggcaaatcgtcgataattcgacttggccccgaagacgtcgattgggcggcgcagctgctgatcagcggacgcaattggtggcgatgggcggccggcgacggagcaccggcgcgaacggcggcgattgtggcgggcggaaattgttgtgcggcactgtagctaggctgtgggtgtactgtaacggtgctgattgatgggtatactgtattaggctgttctcattattaggctgttctcattattaggctgttctcattgttttcatttatttgtaattctcaacagatattcttctcattcaatttcacttttttgttgtttacatttatttatcacagagaaaaaaagattatataaatccaatgtaatcagtccgaattaaaaaaacaaccaattaatccaaactaaacactttattagtgcaaattaataacccttaattagtccaaattaatctgccacaaattgatctccggaatctcagcgtctacgacaagatatctataccggaaaagtgatttcatatttatacaaaataattaaaataatgtaattaaaaatctatttaaattaatgagtgcaaattaggccggcatgattcttaggagaactgctttggtttcgcatgacaaaaactcgcgcattttgttgatcatcgcgcaaaaaagtcttgagaaaagcgcgacggtattcggtgctaaaaagagatgaaaatgagaaatgccaaattggcattggcattggcacctgcaggcgcaaagcaccggcgcactgctggtgtaagcaaacacaaaaatggcacagcaaatgggcgaggctacaaattcgttggcattggcaccgagcaaaggggcgacgaagccaatgaaaaggacattctgaaaaagaaatgatggaaaaatgccaaagcaagtcacggactactccaatatagcagaagaagccaatggacatgatcacactcagcgaaagcatcagacgccgtccattttcagaaactgaatttgcacactcaattagtaccactaattactgaactaaatactaattgggagcagtgccactcactctgcgctttgcgccaccaactgatcagccaaatcagcacatagcagcatagcagcaaaactcgccgaaatacatgcccaaattcaatgcattgaagtagtaattgttctccgggtgtcgtgccgggttgccgagacggcacattacaggcctagaagggaaggggaggccaattagggtccggtcagattatccaaaatcagcaatgatcgcacatttcccattgctttggcatccacaagtaaaagttgcacacatcgaccgccgccaaaaggcaacaaagtgccaacaacaatttaaaaacgatatacttgccccggcctttgtacctgcgaacgaaacgaaatgccaaacgaaaactcaaaatgaaatcaccaaaatggaaaaataacaccgcacaaacggtcgaggccaatggcaatttgaagcgcaacggtaaaagcggagccaatgatgggaagaagctgaatggagaggcaaaagcggagggaaacgtagttgaagccgaagaggaagatgaagaatttgaaggtgaagccgagcagcaggaaggaggcggagaaggcgtacagagcgatcagaacattgcaatgggaatggagtgatctgacaaatgagggagggaaagggagggggaaaaggaaaggaaaggaaaggaactcgtccgacgggactcgaaccaacggccaaccaaaccgcgcaattacggattattttccgtaatttttacccaaaactggaacttattagataattttccgaaaaacggttgctgaaaaatttttgacaaaatgtttattaaaaaccatagtccgaactccgagccgacccgaaattccgatgccccaaaatattgggcgtgagatttgctgatttgcatcttggttccaaaaaattgacaaaaaatagtcaaaacatgaaattatatggattagggaaaatacggcttttttggagcccttaattacggatttcggtaactgaaatctcttatgtccagccctgctctatgcacgacagactgatcaactctggtcggtctgctcttgataaatcctttagatcggtcttgacaaacgctttctcatcagtcttgatcatctcattcccgatcattgcccctctcttggccaacccctctcggtctttggcacttcccgatcttgcaaagtcattttccgtaatttttacccaaaaatggaacttattggattatttttcgaaaaatgattgctgaatcacattattcttgatcattggcaccgcttgacagtattttccaagtcattttcggtctttggcactcccctcagtctttgccatgttattctcgattactcactttgttttgatgctaacatgaactaatgaagcattcagtgccattcccacgaagcaaatcaacgcaataaacccatttatggccacttctcccggcacaaaaccggcgccattgtaaagcgcataaaactgaaaattaaaataaaataaagtaaataaaatttaaaaaacaattaattctaccgggtctttttcatctgacatctgatgatgggcaaaaatattaattttaatgttgcgatttctcaattcaaataattggtaattgaattgatttgtgaattttacctgtaacttgtccatttgcccctattaaatgtcattaaaatgtgccaattgcattttgtttcttttgtaattaatgcgtatgtccttttcattggcttcgtcgcccctttgctcggtgccaatgccaacgaatttgtcgcctcgcccatttgctgtgccatttttgtgtttgcttacaccagcagtgcgccggtgctttgcgcctgcaggtgccaatgccaatgccaatttggcatttctcattttcatctctttttagcaccgaataccgtcgcgcttttctcaagacttttttgcgcgatgatcaacaatcgacgagggtattttatatgcgcatttttcatcagaccaaaaacgaaaatcgcattgttttggcaaatgttgcgatttctcaattcaaataattggtaattgaattgatttgtgaattttacctgtaacttgtccatttgccccctattaaatgtcattaaaatgtgccaattgcattttgtttcttttgtaattaatgcgttgccaatgccttcggcactttctccgttttcaatcccaatttgcttgtactcccccggggtataatttcacttcgtttttcccttcccaactttgtcctcctccttaccatctgtccataattagcaaatgcaaattgtgccctccgcccactcgaaatggtcaaggcaaagtgttggtctcggcacttccacaaaaggggggggcgggggagaagccttttgccattttgccaaggggctcctcttcgcttggcttcggatcggtcgtcgaatgtgcccaaagggaaggcgaggacaacagcggaacaatggccgaggacagcaggcaaagagcggcgccgggggcaaaggaaaagcatcgctcgggggcaaagagtgaccacccaaaagcaaagcctcccacagggcatttgaggggcgaagcggcgacaattatcagagtcgacacggcaacagaatgacttgttcattcagcttcacatttacatattttacgcttaaacctttgttttttgtgccaatttcacaatgtttttgctgttttcgcccaattcgctaatccctcgccaatgggtcaaattcaaattcagaaaatgggttggttcatcccaatgaatggatgggcggaggggcggggaaaagaggggaagggtttcccctcccctccgaatgtgttcgtcgtgtcttcttcccccccccccccaattcgatggaatgagcgtattcatccgcccgatgcccatcttttggtccctcatcaatcccaaatttgtcggaccatttattttttcaaggcggaacggagtgaggaaaaggggaatgagcggagcgatggacaaatggacgacggcgggggggggggatcggcagtccctcttttttccctcatctcctcctccttactcctcccgtttaatctatgctctaatcatttcaggagaccctttcctcctctctatgctgattatctctcactatctctctctctttctgttactccttcattctcttccaccttgtgtgtctctctctaaataatttgtcttgcatatagatccagtctctttccctc

SEQ ID NO: 1430 - DNA, 2263 bp, Heterodera glycines
ttcgtcgtcgttgggggggggggggggcgcgggtcgttccctcaaatggacccccgtcgcctcaaaacgggtcccgggggattgaccggtgaacggaccgaatgcattagccaataatccattaatggaacagaaaaagcatcccaatggacgaaagcaccagcggaagggaaactgatcagcagaaagggacgaacgaacgacggaaaaagcatctcaagcagcaaaatcacttaactgatcagtgaaaggggaagagattggatcaaggcagcagaagaggaccgattggtgatcagaatgattggtcactgatcattgcttggacattgggggggacactttgtccccggccctctcttcggaagattcctcagccgctcgccacctccttctcttccaatcatttttaaattttgcctttttcaattgctcattaaatgccacagattaagcgcgagaatgtcacttccaatttgtccgattagtccttccaattgcgataattagatgcgaataatgcgataccatctccttctgctcattgtcagcattatttgtgtcccctccccatggcactttcttcggcggatgatcatcccttccccttccttcccttccccttccccttccttcccttccccttccttcccttccccttccttcccttccccttccttcccttcccttccccttcctttcccttcgctttccccttcccctccgcccaatctccctaatcttcccctggttttctcattaatcccctcccccaattaattacccgtcgcccttcccagcgatgtttcgaacactgtgttcattgtaaagaaatacactccgagcaaagagcggaagaatgggcggaagtaagaagaatttgggggacacattgggcgtcaacaaaaagaagaaaagcgcgagaaacgcttttggttttggggcgggggaagaaaaggagcgctaatcaaagccaattgaggacaaataaaatgggacgaaagatgaggagaaaaggagagacggggagaggaagtgagagagacaaagagagagagatacagagaaagagagagaggacagagaaagagagagaggacagagagaacgaggaaaatgaaaaaaagagaatgagaaaaatgaaaaacagagaatggcgagtgagagaggcggaaggggggggggaggggggaagcttttaagaatttaagtgcctaagaggagggtgatgaattgaggttatttatgataaggccatcagctgaagtagcaccataagaatgtttttgcgaaaagggtaaaaaaatgggggaggaaatgacacaccaattaaggggaaaagcgagaaatgaacagcacacaacaacaggaggaaaatagcaagaaaaacgaggtaaattaaaaggaaaagcaattaaaaattattgggaaaattgggagagaaaaaatgaaaggaaaatgaaaaggaaaaggaaggagggagaagagaaagaagaaaatgaggaaaggaggaaaagagaaaagggaaaattagggaggagagagagagagggggaaaaggaaaaagaaaaggaaaggaaaggaaaggaggagacaaagggtaaaagaaaaagcggaaaaggaaaagctgatttggagttttggggggtgcgccccgcggcggacggaacgatggctaatcccatgaaatcccttttcgcgcggttcaatcaaataataataacacaaaataaatggccgaatcaattcggacaaaacgaactcacaatcagcagcacacaatggcaaagaataaactccgtttattggtcatcattaacagagcagaaaagcaaagtaaaaattgtaaaaggacgaaaaattagcaaagagagcgaaagacaattagtaaattgcactcactcattaggagggtcaattaggtggggtgaaagcatttggtcatttggaggggaccgaatgtaccgaatgtcggtcccccgccgacgtcgtttaaatgttcggccatttgtccccaaacggtcacttttagttggctaattggctaattgcccctccccaatttattctttgcttatggtccattgccttcttctgcggtcattttgtcctcattctcccccccccccactgaaattggagtcgttgcgaatttcgccgggggaaacccccgggggatttgccttttctgtccgccttttccccggggtgagatttggcaatttgtcgcccatcccttggcccaaaatgggccatattccac

SEQ ID NO: 1431 - DNA, 6126 bp, Heterodera glycines
  misc_feature (2392)..(2392): n is a, c, g, or t
cggcaatttgctgcgggggccgagggcactcaaagaattgcaattggacggcaatcggctgtcagcgggacaactgaaccaactgctggccgaggttggcacactgaaaaggctcgaggcgaaccattgcgggctaaacgatgccgaagtgttggcactgaatttgagcaaagtgccgcaattggaacgcattggactggcggggaataatctcagcgaagtgccgagcagcacactgaggcaagcagaaacagaaaggcgcaattagcggtgctaattgggcaaaattggccattttggaatttgaaggaacactttttgtcgaaataagcacagttcagggcacttgcgctgctccgtaccgtcgatttgtcccacaatttgctccgttcccttggcccctgcgccttttgcggctccaacatttcccgcgtgtttctctcccacaatttgctgggcattggcggcgatttgcgccccattcaccgcgaagcgttcgcagagacgcgcattttggagttggacctgtcgttcaaccaattggacgctgtgcgcttcagctccgaaatgctgcaggatgcgcaagagtcgctggaagtgttgcacatcagcggaaatggccgtgtggcgttggacgcgccgcaactcatcggaaccctcccgcgcctgcgggcactgcacgtggcggacagtgcgctgggtacagtgccctacagtctgccgaaggcgtacggtcagctgacgctgctgaatctgtctgggaacggattggaccatttgccacccaacctgggctcaatgctgcctcatttgcaagtgattgatttgtcgcgcaatcatttcaggtaaatggtatttggccggaaattttcgtgccgtttgccagttcaattctatgctttcagcagttttccccactctttggtcactttcattcatcggctgagaatggtctttttgcacaatgtaaaaaatacatttaaaaaatcgtttaaaatttggttaattatgcattaattaattaattgcccatttcgccgttcgttcagtgcccttgggattgccaatgcgctgctcaaccactccaattgcacatgctccgccgattggaccacaaggaaatgttgcgatatgacgagacactttgtgctgagccgccaatgctccggggacagccattgcatcgcgtgcaaaagatcaacgactgtgccattctgttcggggccaactacggcatcagtcaggtcgggaaaacgaaaaagcattttttgtgggagggagggaatgttcatttgagcaatgctttacctttccccctctttggcactttcttcagtttttctcactttttcttctgattttgcttaattttcgcctttctcagaacactgaactgttgctgatcctcggtgcccttctgctcgccgcacttttcctttctgcctttttggctttgctgctttattttggccgagaaagcacacaaaagggcacttatgtgacgggcgaaggcgtgggggaggaggacggaaagagggcacggctaattggggggatgagcaaaagcatgacgatgaccagcagcggaagcaacggaacggcaggcggagggggcggaggaagagcaatgatcgatttgggtgggaaagcgatcactgatcagattggagtgacttaatgatgggccaattcgtcctttaaagatgcgatggcaatgaacggaagtgccattggcgggagagagtgccggcaaaaaagcgccgactgtgagtcgcctctgctgctcagcaacagtttggagcagctgcagcaacggagcagaacgaacagacaaaacggcacgccagcgacaacggcgacgacagcaaagagttctttggccgcattggccgtccaaaacctgcatttcgccgcgtcaacagcgccgcttttcgccccgtccgcgtctttggccacggatcgcctgaaggagccgcttttgctgcccaattcgccactttcgtatagctcaagcaacaccggcagcagcaacacactgctgaacatcagcagcaggacgagggcaacaatgagtggacaaccgccgctgactgtgctcggcacactccgacgaacggtgccctcgggggcggacagacaaacgatgagtcaccccggggcaggggacagagacggagggggagcaaaggcactgatcactttctgatcagaggcaaaagggaaagaaaggatctcatcagtcaacaagagagaaagagagagaaagaggcacaaaccgttgcatttcacttattttttgtacaaattttgaataaaaatttatgttcctcaaacattttaaatctgaaaaaagctgaaacttcaaattgagtgtttgatttttgccgatttntgagctacaaatgatacggaattaagcgcttttggcaccgacggaaaatagaaccaaattatatgagattgttaaaaaaatgagcattttatgatccaaggaggtacggcgattttagtgccaaaggaggaacaatcaggaatatttttaaattttttagaaattttcttctgaaaaaaaactttaatttttgaaatttaatatattttcaatctttttttgtttgttataatgtgatccctgataaggtggcttctgctgttctacatttcacttcttaatttgcgttggttcagttcccttccaactaatttcctttttatccagcggtgccgttgggcgcagccgtattgaatttttttaaaaatttggcccggttttgttcaacaatgaccattttgttgagtttttgggtttaaaaaataacgaaatttaaataaattttgatcataaaataattaaataaaaaaagcattcagatttttctgtatatcattttttgatcaatttttggaggtttcgcgggtcttttttactgtaacaaatgaaactaatttgtaaaaaaattcataatttggtttttgcaaattaatttaaaagttttttgcaattatatgtttcaaaaatgtcctttttaatttgatttagtggtctcgaaacgaaacccttcaaaacctaaattattatcgagagtgatgttcggcaaaagaatttaccgggagcggtacagaaaaaaaacccggtaattcccgttcccgcccctttttccgaaattgatcgatcgacggtaatttagcggcttttatcaatgaatcgaagcactcacctccattttgggccttggcctgtgctggtcctaatttaccttcgaattggacgactctttctctaggaaatgctgcgcatagaattttaaatggatttacatgaaaattaatataattaattaatgaagacatgtgaatttgaccagctgattaagcctaccccaaggccaattgtacggaatgaaatgaatgaccaattaattccaagcgaatttggcattttaattttgtaaaaaatgcaaataaaaatcaaagaaaaaatgcgaagaaagtgtttaagtgccgtttccttcttcggtttcctttgcctttccgtgccgtccagggctggacgtaactgattttcaattacggaaatccgtaattgcggcaattttttcagttacggccatccgtaatccgtcattacggaggtccaaaaaggccgtaatttggcgtactccgtaatacgtaatccgtaattttcaaaaaaaaaaaagttttttttaatttaaaaattttttttaaaaaacccaatctatatataaatttttaagattaatttatgatcagaataaaagatctgcatgttttttgaggtggaaatcccaaaatatgggcctaaaccgggagaaaaatagcaaaaataggggtaaaaatggcagattcagagctgtggtcgcaaatttcaaaattttttcattaattatcaatatctcacccttttagaagccattttaaaacaaaattgaaaagattgtcctggtttggcggtgccgaaaggcaaataaattataatttgtgacgtaaaaattcattctttttgaatttttaggattgattttgggaatgatttgtgaagggatcccggctaataaattgagaatcattttttgatttttaaaacagcttatttcgcggtgtgcttttccaaaaaactgggcaagatagggggttgtcaggcggcgccgaaaggcgccgacgggaaaaatttttgaaaatttgatgcaatttgctataagattttgtctaaaaatgactaagatttggggctaatatttaaaaataattaggagtttttggggcgggcagtgccgataagcgccgccgaggaaaatttttagaattttaacgaattttgttaaaaaatagtcaaatttttcgacatttcctcttttccctttgctagcctcccccccccccccccctttatgtatgttaataatactacaaattaccaagaagaagtcagattaaatcggaatttgggtagccttttaataaaaatagaaaaaaaaattcattttataaaaaataatcttacaagaaatcgtctcgaaaaatattctaaaaaagccagttacggatcaaaattacggaaaaatccgtaatccgtaactccaagaaggccgtaatttccataatacgtaatccgtaattacgtccagccctgctgggaaggaaatcctgagcttataaggaggggccccaggagtgtcgggaggggcggttcttccatctgattggctgatcccttgggcgccttacataagtgaccagcgagattgatcaacgtgtaagtgatcgattagactgatcagcgagtgcgtgatcaaagcccgttttacgttaggaacagcggcacggatcttcgtaaagaatgaaatggacggaatgttgcgcttttgctgaaatttatcaattaatggaaaaaagcattgcgtttattttatttcgttcgttatttaaaaagacttttgaatattatttaataaatattctaattgcgataaatgacgtggaaattgctcatagaaatgggagattattttatgttttgaaaagggcggcgacaaacaaaagacaaaaggggggcaattggggggggggggggggacgaaagtcgagcaaaaccgggaaaagaaaaacgaatattatcgggcgggggggcggcattttctccgataagggaaccgagtttaagaacagattgctgaaggacttttttgagcagcgagaaattgagaagcatgaacccgtgcattcatcggtcaaggcgtcggtcgccgagcgggccatccgcaatgtaaaacagcggctgtaccggtattttgcggaaacggagacgctgaactgggtggatgcagcacagaaaattgtggacgggattaaccgctccccgtcacgtgcccacggaatgcgtccgattgatgtgggcttttccaatgctcagagggtgtggaagcgattatatgatgatggacaccgtgcgccccaaaacgacgaccgacacgcttccgcaaagacgattttgtgcgcatgagcagagagaagggacagtttgagaagggctatttgccaaattatggcgacgaaatattggaggttgacgaggtgctgaaagcgattcgccccgttcggtacaagctacgggatgagcgcggagagaaattcaagggcagcttctatgagcaggagttggcgcgtgtaagaaaggatgcagagacaagctaccgtattgaaaaggtgtacagaaagagaaagagggcggatgggtccactgagatgcttgtcaagttcataggataccccgagcgcgaatgggttcacgaatcacaatttgttgtataaaagccccacccatataacaacatatcacattttcataaattttacgtgaaataaaaaaatgtcatcgaacagcttctttgtgtttttgcctagcaatgtgacggattacccggacaatcagcccaataaatttcgggtccggctcccaaagccgttgcattttaacggctcttgggtttgtgggctgcatagcataagctacccatactcatggtcaaccattggcacattggatgcacaatggattgacattcacttcacccagcgcagcacaatggatgaggacaggccgagagt

SEQ ID NO: 1432 - DNA, 687 bp, Heterodera glycines
attttggttttttgaatgaagcaccgctgatttattacatacattctacgaacaatttttacgaataattattattggaaatgtgaaactgagagagatgagctcatcttttttacttaatggaaattcagcaaacaaatcaaaaacaacaaaaaattatttgcataaatgaaaaatataatcattcttttaaccgggatcacaattactcccggtctcctccccttccggcctgtactgtgtaattttaatgcaatttgttaacagatttgtccacaaaataaaacctcaaatcatcatttcaaaaaaaaatcctcaatgacctatcaaaaaaccacaaaatgaggataaatcctcagatctgcgagccctgtgtatcaggggtgtgacttatctcagaaaagacgagagcgagagtcaaaggatttttagggtccagcgatgccgttaggcaccaccgtggaaaattttgaaaatctgagtaattaaattactgaccttttatccaaaaataattgtgctctgattttaaaaaatagaggaagcagagaaagaaaatttatagtgtttttcgcgtaaatttgaatatttttctgatctttcggattcttccattacagaccaagagctatcgattggtatatatttcgaccattttcggctctgggccatatgatcaatatttac

SEQ ID NO: 1433 - DNA, 1427 bp, Heterodera glycines
aaatttttgtaatttttaatgtgatttctaaactattttgttcaaaaaatgacaaaattttatgattttgaccattttttaagagaataagaatttttagggggcggcgaaaatccaggttgccgaaaaatggccaggacctggacctggatccaggaaaaatccaggcctggatccaggtccaggccgagctctagatggaagtgtaccgccgagagaaaaatttgaatatttaactgaatcatgttaagattttgcataataatcgcttcataaaactaaaatattgaaagtactagattctaagcctattttggtcctttttatggcattttgtgattagttcacttcttacgaagaatttttttgtttatacatatttttatttacataattcgcaaattttcttacataaaattagcagccctatttattattaatacactgtgttaatttaaaataaagacaccctgttttttgggagtttgaccacttcccatgaaccgatcgagctgaatttttaactgtacgtagcaattctgaaaatattaagattctgaaagtgagaaaccgaaatgatgacggaaaaaagttttacgattttttttcaaaaatggggtgttaatttaaaatagagacacttgataaaaacgaacaaaatcttttaaattaacacagtgtataattagtagggctgtgaattttagtgacgaaaaatcccaaaatagttaactaaaatagtgagtaaaaatgccaaaatagtgaagaaatagtgacaaaaagtccgaaatagtgacgaatagtgacataattttcagacaaaaattaagcaaaaataatttttattcactgattgcattgcaaatgagtagggctgggatttttaagggcaaaaaaacaaaataggtacataaaaaaataatttttaaaattaaaattcttgccacgaaaatacctttttgagaaaatttttttcatttcttaggagtgctttttgaaattttttttgtcgattcttaggggtgtattttttggttttattgcatttttgttaaagaattttccaaaaaatgtcgaaatagtgaaaaaatagtgacaaaacgccaaaatagtgatttttaactattttagtgacgaagtcgccaaaatagtgatttctagtgaccgatagtgacatcagaatcgaaaatttttaatgcagaaatgcgttttttgagctcctttcttcaaatcaatcgagcaaaaaatttagttaaaacctaaaattcacagccctaataattagccaaaaatagtttctcgaaagttctccgccgtcgcttttccttcgccgcgacgccatttcagcaccaattggttgggactgaattatgtgaaggtcagcaaagcacatacagcaaaacttgaggaggcggaggaggattggc

SEQ ID NO: 1434 - DNA, 3095 bp, Heterodera glycines
  misc_feature (24)..(24): n is a, c, g, or t
  misc_feature (135)..(135): n is a, c, g, or t
tttcataaatgacaatcatgaaanaatgatatatataaaataaattatttttttgataatattactattttttaaatcgaccatcattttttggtgattggtcgtttttcatcaaattaccgtgggagtttttgnctaataagcaaataaattttccattcttgattctttcgataatggaaaagctattttgtgagcttttgttttttatttgaaacttatccatttttaaaattatacatgctaataaataacaagcttaaagccaacgaatgatttgaaagattcggttgcttttgagtaaagttaatttgtctactaaaaataatttttttccaaatctggtacatttaaccaagaaaatgttcccaattctcgtcctataattgctctttaagtggatttatgttatgcaaacattgagcaaaagtcgtcccgtcccgttttgggtgttgcgcattttctccgatccaatcttttggcttcctatttttaaaattagctaaaaatccgcaaaattctacctctacaacatgaattggtgagtatccaatttgattttaatttaagcaattttaaatttatttaccaaaaaagaaaattaacaatgggtaaaagggctcgtcttgccgaaactccctaacctcgcattcttttccaaatgaattcatgatcagtttttttaaaaaccctgtgatcaatcaattgggactaagatttttgaacaggtattgcttggataaggagaaatgcgcagctctcacatgatagatttgatcttgttatattgtgcgcttctgatttctaattaaggcttcaatttttttagttttacgttttacaaatttacacattttttgtataatctttgaactttcaaatttcggcgctcaaaatgcttcgctttgctgagatagtttatgatttttaacatgctgggtcctttcgtaaaaattgccactatggacgtttcgtaaaagtgcaaatttgcaggttttttgcgaaaaatttcctaaacaaaaacaaattaattattcttgatatcataagctaaaccatctggcttgatttattagcatgaaaattatttaatttggtgtgtttaaagaaaagtatgaggagtttttttcggtaaacctgcaaattggcacttttatgaaacgcccatagtggcatttttttatgaaacgacctagcatcattttaataataaaattttttaaaaataatttattctacccaacccgacaattcacatttcgctctcccccgcctccccccccccccctaaaattgggacacggagagagtgcgctgcagtttcaattgtcgcgcaccccccgtcgtcagcagttccttgtccgccctcttctgactgctggcggcgggcgatcggtcacgcatttcccattaaataattgacggacgaatgactgaccgattagtgctgatggctgacctgttttgatcgggtggatttgttctcgcatccactcgagacgaccttgtgcccactctttttcagcatattccttctacgggaattgttggtctcgactctcagtctcgaccaacaaaggaaggattagtacaagggatactctgctacctgctcaacccagcacaggggtggcaaaataattaaaattgatttataattagtgttttaaaacggagtggactctggataagttttgtggtccgtaatcactggttttgggtgtgtatttcctgttttgctgattttcaaaaatcacagagtccaattttttgaaaaaataaaatttcatatttggaaatacaaatttaactatcgcctgggtaacaaaaatttaaatgtcattcgtatctaagtgtttgtgttggcctgcttaatgaaaaaatttaattcggtaaaaaaaattgtaacgaaattagtttttaataattacaatttttatgttattttttattttcattcaatgctttcgaatgcggagtaggacaaaacgtcgtcagccgaaacgtcgtcgaacgaatttttcgaccataacttttttctttctcaaccaaattaaacattcttggtattattcgaaagcattcgaaaaatgctattagcctgcaaattttcaaaaatttttatttatacacaaaaaaatcagagcaaaaaaagtttgaattactgggtttttgagttccttctggccataacttttttgaaacttaaccaaaatttttgagattttgcaaattaataataaacacatagagctatcgaacaacaccaacaattcttaatttaattgacagtgaacaaagttatggttcaaaaagtcttccgacgacgtttcggccgacgacgttttggggtgcaccgtttcgaatgatattaataaataaattgaaatttttattgggaaatgctcttttgttttctcctttatttgttaattgtattacgtcaagatcgttcaggcgcgtttcttagatatgccatagggctagaaaaacaaaaattcatttttatataaatataaaagatttggcaaatatttgaattaataaatttgtgtttgaagttttaattttttgaaatgatacaaatttaaaattttaaaggaaaatttttcataaattgtttaacatttttcatttttttccacttggcgcatttacgaaacgcactaacacaaaatttcttaaatgcttacaaaaatgtttattttaaattcaacacttcttttctagatcttttttttattttgaagtataggaataaaacctaaaaccgaaaagtgcattttattttaattaaattcaaaagatttaattttaaattaatcagcgctatgttttggcgtctgaactgcttggccgccattctattcgcactgtgctgcacctccagcactttttggctcggctccgccactactgacgaacataacaaagcgccccatgttgatcaccataagctgacggaaacgcagcaatacgaagtgggtaaaacaaaatagataccgccaattaattaattcaattagcgatgctcgagggtgagtctcgagtcgagagattcatttagtagatttaaatttgttaaaattaaggca

SEQ ID NO: 1435 - DNA, 6257 bp, Heterodera glycines
  misc_feature (6137)..(6137): n is a, c, g, or t
  misc_feature (6146)..(6146): n is a, c, g, or t
  misc_feature (6149)..(6149): n is a, c, g, or t
  misc_feature (6200)..(6200): n is a, c, g, or t
  misc_feature (6207)..(6207): n is a, c, g, or t
aaaaaaaaaatttttttgtaaaaataattaaaaagaaggcagagggaaataccggccaattaaccagcttaagcctttttttaatgaaaaggagggattaggaatgatcgccccctgatcgggggttcggccgggtccaggtttttgcaaactgttcgccgtagtcggtggcctgtgagcggacgctaaacaataaacattcaaatcttcaaacaacaccgccccctgtttataaaagcctgttcagaaatggttatggcaagttatggcaaacgagaattaaaatggtttttctgtgggcgccttagcaaaaaaaaagaatcaagactgataaacgaaaaaaataaatgttttcccctttttctgaatcgttttttcatattaaattagaaaaacccgagggtatataaattttttaagcaaaaatcattaagctcataagtacaaattctgtgctgaaatattctgatttttttaattattcctgctcacaatgtgtcgtaatgggtgagtatttcttccggtgacaatttgccatctttgttttcgtcagcaatatgaattaaatgtttggcttccgcgtcggcatggtcaaagttcaacggcattacccagtcgcgcatttcgtccttaaagcaaaacgccaaatttgaacggttaaatgaaaattataaaataattttgaaatttttttggcaatgtttccatttttggataaaattttacgatttaacaccactaatttgaaatttttggcacctattttgccatttttagcacctattttggggatggcagtttttagcaactataaattgcatccctagacataagtatgtatgccgtaaaatgtatttctctttttatgccaaagaaagtatttaaaattcctttttttgctttaatggacaaaaaaaaaagttgaaaaagacataattatttgcaaccaaaaaattaaaattaatcaaaaaattcctaaagataattaattaattcctttttcaatttttaagttaattattcttgaaaatacaataaattttggcgatttttgcattaaagccgaaaagttttaaaattcaaaattctgttaattaattgtcattaagctcataagtacaaattaatttcggtgaaattttttaatttgaaatttttgattttcactttttttttatatttctcataatgccttcatttggtttttgagaattttttaaagcttttttttgcagttttgaccgccttcgttggtttacttatcttttgatcgattttctatgcttcggttcacttataaatttcgttttttatttttaaattttttcaattaattttcttatatctgactaatccttaaaaataaaataaagttttttttacagaacaatgatgttgagcggacatggaaaaattacaaggaggagcagctgaagaatggcttgctcgattggcaagactacaggtgaagaaaatctaacagagggcgagaagggtggaaaattctaaaaaaattaagaaatttgatttacggaaaaccgcaggagggccaggagatttcaccggaatacgtcaaaatgattgagcgagacgaacgtcggtggaaggtcagaagcaggccaaaaagacctgctaatttatattaaatcgagaggctaacggccaaattttaatatttttaaatgctttccatacagtaaactcaaaaattgatttacaggtggctgactacaattcggacggtaaaatggaccgcacggaatacggctgtttcatgcacccggaggactgtgaccatatgagagacattgtggtgcaggtggattagcaaatttatttattaaaaaaaaatcaaattagattattgcttattaaagtccctttttcaatgattttcattttatatatttttcacttgtcttaacttggaacgggaaaaattcacctcaccctaattctcatatttacccagtattgttgcctaattatttaaaatgatttattattaataaatctttaattgctattggagcaaaccctcaccataattctcatatttatctcaaaccctcgccataattctcatattatctatgtattttcctaattaatcccgaagtattgctaattaataaatcttttaattgttattgatgtcctttccttaaaaatccttaaaaatttctgtacaggaaaccgtcgaagacattgacaaggacaaggacggtttcgtggacatggccgagtacatcggtgacatgtacagaccagacgattatccggaactgaagggcaaagagccggaatgggtggagtcggaacgggaaatgttcagggagcaccgggacaaggacaaggacggcaaattaaacaaggcacgttgaaggggaagaaaaaagtgccacgaaaatgccaatattggctacaaaattggcaattctgccacaattaattaacagaattttgaattttaaaacttttcggctttaatgcaaaaatcgccaaaatttattgtattttcaagaataattaacttcttataaaattgaaaaaggaattaaattatctttaggaattttttcattaattttaattttttggttgcaaataattatgtctttttcaactttttttttttgtccattaaagcaaaaaaaggaattttaaatactttctttggcataaaaagagaaatacattttacgatatacatacttatgtctagggatgcaatttatagttgctaaaaactgccatccccaaaataggtgccaaaaatttcaaattagtggtgttaaatcgtaaaattttatccaaaaatggaaacattgccaaaaaaatttcaaaattattttataattttcattcaaccgttcaaatttggcgttttgctttaaggacgaaatgcgcgactgggtaatgccgttgaactttgaccatgccgacgcggaagccaaacatttaattcatattgctgacgaaaacaaagatggcaaattgtcaccggaagaaatactcacccattacgacacattgtgagcaggaataattaaaaaaatcagaatatttcagcacagaatttgtacttatgagcttaatgatttttgcttaaaaaatttatataccctcgggtttttctaatttaatatgaaaaaacgattcagaaaaaggggaaaacatttatttttttcgtttatcagtcttgattctttttttttgctaaggcgcccacagaaaaaccattttaattctcgtttgccataacttgccataaccatttctgaacaggctttattagagggggtcggtgttgtttgatgatttgaatgtttattgtttagcgtcggctcacaggccaccgactacggcgaacagttgcaaaagcatgacccggccgacctctgatcagtggccgatcattctaatcactcttttcattaaaaaatgccttatgctgttaattgtcgttattccctctgcttcattttaattattattacgaaaaacttttatttttacaaaacataagccatgcccattgtaaggacatcttttttgaaacatttaaaataaaaagccaccaggcttccatagtacatttacatatgtgcaaaaatatttcaaaaattctcttgaaaaaatatttcacaaaatttatttgctgatagaaattgttctgataccaaaataaaaccgaacccatccttttcagattggtcaaattcttatcaagtagaatgatacaaacacatgcaattcacaaaaatattttggagggattagtcctccgaaaactaagaaaaagctttttaaaacttaggaaatttagctgttcctgaatgaaattattgattgattatttttttgctttttgtcagtttatcttttatattttctcatgataaattaatattttactttgaaaatttgcggttttcaaatggtttgacaatcaagtgatttaaaatggcaataaaaaagaataaattctaatactagtgaaatatactaatcttgaaatcgtcattccagttattgttttccaaaattcgtttaaaattagttctttgtagaactctcatcgcaaaattgaggccaattttgggcccaattcaatttggcaatgcactgaagaaatattcaattcactaagtgattaattttttcgttttataagaaaatattaattagcagttttttaaattttaaaccctaaatataaatgcaaattttgcttccaatgaaaattgtataagcaaatgtagccaaaaattgggatcgatatcgaatgattttccgttatatggaattgttggatcaacaaatgaatgccttttgctagtgatattttttactaaaacaaaattttcgtcaatcagattatttgctctccacgatttttagggttttatttaatggttaaaatttaataatccagaattttgacaaagaaaatttaatcaaggggaaaagtttttgaataaatttcaaaaaacacctccaattgtggcaagctttccaaatttctgtcatttatgctttagtcccataaattttgttgcttaaaatcacaaattttgcccagcgttgtctgttcgtatcggtgtaccaaaaaaaaaaaaatgtaaaagcggttcaccaatgttcgcttaaaaacaattttcttttttttcttactgatttagcccttttaaccctaattcacgaattccgattttttttctcgtcccgaatctcggaacttaaccataagctatttttgaccatcactttaaaaaacaaaaatatttgtaagaaaccacggcttttttaagtaccatttacttttttccagctaataattcgcatctttggctaatatttccatggttaatgaaccctaccgctatagaacacttcgactggagaagccatgacctctcctcctttcgctaatcaccttttactctttttttttttatcattttccggctaaatctttcccatcatttttatcttccgtctcccccccccccctcaacattcttcttccccccccccccgaaatgtccatcgggccgagttggaaatgaatggaaaatggggaaattaggcgaggggatgcgctgcaaagacggcggagatagcgtcacaataaacacaacagatattagcaagcaaaaacatcacagagcacaatccccgcgggggatgaattgattggcgggggcgggggatgaaagacagaaaaaaaatattacttttgaacataatttcgtttttcttttattgattttgttttaaaaataaacaaattaattcttttttttgctaaggcacccacagaaaaaccattttaattctcgtttgccataacttgccataaccatttctgaacaggctttaatagagggggtcggtgttgtttgatgatttgaatgtttattgtttagcgtcggctcacaggccaccgactacggcgaacagttgcaaaagcatgacccggccgacctctgatcagtggccgatcattctaatcactcttttcattaaaaaatgccttatgctgttaattgtcgttattccctctgcttcattttaattattattacgaaaaacttttatttttacaaaacataagccatgcccattgtaaggacatcttttttgaaacatttaaaataaaaagccaccaggcttccatagtacatttacatatgtgcaaaaatatttcaaaaattctcttgaaaaaatatttcacaaaatttatttgctgatagaaattgttctgataccaaaataaaaccgaacccatccttttcagattggtcaaattcttatcaagtagaatgatacaaacacatgcaattcacaaaaatattttggagggattagtcctccgaaaactaagaaaaagctttttaaaacttaggaaatttagctgttcctgaatgaaattattgattgattatttttttgctttttgtcagtttatcttttatattttctcatgatagattaatattttactttgaaaatttgcggttttcaaatggtttgacaatcaagtgatttaaaatggcaataaaaaagaataaattctaatactagtgaaatatactaatcttgaaatcgtcattccagttattgttttccanaattcgttntanattagttctttgtagaactctcatcgcaaattgaggcgaatttgggcccanttcattnggcatgcactgaagaatattcattcactaagtgattaattttttcgtttt

SEQ ID NO: 1436 - DNA, 2157 bp, Heterodera glycines
  misc_feature (2107)..(2107): n is a, c, g, or t
cgtcgtattcgcactgctaatcgaagccgtttcctcagaaattccatgcaatgggccgatgatgtgaatttggctggccaagttccgataaaacaccgacaaacattcgccaaaatatttctcactcagaagggacgaattgcgtgacgaagactaataatggcaattaatagaaaaacaacaaaaaaaagtaaaagaacaggcataatgaagctttaccgacatggtcaatactgttgggtctgtgcaaagcaatcgacggaaaaggaagaaagcccaactgccgcggcacttaagcaaatcatttggcatttaaacaaaaacacccggccatccctccgccatatttgttcggctttgttcccatacccacccactgtgaagatggcctgtccgacgccgttttccctcacccgtgccaatttgtgtcgttcgacacaatgccaaaaactctcagcggaagtgctgtcgttgtcggattcgatgctcacaatgagagtttctgcctcggataatgttttggacaacgaacggagggaaaccaccaaatcagcgggttggtcgacacgacaaaggacggattgagactgttcggagaagaaacgggcacacaattcatagtcaatctgaagagaagacgaagaatgggacgaacggcacaaatcgcaggactttttgaagaggaaaatcaatgcgatggctcagagagtgttccctgtcgcttccgtcccatcgtttgagttcaccggcggcactctcttcgcattcctttgacaaaattcgatatttaaactgcaaaaagtgcggaatggcgtctgatttgtccgtcggctgttcaggcaaacgccaaatgaagcggaaaatggaatttggaacaattggctgaacggaaatcacagagatttggaatttcaaaggcaaaaactttaaatggcgaagggttgagcagctcacaatcagttttaagagaaaggagagagacaaaagtggggaacacatcgacagcgaaagcagcagagactgaaggaatggcaaaatgaacggcgagacaagtaagagagagtgagagagggggagagagagagagaggggggggagagagagaagacaagcaaatgaagacaaaaaagcatatgcccaccacaatccttgcgagaaatgtccacatggaaaagagtgcgatcggacaaaaaagaagtgcgccatgagagaagcataatcgggcgaaaagtgatcggaaaagagcggcggatgatcagaaaatcatcgctaagcagagatttgcaatcagaagcagcgaaccattcgaatttgagctgaaaatatcagtgaccaaattaactctgcaactcggatgacttcgcatttctcttcgatttgtccttcgtttttctgttccgattggtacgtctccaatcggtcgattcctttgcacattcgtaccaaaattcgatgcttttcctccacgtcaagcggagggattagaaattgcgcttcggtggtccaatttccgtcaaaattctttaggttttgtgttacaatttgttttataatgtatttaccaaaaattcaatagaaccgtctgaactttggactaacgacagtttcaaaagggacggcgccgtgagagaggccgtgccgggcgaaacgaacaccgaaaaacgctgttcaatgccagaaacgaaaagggaatggccgaattcggcaccaccgccaaatgaattttctgttggatattgacaatggataaatcatattgcaaagaatggcacctttttcagtgctgtcaatgcatttcatttgaatgttcggtcgaattccgacgacgtaacaaaaaaggttttccaatttagcattttttgccatttgttcctggtaatttagcacaaattcgacgccaaattcgccgttcgatacaaaaaatgagtccaagaaaaaataaccattcacttcaattttctgaggaaaaaagccaattttaaaatggccacttccgaacggaacgaccaaaaaatatgggcaattggcacctgaagtgccaaagtgaattcggtcgtacatttggcacccaatgtgacattatgcggctgcgtttgatgaagatcanagaaatggtcatcgttttccagggcacttttgcgtttttatcggcaacgc

SEQ ID NO: 1437 - DNA, 1505 bp, Heterodera glycines
ttgtatgttttaatgacccaacaaaacccccttttttctcgggagaggcgatgtgaaggaattcgaaaaggaaacggacgaagagcgaaggacggagaaaggcctaacggaaaaggaggagggagaaggacacattcaaatgaacaaattaattaatgaatggtgactcacttaaaacgcgccttcacacgacagtcattcaagggaattgccagcgaattgcgcagtgcgaaaatgagagaaaagggcgaacgattggacgaacaaaggacgaaaggtgcggaggcgaagggcgaacgacggacatggacaacggacaggggaaggggcgcggaatttgggtccaccgacggcagagaggaccaaacggatggccaaggcataaaaatggcactaaagcaaaggaaaatgaacaaaaacggcaattttggcatccaatcatcgctcactttggcttctgttccgtctcttccgctgcttttcgttcccgcgtcaattcactgattttcgagtgccatcgtccaatttcgattttattattctccgactgatcgatcattgaaagaaaggccaaacagcagccaaaaagactgaatttgaaggaaattaagccttgaaagaagccacaaatgaacgaatgctttttctgacattgttttgaaattcgctcccttttcctccgctgtctcttcgaattgtttgaccaaattgtcaaaaatgttttgggcgaaaggaccgttcaaaggatgggaaagaaaggcgcagagattgtggcggaaaagggcgtgcgcatcggagggagacgaaacactgaagggaatgggacaacgcaagttgaaattgggcacatgttaaatgagtgagaggacattgtcagttcggcgagttggtgccgcgcgaggaaagcgttgcgccaccagccgaaccgttcaaaggactcaacggcttccaacagagcgaacttcgcgaaatgctcaaaggctttagtgccctctccgccgtcaattgcctcacaaatcatttgggaaaaggcgcggaagagacggacactttcatcggccaacgccaaatgctggcgttgttggagttcaccggtggaggaggagggaccggaaaagggcaataagtgccaatttggacgaagagaaaacaaacttttggtgccatcggagggaacattcggcgaagtcgcgtcaaaccaacggcgcaacaccataaggcattgtttggacggagaatgatggtcagaggaagcgccacccgacaaaagcgcagtggaaagatggcgaatctgaaacaatgagaaaggggaaaagaaagaaaaaaaggggaagagaaaaagggagaaaaaggaacggaatgaaaaaacgaacagcttcgcattttttgagcagcaaaaagttgagatgagcggcggcggaagaaacgtcgcaaagtttggacgcctttcctccgccgagcaaatgttcgctgaatttgaacagttccgccaaccaaaccaaaag

SEQ ID NO: 1438 - DNA, 1854 bp, Heterodera glycines
ttaaattggcaatgcgaagttcgaaggaagcgaagagaagcgactgaaggaaacggagaaaagcggcgaaggacttttcgttggcgagctcaacgaattcgaagattctgcagggaaaaaatggacaaaagaaaattatttgcattaaaagggccacgaaaaaggccattctttcctccgcccctttttcattaccgattttgaaaacgagaaaagtcgcttttcagtttgtccatcagctgactttttgcttttttgtctttgctgaccttcgaactgtcaaagagaatcgcccaatggttctcttttgcctcattcaaagtggcgaaccattcagaaatttcaggcctaacggtcagacgatattcctcaaaattctaaaatcaaaatatgtaaaaatttaaaaaaagaagcgaactccggaattgacaaagaaaatgtggacgaatgcaaattcggagttggtggatgtgtcattggaactccttggagtcgagcaaatggaagtgtcggcgttgaaagggaccagcgaaggagtgaagcgcaaattgaacggcaaactttgcgatttactctctctaacaataaacaattgtggaacgtatcaaaagaggcgaggaccttttccaggagagaatgccattgcccagtgcattaagaatgtgccgtttgttatgcgtaaaactctcttcattcccatgccctttgaaattaaaacgaatgatttgggaaatgaggatggatttacatgatattctgataggttctcttttgttgattgcgaagagctgacaatcactggtagcgattttcatttaacaattttggatagcaaaaaattaaaaagtctagacgaaaaattcaactttttaaaaaatgaatatgtaaaaaaaactttttcaaaaatttaattttgcgggtatttttggaaattttccaattttattttttgttatccttgctctccagcaggggtggagcgcgggcggaaatgcccacgatcacggaccactgcaaagatcattggtcccgaaatgttttaattaatttttttcgtaaagattttttaaacaattttctaagggtgttttgaggcgctgagcacgaatccggactccatttcgaccaattccgaatccctaacccgaactcgaacatttttagagaaggaaattttaaatttttttttaaatttctcttaaaacattgctttgagttttcgggattgataaccttagaccaaagcacgtatcaataccacaaaaatggtcattctgtaaggatacgaacaaaggacatgacttatgataattcagaattattgagagggagtacgagaacagaactgggaaactgaacaggacgaggtgctggaaacactcaagataatgatgacttctgaacccggatatacaatgcccctaagattaggtaaaccgatcataattgagtgcgacgcgaccaaaaaagcaattggagcggtattactccaaacaaatggcccagtcgcatatgcttcgcgcgctttaaacagacatgaaacaaattacccgtcaatcgaaagagaagcattagccttagtgtatgcgttcaaagaattttcgccttatattggtggttcaggcgtaaataaaaccattacggattgtatcgcactgacgagcatgatgaaagccaaagaattaaaagtgcgactagagaaataccagatcactctccaaagatttgaccttgggaacgtttacggcccccgaagcaaaaacaaggcggtcgattttcttttcccgttataatataccaggcaatgagcccgaaaacccaaacacaaaggtaaaaaagaaaacaaaataaaaa

SEQ ID NO: 1439 - DNA, 1847 bp, Heterodera glycines
tttttttttaaatttctcttaaaacattgttttgtgttttcgggattgttaactttagacaaaagccgtttcaaaaccaaaaaatggtcattctgtaaagatacgaacaaaaaaagaattttgataattttgaattttcgattttttgttcgagttcggatccggtattcgaaattggtcaaaatgaatggcagattcgtgatcagcaatcccgaaaacactaaaaacaatgttttaagagaaactttaaaaaaatttaaaatttagatctcgaaaaatgttcgggttagagattcggaattggtcgaaatggagtcccgattcgtgctcatttgtcagcgccttaaaacacccctagaaaagcgtttaaaaaatttttagaaaaaaataattaattaaaaaatttcgggaccaatgatcttcacaattgcccgctgcccctcccttcccctaaaatttaaattagaattgctgcaactgttgtctctgttcactcactattcattctagcaaaggaacaaaatgataaaggccattttggtgttcaataaccatggaaaaccacgactgctgaagttttacacacaatatgtatgtaattattctattcttcctcttttggacattgtgccgaaattgaacttttgcccattcagagcgaagaagaacagcagcaaattgtgcgggagactttccagcaagtgtcgaaacgtgacgacaacgtgtgcaactttttggagggcggaaaattaattggggggtcggactgcaaattgatttacaggtaaatggtcctgccgatggatggttgggttaattaggacatcctcaaccattttaaatgaaaataatttataaacgaattctccgcctataattttaaggcattacgcgacattgtactttgttttttgtgtggacagctccgaaagtgagttgggcattctcgacctgatccaagtgtttgtggagactttggaccgatgttttgaaaatgtgtgcgagttggatttgattttccatgtcgaaaaggttgccaatttctgcgttttcatccttcgatttttttccttttcggtccatcacattttaaacgaattggtaatgggcggcatggtgctggagacgaacatgaacgaaattctgctgaggatccaagagcaggacaaaattgagaggcaagaggtagcaagcaatttcataaagaaaacccggcaaaatgtcaacttttcttttcatttgccatttccttaggctggcatcgccgctgcccccgcccgcgctgtgtccgctgtgaagaacatgaacatttcgcaacaaattaaggacctgcaaattgccaggattgccctctaaaattgccaatttcaaaagcccattttgaaaattgctgcccttttccaattcatttgtctctctcccaacgtgacattggccgagttgatcgggtcttacaatggaataccgtacaataatttcttatttacttatgtaatttcaaaatttaattcattaagaaaaaaaatagttttttcagaattttagtttttaaattttataagcgaaaccttgtacaaatatcatgacaccagttgatcaccaagttcaaactgaaaaggtcaatttgatgaactgacggatcaactttaaccagttttcattttattttatttttgcaatttaataaattttaaatgtgagaaaggtaaactgcccatattcacagcgaaagttgtgcagaaaatgagcataattcccggagttttcaatagcaaaaagtctcctcactgaagtcgcccattttcaaagaaagcgactgctctttcgtgctaatataaatagttttt

SEQ ID NO: 1440 - DNA, 4570 bp, Heterodera glycines
  misc_feature (4542)..(4543): n is a, c, g, or t
  misc_feature (4554)..(4555): n is a, c, g, or t
taattgctgctttttttcgtttgtaactttcttgaaatgttagaattctcttgttttctcgtattattacattattcagactttgtgctttcgaatgataccaaaaagatagggtttgttcgaacatgaacaaagttattgtataaaaacccgggattgtcaattgattggactcataaaggtcgattggactcataaagtgcattagagccttaaatatttcatcactcttttccaattttcgcctttttaggcatttccctttttgtttttcctttcacaacatctccgccagtgtaataattgggttaattatgttttttccctttgaataccgtatctaatcattttggtgtacagtatgcttcgtttttcgctcaaattacgttttcacaatttgttttttgcccgttttctttcccccccccccctactttgttcaaatttatcgtttccgcagtttatccttcgcattgttccgccctttccctcccaaattgtccattcgaaactgttaaatttgtccattttcccatttcgttatgtcgacctatgcaaacacaaaaagtggcactaataaatctctgtcgttctgtcgtcgtgactctctgatcaaacagggtcagctgacactgctttttggcacaatccccgtgattttatacagcttcgttggaccgagttcaaaacgaaggtctccgtcgccaaaatacgcttgtgagtcgtcaggagttggagcgacaagctctttgcaagccggtaagactaatggccattggtgggctatgccctggccaatttccctgtgttcattcatcttttgttttcacattttctgcttctccaacttctcaacgacgaaagcatcgaattaatccggacggcgagcgatgaaaaagcgctttgtgttgtgctttccgtccactgttctggcgaaagtcgcactgtgcttcaatcggcgttggccaatttcagttccattggcctccgcttgggacatttggacacgcggcccgacttaggcaaggctaacaaaaagaaaaagctgatcggacagcgaaacgatggacaaaagcatagaaaccaatcatttttaagttttgttcccacactttaacagctcatcctgacgaattggaaatccgagcccaattaagcggaaggaaagcgcaatttctggaagcattgaccaaattggtagtggaaaaagccatcgaacggatcgaattgagtcatttcatcggacaaacggaggaggaaaaggacaaaagaacggaaacgaaattgggaagaggtacaaaatgaaaaaccacaaatgggtataaaagcaatttaaaagcaacagaaatttggtttcctcggcacgtctctgagctggacaaaagcacgcatgtaatggtcaaatacgaacccaccgaagacccaaaacatccggtgagagagacagggcgaaggagagagagggggagggaaagaggaaggagagagagaatggtgcataagacagaggggtaagggtgaaatgagagacagtttgagaccgagacggggaagatagagaatgagagattttcagggatttggcgaccaacaatacattgcccgccgggctgaactgaatgcgttggccaatggttttcggcacggcgattccctccctttcatttgctataccgacgaagaaaatgtgaaattcaccccttaacgaactcacgaaacataaaacttcagaaaacttggcgagttgcctatgaacagcttaaggaattgcgcgagacgcacacatgcgaagaataccaaaggaacattagagaaatggaaagagaagagataatgtaaaagggggagggagagggggaaagacggaacattcgttcacagaacagccgaccgaattccgcagctgcgtccgctgagtctgtacatccaaagtgggcttccccacccactttttgctcatttgtcagtccaaattctgaagaaaggaccggcttcgaactccgtccctgcggcggtttgctctcggctcgcgactttctcgccagtttggccttccgcgtctttcaggcactcccccaacagaataacccataaaaaaatgttgccattcaggcgacgctttacgttcgccatgccaggtgctccccctccctctccttcctcatgccctacgcgccaatttctcccccccccccccgattaattcgaatgtaaagttttgttgagttcgccgcaccattgccctgagcccgatgtcatccacgaagtgctcgggcattgtccgatgtttgcggtattcgaaggcattgacactttgtgtttaattaaagctgcaaaaggacgaacatttggcgcaaatgtcgcaggaaatcggcctgctttccttaggcgccagcgacgagcaaatcgaacgattggccaccgtattaattaccgtattcactgccattctaattcccccccccccctcttcaggtgtattggttcatcgttgaatttgggctgtgccgacagaatggtaccgtaccataggaatgggcccttgaattggctttctgttcttaattcccaggacaactccgcgcaatcggtgccggccttctctccgcgtttggggaactgaaggcattgccaaccattagaccaattctttaattgttctgtttttgcagttcgcctgctccgatgggccgggccatgaacttttcgtggccgaattggccgcgcaacggttggccacagggaattggcattaattgcagcccaaaagggaggattacactaaattctctctgtttctcagttcgtacgtcgactcggactatcagcccgtctatttcgtggccgaatccatccgaaaagcgatggaaagcatacggtaaatgaaaaagagcgaacgcccccgcctcaccagccgaccaatgaatagtcggcgttaaagcattgcactaattaatgaggtgcttttcagggcctacgccctttcgatgcgtcctcagagaattaacatttaccacccattgccacgctccattcaaagcgttccaagccacgctctgatcggaaaaagaatgggccaattgcaaaaggaatgtacggaactaagccaattgatggacaaaatgaagacggaagaagagaagggaattataccggcggaagagagaagggcagtgattgactaatgattggcaaaacaatgcttttggcaggaaacccacaaatggcatcggcacaacctttgggggttataataccattggcacaaatcctatacggtctaataaataacacattccccaccgagaacaaaaatcatttaatgatgtgacaaataagaggtacaatattcgaacagaagtgaataagcaaaggaagcaaaattagttaggaaagcgatggaatgttgtctaagcaagggattcagcttaaaatgtcaaaaattactcgtaaattccaattaacgcactcatcggaaaaacaaaacggaaaaagggggagggggcaaaaaaggaattgctaacaatgagaactttgagaagaaaacgttacaagggaaaagagtcgctgcatttaaaagggttgagcactttgaagcatggccgttctctgctcacagtcattggttcttcactggcagcgccataaagtgaagggacctgccaacacagaacgacgttggaattggcaaaggcggcgtaaagacggcgcgattcgttggcaaaaaggagactgaaaaggcaaatgccaaattgggaagtaaatgaccacctgaggacgggaaaatggaaggattgaaatgaaatgtcacggactacagtcattgtccacatttcgatcagcctgaaaattaaattgaccgatcaccatttatttccccattgttgtactcaatctcacacaaacaagaaacggggtcatggcaatccgtcagtctatggatttgttcattgacgaattgtatacgagccaaaaagccctggatatccagtccaaaacctaggaacgtccatgttctctcccacctgatcatccccgattggagtccaattgccacacaattaacagcggtaccttcaggcaaatcggttatggcaatgcttaatagttttcctttgttttttgtatcatgcaaactgtaccttgttattgtgcgttggcgctcactgtgcattccgagcaattcgccgttgattgaataaagtgccaaccgcgacatgccggattgaaaaacgacggcaacgtcggcactggtgggtgagacgcagctgagggtgactgtctcctcaatgggcaccgaaccgttgaacacgggcggaggtggcgggaagcggcgttcgaaattgtgcctaagtataggggaaaatcgaaatgcagaaaaaaaagtacgacttgttggcatcccaaagacaaattttggcatcagtgctggtggacaaaatcacgtggaatttgtcagagatcgacaaagaagagatggcacaactgtgagcatagagtgatgagcgctaattgactaatgcctatttcttaaagtgaaanngggaatgaccnntgcaggcccatgcaa

SEQ ID NO: 1441 - DNA, 5799 bp, Heterodera glycines
  misc_feature (39)..(39): n is a, c, g, or t
  misc_feature (99)..(99): n is a, c, g, or t
tcagagatcgacaaagaaagagatggcacaactgtgagncatagagtgatgagcgcaattgacaatgccatttcttaaagtgaaagggaattcttcctntgctattcccggcactcgcctggtcgtattggagagagtacagccgaatggatccgcacttgaagccgagaagaaggctattggctgcggacgaataagcaacccgacaccagttccaacgattgcaagtcaatgagacgctcccaaaactgttgcggcacatcgatggatgaaggcgaaagttggaaatgccttttgctagaatggccagcgtagacgagtttaatgcgcaaaacattgtcggtaaaattggaagggccccaagcgacaacggcacacaatgccaattcattgttgagacgtagcgggtcttggaagaaacggaaaaataaacacaaaggccaaagcatcacaccttttctgtccggtcggtaacagacgattaattcggtcgattcgggaataccgtagcaaattgccgtggtctgatcacaatgcaccagggaaagacggagagagctgaacaccgattcgatttggacgtttgcattaaaaaatcattaaaaagttataatgcaccgttttgttcccgaagtgaaaaatcgtgatggggtcgagaaatagaagccgtcatgttccggactgcctacgaaatcaccccatttcacaccgacgacggagtgaaactgttcccgaaatgagcccgcagagacagacacagatggacgagggtccggacattttggcgttgtttgttggttttggcatttcggtgggttcaaatgcggaagatgaggcgaatcgaacaattgcaagggcatctgaccataagtccgaatctaaacaaaaaaatgcatctatttttattgtgccattgtgcaatttgttacttgccattgtctgaatcgcgcaaacaattaaagggtcgtctttgttgctttccacgaaatctcttcctcggtacgtctattttaaatgttaaaaaatactgattgtgaagaatattttgaacttaccgctggatggaaaacattcattgctcggacggcgttttcaccgttctgtttgaaaccaaatatcaaatcaatccaatggtgaagattggtcgtgacatgacggtctaaagggaagaaagaaaaagcatcgcttttccagagaattttctacacagaattaacgtactttcaagtgcgtgacgatggattagacaaaactgaaaatgcaaacatcaatttttaaaaccaattttagtataataaaacactaccaaacggtgatctccacgaggacaccaaggtggaacttgaacatggtcaactcggtccccagattgccgaactcccaattccaactcgtcgccatttcgtagcatttcatagaggtaaaagaactcagggatgagttcctaagcatttgttactttcttggataaaaaaattagtttcaacaccttaaaatctgtggtcgattctgagctggaaaggcgccaagtcgtgtccattgagctgaagagacggtcgggaatgtcgaagttattgtctggaatataaccaatcatttgacctattttgttaaacgattttactgctgaccttgatattcgagagcaacggaagtgtaaggagggacacggaccaaataatgggcaacaattccagtattagactgaaggacttattgaaataaccaagtgaacacccaggaaataacgaacgtaatgacttccgtaatgatacggcccaaaacgaacggttgaaaaaccactttttggggaagaaccgacagaatcggcactttggttgaatcggtcgtactcttccgccaaactctggtaattttgtgcataaactttctccatgtgcgcatcttgaattgccatcggctttgtcaaattcctaaattgttgacacttaatttttaataaattaaaaaaaggataattcgaatattattaaagcaacaaattaacagcctcagataggaaaagcttcaacaatgatcgcttcagaagcagaactggctcctgaaaatcatcataggctgttttataggatactcaacaaaacaagacgaaattgaagggaatcgaaccgacaatatttgttaaaagagcgagaaaacccactgaaccaacgaattgacaaatggaaggaaaatatgactgtaaattgtgtaaaatttggatgacctgtaagaatttggattggcaatgtcaagggcgtccgagcagtaatcagaaaggacaaacggaaagacggggtactgcatcaaatcgttgaaagttctgccggccaatttattcaaaaccataaggtatctaaaaagcaaagggtcgaaattaaattggaagtttttctcactcgaaatttgtcaaagtgccacggcgccacatttgtgtggcggacttaagctgcgctttgtggtccacgaagagtttatccaaatgaaaagttcgaaacattcggaggataacggcgcgatcctaaaaataaaaataaaaccgaatgtaatttactatttccatcattcacttcttccgatgcgaaaacaacgagaaaggcatcgccagtggtggtgaacagctcaagcgcagtgtctttcaactgataaaaacggatgtgcatctctttgatttggtcataatcccacgaataagtgacgggcgcgtgaacgacgcctttcttagaacaaaatgatcataaagcatttcaatgaaaggtcatccaaacctgtgtacttttagcactttcacccaaaaagtaaagcctttggtcggaaatcaccaaatcaccggaacattcaaacgctgtttgaagaagtgtggcagaaatgctcattcgtatctaaatcaaaatggattaaccttttacagaaacgaaatgctgacagggtcttccatgtccctaagcccattggcatgactttgttggatgtcaccgctattctgaaaaaattagttgatttgtaaaagtggaaataagagtaagaaatgtgccattactaataaattgtccaatggcatcggtgcgttgtgaagactttcaacagctttgcttcgctcacttttaagaaatttgagtggaaacaaataatgtgcgtcggaaaagcgtcgtctctcacgcgatggtccttcggttgtgttaaggacacggccaataggccaaaaaaatggagagaaaaatggcgcctccggatgacaaagctctttctgaatatttttctacctttgttagagtaatatagtataattttacagtatttaaacaatgagcatttttttaaatttattatttttttatatgaaagggattcgaatttgaatagaatttgcaagtgcggcttaaatctatgaaacatcaagatttttgcgattttccatgatctatatcctatccttaatttaaataatgttttgaaaagattttctataaggatcaaataaaatcagcctgatttcccttaccaaatcacgaatcattacgaaattttttttgggtccgtgattgaaatttgaaatatattcatttgcagctctggctgaaatttgacttaccactaaatgtgctaatgttctgttagcgcgcgaccattccctttgagattctttcttccaattgaccagcagtcgtcgaggtacattttgaagttctgccacttcgcatgtcaaagtgatcgcttgctaaaattaaatttaaacggtacgaattgcggagcaggggaagaccaaaagttcagaaatggtcccgataataacatcagaaatcgctcacatcgctagtgaatttgagcaggttgcattccctgtcccaagcggcgttagccctttccgtcattttcccataaaattggctttttatttcagaaaattgttgcagtagcaaaatttcgtctgctgtcagtgagccaatctcttccagtgtcaaatttgcaagaggcgaccgaatattgatggaatgcatgaatttgatcaacaaatccaagtcggtgtcgaagtcgccgatggaagtgaaatgcaaaaggcacaactcatggagaccgattttcagagcgtattggaaatcctgaaaaggcagaatgcaattttgagttaatgtaatgcaaaacaaaccaaattcaattccatgagcattgacatgttctcgcggctctgtctcaattccttggctaaaaatcggacgacgataaatcgacggtggagagaccacggaagaaagtcggaagattggtccaatccaacgcatttcagcggcaaaaataaaatgaatgtgtaatgacttcaggacgaatcaatttttagagcaaagaataaaaaagtctataaatgtttcaacccattttcattttagtttaagagccagggaagtcaagcatcgtattgttttttaaacaatattatttctaattataagctcaaaatgtgtgccgacgttttgtaccattgtttgactgttggcattgtgccgcgtttgagtgtgagctttttgtgagttaatttgtgcaggaaacagcaagaaagcgatagtttcgagcagcaaataacgcgccctacgcaaaaaggacgcacttcgaagaatattctgccagtcgtctattttcttaaatagggaatttcagccaattgtgaactgatcatcagactgatttggacaaattggcttttttctaagttctattcttacaatggacgcttttcgaggcgacaaacagcaggcgcagaagagaatctccaagaaagtcgcgagcaaagtttcttcggcttccgatgccaattggggcgagtcgaaaaacagaaacaaattgcgaaccattgtcaaggagaagagaaggcgatttgcgttctcttcgttagacgcaaagccgggattgaacacagaagcgacggaatggaagccatggggtcgaaaaaagtcaccaaaagctaaacggataatgaaaataagatattaaattgagtactggtacggtacacgaatcggcagcagggaaccattgagaagtactctgaaccaattcaaagtcggaagactcggccgaagatgaatattctaacaataagtcattttaaaaataacaaataaaattacagaggacaacaaaacctcgccgattcccgaacatttctcgtcgctttgaagcggccaaactcgagaaactgctcggcgtccgaaattggtcagaaagtgtggaacgaagagagtcaatccaacagaagagaagttggcaaagagcttgacgaagcaacggattggaagaagaggcagccgatgggtcgaaataaggctaaaacattgataaacaatgttaattgattggtatgacatcaaaaagaatcaccgtcaagtgatcgggggaatggctgctggaagtgctatttgtacgccctgaagaggaggtggagggcctccgatggccaaattcatctgcaaattgtccttgtcctccgtccttccacaaagcaatgatgcataaccaaacaaactcttcacaagacgaataggaaaaagggtcactgaattgaaatggcaaaaataaaagaaaatgctaaacgatcgattgctcactcgtaagggacgagactgttcagaatggactgagcaaacgaaagccaacagtcgaacagagaaaccaattcgaattcgcgctgagtggagagactgcaaagcgagcgcagaacatttgccatggaatcgaccaagccaagttggagcatcgactgacggggggacgaatcggtggagaaaatctgaaaatgggacatta

SEQ ID NO: 1442 - DNA, 5515 bp, Heterodera glycines
aatcgtgctgggccgtttcttaaaaactgccaccatgggcgtttcttaaaactgccagggcgtttcttaaaaactgccaagtgggcgtttcttaaaaactgccactatgggcgtttcttaaaaactgccaccttgggcgagaattaaactacaaattaaaacaactatatagaaatattttatctaaattttattgatataaagtttgtaaattaatatatatattccagtatttcttttttaaattttcttattctttaaaatgttcaccaaaaacatgaactgacaagttcaaataactatttaaaattctaataaatacagacttttgttaatgaacattcagcactttcatacaaacatttgcaaaagcttttgtcgcaatcgtagcgttttctagatttgtttatatagcataaatcatagtaataacagcaatcatcgactatatcatttaaaaatttataataaatttaaatttttttaaaccttttttaaagttgcaaaaccatattactggtgctataaagcatgagtcaaaacatgaagtgccacaataagtgctacaatatttctttgcaactttcaaagggaaattttaattataataagcttatcagtaaaaaatttaaataattaatttatcaagaaaaaatattaaatatatcgttgagctcatttgtaaattttattaactacaatcatcagaagcaataaatttattaatattttaattttactgagcttggtgttgaagatagtgttgacaaacaaatgatgtaaaaattatatgtatatatatttttattatttataacgttggcaaacaactgacataaacattttttaataaataaatatatttgtttgcagtttttaagaaacgcccatagtggcagtttttaagaaacgcccacttggcagtttttaagaaacgcccatagtggcagtttttaagaaacgcccacttggcagtttttaagaaacgcccatagtggcagtttttaagaaacgacctagcacccatttttatcatgtttaatacagtaacaaaggcttacatccatttccaaatatttctgtttgattcttgaaatcgcaaatcttaaaaaaacaaaattcggaaattacttttaaaaaatggctaacgcattttgtaattttgaaaataaaattgtaaaaaataatttttacgtgttttgcttcctaaaaagcattaataaaatttttttttgcctattttagtgcctattcgaggatttttgtgcctatttagcgatttttttaatgcctttttaggtgcctatttcgcgattttttgtgcctaaaaatcgcatccctactaatttggtttaattttgttacttttttgaataaattttgtcatttacactacaaaatttcagattttttagtgatatttttggccgtatcccacccaacttattaccattcagtagcctaaattttattcattatcctaaaaattaaaaaaaataaatttttattaattcaaatttttgccagcctttacaaaagttacagtaagaagaattgagggcggaatttacaaaatgaaaaacaataaccaacttttgtgggtcctcatatgcataacatcccggcaaaccgttcccgatataaaaaatttcagtttgcttctcggccgggttctaaatccgtttcgaaacatttagtaaaataaataaaaaatagatagataaattaaaatatccaaaataaaatttattaactgcgaagattcaaaattttacaaaaaatttttcttggctggcgaacaccgggaaaagcatttgcttctctcgctcgtcttccgacgtgcatttatggtaagccttgtaaattggctttcgtccataaggttttccaatgccatacaatgcggcaaaacggaactaaaaatgataaataaaagccaatggaaaagaaaaagcggctaatttgtagcacttttaatttgcatatttattttcccaaagtcccggtgatctgagattgataaatgtccattaaaataattaccatttgattgccaagtcctacacaaatgccatttgtattcgtcgggaagacatatttatcggcacttttagggaaaagtctacaatcatcaaaattaattttatttatttatttttttgtaaatgataaaatttggtcaaaacttttgttttaccgttcatattcttcgtccgtcagattatttttgcatcgccgcatttcatcagtttgttgaaaactttaaattgaaaatttaaatgtaatttcaataaaaataataataaaaatacagttgaacggtggtcaaccgcacattgaacacagtgaataacaaaaggattaaattcacattcaaaaaatggcacatttttacactaaaaaagaaagaaatgtataaaaaatttttgttttttcgatttatttttttataaaattatttaaatattaactaatatttcttttacattagaaaaattatttccatattaatgggagaaagcacagatcaactacaataaaacatcgttgatcatttatgagaagagatggaaaatggaccaacagcagatggatgattcagcataatctgataaataacgaaaaaatgaaaattgaatattggatattcaaataaaaaatataaaatattaattcagaaaaatctgttcgtccgatgattataaattgctgaagtttattaatgttggtttctcgtaatttattattttttttaaatatggacataatattgactaaaaaagcccgaaacatggactaaaaagctcaaatatgaccaaaacatggagtaaataaaaactgtcaaaaaatttgttttaaacctcaaaaattccaaaaaatgtgtatgattcaatattttcttaaatacatcaaattgtcgtcacttctttgatcacttttgccccctccgtgtcccatgccaacacagtgatttgtgccaatggcacattggacaaagtcacattgtcaatgtctctaattaacaagcgacaagggacgaatggaaaaatcacataaataaaaattattaaaaaaatcattttggattgtttgaggtaataggggggaaattaaacgcactcaaaagaattattaacttcgattgtaaaattatttttttttcacgaagaaaaatttttaaatatttatcgcgctatatcaacctattatatcattagaattttattattattattattatattaataaaattctcttttttaatttattttttcaattattctgcaaccaaaaatggatttgcatttgcttatgaaatttgaaataatttatacaaattgaaatattcgatatgactaaaatttattcaattgccatcttaattaattttgttttatgtgaaaatatttgatctattgaaattatgttttattaacaagattaggctatggcaaaataaatcaacaggtcaatttcgaaatcaaggaacattaatattagagacctgaccgggccgggcccgggttttcccgggcccggcaacccggcccggcgatttttggggaaatccgggttgaccgggttaaccgggttgaccgggttttgagaggccgggcttgaatttgaaattgggcccaaagttcgcctcgatttcatcaccaaagtcccaaaaagtaacgaatgggaacaattggtcgggaacagaatttggtgaattggcaaccgaatagaacgaacctgggataagtaagataaataaggaatcatttgcggtttttttttttgaatagtcaaagggataattgggtaaaaaaacaaaatataaaaaacaaaatttggtataatgaaacttctaggttcaactttttgttattttcgtgcttaatgctgagcatctaatttttgtgcttaatttaacattttaatgctttttgtgcttaattgacatttttttgtaaaattttgacgaaaacaccgtttccaagcaataaaaaacgaaaaattcacccctaagaatcagcctaaaaaacttcaaaaaatacgcccataagaaatcatccaaaaatttttttttacaaacttttgctttaaaatgttaatttttgctaagaaaatattaaaattgtcagtacgaatagaaaaattgagaatttatagttaactgattaaattttttgtcaaaaatcatcaaatttttgtttttgaaataatttggaaaaattgttttattcaattgccacatttattaattttctttttttttggtctattgaaattgttattataatttctcaagagtcattaacagtgaacggatttatatgtgccaaaaaacccaaattatgtgctaaaaactcaaaaaaaaaagagtaagtttgtgccaaaatttgaaaattactcaaaaaatgacttaatttctcaaaaatctcattcttttatatatttcactagcataactcaaatctgaagcattgcaatgctttttaagatttacttatttttcaggattttcttcgctaaaattataattttgacataaaagtgaaaaagtcattaaagtcaaaaaatgcaattaaagaaaattttaaaattttaggcacttggccaagaacttgagaccaaaaaagaaatttttataaaaaaaagagtttttcaaaaatcgccaaaacatgtgccaaaaactacaaaaatcccaaaataaatatgttttttatgagcaaaaagtccaaaataacaaaccctgacgccgtccgtttttggtgaagaaaatctgtcgggtggccaaattaatgccacatccgacaatatcgttttctgtgtaagaatcaactgttgacacttccatacgccattaatgataaaaaatccacgattaagataaaaaatgtttgtttctcccaattttttgtccttttttacggtgaatccgaaggagagtaaagcgtaaggggaactaaataaattaaaaattagtaaaaatttgtctttaggataataaatgctgtttatttactgatgcatttttttgattaaaatttcaaagtaaaaaatgccggagaaatccttgccaaacaaaattggatgggtagctaagacaatgcgaaatccgcctaaatttaaaaaatgtattgtaaatttagatttaattaccttcatttccgttatggcaatggacccttaactcagtgatttgaatctcattattacaagctttggcatccccaagattttgtcggaagtttaaaagcgccttaaacaaaccaaggatgggagccggcgcaaaaaaagtcaggaacaaaagaaacttcaaaaaaatcatacgtaataaacaaaaatggagattaggattttgacgatataattttagcgcgggcttattgggtttcaaatatttatttagaaaatcaaataaatagtgtttttagcttgctttgaaaataattgggttttcgctttttgaccgaacaaataattgctttaaggtatttcgagaatttgaaccgattttttgaca

SEQ ID NO: 1443 - DNA, 3263 bp, Heterodera glycines
aaaaaccttaataaaaggaattttcccaccaatcatttaattcaatttgggcattaaaatcaaatgaaaaatgcaaatatcggaaagcaagaaacaatgatagaaatctgcttatgactcatttgtaatgaatttcgcagattctttcttaattatcccttcgtttttctcatctgtgaataatattctttccatttacggacgctatttggtgaaaagatcggaaatgcttttataagcaaaattggggccaaaattggcctcaattatgtcgccggtttcaaacataaaaacataaggaagcaagtcggtctcgaacacgaacacattcggcatatctgaaaatgtgattgaaattatgggaggagcgcgaccgcgatacgccaccatggcaatgaatccgcgatggcggtttccgaccgcggtaaaatctgtccgtggtcgttggcttttttctcattgttaatttctttatttctcacctaatgactgtccgtttttggtgtaaatggcttccatcgatgtcaaattggccccgaatccgaccgtgtcgccctcatcaaaggagggaaatccctcgaagccattggcattgtgaccataaacagtgccatcgcaataatatcggtaagatgtgtcccggccgatttagaccaaaggccaatgcttatcgtacttaaaagcaaaattattaatttatgctatttttgaatagcgcttgaaaaatttaaaatttaactagtacgatgtcagattcttaaaatcacctagcttttataagtttacttttaaaatgaaatggggatttccccaaaagaatacgtgtccagtcaatgaccatcctcagttgcttaggtcataacttttttcttacctcatcaaggcctacattcttgataacaaacgaaagcttgaagtccatagaattttttatttgcttttttcttgtaaatccctgagtctttagccttcgattcagggctgggaccgcgccgcgatgcgcgaccgcaatttttttttttttttgcgggatccgcgacatttgggactccgcggcaattttggaccaattaaaaaaatcatttatcgaagcgattgttttttatgtttaatattatttaaaaataagtattgtttttgtaaaaagcaagagatttatggaaaattatgtcataatctcataaaatcactattttaccaagaaaatataagattgaggcaaaatttggtcattttctgacaaaatctgttaacaaatcgcattaaaatttaaaaaattttcccggcaccggaccccctcctcttgcccattccccagaacttttttgggaaaatgcgccgcaaaaaaattgttaaaaatctgattttctgatcccaaatgaactgaatttacgatttgcttatttctaatgggagccaccccccaccattcagtcccatcgcaaattttgtatatgcgggattttaactgattttttataagaaaatgaaaaaaattttttttaatggtttaaaaattagaaaaatttttaataatgaacgatccgctggccgcggcaatttgaatgcgcgatgcgcgaccgctgtttttttttgcgagatccgcgacatttgggactccgcggcaatttgaatgcgcgatgcgcgaccgctgtttttttttttgcgagatccgcgacatttgggactccgcggcaatttgaatgcgcgatgcgcgaccgcggtttttttctgtgcgcgccccaccccttcttcgatcgaaattccttttcacaaaaataacaggaaaactgatttagaggttaaagtgatttatttgaccttctttacttactcgcttttggtcgcttgtctccttatgattttgatctcataatacacaatgccaaagtgtggaacgagcacaaattccgcaaataaaagttttgcagctgaagaaaaatttctttaaatcattttaaattaattattacgtaattaattaattaatctttctccattaaacatacaattctctactccacgatgtacggctttcaaataattgggcttaaagatgaaaaattcactggccgatttgttgaggcaccaatgatttttgggctgaaaatatgtaaatgctttttgtattttaatttgaatttacctgaacatcattccaattttgcgaataattcaatttctccacttctggtaatgtctgctgcttttgttgttccaattcggcatttttcgcccgcaaattttcctaaaattttatattttaatttttttaatttttgtttccaattaaaaatatgacggacattctcgttctgcagttttgtcatattttgttcaatttttttgagctttccattcaattcttcaacatctgtgggcgctaattctggaaaatatttatttttttattgaatggaattcgcaccattccctttggtgccattcaaatcgatggaattcgttgtgccattcgaattcactgaagacgaagtttttaattttgaaaattattttaatgtaaataaactaaaaaaccatcattttcttcaacaacgcccggttttgatgaaaattgttgagcatacaaaaataggagaaaaaaagcaaaatatggcacggccatcaaaaatattgtaaaaaaaatgttttttattttgtaaaatataaatttgatttgaggccaacttaaatgattggttaacacaccgtttcaaaaaacgagagatgaaccaataaatagagagtgcagagaaaaaaacatctctcattttggcgtactatttttttgtctctgttattagagaaaaactgaatttacttcgtgacgtttaacttttttcctgcacgttaaatccactccaaattttgcatatcgattgagaaaaaaaatctgcatttttctatactgattttatttttgtttatacgttagttcaaaagatataataaaaacaaaatttcaaagcatcatatcttttttctaacccatcaaattgcttaatgtttgcttataaaaagcttctccccatcaagggctttcgaatgataccaagatttaccaatttggttggcaaaaagcttcaaaaataattcccaaaattcgtcattttttaatattttggacaaaaataaataaaaatattcatgttgcacaacggactcgaaccaccaccctttgtccctttactatcttacaaaaaccactgagccacacatgcaaatctttttggaactgggaggccaaaattgaaacggtgtgt

SEQ ID NO: 1444 - DNA, 1448 bp, Heterodera glycines
  misc_feature (1381)..(1381): n is a, c, g, or t
aatttgctctgtcaaaaagtacataaaaacaatttttttttcgtgactttctatggaaaaaatataatttccggacattttaactgatgggcacattacgtcaaagtgttttttgtactttaaattgtttcacaaaaattaataattaaaaaataaatttaattttcttttctttttcattataaatgaagtcgtacattttcacactaagaagacaaatattttctcaatactaactttttgaatttttttttaaattgtaaaagtgccaaaaaaatatttcctctttttttcgtcattttctaaattatcttttaattatttatgaaattaattaagttaaatgttgtccgtcctttcctttgtgtgttattccatttatgaactcgtctccatcccgttgtatctgcgcatcattttttttctgatcactaaaaaagaattttcttcaccgttcttccaatttttgagcatcattggcattttggtaatgatatttcaattcatgggtcagataatttattttttataaatttaattatttttttaaataaatgtaaggaaattgcccattttgtcgtcgatgttgtgttctatcggttgcctatttttgctcccacttgcccatggttcggcacgtcgccctcggcactttacagcattggcacatttttggtatattttttcgaatatccaatttatgtgctgcatattgccatcacccttaatcgttgctcgtgcgtttgggccccaatccggcacaaagaagtaaaacaaacacacaaatcatttacaccattacattttcttagttttggtgtcgtgcttgtaagccgacaattgcgtttgcttttgccctttctttggcattttctgcccaccgtttggtcactattgcccagttggttccacttgacaaaacggacccgtccaagggctcaattccgctcattgtcacctaccaactttattttgtatgtccaaattttgcgaattcattttgaaattttgtggcgactgcttatcgcggcgacttttttgcgcgaaacgcgtccacttatgttttagcgcatattaccattttatcttcttttttttggattttcaaaaattaaacccaaaaacctcaaataagtcatattggtttccagtacatatttccaaattcctccagtggtgccgaaaaaatgacttaatctgcagaattggtcgttttatgcataaattccattaaaatttttaataaagttttcaataaattccgggttacacttctgattttatggtcgctcttccacagtttttcattttttgttttaactttttttaatacaaaacagaaaaaatcgaattttcaaatattttacgtgaaaaaaattanaatataacaaataacaaagaagtcaagtatgatccaaaattttaaatcttttttatattttacaaaa

SEQ ID NO: 1445 - DNA, 1423 bp, Heterodera glycines
tttctaatgttaccgccaggccaaaaatacccgtttttaagaaatttgactcaaaaatcataagatttgatcttcgggcattggtttatatgattgaacttttttgctttatgaaatacgaaaaagacaattaatgattggcatttttacatcggcaggcaattcatgaaactgaaaatttattgccgaattcaccgaaaaaacttctcccaaatttaaaattaataaagaattcataattataattaaaaggcacaaaaatatgaatttttgtaaaattcattccattaaatacatcctaataataactctccctccaaatgtctctcacctttccaaattgatcactttcattttcagagttccaaattaaaatttctccacttatttgcatacacaacaatttttggtcaatttgcaaaaaaatcctccgattcgatcaaaatgtagtgatattcgcgatagaaaattttcattagtattgagtacaatgatcaaaaaaaaaaattaccctaaacactgtgtattaagtatttttgtttgactcaaaaatataattatttttgttgacaaaaatataagtggacaaaatcggttacaaatttgtaaatttttaattctttcggcattttaatttgttcaacccacttccagttcataaagttctgcttcatcactttggacgctgccgcttcaatgccgggtacttccaacagcagggcaattagcagaggctaattgaaaaataagtagtgcaattagcaagatacaagaataatgcagtttgctgaaaaatgacttataccacctgtatctttaaaaatcgcaaaaaattttaattttgtttatttttcaatatgtaaaaaagagagggaatatcctatttgaaaattttgtgccaatatttatgcaatttctccaatgattggaatacttccgttagtttattttttgtaactttgaaaattcttaaatttcaaatcgaattccaagcccaaattattggataggcgccgcaggagagattttttgaaaaatttttggtgtgatttggtaacattaaatatttgtcagaaaaacctactaaactcattcaaaaagcttttaattgagttgcaaaatcaacattttttattaaattaaattaacacgaataaaatggtaattagcgttaattgaaaagaatggaatttaaaataaacaaaagcaaaaaaaaacattaattaattaattagatgaaattattatcgccttcgtccattgtttctgctctcttcaaagagtggccaaattgaatttgaaatgtggcccaaagttcgcctcgatttcgttaccaattgttagcaaagaaacgaatgggaacaattcgtctggaacataagatggtaaactgtcgagcgaatagaaggaacctggggataag

SEQ ID NO: 1446 - DNA, 4405 bp, Heterodera glycines
aaaaatttggaaattcaatatgtttgaaatgtctaaaaaatgccttagcctttgttttggtgttttttaaagtcaattcttaatttacacaatttttggcattttttcagagggttaaaagccatttttggcgttttttaacgcatattttagtgcatatttgggtatttttcgggtttatagggcatatttggcggattttagtgcatacaacttcgaaccttagaaatgacaataaagttgatgttaagggtggctatttttcaattttgtgttttcttacagatttttctcaaaatgccaaaaatatatgcaaaattaagctgcagaaaaatatgtaaaaacatcccagctctatagatcactataaatcattcaatttttaatttttaattatgtgaaattgttcagaaaaaagtgaagacggcaaaatgttgagcaaaatattaatttttcattttcgaaagtgtttaacctgagcctggtcccaaattttgtgccggacacccggcggtgccgggcttttgcaaaacttatgtaatgctgctttaaaatgaaaaatttacgtttattaaatttttcaaatagacaaattcagtgggtatgtttacccgttaaaagtccaattttacgtcatattttataaattgggattatagaccattaagcaacaaattccgactcgtctcaactaaatcaagaatacatagaaggagtaggggccatttaggcgccagccaaagtttttggatataacttttatcattctcaaccatccaacaatcttgatatcattcaaaagcttactgtttttaagctgtttctaagctattgattcgcgactaaataattaccaaaaaagttataacgtaataattgcaaaaaagttgaaatttttgaatttttgtttgatttcgttgagaataaaaaaagttatagtccaaaaacttggactgaaagatgtagaggcttggataacagaaatttgttgaatcatatttgtattcactatattaatggacaaaattctcagatatataaaacacacaaaaaattcaagagcattttttaataaaataaaattaaaaacaaataaaataataattcgagttacaaaatcaaaaattaaaaataaacaaagagcaaaaataataattaataaatgaattcaaaattatcgccttcgtccattgtttctgctctcttcaaagagtggccaaattgaatttgaaatgtggcccaaagttcgcctcgatttcgttaccaattgttagcaaagaaacgaatgggaacaattcgtctggaacataagatggtaaactgtcgagcgaatagaaggaacctggggataagataaatgagaaattatttgtggttttttgatgatattgagataagttgtcttcaaaattggcgttttatgtaataatttgttataataattattattttgttaacaaaccctgacgccgtccatttttggtgaagaaaatctgtcgggtggccgaattaatgccacatccgacaatatcgttttcttgaaaagcatctaatttctgatccatccatttgccatcaattgtaaaagagccattgtttgagtatgcataagtgccaaagttagagacaattgttccttccaattttgtccactttatgggggcgaatccaaaggtgatctgactgtgtaggcatctaaaataatttaaaaataatatcaaaatagaaaaacatattctttattattaatattattgaattttttgattaaatgtattttatggtaagaaataatgctggtactttggtatttttttaacaaaaattgcaaagtaaaaaaagctgaaaaaatcctcgccaaacaatattgtatggggagcgaaggtagcgccaagatcgggtacattaaaaacaaatttataaacccttttacttcggaaaaaattattgtgaacgccccgccccgctttatatcgatcgttttgtctcggcgaggtaagtatgagcaaatagttccagatttgcgtaaattccaaaactgacgaagaatgggcccgagggctggagaaagaccggcggtcagatttgctaatgagatctacctatcaaaacttgaggattttatgttacttctcacacaaattgttgcgctgcgtttttcaggggggggggggcaggccgaaggcaccgctcggaaaattttcacaaattttttatgaaatttgcgacaaggaaacggtttaagtttaattgaaacaattaaagtatcatttaacccatttctaagcgggtgttcattattcattatagtttattcacccgattctgcacttaaatgacaatggatcttcaaaccagtgatttcgaggtcatagtgacaagtgtagccatcccaataattttgtcgggagtttaaaagcgccttaaaattaaaattcaccataaagttttgaattttagtattttctagggttgctccccgacccctcggggggcaaaatgtcgggggccggggacctcgggaggcgatatgggggaggagaggagctcaattgtcgggggtcggggaccccgatcggggaatgaccaaattttattttaaccaaaaaaagcatgttttctttttaaatgctcgtaaatcttcttttttcactttaatcatctgatttcgttagcgccagtaagagtgagtccaggctggcctttaaacctgggcttccatttgtcttatttatgtataagaatgttctgattttggggtagcgactaaaattattctgatttcttaaatatacttatagttttgaaattttatggcataatgtcactatttttcaagaaattttaaggtctgccgcaaaattttttgatcttttggtcccgaatttactgaaatttataattttgcattttcctccccaaaatatcaaaattgataatagaagacaaaaaatataaaatttgatcgaataaattggaaaaataacatagaaaaatgttgtaaaatgttcatatttttgatactaaaatcttattttgggcttggagtttataaaatttttcgatggaagccctggtttaaaaataagtggaaaggggtggggtttcaaaggggggatgagctttaggagcgtgaggaaaattttttcttgaaaatttgcaatttgttaacagatttttcctaaaaataccaatttttgcaattttgggacaatttttggaaaaaaaaatttggggttttgttgggccgacggtgccgataggcgccgccgaaaagtttttcggaatttttaattaattaatattaagaaaattgttcaaaatttcataaattttcaacctttcccccttcattattgaattaactttttaaatttttacaacgctcggagtccccaattcccgaattagtgtcggggagtcgggggggcaaaaagtcgggggccggggacctcggggacggggagcaacttttcaaatataataaaatcattttttaaattattttaatcttttttccccttttcattaccattttcatctgaatttttttcagctcctttttcactgcattgtcttttctcttttgttcattttgcaaatgttcgatttggtcgagagaaactaaaaaaaaattaattttttatttattgttatacatttttttcactgcatttaatgcaaaaatgataggtacttttccgtttttgggccaaattttgaatttttttttaaatcaacagcgggcgagaagaattgctaaagttacgcgccaaaatttttcgaaggcataaatgccacaattagagcttagattatttcttcaaatgaagggtctgcgccacgggttttgacattttcgcgccagaggaattcgcacaaatactagtcaagttctactcacccgcttttgatttaaaaaaattcaacctttggccccaaaacggaaaagtaccaaatgatatttgatagtagcaataattataataataatcttacggtacgtacagtaatccttgtccaatttcccttacccttttgctgttgattttccatttccattttgtcaactttcgtctgcaaattcacaatttgttccatcaattttttctcgtggtcttcttggaatgccttctgctgaaattgaaagtaatttataaccgattgccttcccatggtcaaaagtttgatttcaaaggtcataaatttaaaaaaaagttgcaaaaattacgttgttctgtaactcctccaacttgtccatgtactgctcctcctcctcgtccatttttgccttcattttttcaatttcatttttcattttcccattctccgcttcgatcttcgctagcagtgcattcgttttctgctgcttcaacttttcttggagtcccttctaaatttaatt

SEQ ID NO: 1447 - DNA, 1249 bp, Heterodera glycines
ttgctgtgccgagaaccggcagacaatggatggctttcaatctgcaagaaattagattggcaatatgtggttgtaaaaaacttttgggtatggaattattttttgaagtgagtcaaacaccctattagtgctttgctgtgccgagaaccggtatgcaatggatgtctttcaatctgcaagaaattagattggcaatatgtggttgtaaaaaacttttgggtaatgaattattttttgaagtgagtcaaacaccgtattagtgctttgctgtcccgagaaccggcaggcaatggatggctttaaatctgcaagaaattaaattggcaataagtggttgtaaaaaacttgtgtaaggaattatttttcggtgtccgtagactcagcatgatgtggcgaatctaacggtaccgagcgcctcacgttccgttgcccatacgctaaacaatgtgtgcacgaagtttggtgaaaatccttacaacactagtggattggtaaaaagtgaaccgacgaaagcagtcgctgtgccgcgaataggcaacggaacgggacgcggtcggtgtccgtagactcagcatgatgtggcgaatctaacggtaccgagcgcctcacgttccgttgcccatacgctaaacaatgtgtgcacgaagtttggtgaaaatccttacaacactagtggattggtaaaaagtgaaccgacgaaagcagtcgctgtgccgcgaataggcaacggaacgggacgcggtcggtgtccgtagactcagcatgatgtggcgaatctaacggtaccgagcgcctcacgttccgttgcccatacgctaaacaatgtgtgcacgaagtttggtgaaaatccttacaacactagtggattggtaaaaagtgaaccgacgaaagcagtcgctgtgctgcgaataggcaacggaacgggacgcggtcggtgtccgtagactcagcatgatgtggcgaatctaacggtaccgagcgcctcacgttccgttgcccatacgctaaacaatgtgtgcacgaagtttggtgaaaatccttacaacactagtggattggtaaaaagtgaaccgacgaaagcagtcgctgtgctgcgaataggcaacggaacgggacgcggtcggtgtccgtagactcagcatgatgtggcgaatctaacggtaccgagcgcctcacgttccgttgcccatacgctaaacaatgtgtgcacgaagtttggtgaaatccttacaacactagtggattggta

SEQ ID NO: 1448 - DNA, 3144 bp, Heterodera glycines
agtgaaatcgcattttttttccagccacaatatcgcaccatctgacgaaccaccacactcacccacgccaaccaaccaacccatagcacatacgactaggaactttatacaaattttaaaaaagtaatattttgtatatgcatttaatcaaatttctactttctttataaatgttagctaattagtcagcgtctatttattttctgtaaaaattagcctctttatttaaaattaaattatatataatttcatgaaataaggcactaaatgtatagagaatgattaacgtggtcgattggaataaatggaaaaaaagcaaagttaaagacaaaaccttaaagcactagtcgattggaataaatggaaaaaagcaaagttaaagacaaaaccttaaagcactagtcgattggaataaatggaaaaaaagcaaagttaaagacaaaaccttaaagaactagtcgattggaataaatggaaaaaaagcaaagtcaagaacttatcctacctaatttcatggttacgaggcatttgcctacctaatttcagggtgacgaggcatttggctacctgactaaatggtgaagaggcatttgcctacctgacttaacggtggcaacgaggtatttggctacctgacttaatggtgacgaggcatttgcctacctgacttaatggtggcaacgaggcatttggctacctgacttaatggtgacgaggcatttgcctacctgacttaacggtggtaacgaggcatttgactcccttaagagagacccttctcttctcatgtacctttacctaaaatgttgttggcacaaaaagtaaagggggaaaaagaagacaaatcatccgatcaagggctaagtctcaacagatcgcagtgtaaaagctgctctactgctaacaaccccctgaccagtagtcaagtcgtatacaagtgattttgcgccccgacgttccaccatggcacacgagtgctacggctttggcaaatgtgcgagcaattaagcacgcacatcgggccttcagggtgacgaggcatttggctacctgacttaatgttgacgaggcatttggctacctgacttaatggtgacgaggcatttggctacctgactttgtggtagcaacgaggcatttggctacctgacttaatggtgacgaggcatttggctacctgactttgtggtagcaacgaggcatttggctacctgacttaatgttgacgaggcatttggctacctgacttaatggtgacgaggcatttggctacctgactttgtggtagcaacgaggcatttggctacctgacttaatggtgacgaggcatttggctacctgacttaatggtgacgaggcatttggcttacgatgcctgttcgtaagagcaaaaggacaacgctcgacagcgtaattccatatgatagctgttcgtaatagcaaaagatgtctaagcgatgcctgttcgtaagagcaaaggacaacgctgggcagcgtaattccatacgatagctgttcgtaatagcaaaagatgtctaagcgatgtctgttcgtaagagcaaaagacaacgctgggcagcgtaatgtccatacaatagctgttcgtaagagcgaaagtacaacactcggaatcgtaaagtccatacgatgcctgttcgtaagagcagcagcgtaatgtctatgcgatgactgctcgtaagagcaaaaggacaacgctcggcactcggcagcgtaagtccatacgatagctgttcgtaagagcgaaagtgcaacgctcggcagcgtaatgtccatacgatgcctgttcgtaagagcaaaaggacaaggctcggcagcgtaattccatacgatagctgttcgtaatagcaaaaggacaacgctcggcagcgtaatgtccatacgatagctgttcgtaagagtgaaagtgcaacgctgggcagcgtaatgtctatgttatgcctgttcgtaagagcgaaagtacaacactcggaatcgtaatgtccatacgatgcctgttcgtaagagcaaaaggacaacgctcggcagcgtaatgtctatacgatgcctgttcgtaagagcaaaaggacaacgctgggcagcgtaatgtccatacgatagctgttcgtaagagcaaaaggacaaagctcggaatcgtaatgtatatacgatgcctgttcgtaagagcaaaaggacaacgctcggcagcgtaatgtccatacgatagctgttcgtaagattaaacgacaacactgggcagcgtaccgtccaacaccaattcccttgtggtaaacggtttctccatgttcttcatgttcatgttaagagacttttggcttccctgtttgagcacaacaggtactaacgcctcacaccagcgcgaaggtagtctctactcgtgaggcaaccctcacctgaacgaacacgttcaggatcacggggcgaaataatagtgcggcaaaaatacatagagaatgatctctttatttaaacaaaaaccaaaaacacaaacaggtctcagatccttcgctcatcactcgagcagaatttctttgtcggtaaaaattcttctgcaaattcttcctcttgcatggcaacagaaggccctgcgagagatggcccgacatccatagcatcctgtaacagatgcgctggagtcacgtactgctggttcgtcacgatgtcgtgtgcggcagggtagttcagctgttcaggaccctgaaacaccaaatgaactgagctccaattgacatatactgagaaactgaccaagattgtttggaagtggttgagtccattgtaccatatcaaaaccgggttgtgtacctccctttgttgaccttgatgcccatgtacagtgaagtgttgcagctgatcatgtggaaagtcttgctccattctctgtttttaaaccaatatgaggtaggccttgaaattatttgtcaccatatgatttccgtctgggaaaaacactccaattgtatgtcgaacggtgtcgtcataaaagctccaagcacgttgggcattgtcaggatctacaggtgacacgacaacaattgtctgcccgagtaagacggccgcgatcagagcatcagatgcgtctgcccaatcagttgcgcccacccgacttgcgatgtaagcgtcaaa

SEQ ID NO: 1449 - DNA, 795 bp, Heterodera glycines
cccccccctcccccccgaaacccaaaaagtaaaaagtttcaatgtttttttttgaaattttaagcaattttcttaacaaaattgcattaaaattttcctggcggcgcctatcggcaccgccggacccccattttaccaaatttatgaaaaatggagactaaaatggcaaaaaaatagtaattttttggaaaaaagggctaaaaaatttgtaaaatacaccataaaaagaaaaatacatccataaaaatcgaatttttgacttcagtcccccccccccccgaagccaagggtatggctacgcccttgggggggggggggggggtgtacaaagaatcctttttagcaataatgaacatactgacaaatgcattaaaatttttaattgaatcttaatttgagttataaccatgatgacaaattaattagacaaatgtatttctaactcagtaatgcaaaaaatatcaattaacaatttaataatttctgaaactgcaaacattggaaggatggatatataaatacatttatttgggaataaaatgaaatgcagagaacttttgaataaataactattcgtatggccttatgttttgaaatttacaaaggatgattcttcgatttaccttttcctttttcactcatctgtttacttcgatttctcaattccatccttttcgtatttacctgtaaactatactaacgataagatacctactattacgaaggctgctaatgaatttatgcaaccgaatacattattaaacgataagggtccgatgatgagcgtaacttggt

SEQ ID NO: 1450 - DNA, 3262 bp, Heterodera glycines
gtgagcttagttaaaccgtaaagctaaagatgttctaatcagtttgcaaatcctaattcggtttaggaaatcttcctccgtgagctgatctccaactcctctgacgctcttgacaagatccgttaccaggcgctgaccgacccgtctcagatggagagtgggaaagagctcttcatcaaaatcgtgccgaacaaagccgataagacattgaccatcatcgacactggcattggcatgaccaaagcggacctcgtcaacaaccttggcaccattgccaaatccgggacaaaagcgttcatggaggctcttcaggtacagttttctagtcgcgtcgacaacctgcaaattggcaatttgtttttaaggctggtgcagatatttcgatgattggccagttcggtgttggattttattcggctttccttgtggccgaccgtgtcacggtcacatcaaagcacaatgacgacgattgctaccaatgggagagctcagctggtggctcgttcatcattcgcaattgtgccgatcctgaagtcacccgcgggacaaagatcgtcctccacctgaaggaagaccaaacggattatttggaggtttgtttcattggtactttggttcgaaagttatgtcattgtttaggaacgtcgtgtgcgcgaagttgtgaagaaacactcgcagttcatcggttacccgatcaaattgttggtggaaaaggagcgtgacaaggaaatttcggatgatgaggcagaggaggagaagaaggaagatgaagcaaaggaggaggagaagaagccagaagatgacgtgtcaggttgtctttaatcccaagtcaacttttaaactgatcacatatttaaatatttctcgttgctttctaacaactgatacatctacgtttttagatgacgaagccgagaagagaaaagaggaaggggacaaaaagaaaaagaagaccaagaagatcaaggagaaatacacggaggatgaagagctgaacaagaccaaaccgatttggactcgcaatcccgatgacatttcaaatgaggtgtgaatttaggcttccttattcacttgctttgagctattttttttctaattccaggagtatgcggagttctacaagagcttgtcaaatgactgggaggaccatcttgctgtcaagcatttcagcgttgaaggccaactcgaattccggtcggtcttgccttacctatgtttattctattactagtaatgagaaattggtgtcccagcggaatgtaaaaaggattttttcttgagcgaagaataagctggcaaaatgaacttatttttcctagtgctctcctcttcgtcccccaacgcgctccgttcgatctctttgagaacaaaaagagcaagaatgccatcaagctttatgtccgtcgggttttcatcatggagaactgcgaggagctgatgccggagtacctgaacttcatcaaaggagttgtcgactctgaggtttgtttaaattgacattgatgaaaatttactaaaataagtatctcaacctttcttttaattaaggaccttccgctgaacatttctcgtgaaactttgcaacaatcgaagatcttgaaagtcatccgcaaaaaccttgtgaagaagtgcatggaccttttcgaggagatttctgaagacaaggacaacttcaaaaagttctacgagcaattcgcgaagaacattaaggttgcgatttttcaattacatgttcccggacgctgtctttcatttcaaattaattttagcttggtattcatgaggactcggtgaatcgtaagaagctctcagactttctgcggtactacacttcggcctccggcgaggaaccatgcagcttcaaggttatattgggctattactactgtgtctctggtttgggcttctaaaataaattttattgggtatacaaaaggctgaatgtaatttcttttttcaggactatgtttcgcgcatgaaagagaaccaaacatgtatctattacatcaccggcgagtccaaggacgttgtccaaaactcctccttcgtggagcgtgtgaagaagcgcggcttcgaggtcatctacatggtcgacccgattgacgagtactgcgtccagcagctcaaagaatacgacgggaagaagttggtcagtgtgaccaaggaaggccttgagctgccagagagtgaggaggagaagaagaaatttgaagaggacaaggtcaagttcgagaagctgtgcaaagtcattaaggtaagtactttgtttttaattttagttcggagcttaatttattttttaggacatcttggacaagaaagtccaaaaggtttctgtctcaaaccgtttggtctcttctccgtgttgcattgtgaccggagagtacggatggtctgccaacatggaacggatcatgaaggcccaggcattgcgtgactcctccacaatgggatacatggcgtccaaaaagaacctggagatcaaccctgaccattcaatcatcaagtgagcgcattcaagatgaaattgagatcatgatgtaattttttgacaatttttcgtttttaggtctttgcgcgaccgtgttgagaaggagcaggacgacaaaactgcaaaggacctcgttgtgctgctgtacgaaacttctctgctcacctccggcttttcattggaggacccgcaacagcatgcgtcgcgaatttaccgaatggtgaaacttggacttgacatccccgacgaggaggagccggccgagcaacagccgagcacttcgggcgagccgacaattgcggagaaaattgctggtgccgaagaggaggcctcgagaatggaggaagttgactgaatggtgacatcgctatccattcttggatctcggctattcattgtttttttgttttcttgtttgacataaatttgaattaaattttccgtttcgaaaccaaattatatatggaaattgggcagtaagtagcttcctggcatgctttgcttgttaattggatacaaattaacaattttcgtcttacaaattagtctaccgcccacataaaccaagtgagaaaaaagttatggccagggataggatttttaggtttttacctattttttttgcggcttagttatgatgagagaagcccaaaaatagcattttctcctaacaattttcgatttagagcgactttttagcacctaaaaacacctattttggcgttttggcacctaaaatagtttacaacctattttggcatttttcgaatt

SEQ ID NO: 1451 - DNA, 5225 bp, Heterodera glycines
  misc_feature (58)..(58): n is a, c, g, or t
  misc_feature (64)..(64): n is a, c, g, or t
  misc_feature (112)..(112): n is a, c, g, or t
  misc_feature (123)..(123): n is a, c, g, or t
ttttccagaattttcatagcaaaatgcaaataagatgaaaaaacacaccccctaagancctgtnccaaaaattgttttttaaatatacccctaaagatgacccaaaattcangaaaatattcncctaagaaacaaaaaattttcccaaaaattcgtccacaatatttattatttattttcttgaccaattgcaattgtgtgggcgaaattgataaaaaattagtcgcttttggaatttttgtacataaagacactggatttttccaatttttaacacctattttggcctttttgggggtttttagcacctattttagtacctattttgggattttaagcctaaaaattcctgccctagttatggcctaataatttggatattatcattgcataaaaaaaaacccggaaatatgtattagtcaaaaaccaaaaattccgactcgacaatttctttattcaacacacaaaagaacaatgggttgtgtactacatatcgtatcatactttatacatacattaaacgaattgggaggaggcgattatattgtaacgcatatgatcacattatcagcagaactcattgtcaacgcatcaatccacctcgacgacttcttccgtcaccactgactcggaaaatggcgccatcgatacattcttcaagtcgtggaacgctcggatgatgtcgttgtgcgacaatttgatttggattttctccgcttcattttcgcttccctcgttggccaccgaagacgaccttaaggcaatgaaaacattggaattgcaaatgttttgttctgccatggactcactgctgaagaacactgatctgagtttggacgacttgctggtagcgcagaaggaacgcgaaacggatgacctccttcagctcggaactgctcatcttttgcgtcgcttcaacaacttcggcgtagttaaagtccgcctccaaattctcgttcgccaaaatcttgcgcaggagcttctcgcgtgcttcttcatcgggcaagggaatgtgaactttgagtgagaagcggcagagaactgtttcatctaaaaaagaatgttgcataaacacaccaccgacggatggaaaggcattttcctcacccaagtcgagcacacgattggtggcaccgatgatgatcacgttgcagttggaattgcagcgcagaaactcatcccattgcgcgaggaattgcgtcttcagcagctgaaagtcattccgattgcgatggaacagcaaatctgtgagacaagaacaaaagcgaattgcaaaaacatgaaaacacaccaatttcatcgatgaaaatgacacacggctgaattttctctgcctggaaaaggaaggattggcagaaagttcaaaaaaagactgaccaaagtgaacagagacttcatagtaacggatgatccgttgacaaaatctgaaaaatgaaattattgcaattcaattgttgtttttaatccacaaccgaccgacgagcgaagttccaaaattgatgaagtacgcatccacctctttggcaatggcacgcgcaatcagagttttcccacaaccatttggtccataaagaagaattccttaaaagcattcattatgcactcatttttactggtccaatttcataagacaaaggcgacctttcggcgcactgtacagcaacgacggaagagtggtcttgttggacgccagttgaagagggacaacaactttctgcctcagaagttccaaaatggaagaacagccgcccactttctcgaacgaagcggcatcctcggaaaatgctaaacgaagattttcaaaaggaccgacggcaaagcccaaaaaaatactgacagatgagtgaagcaagggccaactgaaaaagaatttccgttatttgactaatcggtttgtttgtgtcgcttcaaaacccgcctcgtgtgagttgagcggagtgttcgggtccaacttcagtgagtccataagctgtgcctcgtctttctttttcctcaaagtcatttcgtctagaagttcttgctgggagcctttgcgctgcaacaatttgtacgcaatacagccgagcgcaacggaagaagcacacacgccaattgtcaacggcaaattcttttcgctggtcattctgattaattttcagatcaaataagcaaaacaaatctaactaaacaaaaaattaggacaaaatgaaaggagaaaaagatttttgtaaaaagtaatgaaaatgaaacaatcacaaaagagttgcttgatataaactttttttatgactagagaacgtaattgtaggaattctcacctttttttttgttgcactatttatatgttggtttgatgtttttagacttcattttatttccatattttggaatggaaagaattgcaatccttttttttacctgaaaatgataattgtttaatttaaaatacatttttaataattaatattaaaaatgtatttaattgtttaatttaaaatacatttttaataattaatattaaatattatttatttaattcaaattcatttttaatattaatttttttgcccatttatttgcctttttcgcttttgcgcctccgtccgtctcgccacgctccacgtaaatgaacagctcggcattccaacactgctgcagttcgtccaagttgcccagctcgacaacggccgtcgtctttttccgctgttcagcaaaagccccgccattttctccccccagcaaattcgaattgccgaaaatcaccaaatgcttgggctcggagatgtgcatcattttgtagcagtacagcagcacattcaaaaggccaccgcctgcaaaaattggaatgggccactacaaacggaaaagcttagaaaaaaatacaacttggtccatttgtgtgaaaagttcttatgttagggggaggggcttctaatacagaggggcgggggcttataattcagcgaatacagtatgactaagactgtagacatgttaaaacgatcgaatttaggtcgattagatgcacaaaattcatctcgaacagcttcaaaacagttgcggttgctgtttctcgtcccttttggcattgctcgtctcccctttctcaaacagtcattttctctcttttttggtgaccattagtcccattttggtgaccattcgtcccatttgatgaccattcgtccctttttggtgaccatttgtcccactttgatgacaattcgtccctttttggtgaccatttgtcccactttgataatcatttgtcctcattttggtgaccattcgtccaattttctaatcatttgtcctcattttttgagctgcggtggctcatcaattcgaacttcttgtgaaatcattttgtccagttgcatttccacctcatctttaatttccgccaaccattcttcttctttttatggcacaatttttccaaactttcgttcatccgaaagaactggaaaatttcaggttggtttttgtccgcatttaatagagtttttagtccctaatattaatacgaatgcagcagtgctaatactcgggactaatatgaagacccgagactaaaatttccccagaatcggggccgagtctctcaagagcagcaggggcggcgaattgaatttttatattttataattaatacatatgtgtaattgtaactattaaattagaaaatattctataagtgtcttatacatttatagaattaatttaaaaataatctactggtgctttgtataattaaaataaaacaattaataaatcactaaataaggatgataattgacacataatataataaaaatgaaaaaaaattttttttggaatgaaaacaaataaaaattcaagaatttaagaaagcgcagatgactcagccggggaccccaggaaaaacgggggtaaaaaactgagattcacaagaaaataaatatttttctcttgagtaggtgggtgatccaacttaattttccgcatcctattaatcatattcttttatttttctctgatttgaattccgctgtttttcctctcatgagtggcgaaacaaattccaaagttcaattaaaatatcaatttaaaatcacaatttaacaaatcatcgtgttttttcgtcacttttcattttgttggccttttcttctcacaatttctttttcattcggaataataaataatattaaataataatttcataaacagtaaataaaatggaaatatttggcataaatattccgtggatcattttgtgttttttgttatttgttccacatttatttaagcaatcaaaaatctgttgtcaaatacctaaataaaaatgagcctataaataaatgagaaattcaccaattaaaataaccatttccccgttaattttgcatttatttttcattttttaagaagcatttcaattttcaaacgattaaaatgtcggacgaaccaaagcctccgcaaacttcgttcttcctttggtagtcaaaaattagtgcaagcgggaattgtaactaatcggaagcaatttaggatgaacgaaaaccgggaccaattctatgagccgggaatgactcaggcggacgttgcgattgtcgcaggtcggcacaaagcccaaaacggagttcggtcttgaaatccgtagtgtttttcatattgttccatgtcacaaagtcggacgaaggattgtttttggggaaatagggctaagtaaagagaaacggggagccgattatcaatacgatgaaaagcatcatccccaaattaaggcgctgagtggcgccgattgccggaatctgagaaagccaaatgggcacagaagtcggaggaggacaaagaacgcttcgcacacggcaaaaaaaggggggggggaagaaaatgaaaaatggcatttttgacatttgcagaaaaagccgagaaaagccaatcgcagcagaaggaagaggaggaatgagaagaacggaaatagaaaagagaatgctaatgatggacgaatggattgatcacatttgagcattttggattaatcacacaaattgccattattgcttcttgttgaagtagaacataattagctcgcaaagtcgattaataaatgtccatgcaattattgctcaattaatttggctttgttattgttcatcgcaacatcactttagcttgtgcacaaattattgcagcttttttccttcctaatatggtgtcgtcattcccaattaaaattcgccattttttgttttgtgtcg

SEQ ID NO: 1452 - DNA, 2898 bp, Heterodera glycines
  misc_feature (32)..(32): n is a, c, g, or t
aaaattagtgcaagcggaaattgtaactaatncggaagcaattttaggatgaacgaaaaccgggaccaattctatgagccgggaatgactcaggcggacgttgcgattgtcgcaggtcggcacaaagcccaaaacggagttcggtcttgaaatccgtagtgtttttcatattgttccatgtcaaaaagtcggacgaaggattgtttttgggtaaatagggctaaataaagagaaacggggagccgattatcaatacgatgaaaagcatcatctccaaattaaggcgctgagtggcgccgattgccggaatctgaaaaagccaaatgggcacagaagtcggaggaggacaaagaacgcttcgcacacggcaaaaaaaggggagggaagaaaatgaaagaatggcatttttgacatttgcagagaaagccgagaaaagccaatcgcagcagaaggaagaggaggaatgagaagaacggaaatagaaaagagaatgctaatgatggacgaatggattgatcacatttgagcattttggattaatcacacaaattgccattattgcttcttgttgaagtagaacataattagctcgcaaagtcgattaataaatgtccatgcaattattgctcaattaatttggctttgttattgttcatcgcaacatcactttagcttgtgcacaaattattgcagcttttttccttcctaatattgtgtcgtcattcccaattaaaattcgccattttttgttttgtgtcggcttttgctttatcttaatccccccccccccccttcccccgcctttccctttgccaatgaacgcttttcccatctgttggtccgccaaatttgcgttaagcgctatcagtccaacaattgtgtggttgtcatggcgttgttcttcggcttttccacatgctgacattttgtgctgcccaacattttgtgttcgaccgcccggctaatgttcgcgttaattggccgcccaacgaacggcgcgagggattggcattccttccgccccacctgctggcccattccgtttgtcggttaagccatgctggtggtggcaactaacgcgaattccattaatagcacatttttggcggaggcgaggggagggaaaagcaaaacaaaccaaaaggcacagcggttaaacgagataaggtagttcagtgacttcaaattaggcatgaattgacatgataagaagcttacggtaacccaatcactgtatgttgttttttgagaattttgataatttcataaaacactacaaaagtttttagttttcaaaaaaattgaattggcaaattcaaaagacattcttatacaattttcactgtgtattacaatagtcatgctataaaattattttcaaaaatactgtatcattgactcattttccggaagcctttaattccattagcatttaatgggactgactgatttgcactggtttttggtagtttctttgggacccttaacttcgatgctcccaattttttagtttcacctaaatttctcctaccttgaaatccaagtcctaccgtctcacttccgtccccccccccgcacccaattactgtaaatccctctaagcagttgtccccgaccattcatccggccaattaattaatttattgcctgacaatttccggcatcgcccgcggcaatggaaagcgcacaacggcaacaacagacgatgagcaaaagccaaccgcaaaaacagcataaaaaacaacagcagattgtgcgacggcaaatcagccaagccaaagggcccgaggcgatgaaaaggtgcgaatgataatttggaaacatttaaaaggcgtggaaccttccaatttccggaatttattaccgaataatagaaaagacagattttattgttttcgaatctttgtaaaacaattggagttaacctgaaaatgccagactttggttgcttggccataatcagaatgcgaatgggaaaggtattcattataaggcttcccgatctgaacgctactcgggactgaattgaccccaaaatttgagactgggcgggaaacacaatgctccaagcttttcgagtcgagaccgaaactaaaccaatcttttttcccgcggcttagagagacggagacgctgcaacgaaaggcggcaccgtcggtgggtgcttggagtgatgaaacatgtcggctggccagcagagttgagcaggtgccgttgctgagcaagacgttcaccgcactaaacatgtcctcctccaccgattttcgccagcgttgccgtgacggcactttgcgttcgccgacgccaatttttcgccaaccgcggcacagatcgaatagcatcgactccgatttgagcgactttggaccaccaggtcagtgggaaaaaaggcttgaactgaacgaaaagtcaagcccctattatgtcgctttagtacctgattgtttcaaaagtgccaaaattgtccagatgtgttcggcattttggcgcgacggaatcgtacaaagtcgcgtgagcgcaacaaatgggacttcagctggcgcgcgccaaagtcgtcggtcagcaacaccgcttcccttagcagcgacggcacattctcgtacggtgccgcctcgtcggtgggaatgacaacgacgaaactgccgcaattggacgggttctgcccgggacggacgagctgccaattgcaacatgtcagccgatcgcatttcgaactgatcaaatacaagcggacattgaattcgtgacggtgccacgaaaatgggaggagcgaaggggcgccaatcgataaacaatcgattaataacagggttgccagatctgaggatttatcctcattttgtggctttttgataggtcaatgaggattttttgaggatttttgaggcttttgggaaa

SEQ ID NO: 1453 - DNA, 2014 bp, Heterodera glycines
  misc_feature (13)..(13): n is a, c, g, or t
  misc_feature (109)..(109): n is a, c, g, or t
aaaatcgcaaaanttggtcatttttcggacaaaatctgttaacaaatcgcattgaaaattacaaaattttttccgggcggcgcctataggcgccccccgggggcccccncctcgccccaaaagttttttgggaaaagcgccgcaaaaaaatcaactttgtttttcatgttcagaatccccaaaaatgcttatttctaacaaaaaaatgctcaaattgatcatggacaatcaaaaatataacatttgaacattttaaacgtgttttgaataaatttgtgaaaatgaggctttttgacccaaaatgaggcttttttgcctgccaaatgaggcttttgaaaattttaatctggcaaccctgattaataataatgtgtaaataatgtatttatttatatgtacatacataaataaatcagtgttttttttcatgaagtattttttgtcgcatggcaaatgaaattttcaaaaccaattcaaaattaattaaaaatcagctctaaattcatattcgttttcacttaaaaaaattacagtattgaaaaaattgtggtgaaattttattttaatatgttacggaaggacctgaataaattaatggatttaaaaatacaaaaaaaataagaaaattattttaaattagcaaaagtataatttactgttaaataatttgtttgaattttggacattatgagaatcaagcaagcccgcgcaccaattagcttcgatctttaaattgtcaaaaatgatgaaatttacgaattgaaaaggtttccattagcagcagaaacaaatttctctttacgctttacgtcactcgctttgttaagctttaatgcttaatattaaaaattgattgttaatagaaataataattacgtaattcgatttgctgcaaaattattttttgcaaattcttctgtttgtttatgattttccattttcaataataatttaatcgcttttttttttgcaaattccatcgttttcaaatgtgccaatgccaatggtcgcgccaatgtgcgtaattcaattgattccatcgattgtatgcatagcaaattttccctcttcctcataaatttatgcgcgtaaaatgttcagacatacatttattccctcataataatatttaattattattaaactatcactaatattttaaattaattctcgctcatttagtgactgaaatggccaactctccgctgcttcttctcccaattttgtcattgtccatattttgcgcgtttttatctgaaattgccatcggtatgccatcgccgtttaaaacacccgaagcattggacagaatggacggaataagcccggtgagcagcgcatggacatcgccgacgatcagcggatgcagcacgcccgagatgggagccggcagagccaatctgcggcgatgtgccagcatcgcgacggacagaatgccaacgacgtaccacggcgccggcagaggccgatccccgccaacactgagccagcaaatgtacggacgaacgacggcactccttcccggggcgagggacggacggacaattggaatttttgaattgattgattttttgggagggggtttcccgaggcttaaagaagcccgcttttttcccggaattcgatcccaatgtttttcggccgttcgaatcgaaattcgattcggccgattttgctacctaccgaagcacacacattgttgaatttaccgcttaattaacatacgtttttatctccttcaccagcttttcatttattttagaagaatgcctatttcttcgccgcctcgtcggacttccaattacaatcgtagcttaatgtaaaataattaaaataaagaaataaatatacaaagtatttctaaaatatgtaaatattatgtattaatataaaaatctggctctttttttcaaatccaaatgccaatttttggcattttcagcaattcgccacggaaagtgccattagccgattaccaaccagtgacttccttgtgccttccgaggaggatgga

SEQ ID NO: 1454 - DNA, 2057 bp, Heterodera glycines
  misc_feature (1973)..(1973): n is a, c, g, or t
  misc_feature (2020)..(2020): n is a, c, g, or t
  misc_feature (2040)..(2040): n is a, c, g, or t
tttgttggcctgaaattctccagccatccgcgctcctcccccacctttgacattaggtggaatttaattcacagttggaaaagactcttctactaatgcccaaattgaagcgatagcaaagcggagtgcgcgagttcaattcccaagagaacacgtgacaatgggcgggttccatttgttgagaaaggcattgctggaagagcaaatgaaaaggaacgtcaaatgcaaaattcacttggattcctttcgtggagtccgtttccgtcttctgacatgcatcccaagtcgcgtcaaattcggcattcaattgagccaagtcgtaatggcaaacgaattggttccgagtggcttccttgcccaccctttctaagacaaccaaaaggccaccaccgtccgaagttttagcagcgacgacagctttttgatgagaaaccaaagggaaaaaggcatcgtcatcatcatcatcacctaatctcggaaacattttatgattgaaaagggacaaaaagcacccaatccgcgacaggacagcaccaattccatgcgcgactccaaggcgaaagacccacttcggcttcggtcattcagacaaacgcgcgacagacgaacatccatacgttcgacttgcaaagtttcactcacaaaaaggggcaagtctgcccgaaaagcactcccaacaaaaaaagcatattggccataacggaaggaagcgaccaccgaatgttgcgaaatgcctctgtcatcgatagcgccgagaacatcgccgctataaaacagggcaattaattgaaagaaagaaaatggaatataaacggacccaacagaaaagtcgaaggcgtggacactcgcatttttagaaccgtaaatggcacgcacaaaaagacgcttttggttgccgaccacagtcctcagagaacggactgttccgggtaaatgccgaattcggcaagtgccattatcggaagaatttgcataaatgggacacaatctaaaggaatccattatacaattaggtaaaccaattgcgaaagcaacctgcataaaacattagtgcaaatgacgagaattgaattggccaaatcaattttgagatcagttaacggcaattctaacggcaagggaatcacccgaaaaggtacgaatggttcggaaatgggcaaacgaccatcgaatttaaaaagagacagcgatttatcggttgcaaccacaaacaaatctccgttggtaacaatccctgaaaaatgtgaggagaataaccagacaaaataaaacacctgatagtttaaattcatttccaattttggtgaccaaatgtcccgtgccatcgcctctcttttttgtaacccccgctgccgtcgatgccgcagcagaaaagtggaattgaagcaggagaataacaaacatatggacggagtatgggaagaagccattggaggtgcgacaagaaagcccagacgggcgaatcaaaaatgcattcagcagcagatccagtttaagaacggcaaagttgaggaagaacgaacgatggtttgtgcaagcaattagagaatttgattgaacagtgaagttaattaggcaatacgaaaatagaaggaaaatccggtaatagttcagtttgtcccccccccctttttttcgaaaattttttttgtgttttcggggtcgctgatcacgaatccggcacccatttcgactaatttcgaacctcagacccgaattcgaacaaaaagtcgaaaattcaaattttcgattttcacatttttgggctaaaagtggctcaaatgatcttttattgaaacaatgttgaatttcagttcgtttccgtgtatttaaacaaagtttgaaccaaaaatgtgaaaatcgaaaatttgaattttcgactttttgttcgaaaccgaactattaccgaaaatcctagtttattaattaagctaaagctgaatttggcaaaattgttcaacagtcatggttanaagtgttgtcccatcctttcttgtaagatatgtatcatcggaaatanattgtaattttgcattctanaaaaagagccctttctg

SEQ ID NO: 1455 - DNA, 5144 bp, Heterodera glycines
catatcatatgcgaagacgacgaaacgaaacttctcggccaaattcccaattcctcgcatagtatttggcttcgttattctttttcgcaagagaatgaactggaggttgttgagatacaaagaagtcgtacaaggaactcgagcgtctcatcggtgctctgagtgaatcgtccgtctgaaagttaatgagtggtcatcatacataaaaaagggggaggggttggccaaagatatattttgacgacctttttttttgctttccaaaaccacttttttgcggcgcactttttccaaaaaattttcgggaactggggtgggcggcggtgccggtaggcgccgcaggggaaaatttggaaattttggatgtgatttggtaacagattttaatgagtctatttgattcgacatgtcctagtttttgcataacctttcttaattctgaagttgcattcggatagacttgaatataatctgttgcattgtgtgattgatattttggcatctctcgaccggcattcgaactaatgagcattgatttgttaatgtattcgctttgattaatctccattatggcatcaatgtcaacgtaatctcctgcaaaattcgctaaagaaacaaaaacaaccaattcggcttaccatcgaacaccggaggaatgtattttgaaaagcatggctaaattagagaatttgattgctgatcgtgcgtagtttattttcatcaataatgtaaacctgtgaagattgtttgcgaggtggtagtggcggtggaagtgaaggcggagatggccgtcttatctaaccattcactaccgtattcacttttgaattagccaacaaattaccaaccattttatctttgttagagcgtccactgacgcgcgttcttccgccccgttgaattattcgcgcgttgagctcactgcaaatgctcaaacttctcaaacttgtcgcgtcggcttctatgaatttttcgcaagaagcatataatggcgaattcttttcttgtaaactcattgcggaagaaatgcctttttcggagactgttgtttctaacagttcctttggatgaaatagcaaactaaagttaaaacggatgcttatccctcacattcagactgttagccaacggcgtgttcacataatgcactgtcgttgcgaaggaaccgctgtaagtgatgttctcctccgtcatggccgactcgttcattgctcccttcctttggcttgtccctccgaaagttgccgttgacattgacctaattttgctttgtatggatgagtgtggttgtgaaactctcagtacatttcttcctcggacttcagcaaacggacgctttcttcttccaccttcacattagtctcgtccatgccgcattgtgtggccaaaatggccacggcattttcacataaagacgactcttcgctgtggctacgatgttcttctctctccacactgctctctcgctgggaattggaagttgaactcctttggctccacttcagacgttcactgccccgttgtatcgcactgtcaattcgaatactcgacgtaacaaaaggctcgttctttcttcggcagttcactaactcattttcaactgattgtttgctgatggctttatccgccatcgaaataactggttttgtgggcagtaaagctccacaatttgcactctcattactttccctcgtgtaactgatgctgttgcttttgtcgccatcatatttcttagaatttaaatgtacagcaaaatcgaaatgcctaactgtgtatgatccagtgagctgtcgtttcagttttctcgaaagtgatttgccgattttatggtggccattctcagcaaaagtaagaaacggcgaatcggaagtgggcttgacaagtccaggcggggccgcattcggactgaaatgggtcacttcggagacgagctgttggttgaggaattgtgcgggcgttccttcgatgaactgcaggtcctcaaacgcccggtcctgtgcgtcttccttgctctgtgctgggtcactctctatcaacagatcctccacagaaaatccgcctccccgttcgcttcctggggtatcgttttggtttggagtttgtctcgcacttctctttacccaaatccaccggaatagcgtatggtccttcttcgattgactttttcttcagcggaggcggctcagcttcgccttcatcaaaactttgtgaatgaggacgacgtccttaaattcatccatatctttaataatggggcattacatcgaaataaggaagccgatcgcgatttaagcaccattccataaaaacccaaaagaaaacatagaaaatttatcaagctctttcaataaaaggaatgtatttaaagtaagaaataaagcaaccagtagcacccatccataactgagattgagccaaattgcaattggactgccatttcgagaatgttccgaggtattaaatgaacaaagaaatggcagtaaaagaaggcacctgagtcaacaacaaatgattaaagcatctgaatgaaaaacaaaacaaaataaagcagaacgaaaaattctttgcaaggcaattttaagtttgctgctgctgatgacccgtcaaattgaaataaagtgaaggaaagagcggagaatgctccgtctgttggtcgctgttgttattaacaaaaagtgatgggaactgaaacttgcgctgaccctcattcgcataaagcgacgcaaaaatgggactcggcgtctgtcttccctcgttggcgtagagaggagagggcgaaaacagaagctgctgatggctggacgacgcctggccaagcgagctgcttttcaacgaaggcattcgacttgcttgactgccctggtgaaggtactgcttcgtcttaacgagaatttcatcccagaaaagacctatgaccgcaccttcaggagacactgcaatttggctgtcagttcagggatctgatcgctagtgaacacaaagctttgcggtgttgaccaggggtaggtcaatgcgcgaaacgcaaagcgattttgaacgcattcaacatctgctgatagatgaaaaacaaaaaattgaccaatccgagcagtaattaccggacaaatcttccaagttgagatacaatcgctgtttcggcggcacttcctggacaatgacgagggcgtagcgctttaaagaataacatttgaaagtagcacttgtattctacaacaaaatacagtgatgtgaattcgtgcacttcgagagtttaatttgatgacggaattgtcctttggaatggtatggcacttgacaaaatacatggcacctgaaaaataagcaccgtcattataagtgcggctcaataaatgacttcgcccacaaacgtccttcaaccactccttccaaaacaccatgctctcgacattgctaaatgagaagatcaaagtttggccttgtatcaagatggcgagcgtcttattcgagcgtttgaatttaaaacctaaaatacactgtaattgttcaaaaaatagaggcttaaagacgaccatattcgtatccgatgtaattctgcaaatagaaaagttccaaatgttcgcctctttcacgacaacctccatttttgaaaataccctgatttttttattgtttaaattctgcgtgaaggaattactagcaaaggagcctcggacaagcagcgcctctggcaaacaacataacgattttgccactaaaataaatttatcaatgctcattatggtattctttcaggatttttcagacatttgttttttaaggggcccaatatagacagtgttactctcattcttttttcttataacctaccttgtcatcggtaagaattttgaggcttgattcgattcgaagcccattatcaaacaaagaaacttcttcctttcgtccaagccatctacaaattcccatttgcggcttaatgtgatgaaaaatgaatagaaaaacaatgcaaaaaacatttaaatatgcaaataaaagcaatgtcgaaatgatacaagcgacaaagaaaaataatttatttgtttgagacaatacgctaaaggataggcacattatttagcacgtataatacaacggcattatggggaaaggaaacaaacgacaaatgaacttttgccaaattagcctcgaatagccttgaagacgaaaaacccgactagcgcaacaaccaaagcagttgaggtaacgatggaaaaaaggttactggaatcccacacgtagaaaaggctttctgaaggttcaacggaagagcctttggcaatacttctaaaaaattaaatcactggtattcgagagaataaaatagaactttggaagtaggtaatcctgcctcaattgcaaattcaaatcgtagccaaatcgttttaacacagtccaaacggtgtcatggcggcctttttgtataaacatttgatggaggtagcgaaagccatccaaagttatggcgttgtccatcaccatgttagtatcataatcggagatcaactttttcacatccttaacacatatatcaacaaccaaacattttgaggtatcaagtgcatagtgatcaaaaaattagcttgaaaaattttcaatattttttcggaggaggaaacaaccgggggaggggggggggaaataacgatggggaaacgaaatgcaggcaattgtgaagttggtccctcaaaaaaaaagaattaaaatccaaaaaaacacatttttaggggttatttgatgcgctgaatacgaatttgatcttcttttgactttgtttcgaacccctgacccggattcgaacaaaaaagtcgaaaattccacttttttggaatttcattttttagtctaaaataatttaaatgttctttttatggaaggattgttgacttttagttcattttcatgtatttaaacaaaggtttgaacaaaaatgtgaaatccgaaaattgaattttcaactttttgttcgagttcgggtccgggattcggaattggttgaaatggatacaggatttgtgaccagtgaccccaaaaacccttgggagcatgtttcaatttttaaaacaaaaaaatgttgcgaaaagtaatgaagggaaccagccttaatattaccaatccgagtctggggttcgaaacaaagtcaaaag

SEQ ID NO: 1456 - DNA, 1197 bp, Heterodera glycines
  misc_feature (1059)..(1059): n is a, c, g, or t
ttggatcacataactgaaattgaataacaaattttaccaattaacaatcaaatcacatatgatttattttacaccttgaatattcttgtgattgccttttggcatttgatagataattctctcttctcaacagaaaaaagaggtcggaaaggataaatgacctaaattcaaaaaagaaatgaaaagcaacagtaaagaaaataccgctttctgagcgtaataaaaaatttctgagacgtttttgataattttcgcagagcattcgacaacagtttcaatttccaagtagtcttaaaagaagaggaaaaagtaagaaaaaaacgttatcttccaaccattcattatcggagccatttttacaatgtgatctcctccattctgatgatccgatttatttgctaccaaaagcacagaacaattatggttgcttccgccaagtgtttcttggattaagggaagccaatagctggtgacctaatcaatgcattgctaaattgacgaaaatgttaaattaccctttcctcgcttcttcgatcatcaactgaatacaccacacaaatggcatttgcttctcttatcattgacctaagttcttcatcgctttgtaccctttctaaacaaacaaattaaaataaaaaaataaaataaaagccgataaaagaaaaaatcataagcactattttggcggttttcggtgccatcatagctctgttaatgaccgaatttttgtaaaaatttgggaggaataaagcaattagcgtttatttgctacctgaatagtctgttatttgcgtcaaaacgccatcctcgctgaattctctcggaaattggatggtaccacttcttgctggaacatgatcagaaaaacgatcgtatacaagaacatcaattaagcttgttttcccaacattggctggaaataaataataattgttaattttttttattttttacaatctccgacgagcatattctgacttcggcttcagccgtactcgcttcgacattttcaaaaaattgacttgaaaaacttgacagttattagcggtcattgttcgnttgctaaatgtgatgaaatgatgctatgttcagcctgaccttgatttttctatacgaaggtaaaaaatttttgattgacgcggattggggaggggggggggggggggggggggggggggggggggggggggggggggg

SEQ ID NO: 1457 - DNA, 3736 bp, Heterodera glycines
ggatgctattatatgtacttcatcatattagttatctgctttgagtgaagagcagcaacatttctaaaaatacacaaataaattttaagcatttatttatcgttttgtgattttttttattttttttatctcttttcttatgttttgaatgacaaatattttttaacagtctaagattgcttttacgttattaatattaccattaatttttctcttttagaattttctaatatatttcattctaatttcacacattctgtttttatctcatcaagaattaattttagaattttgaacatttgagtttttctttatattttgtttttttcgtgccaaaactcctcaagtaaaactaaaaaaattataaacaaaaatctttgactttttttaaatgcaaattgaaaatagtcttttttaatatatatttttactcttgcatttagccatcaatcgtttgatataattcatagccattttttatttaattttaaaaatttcgaaatttcttaatttaataaatatttgcaaaactttttcgtttttatatgtatattaacttgtttattttttatttaaatcatggtttaaattaattcatcatttcttgtgaaggctggttcctattatttctttcttaattagaccatttcaagtgaaacttaaaaattttatcattgacaataaaaaatgagctttataattatttattatttctataatttaaattatggaacgaaaacaacctttatattttaagatatatgaaatagtgatatttgctttattatcatttattcagcaaattattatctatttatttattaaatgttgagttcccataagtttataaaatgttcggttttttaatatgttcgtttatttttatttttagatatttgttttcttttttaattttttaattaaattttgtgttaaaaagtatttaattttcattattaattttactaatatatagtttataaattaaaaagatattgaaaatcgaatttaaaattataaattcaaacccattttccacttttccgagccccaattaaaccctaaatcccaccacccgcggcgagcactgccgctcgatttttcgaacatttttaactttttaaatattcttttcttttatatttaatattaatgaaattttattttgtttctctattagtcaatcttttattcgtatccatgccatgtttaatgaatggcgcttaactggcaaatgagcaaattttatgactaattatgtattcataaaacttttttttctggaattaaattatttatttatcacatttttcgtttaatgtttatattttttctctataatcttgacgtcttcgttggactttatgttttgctttgcatagagtctaaatttatttaagtagattatgtttttattaaataattcgagtaatggcaccattatttcaaatgttaattttaattaaatgctgttgctttcttaattttacaagaaattaaattatttactaattattattttagctatttaaaaaaattataaaatgcaaagctaatgagtagatgttactcatggcaattaatatgtttgtatttattattattgacctttagtaacaaattagtgcataattgcagtttaattagcatcatattcattaattttgttaaatgtacaactcctctatgttctattcgtttgatattagggttttttaaatttcatttattttaagaccatttttattgtagtagcataatgtatgtaaatcttagactttctgaagtttatttcttactatttttagttgttatttttgtttaattaattttgaaactgataaaaattaaattaataattattatttcttgtccactattagagcgactactctgggttgtctgcattcagtattttatgagtttaaaaatcatgacccagggcttttttcattgtttatttataagagattaaaaaattatttaattaattaaaaaactattaaataatcaattgcgtaaaaaatcattttcatgtaaatgaaaatttatgtaatttaacttgactttcattttatcaatttataaattttttactaatatatttatttctttttttattttcatgatgcagaataaaaaagattataatttaattttctatttcaactgcggaataaataatttttgatttaattttaagcataaaaaatagttataattataaaaacttatctattataatcaaaatgttcttcaagcatttatttttaataactaattttaatatgggtttttattagttcataaaaaataattatctataataaattttaatagattatatttttccggttttgagtaaataaacaatttgattattcaatgttttctaatgtttcatgagtaattactatggagtccaattatatgcacatgcatatttttttcctggactgtgggaggcctgaaacgcacgaaaaacatgtttttagcgtgttttgaagcttctaggatgactttccatatgcatgttttgcatatttgtgcatatttcgcgatttatgtgcatatttgcatatttgtgcatattttggcatttcgtgcatattttatgtgcatatttgggcatttttccaaaaaacctctaatagaacggccccccaacagacaaattggcctttttgacctcaaaaaccggaaaattttccaaaaaaataattttttagcaaaattttcacgaaaaatattgaataaataaattttctcaaaaaatggttaatttatgtcaaaaataagcaaaaaaagcaaaatttcgctttttgggttggtttttcgcaaaaaatgagtaaatttttgctttatcatgtttttttcttctaaaatgatttttaataccacatttagccattttttgaagattttacttaatatttaacaaatttgaagaaatttagagacattacacccttaatttggaaaatttatatgcatatttttcactttttatgtgcatattttgccatttttggtgcatattttatgcgcatattttgcgattttatgtgcatatttttggactccctaattataagtaaagattttgaaaatattttatgttcgctattccaagtgttaattgtcagtatgtaaaacgaatttttatttattatttataaattttgcatttttaaatattttacttaatgttatttcatactgtaatttaataataaaactataaaaaaatattcttaaaatgccatctctgtcgggaggccggagaaggggaggcgtagggcggggaagcggggagagggaggacggggaggcgtagggcggggaagcggggagagggaggacggggaggcgtagggcagggaatcggggaggaggaggacgggaagcgtagagcggggaaaggggtggcgtgggatggggaggcgtgttggtgacaaggttggctttacaatggcatgtgcagtataaatttgagtaaagatggcaacatttcaaaaaaaatacacaaaaattttgaatcttattttaaatgttttatcaatttcttcatttttatttatctcttttattgtctttttgaatgacaaattttttaattgctttcttttgctgtgattattttttttgtacctttaatgtttctcttttagcattttctaatatatttaattctaattacacgcattttgtttgaaactcatcaagggttaatttt

SEQ ID NO: 1458 - DNA, 1589 bp, Heterodera glycines
  misc_feature (1437)..(1437): n is a, c, g, or t
  misc_feature (1498)..(1498): n is a, c, g, or t
tttttgaaaaaaacgcgccgtaaaaaacgtgtaaatagtcagtcactccttttcccaaaaatgttctaaaataatggaaaatgacataaaaaatgattttgataaaagcattgaataatttttcaagcaaaatatgcaaataaccaaaaccatttttgaaatcaccttttacttggttaagaattagaaattagcctataaaatatttatttagaaaatttttatttatattttttgaaaaattccgatttccgaaaattttttggggcctcggaatgccagaggggggggggggggggggtagggggcagcggcccgcgccaattttgcgaagtggtccagccatgaaattgtcgacttcttttcttttttgctttaacctctttttttgcggcgtgcttttccccaaaatttaggggggtccggcaaaatttttgaaattttaagcgcattgttaagttttctcaaaatagcaaaaactaggtcaatttttggacaaaatttgttgactatttgcattaaaaatttcaaaaaaattttcccttcaccgggaaaaaatgcataaaaaatggccattgaaaaacagttttctcaaaatagcaaaaactaggtcaatttttggacaaaatttgttgacaatttgcattaaaaatttcaaaaaaattttcccttcaccgggaaaaaatgcataaaaaatggccattgaaaaacagttttctcaaaatagcaaaaactaggtcaatttttggacaaaatttgttgactatttgcattaaaaatttcaaaaaaattttcccttcaccgggaaaaaatgcataaaaaatggccattgaaaaacagttttctcaaaatagcaaaaactaggtcaatttttggacaaaatttgttgactatttgcattaaaaatttcaaaaaaattttcccttcaccgggaaaaaatgcataaaaaatggccattgaaaaacagttttctcaaaatagcaaaaactaggtcaatttttggacaaaatttgttgactatttgcattaaaaatttcaaaaaaattttcccttcaccgggaaaaaatgcataaaaaatggccattgaaaagatggacatcgcaaaaaagtgacgtgaattgtaaatggttgaacgcaaaaagtttgctcaaaccttgaagctgcccaagttcggcttcagtcggttggacaaaatgttgagcgcggtcgatttgccaattccgttggtgcccaccaggccgagcaccgagccgagccgcggcgtgggcaggcggtgcaatttgaatgaattggcactgtaccggtgggtggtctcgcgctccaaattgctgggcaaattgatgatttggatggccccgtaagggcatttctaaagaaaaaacaacgaaaagattgagagagaaataccgaaaaacaaaatgaaaaagtataatgccnggagttttttgttgtaaaaatttatgtgccaacgtttggctattttcttagaatgaaaatncttaaaattttccccgcccgtccctatcggcatcgctgcccccacccccaaaaaaaaaagaattttttcctttaaaaaaatttgctgaaaa

SEQ ID NO: 1459 - DNA, 1551 bp, Heterodera glycines
gctattttcttaagaattgaaaattcttaaattttccccggccgtccctatcggcatcgctgcccccacccccaaaaaaaaagtattttttctttaaaaaattgctgaaaatctcaaaatttggtcattctttggcaaaatctgctaacaaatagcattaaaattacaaaacgtcttcacggcggccccacacaaaaagtttttttaacaaagcgcgtagcaaaaaaaaacgcgttttttaaataacaaaaaaatcgttgccgtctaaaaagcgcaaaaatttggcagttttcgttaaaaatctgttaacaaattgcactcaaactttgaaaatttctctccgcacggcccaaaaaatattttgaaacgcaaaaaattgattagaaaagcaaaagaaaagtcgtcaatttgcagggccggactccttcgcaaaattggctgctgacccaccgtttagcaaaaattttggttgaccccccccccccctccctttttaatgtatgcacaccttaacacaaatgccgcatccgatgcacaatatctcggaaatttcagcaattttcgatgttggctcaaccacaatgcattgtttgcctaaaaatagagggcaaaaaatcatttttaatgttcaaaaaagagggtaaatcggggtcactgatcacacaaagtctgacacccatttcgaccaattcctggtgaaaatttcgaacaaaaaaatccgaaaacgcaaatcttgaccagaaataaaaaaggcagagtcataatgcccaaaatgcttgcgccacagatgttcagaaattgtgttaaacttttgttttttctgcaccgtaatatgatttttttaatttgaattttcgactttttgttcgaattcgagtccgaaattggtcgaaatgaaatcttatagtctgtaaaatatataagtaccaaaaaaaaaaattaccagtgcggacgacgggacaattctttttgcatggctgcccacaatttttctgtaaaattgaaataaaagaattaacgcttaaaaaagcaaattattaataacccatatcaaataagcaattaactttaattaaattgaggcgtaaactcaccggcttgcatctgtccgggtttacaattgcgattcgcgtctgtgctgtttgaatttcgggcttagcactctttttcatcacgaataaggaaagtttgagctttaaactttaaatacaaaaagttaaaaaatttagaaaacagagctctattgcactttaggcgtacatatgtaaaaatattagagcgagcccggacgggcccggcaggcttttaccgggcggcccggtcacgaagccgttttttttggaaaaaaacgagccctggacgcccggtaaaacgggcttttttgaacgagcggcccggtcccggtcaaatggctaaacccggtcccgggcccagtcaatttgaccggctaaaacgggcttgggttttaccagcgaaacggccgaaatttgaaaaatttaataattatgtttggcaaaatgtctttaattcaaattttcaagacagaacttt

SEQ ID NO: 1460 - DNA, 1745 bp, Heterodera glycines
tttattgggttgaattgcatataagatacatttccaaattcttagctgaaaaactcattcgattgtcggcaaatttaaatttattcaatatttttcgtgaaaattttgctaaaaaattatttttttgcatttttccaaaaaacctctattagaacggccccagcagctaaattggcctttttgaacccaaaaaaccggaaaattttccaaaaaaatcattttttcgccaaatttctcgagaatattgaataaatttaaattttcataaaaaaataataaatttatgtcaaaaataagcaaaaaagcgaaaatttcgcttttgtgggtgattttgatctaaaaattaataaatttcattttttttcttctaaaatgattgcacagaattgccgaaaaaattcggtaaaaacccaactcgttttttgccaactcgttttttacccaactcgtttttgacccaactcgtttttattaccccaactcgtttttattatcccaactcgtttttttgactggaaaatggaaaaaccaaagaaaacgtttaaatttttaaaaatttttagttctaaggtaatttttatttatttacagactaatttacggatcatccactaaattcgaattggtgctataaatggacagcggcagggcccgaaaaaagaagagggacagcgttacgtgtgctctggatgcagacgaatcaaggacaagaaggaagttcctagtgacacaaaattgcctgcaaggaaacgacttggtgaatcgtgggcagacagcggtccgaaatacccgcatttttgtcaaccattctcaaagactgagcttctaggcgttgaagtgagtaactttttgaaaagcctgaattaaatcagttttttgaggagcgaagaaagatccaagcggagttggcactcggcgcgagagagaacattgcttcggcgaaagtgcgaattgaatgcagaatcgaacaaaattacagcgacaaaacggatgaggaaaaggcgcaaattcgcgataaagcgtgcggaaatgcaatagcgacaaaaaaagtaattttaaaaatacaaaatgtttattagtttaattaaggcattgtatcgttcccaaatcaagcggaccatgaaggtgcgtacgttgcttgaattgcagcgtgaggaaagcgctcctctgtggaccactctgagagggcgattggcgcacagggacagtgaccactttcaagaacttttcctactggattgttcaaatgaaattgccattttttcgtcacctcgtcagctggccatgctcaaaaaaacgagaacaattataagtgatggcactttcaaaatggcaccaagaggaattttccaggtgaaacaataaatttgaagacctagtgtttgaatttaggtctatcgagtctttgggtttgttgcacacacccattcggttcctttggcaactgcacttatgcgtggcaaaaatggcgacatttattcaaggttttgggacaaaattcggcaagaattggacacaattcctggacatttagaggcattttgtttttctttttggtcattcaaataaattttcagattcgacaggctaattttgactatgaaccggcgtctgtttttgcctttcagcgtgcattccccgaagtccatcccaatatgtgtgtttttcacgtgaaacaggcgctcaaccgtcgcattcaaaggaaaaggctaatcgatttgtacaattccaaggaaccagaaggc

SEQ ID NO: 1461 - DNA, 7557 bp, Heterodera glycines
tgaaaagctcaggtcccggtcccggtcccggtagggcaaccgggaaccgggaaaaacaagcactggtaagaatgggggtctgagtgcaaaaattagtgagaaaattggagttaaaggaaaaaatttagaaataataattaaatatattcataaagtagcaagaccaaaaatttatgtgaaacttaaatctgaatttctaataatattcgatcacttagtccaaaaatgattaattgtttgaaagaaatgaagaaaatttgatttgaaaattttcattaatttattagctttaacttttgggttttattaaataaaaaactaaataaaaatttaattatttaatattttcacttgaaataaattaaaattggtaaaaacccaactcgttttttgccaactcgttttttacccaactcgtttttgacccaactcgtttttattaccccaactcgtttttattatcccaactcgtttttttgactggaaaatggaaaaaccaaagaaaacgtttaaatttttaaaaatttttagttctaaggtaatttttatttatttacagactaatttacataaaatgtatagtcagcgcattggttgtaggtccgtaatggttacggatcatccactaaattcgaattggtgctataaatggacagcggcagggcccgaaaaagaagagggacagcgttacgtgtgctctggatgcagacgaatcaaggacaagaaggaagttcctagtgacacaaaattgcctgcaaggaaacgacttggtgaatcgtgggcagacagcggtccgaaatacccgcatttttgtcaaccattctcaaagactgagcttctaggcgttgaagtgagtaactttttgaaaagcctgaattaaatcagttttttgaggagcgaagaaagatccaagcggagttaaattttgaagttttaggatgacacatggattaaaaaccgtattggtcatgcattttttccctttttgacgtcgaccaacaccgtacaacaaatcatgctgaatcatatcatggtcgtcagcgtcacttttaccaacccggctttttgttagggcggtggattgcaaattttcaggttaacgtgaaaatctttctgtaacttaaataaaaaacaggaactgagccacgctgaagaagaaagtgcagtggcggtagacgaggggcgcgaattaccatctcagcctctgcaacttacaatcgaattggacaatgcaatcgccggtgaaaaggcgaacatcttggcatttttgaggactgactacgatgacgaacaattcactacaacgatgtcaaattattatggaagaatcgggcacttgatcgggttcaaccccgttcaaagaaatgagcttgacgaaatgatcattgacgatgatgcaaggaatttggcggaacaaagtctggacgaaaatggtcttctcaatgccgatttgccttttgacggactggatgaaattgaaaattttgctcgaagacaggcaagaagagaatgctattatttcaacagatgatgaagtcgatatcattaattaaacgcaaattttgaattttattatgttcttcatatttcattgcggttttcaaaaagcttaataaactttattgatcgaaattcagtcagtttgaatttacatgcttaggttgttttatttagtacaaatttacaaaaaaatcatgttttctttggtttttccattttccagtcaaaaaaacgagttgggataataaaaacgagttggggtaataaaaacgagttgggtcaaaaacgagttgggtaaaaaacgagttggcaaaaaacgaagttgggtgtcgtcctgtcaaacacacggtcagagactcgaccaaaatcggacaaatgctttcgaagtgagacgattgtctccgtctaaaaaataaaacatctttttgtggaggataaacatcaaattgcagaacaaaataatgcgacacttttgctcgagtgtaaaaatggtactataactgccggttcaagttatattttttaatctgttaatctcccccccctctctcctatcaccgcggtttgtcccaatattcaaattatggattgatgttcggttgtgagaaaatttcataacaatatttagagccatattagggcatcaaatgaaagcgaacctttgtttcagtctcaggcacgtgttcggacacgttttcaacggccttatgttcctgtaccacctttgaaggacccgacaattcctaaaaggcgaaccgtttgtttaagacattcattttcaaaaattccaaataaagcctgacatcggcaaaaagcatcaccgtttctcaaaagccaacatagacaaagtgcaaacctctttagcatccttctgggccccgggctcacgctcgactgacacactttcctcgttcttatctttctggttacgttgtaccaccgcggcagtgcgtggcacgccctgaaattcaattcagctttaaacgacctttccaaatagtgaggtgcccaagcgcgcggcaacaagtgcggagagtactcgggcagtgccgtcaatgccgacgcctcagggggatggcctacccccttcccacaatgcccccattaccgatggatcgagtgcggcgacgggtgccctttgaatcggtggggctcgattttctcggcccaacagctactctggacgacagcggacaacgacagaaagcatgggttcttctgatcacctgcttaacaactcgagcaatttacatcgacgcaacccgggatttgtcagcaaagagcttcatcgctttactgaggaggttcattgctcgtcgcggagcaccaagccggattctgagcgacaatgcaccgacattcacgattgttggcaaaactttgggcgaatttggcataacgggagacaatccgctggaattcgcggactcccggggcattcaatggcgattcaccccgcaacacacaccatgggccggtggaatctttgaacgggcggtgcaactcgttaagcgagcgttgcagaagacactggggagctgtgtcctcgattacgaaggcttcagcacgcttttggctgaagttgaagcgacggtcaattctcgaccgatcacttatgtcaatggcaacccggaagaaccgctcccgctgcgaccgattgatctaattcaggagaatggtcggctcatagtgaatccaccgccgggatcctccgaaccgaacggccaacgacgcgaaccaccgcacgaacaactgacgagacaatggcggcactctcaacaacgacttgaacatttctggcggcgatggcacccagagtacctcatggcactgcgagaaaaggcgggatggaatcacccgcagaaacgggtgaatgcacccggagcaccaagagtgggggacatcgttttggtggaagataagttccacccgcgcaatttgtgggcgatggttcgcgtcgaggaactcaaaggatcaggcggccacgtccggagtgtgctgctcaaaatggcgaacggaagaatttggggaagaccagtgaataaaatttcgtaatgcacaaccgaatattttttcttcgctctgctgcaaccgaattcgccaaatcagacacacaattaggctaatcactttaattgagaaacaaaacaacaaattagaataaagctcggaacaacaaaataacaatccaaacaaacgtcagaggcgagagaagacttatttttaagcacaatcaaaatatcaaaaatgcagaagatttttggagaccggagacgaataatcaaaaaatccaaagacgtaaaaatgggaagaaaattgagaaaacaaaacgccaaataaaataatttaaaatgagaacaaagtataattaatatttaacacattcccgcacaaagtcaaaaggcgtccctgccgaattaaaaacattcttaggctgttgaaagggggcgattcgtccgggtgagctcactgccagcggtgccaacgagaaaagcgacgacctccagcaacagaagacatcgaaccacgtccaaatccacgatacggatgcatgcgcaactgctgaccggacacagggtggtcatctcgacccatccccgatcgagctgtgattgaacgcaatggtggacggtcacctggacccgagtccccacttcgattttgacggacaacatgaacggcggagcgaacggtgcggatgcccaattccctgttgccagggaatgaagcaatttgtgattggacccaagccgccaatgtcttcactccttctcggctcatccaaccatcggctgccactcgcgttgtgtcgaaagtgtcgccgtgtcggaaaatttccaagatactgcgtcccgtcgatgtcactccgacgaaccattccggaaccaattgggccagtcgagtcacaaattcgccaaattctttgtcccgctggcgcacatatggaggcgggatccagaacacatgagccgaacaaaaacgattgcacatttgtttgagtcgaacacattgttccatcatttggtccacagtttctgattgcaccaatgagtcgcgtccgacacaaatcaaaacagcttgcacattactggacaaaacacaatcgctcaaagctctgatgaccatcggcaaaggcccacgttcaacaccaacaaagtgcgtttggtcacgcatttcggccaaaagttggtggcaggacgaatcaccgacaagaacgcgaggtgtgtcgataaaaatggcggcattgtgaatcagtttggcacggactctttcaagaacaagccccgtattgtcgaagagtgttgtccatcccgtcttttctgattccgtcaacttttcgagcgccggagggacagccatctgaattgttaatgagttttccattttctttccattattaatgaccgtaattgtcgaaaagccagaattggctaatatttctctggccaaaacgcaattttttgcccatatgtgccaaatgtcctccatttgcgctacagttggaaatgtgccacttttgacattgtctctccgtcctccttcgtacaaaatcaattcaaatccaggatcggatttgacgaccaagcggaccaattcttgagctgcggatgctgagactgctgagccagaacggaacaaaaatgccgaaaggagtgcttggagcggagttttaacgacagtttggcccatttcggatgatgtctcgagaactgggtcgagatccacgcacttgacctttgagcatatttcatgtccaaggccatcgcaaatcgaagaccatgtgagcgcgtagctttcgtctttgtctaactccatcgccccgtctaaaaattcaattgtccctaattgactatttgaattcccttcttcaatttccaattttttgggtccgattcggtcatttttctttttcgtccaacttttgggtgcaatcaaagcatttagaacatttctatacatatttttccctcttggaagggtagaaatattcggcaattctggtggtactctaattaggcgttcaatcgggactaaaattggttcagctcttttatcaacaggtacaactttggcggatgatttactgatctcaacaattttataaggtccaaaattgttccacaataattttttatggggagagcgagcgttcgaacccggaaatagcaccatgcagcggtctcctttactaaatttgttttcagtaacatttgggcgcttatcgtagtactttttcgacttttccctagcaatttccgaatttttcacggctatgcttattatgtcctttaagttttcacgaaaaagctgaatataggtttcctcatcaattgtgtaattggggttcgtttgccaattaacgtcctgttcccctggaaaatttgccggctttccgaaaagcaattgatacggtgaaaagcctgtcacctccgatggcgttgtattataacaaaacacaataaacggaagtctttcgtcccaactccaatttgaaccggttgattttctcagcatatttaatatggtctgatttgcgcgttccgttactccgttagcctgtggatcgtaaccggacgttacagttttttcaacaccaagcaattttgagatttccgccaaagtttcattcacaaattcaccccctctatcgctatggagacgtttcggagtgccaaatacgagaataaattcgtttacaaatgcgcgcgcgacagtttcactgtttttgttggttaggggaacagcaatgagatatttagtgaagtgatcaatggccacaagcacataacggttttctgactctgatggtccaatggaaagtatatcaagacacactaattctagtggctctaaagtcttcactatttgcatcggtggctcatttttccgaggcttacgggaatgggcacaaatccgacagctcaatgcgaattttaagcagtcattcatcatgtttggccagaaatataattcacaaagttgtctccacaacttttttccgcttaaatgccctgcgcattttccttcgtgccttcttttgatcagttcttttctgtatttttcaggcacgaacaaacgaaaggaccctgtcttttggtcaacgaaatacaaaagttgttcaatcagagcaaaattattgattttgtccattaaactttgtgcctcgttaatgctttgtggagtttctcttttctcgaaaaactcataaatgccttttaactcactgcttttggtctgttcaacccactcttttcggtccagtttctcaatgtcagcatttgtcttaatttctttgatagacaattttttgataacaactacctcagacggacaatcatctaacaaattttccattttttctgtgtctgactgttttccaactcgagatagaaggtcagcaaccacgttctgcttccctggctgatattcaacagataattggtaacgagcgttcacttccatcagccatcgatcgactcttgcatttcccgtttcctttttacttcgaaacatgggaattaatgctttatgatcggtgatcacccggcatggaatacccgtaatgaattgtgaaaattttcgagttccaaaacggattgccagtgcttcgagttcagtaggacagtatttactctcatatttattgcattggcgagaagcaaagtatatcgggcgaacatttttaagttcgtccggctgacagagaactgctgagattccaaatttactggcatccgtcaaaatgataaatcgcctcaacgcattttccgcagctactttaaagtccggaaaatacaacacaacatcttctaacacttttcttttcaaaaaattaacaattttctgttctttttcgcccattacaaaaggtgtattttctttaatgagatggaagagtggcgcagccaaagatccaaatccgtaaatgaatttacggtagtatgtcatgaatccaagaaatgactgcaattgtttttttgaggaaggaagtggaagttcaagaattggacgaattttatccgcgtccatttttatccccatttgttgttaggatat

SEQ ID NO: 1462 - DNA, 4149 bp, Heterodera glycines
ttttgaaaatacccgcccatttttcatccacgtttttcctgttgaacctctcaccctcgagctccagtgtctgttgcgactcagcgatctcatcatacaaatcattcatttcatcatcagttgtcgccccacaaaaatgcctatgcgccttccgaactttttcagatgttggctcagactcaaaaatgacccaatctccaatcacttcatccatctcagaaaattgtcgtgaccatttgcacaaatatgcatatgcgtcctcgtaaatttgctgaaaaatcaaagctaaacaaatatttaatgaaaaatcaccttaaaggcggctcttaatttgtcttttttggatggatcactccagccgacaacaattgaatccgcccacctcttcagttgactcagacgggacgcgaccgaaggcggacgacaaccaaagcggaagccggtgacaacgacgacgacgacgacggtgaagtcgttgacgacttcttcaccgtggtcggtgtctgggagcgggccggctcccggtcgcgtgccacgcagaccgagaccatccaagtgcgcttccacaactgggagcgggcgcggcgccccgacctactgctcgcacgctgcatcgcccgtctgatggctcgcgtgctggacgggcgtgcggagccgctccgcgtcgggctgtccgtacagccgcccggctgggacaactgcttccacgtgccgatgcgcccaccacagcagaacagtgcgcacgcgctggcggccgccctcgaaacattcgcgaagcagtacgacgagctcgacctgttctccgccgacgtctgcttcaaagtgtcggcggtttgggccttgcccggtgagctcgtcctccgcatcccccacccctgtccctcgacaaagtttgacccctccccccaccgtttagccgcgcgcgtggagggcgcatgtgccgaggacgagcagcgcgcacgtggcactgtccgctgccaatcctttttgccggttgtgaacggggcgggcggcgaccgctggtgcatggcacgcgccatcgtgctggggctggcccagcggcgcatctgcgtactggagcagcgcaacgtggtccacttccgcgccttctgtctggcgcagcgtggcgaagcgggcgcgcccgaggcacgtcgcctgttggaggacgcaacggtgccgctggaccgcccaacgtacggggctgccgaggcgcaacgagtccagcgctggctggacgccagcctaggcgcccaccaagtgcggctggtaatcttcgcccgcgagctggcctaccgcgtggcgtggaagggcgcgcggctggcacgctttaacctgtgcttggtggcgcaggacggccactacgggtacatacagtgcccggagcagctattccatgtttgtcaatgtccctttacttgtgaaattattttaaatatgggaagcttttaggcgcgccagtactgtgtggactgcaagcagccggtggaccggcgcacgcacccgcaaggctgccgggcgctgtgcccccagtgtcttcgctttggctggggcgtccctgtgcgcgggagccgggccgcgctccgtcgcgctgcgccgactgtctgttcgtgttcgagaacgcggactgcttcgaggcgcaccggcgccgggtggacccgccgccgccgcctggctggcaacacgaccgtcgtcgcggcagaccccaccgtccgatgtgtgaggagcggcgcgtgtgcgcccgctgtcgtcaggtggtgtggacccgtcacggcgcgcacgcgtgcgccctcaacaacaatgttggccgacagcaagcagcacaacaacaacaacagtgcgaccgatgcttcgggattcacgacgcgcagtggaccccccacttcatccagccgaagcgggcgcagtgtcagctgatcgtcaacgacgcggtgcggccacccgtcccggcggaaggcctcgacggcgacaacgacgacgacgacgacgacgatgataacgatggcgatgctgacgatgtcgacgacaacgacgacggtggtgatgcggaacagaatcgacaacgtcgacgacggcgcccgctgcgctttctgttctgggatgtggagtgtgcccaagtggcggacgaaaatgaagagggggacgagggggtgccggcgcgagtgctcaaacatgtgccgctgctggtgtgcgcggaggtgatctgtgagcggtgtgtggccgcgggcgtggacttggagcgcgagccggaccgacgggcgcctggctgttgctgcggcggtgcggcttggcgagacggacaacaccgccagtggttgatgcgtgcgcgcgaggacgcgttcagcgacgacgacgacgacaacgcggacggggggcggcgatggcggcggccaaacccgcgccgcttgcgtttcttccacgacgcggcgaccgggcgttcgccgatggcacagtttgccgattttgtgctccacgacgggcccgtgaatgtgcgcaccgtgatgctggcccacaacggggtacgggggtgtacaaaagcggagttgaagaaaagctaccatctacgctttgtaggggcggtacgatgtgcatctgctgatggaggagctccagcggcgcggagtgcgcccccggcggctggtcgccaccgggctgcgcgtctacacgctggagctgggcggacgaaatcagcgcagcgtggtcgccaaggactcgctgaactttttcggctgtgccctgtccaagctgccggccatgttcgggctggacggcgtgccggacaagccgttcttcccctacaactacatccgggccgaaaacatggatgtggcgcatgtgggactgccgccggctgccgactacgacccggaccggatgcgcccggcggagcgcgacgcgttccagcgctggcacgcggcggagcaacagcgtcgacccaaccgactgttcgtgctgcgccgggagctgctccgctactgtgccaacgacgtgcgcattctgcggcgcgcctgtctgcgcttccgccacgtggtcggcgagctgtcgggcggtgtggagccgttcctggccgcctccaccatcgccgggctggcgctggccatctaccggcaacaacatctgccccgtgatctgatggtgcacacgccggagggcggcttcctgcgcggacgacgcgcttccgccgcctcgcgccacttcttcgcgctgctggagagactgcgcccgcaatggcgcggtcgactgcgcaccgcccgctggtccatcggcgaagcgtgcgtggaggacgacggctaccggctggacgcgctgctctaccgcccggtgccgctgcgcccgctcgtcatcgagttcaacgggtgcttctttcacggtaaggaagggggggggctccttttcctgcactttttccatttgcctcgtccaaggttgccccgagtgctacccgaggcgccatcaagtgttggcgggcggccaaaccgccgagtcgctgtgtgccaggacacggcagcgtgcctgggagctggagcagcaccacggcttcgcggtgcgcacggtgtgggagtgcgccttccagcggtggctgcgccgccagcccacccgagtgcggcgcctgtacacggatgtgtgccgggcggtgcccggcccgatggacctgcgccgggacgcgctgttcggcggccgagtggagccgttcgcgctccactacacgtgcacagagcgagaggaaattgacgcattggacattgtaagtgatggggcggggggggggggggggtgttgccctgtctaaacctcacaactctcccccgcgtgtaaaggtgtcccgttcgtgatgaagtaccgcgccttccctgtgggtctgcggcgggtgctcagcgcagagcgagcttgaccgcgacgcgggggtgaggttgccgtggacgagcgcggagcgagaaccccttccgcggcttcctccactgccgcgtgctgccgccccggcccgccgagctgggcgaccgccacgccctgttgccctaccggacgcgcacggggcggctgacttttccgctctgcgccgcgtgcgccgagtgggccaacgtggacaagaaggtgcagcgccgccatcgaaagatgccccgctgtcgacaccgggcggcgcaacgcgcctgg

SEQ ID NO: 1463 - DNA, 2203 bp, Heterodera glycines
actccttccccgcttgtataggtgtcgctctacccgttcgtgatgaagtaccgcgccttccccgtgggtctgccccgggtgctcagcgccgagcagctcgaccgtgtgcggttgccgtggacgagtgtggagcagaatccctaccgcggcttcttccactgccgcgtgctgccgcctcggcccgccgagcttggcgagcgccacgccctgttgccctaccggacgcgcacggggcggctgacttttccgctgtgcgccgcgtgcgccgagtgggccaacgcggacaagaaggtgcagcgccagcaccgcccggtgccccgctgtcgacaccgggcggcgcaacgtgcctggacgcacgcctacaccgatgtggagctgaacgcggcgctacagctcggctacagggtgctggcgctgtacgaagtgtggcactacgaccgctgggcgagcctggaggcgggcaacagcctgttcgccggctacgtcgacacgatgctccggctgaaggtggaggcgagcgggtggccggccgactgccagacggtggagcagcgcgcgcgctacgttgcgcgctacgcggaccgggagggcatccgactcgaggcgggccgcgtgcagccgaacccggggctgcgcgcggtcgccaaggcattgctgaactccctgtggggcaagctggcccagcgcgcggagcgggacgacgtgtgctacacgggcagcgcgcgcgagttccacgagctgttgggcgacccgcgccaagatgtggtcgactttgtccacctcaacgagcagctggaccggtgcgtggtgcggcgccggtggccctttgtgcgcgcgccggacaccaacaacttggcggtcgcctgcttcgtcaccgcgcacgcccgcctccatctgcacgggcggctggaggaggtgcggttggcgggcggccgcatgctgtactgcgacaccgactccgtgtactttgtacgcgcgcggcgaccacccggcccgcaacaacaccagttccttcgatccgagggcgacgcgttcgggcagctgatgcgcgagtggcccggccggcgcattgtccaattcttcagcgccggccctaagaactacggtttccggcaccggtgcgccgcgagcggcggggacgaacgtgcggagcgcaaggtgcgcgggctggagctcacctacaccgccagccaactgctcccgttcgagcgcatgcgtcagctggtgctcaacttcttcggccggtgagcacgagggggtgggtgggataacaatggaatgtgtgtgtgtgtatgctacccccgagcaggatgcctgacgcggagcagcgagtgcccgtcccctgcacccgcttcgtgcgtacgaagcgtgccgaggtgttcacgcgccgcggcaccaagctgtaccagcccgtgtacaccaaagggctggtcgatgcgcttgacgagagggaggctggcggcggcgccggaaatgcctacttcaccagaccgtttggctggtacgacgacgacgacgacgacgacgacgacgctgaccgtgacgatgctgaggaggaggaagccgaagatggggaactctcggacgaaagcgacactgatgatgatgatgatgatgttgattttttggtacttggataattttttaaatttatgcgcaaaaatataagtgaaagtgtggtcgcactttatgggggaggggggtgggggagtttcgactatcgcctgtaagtgcttctgttgaccatcgtctcgatgttctgtaaggcctcgtcgatgtgctcctctctccgtacaccggtcacaatcagctggccgttgacaaacagcagaaaagtgacggcgatcggcggagccacgctctgcggttgttgttgttgtcctcgcaaacgtgactctgaaagtgccatgctgagcgtgcaacgtagcgctgggaaggcacagaagtccagacggcagctgcgtacgccgacaaattgggtgtcggcgagaacattgtcgtcgtggttttggtcaattgccgagtgtcggctcatcaacgagttgtacaaacgttcaatgtgcactcggaagggcaagcgtacgctgctcaccagattccgcactctcacttcccctatgcgtaaggctcgtacagcggctgagagtccagccccacggagcgccgccccaacccggtggcgcacccgatgggccatcacgtt

SEQ ID NO: 1464 - DNA, 5022 bp, Heterodera glycines
tcgtttctcattgtttagacatttctccgtaccatcacttccgccagctacaaaattcaatttaaaatacggcgttaattgtgccatttgaactggtgaacgaacaaacgcacgaaaagctgacactaaagaaagcaaaggaaagtcaatgggtcatccgatggataattaagcgatgcccaattagagagacggcggcgattaattgggaatacaaaaattgcgaggatttgaacaaaatcatcttttatttgtgtggtgaccataattgccttgggtgagcagctcggcaattgccattgctttaacgaattacaaattttgcacatattttaggccattgcgccctccaccggtagacgaagaagcggatcaaagcaactcaaaagctcttttgagtcccgggccgagccatcagtgaaaaaagtcaatgcgatactattgtttcatgagcaatcaggggcagtctcattgatttttggttaatttatcgatataattttgattcgacgagattggccacattaaacggcgcctcacccgatgggccatcacgttgactgtcgagcaaagaccgcacgcgggagcgcgcacacctgtcatgacgacacgtccgctgcgaaacagcagagctgtggccactccattgggctcaacggcgtcgtcaccgctgttgtagcctctaatgcgtaacacgatggcagggaagcgtcgcggcgcgtactccgtacagatgccatgcgttgccatcgcacggaattctgtgtgcgagaaagcagttggccgattgttttggcaaaatgtaaatgtgaccgtactgtttcggatagtattcaacatctacaaatccatgggcttgcaaatttatttcaaaaaaagtgcacaaaaactataacagcacaataagttacgtgatcacgcgcgcaaatctacaatgaccatgtctctcaaaaagctagttgttagcgcatcgacagcaacagcggcaacaatgtcgttccggcattgccatcgactttgtcggagccacgtcgccggattcacgacggtatggctcttcttgcttcaccgtctcctgtttggcgcgcttcgtacgctccagcacgacatggacgagctccaggctgaaggcgtttacgctcacttcccccatttttgcgtaccccccgcttacggatagtaggaggcgtgcgtgccgcccccgaactcgatcatgcacggcatgtacgggtgcttcagctttagcccgtgtttggcgaagaagtattgtcgaacctggacagaaggccgcaccattattggtctacacagtcatcgaattacggtaagctccagatagccaccgcaggcgaacgtccggttggcgttctgcacgctgaggtcgtgacagtggagcgcaatgttacgctccgccggtttcagatgcgcggtatgaagtcggcagtgttgttgcaggtgcgacaccatacgctgtcgcgcgtggacactgtggaagaggagttgaagctccttcattgaacagtcgttgaacgcgcacaggtagttgagcagcggcattcgaacaggctacaaacagtagggggggggggtagaaaattagctggcctccacctacctcctcttcctctcccccgccgagcagttttgcgccttcgcttccaccgccaccgcccgtaccgttcgtcatgtcactgtgctcactggagcgctgctccacccctttaacagtgttggaagagtcatccacaacggttgccgtcgtagccgagggggagtctgtggcgacgggggtgtcttcaatgtcctcatcctcctcctcctcctcctcctccccatcatcggattcgatgaacagcagtgtgccgtggccgccgctgccctcttcagcaccgtccttctcggaggagggggcttctttttccagtctaaactcggcggtggtaggtgtggtgacagtagctgtgtcactgtggaccaactttcctgtcccgttttcctcctcttcgtactccattgagcccacagcagtgcctgtcgtctgagccgttggtcgcagaatccaggcgacagttccgaatgaatccattttgggggtgggggtttagtagaatggaggaagaaattttttatctacatatttatatatatatatgtgtgtgtgtgtgtgcaaatacagagggacgcaaaaaaccgaagaagggaaaatgttcttcaagcacccgttcaccatgtgcgtcgccggatgcaccggtagcgggaaatcgcagtgggtggaccgccttctttctcacattgacctgatggtcagtgaaggccctatcactggcgtgctctactgttatggggaagtgaacgacaatgtgctccggctacaacgtatggagaacaccgccaccacttcaagtgacagcaacaccacggagggaaaacattcgatcagaatgtgccatggagcgcccgaggagagggatgtggagcgggaagcacgcgctacgggcggacggctcctgttggtgctggacgacctgatgtccggcggtctacgctgcagctttctggacacggtgttcacccgtggctcccacaactggggcgtcagcgtggtgctcatcacgcagcatctgttcactcgtgagcttcgtatagcgcgcaacaactgtcactacatggtgttgatgcggaacccggccggcgcacttcagatccgcaacctcggcgcacaactgtttccgggcggggcgctacgctacttcttggaagcgtacgaggacgcaacggccgaaccgtttggctacctgttggtcgacatgcacccaaccacggagcaacagttgcgcctgaaaacgcatatatacccgggggaaatgtgcgtggtgtacatgccacgagcgcgcgcgaattttaatgcaaacgcttagcgcaattagcaaacagcagtcgacaccgaaaaaaattcaaaggggcggagccaacaacaacaacacattgaagaagaggaccgaagggtctggcgaggaaagacgacccagcagccgcaagctcgccccttctcgccccccagtgctgagcgaacacgtgaggcgccacattgatttcttccaacaactgaaggcagcacgcggatcgcctccccgttgccaagcgctggtcgccggagccagcagcgagcagcttctctgccttgtggagagtgcactgaacatcttacgcgcgcgtgtgcccatccaacggcgtcatctggcccgcctcagacagcgtgcgagcgacgtccgcacactgagcagggtgcgtagcacacgctccgcccgtcgccttctgctcaacgcccacgcaccgtcaacagcgcaaactggtcgtggcataccgcctctggtcgggttgctcgccagcgtgctggtgcccgtgctcgtccaacgcgtattcgagacaaccagcagtagtagctgaaaggcacccacacgcacgcttgcccgcgaagaaacaatgacgttgaagcacactgtacgcatgctactcatccccgaggatgtttatcgacgtctgatggacaaccccagtgcagcggcggcgacgtcttctaccacgtgcatgaacaagttgcccacgcccgcaactcccattgagcacacggcacgcaaaatggtggcggcatcgagcaagcacacgaacgacgacgaacgcctcatccactaccaacaggagttcaaacgctaccagaaattgctggaagaggaggcggaacgaccgctcaacgtacagctatcgcaacggacaacaaacgcactgcgtgacactgtgctgcagaaggcttcgccggcaacagcgacgccgccgccagctcgcccccaacggaccacacctctgtccagacgacggggcttacagcatcaaaaccaagcgccgagcgcatcttcctcttcttcgacaaggccaacaaaaagtagcagcagtaacgagcaacaacaaccgctcccccagcagactgctgctccacaaaaaattggcgatctgcctaagcaagctgagccgcgtatacatgccgcgatggcgtacgcgcaacagaacccaggcttgcttggcgtcggcggtgaagacggtcagcaaattttgcaccttgcccagggcgcttatcgccccatccggggcagcaaccttgacacgctgctccgctaccactttgtgggtcgtcatcagcagcagcagcagccgcggtcctccactaccacccccaccgccagtgtcgctaaggcaccaccgggctacaaaaccttcgtcaacaatgcgcgtgacgatcttcaaatgtggcgtctgctgtttccggatgaaagggcggcggcggcgggcagtgattcagcgtcaacagtgggcggacaacctcggcgccaccaacctctgcgcggacaaaagaaaactggcgcgggccgcctactacagcctaatcatcatgcacataaatcggttcaaaaaagtgcgacgagcaagaggaagcccaacactgtggagcattccactgccaaacgttttaagcctcaattatggtgattggaagcaacgccgtccgctcactgatggtggaaagtcttttggacccgatttacaaggacgaacggtcgccagcttgcttcaccagcgtagagcccctgctgcgggaggcgaagcgccggcacccggacgcccgtcttacgcgcgcggagatcagccgctacttggcgggccaacgtgtctacaccctgcaccgacaagtgcgacgacgcttccgccgtctgccgactctggcctccggtctacacaccgactggcaggccgacctggccgatttccaacgtctccgcgcgcaaaaccgcgggtacgcctacctgttggtgtgcatagacacgctgagcaggcaggtgtatgtgcagccggtcaagagcaagcgctcggacgacatgatcgcagcgctcaagcgcacctttgcccgctgtggctacacgccgtggcaaatgttgacggacaagggccgcgagttcaccgcctccgctg

SEQ ID NO: 1465 - DNA, 1403 bp, Heterodera glycines
gtcggggacaattgtactgaacgaacatgaggaggatttttagtcgatcagggcattgcggacgcaacagcaacaccaccatcacaatcattctggcattatatcacctccattcggtgccgtcgatgaattcggcaccgaatgccatgccgagaaggaagacgacggcgaggaggaggagcgggaggaacagcacggcacgcaccacccacaaatagaacgacagcaccagcagcagaaagtaatcgtagtgaacaagtacatggcgaacagtaggcgtggcaacaatgccaacaccaccaacagcaggtggggtaattaaggagcaattaacgcaaataataggtaaaaagtcggaacatttaaacttacgcgcccgactattaaagtgagttaatcaacccctaattaaatcattaatatctttaattcgttttaattgcctttattaaatctcttgaattgttttatttgtttttctcaccccgttttacctcaaatggaaactctctctttctgttcatccattaccgatccgtcaaatgcatttgatcatattacaaatcgtcgcctatttcgtcccattttggtgctgttttcatattgttaaaaaatttgttggcccttcccccgccccccggcgttttgtctgtctgtgtttgttttgctgccatttttgatgcaattaggcacataattttacgataatttgttgaatttaatggccgggaaaaacggaaagagagaaatatttttaaaatatgataagaaaaatttaatctaattttgaataagtgaactgctattaaattgattaaccagcttatggaatttatagaaaatgaaattataatcaaacaaattaaataattgctgtattactttaaaattaataaattaatcaatttttaattggtctgagatttttattattttaagtttttaatttacacgaaaaaatcaattggagcaccttcattaatatgtatgtttaatttaattttgcattactaataatgttgaaacaattttgtgttttcatcacttctacagttttatttgcacgtgcaaaataaatgtttccatttttggtaaattagtcaaaccaacaacaaatggtttttttaattgccgatttttgtcccttttacaatagtaattagcctaattttcgcttttcggtgcaaataatttaaaaaaaaacacacaataacaaaaacctttacatacatatgtaacagtttctgctgctgctccgcttattcggttccgttcttccgtcgccgtcgtcacaaaaaattgggcgcacttttagggcgcggtgagcggcgatcactttgaaatcgataccccatggattttgagtgatgacccttttttttgggagaaccaaccgctccccc

SEQ ID NO: 1466 - DNA, 9214 bp, Heterodera glycines
aaaaacatttcctcataattgttgccacttttaaaatcccccgctaatttgtcataatatctcaatcatattgaggctcctacagtgatcaacaatagcttcactattttctgtttcatgaaatgtcgagaatctctatcaccaactgacctaaccataatttccttaatctatcccgaagagacagttggccaattagcgctaatttggccttaaacacctcattaaatgccgaatgttttaagaacggttccgctaatttgtttatttgggagctaccggaaaataaaaaataaaaaaaataagcaggactaaggccggccaaatcggtcttatttttggacaaattaaaattgtagaattagttttggccaagtcagtgccgatgcctttacactaattgctgttccattaattcctgcctaatcccaaattgtgcagcagaatgccaacttcttcctctgcccacggcaccgccgccggcttctgtgccgtcccgtcccccttctgctccgcctcgtcctcgccctaccaaatccgtgacaccgccacttccgctggtactgcagctataccacacctgcaccaaggccaggacggcgaagtgatgtgtgccgtgtgcggcgacgggccggcaaagctgcactacggcgtgttggcatgctacgggtgcaaggcatgtgccgtaattggtggatggaggggcaaattttagtttaaatttttaaattgaaattagaattatgttgaattattcataattaaaattttcttaatttctattcgctaattgccaaaacttgttggtgtttctatttttttaaatttaaatgattgacatattcgccaaatggattcaaaatgtttcaattcaaattaacatttatctatccgatcatatcactgatttaaaaaaaataattagcttgaggaatattctttatattggcccattaaggggaattagttccaaatccaataagctgaccctttttatgtcccaatgcttttcaagggcttcttccgacgcacattgagtggaaaataccattgtaagcgcatttaaaattactgcttaaatcaccttttcaaaatttagatgtctgtcgcttcgacaacgattgcattgttgacaaatgtgagttataaacgatgatgactcatcgcaaatgcaaaaaattgagccaaatttaatcccaagactctcgcaaagacagcattttctggccaaattcgatgaccaattttgacggtgccattttcagtccagcggaacagttgccgatgttgccgtttcaagcggtgcctcgaggtcggcatggacccgaaagcggtacggcctgatcgcgacctgaccggcaaacagcgcgtgccacgaattcgcaaacgagcactagacgaggagctgatcaatcatatggtaatgatccagaacctgggcttcgagagtggtgcattcgattctttggtgcacgagagtgagaatatttcccgagactcggaaccccgaaaaatccaagcctctcgagaccgtcggccatcaataaggtgttccctccggctcaggttcgtctccagggcaatgattggtcccgcaaaatcccggtggaagcccgggtgcttctgatgcaactgctgaacatcgagtccaaagttgccaaaggggacagtgccatggaccgtcggctcaacaccggcgttggcggtatcactcaatcgacggcggcacaacaacaaaatcaacaccaaaatcagcccccgttaccatacgaaccgtcgacagcaacggcatacaatggtggcaaagagacgacaacaagacaacaacagagggaactgtccctgagggaactgttcgagcagaagccgtcgctgaacacacgcagaacggaggtgtgccgatttgggaagggaagaaggaaacatgaagaagcgatggtggatggacaattgcggcgccaagtcaaagcgacactgcggcgcccgacattttcggcaccgatattttatggcgcccccataaataatgcgctaaaccttttaattaacatccttttgctgcgccgcaagtgtcagcaccgcaagcaaatgtcgcatcaccaattggagagggtcccgttattaagtgccgatcgaacccattctttgggcgagagtcggatcattaactaaattaacggctcactgtcttcatcagtgagttattctttcagctggcaatttctgatccgacatgtaactggccagatcactgatttgatttgatttgatttgatttgatttgatttgatttgatttgatttgatttgatttgatttgatttgatttgatcactcttccctcggacctctctgtagctcaatggaagagttgcccattgtattgggggagtcgtgggttcgattcccaaccgaggcctaacattttaccataattattttggaatattttttttatccattctctctctgtacagatgtgctatgagccgtaccgaatggcacaggcggaagaattgccaaaaattgcgcatcgcggtgccatcgcttcggtggattgggtggagtcgttggccgaactgctcgacactgtgcttctggacacgcaagacaaagttgaaaatttaagaaaagccttttttaatttgaattttgtggcagatttcgctggtcaaagcgtgctatgcgccgttgaccattttcaacttttcggcacggactgcgcaaaacacgcgcaacccggacattctgtgcctgtgctcctattcgtatgtgccgcgtaaattgccgcccgattttaacgggtcaaagtgagtgcaattggcataattagcatttgttttgtcataaattgatcattagaaattaattggaagtttatccattatccgaattttttaataatttcccgacttatgccattagtatttcgacatttatgattgatttaccatttttaatggcgatgttagatttattagagtgcgatattctgaaaaatttatggacagaattcgggaaactcggacaattttcaaaaatgctccaatcgggatactgtgaaaattctgccaaaactagagtgcagcgggaccgggaatttttggcaaaaccgggactgggactttgccgggacctgagaagccgggaccgggacctcgatttttcttcgggacgggaccgggaaccgggaccaaccgggaaattttaaaaattcaaaaaaatttaattttaatttatttcaagtgaaaataatacaaaattaaatttttattttgttttttatttaataaaaccccaaagttaaagctaaattaaattaagaaaaattttcaaatcaaattttcttcatttctttcaaacaattaatcattttttgactcaaatgatcgaatattattagaaattcagatttacgtttcacataaattttttcggcgcgctttttccaaaaaacttttggggaagaaaggggtccggcggtgccgttaggcgccgccgggggaaattttgaaaatttgagtgtaatttgttaacagattttcaacaaaaaaggctggttttcgggattaataggctcaacaatttgtacggattttcatttaaaaaaatgataaaaatgtgacaattaaaataaaactatgagtaatcatattttgtcgataggaaacacatgagtatacaaaaagaatattccaaatatgttagtttctgtagagggattgaaccaggggaaagaagaagggaaagtcaaggagactagccactaggccatccgcacaattgtcgtcgatacttttaaagaatatattaatatatttttaaaattttttccttttaactccaattatcttcactaatttttcactcagacccccattcttaccagtgcttgtttttcccggttgccctaccccgggacctcgaatgaccgggaattcccggcccggtcccggtcccgctgcactctagccaaaacccgtcctgttccggatttataagtaccaatctttggcatttgttagcattgatggtctaaattcattttggcattgtgccaaatcacgtttccctttttcagccacctgtccaacaatctgatcgatcgaacactgaacgaattggtcggcccattgcgcaggctggccctccgggaggaggaggtggtgccgctgaaggccatcatcatcctggacccgaacacgcgcaacttgtcgcccgaggcgcaacgtggcgtggccgaactgcgcgaccgtgtgcaggacatgctgttccacgtggtcaaggagttgcacccggtgcacaacgcagcccaacgcttcggcaatctgttgttgctgttgccaacaatttcggtgccaaaatcgaataaatttgcccctattgatttgaaaattcaagggtagaaaaagttaccgtaaaattataatatctctgagtacggtatcgcgaatatacagtatccctcgcccttctcagacactttctggcgtgatgtgcgagaacatgcagttttgccaagtgttcggctggacagacccgttgctgaacgaactgttcgagacggacactgacaaatgccatggcacaggcgccggaggggtcgaactgtccgagtgtttgtttggcggcgcatcctcattcatgtcctacagtccgccggtgctcggctccgtagacgcaacggcgacggcaccgacaactccattttgcaacccggccgacatttcactccatgtacgatcaatggcatggcattccatcaattttatgcaaaaaattctaaaactttatttggttttttttaattattgaaaagtatttgagttttgcccgaaattagaattaaaactgcttttaataaatttccaactgatcaaagcaaagttttgacccgtacaataaaagtgatcgaatttgtaatttggggacatccattggaaaatttttttaaaaatcaatttgaatggggaagaacgaaaaatggcttttaaccgaagcaaaaatgtctgctctttcctataggacagaaattgatcggctgtcacttgcggttaacggtgcaaaaaattccgattagcatagcataagaagggtgacagaacttatacaacaccccaataataaattcgaatctcggagttaaacatttttacggaagcggatttgccttattattctcaacaaaatccaagggaatgccattgattgggaccccaaaatgcgcgtgatccgcttctgcgtctctctctaataatcgatcaaacacgagactgatcttgatcactccaatcaatcacttctttcagtcctcgcccctcttccacgcttcgacttcgtccgcatcagtgccaacttcgcttccccattcgccctcctccgtttccaattcgtcctcgtcaagcagtacacgaaccatggaaccaccgacgatgtttagcaacagcagtaaatgtcccctgcggctatcgtttcggtgtgaaatgagcacacaaacggagacgaccagcggagcagaagcgaccacaatgttagccgatggtagcacattacacggcgatccgagtacatatcaccagcaccatgagcagcaacaggtagagaggcttagcagcaagttcaacatcagcagatttagggggtcagagatttgatcgacccctcccccccccaactaaaaattatttttacccggcggcgtctatcggcaccgccggcccccaaaatttttgcacctaggagatgctctgatcactcactgattagagtgccttcgagttacccattctcccccccccctttccctcaaggaccttgcttcccaatcgtcggaggacgaccgcgccgcaatgctttcgcctctcggcgtgctgttcgacgatgccgagttggactcgttgtgccgtgaccacaacgggcaacaagtgaccttcgacccgttgctgtttgaacatgccgccgctgcggctgtcgccggctcagcgggtgccgtcgtcgacgaccaccaccaaatcattgacgacgacgacctgttcagactgatgcaataagacgaaatccatccagcacaactcgactaaattaccacacggattaattatcatcattatcatattgctaatgatatgttggtcccaattagagttaaaagggtctgggaattctcggcattttcaggaaccgttgggctaactcggtttttgcatctcggaactactctcgagcaactctaattaattaattaattaattaccccttccctatgggagaaattttcccaattgtactaactccaaacaactccgatacggcaccttcaagccgaacaccgggcacgggcccctgtttccgaccggtctcggatgggaggtgagaatgcccgttcccaatggcatcccaatcccaaccctcaattaagtttccaccgattagcaaaatttttcaaatcactctctgttctaaaatatttatgataatgtattattttacaatattttccaaatttatttcacaatggcaaaagcaattcctcccaaaacagtcattagcgcgcttaaataggtttacaatttgaatggatacaacccactagttatttatgccccagtcgttggaatggaaaagggcagccaaaatgccgcctttttcgccaaaactttatttgacttattaattttatttttgtatacattttgaaaattttattgtcttgtttaaatgcacttcttcaatgtttctttgatgtcaaaatttggaattggcccaaaaattatggcatttatttcccatgtccctccatttgacaaaatcaaaaatttaaaaatacgcatatattttaatttattccgatacaaaaatttatggtccaatattgagcaaataaaaaataaaattatttttataaaaatatataaatttcgagagaatgaccaaaaaatagaattaaaacaacacaaaaaagaaattatgatgaagagaaaaatggacaaagaatggattggtgtgttatgttgtgtatactcgtactatcacagaaaaaagaaatgttggcaaaaggaggagagagggaggaattactgtcaagggacgcggaatacggtagtgggaagagggagaatacggtaggcatttgtcaattgaagtgtgtctggcatatatatatataataagcggcaatcaatcagtgttttggggtcccaatggtgctatgacgttagtcaaaaaccatcataatgggcgttagtcaaaaaaccattaaatgaaaatattttttgatataactttgttcaaaagcatctaaatttttaattcttgatatcattcgataggcctaagggttttctattatcctacaaaattccaaaaagtttcgttaagtttcaagaaagttatgactaaaaatgttcaaaaaaacttggttttttgagcttctcaggtcataactttttttaaacttaaagaattttttaaaaattttgtaggataatagaaaacacttagggctatcgaaaaatatcaatattataaaatttgatccattttagacgaaattatgaataattttctgtcaaaaattattcatttgatggtttttgactaacgtcccagcaccgtcccaatcagggcatttaaaatcatttgtttgccaaaacatttaatgtccataaataattagtgccatttttaaagcgcgaacattttgtcccattaatttcagcttattttttgactgattgatcaaaacattgatgattggttgatcatcgacatttcaacaacaacaacaacaacaaaatattataattcacagaattgtgtcagcagaatcgggcgaaaaagtgatcggcagacgacggcgatcaccagtgccatcggcagacgatgatgacgatgacggcttgttgttgttgttggcactttcgttgctgtgccgttgctgctgttgttccgcgatatcatgccgtcgtggtctttgttctgcgccgtcgccctcctcgtccgcttcgttgttgctacccaagttgcggttgccgttattgttgctgctgcttgacgaactttgcaattgtgccgggtgattggcgctggacgacaatggcatcatcaaattgcagctgtacggtgacgcaaaatgctgcaacaacggtgggcccgctactgttgtttgtgttgctggtggtggtactgcttgcgcttgtcgtcgctgttgttgctgttcgcctccgccgccattcccatggacacgctgattttgctgctggtgatgaacatcaccacttttcgtattgctgcttctgctgtcgtcatgaacaactgtttgatgttgtgattttaatattttgggttttcgtaatataatatttttaaaaagataaaatttaattattaaatatggcacggcaccagagtgggacaaagatgaaaaaatttaagaaattcaggcatttgaataaaaatttctgaaagccagaattcgggacccgaaaaaaatcggaagcgaaatcacatatgcgtcattaatcgttaccacgattgtctgtcattgttgtggattggccgcggagcaaagtgagtatttgttcaaagtccgtgttcattttattctgcatttcggcaatattactgtaaaaatggtaattttttgaaaaataataaaattgctttttaaattttcttcaaactgatcaatgattggatgatccgatcaatcaataatcattcttcactgacttctcgatggagtccagcctccgctcgatcacatccaatcgcgcggcagaagattggccacactcatctgccgcgacggacactgacgaatctgtgaattttcagtttatgctaattttaccaatttatttgctacaaattctttgcactaaattgatcccgagaatcagtcgagacccaaaccacccaaaaagtcgagaaattttctaatactcgagagataaaattttttgagactcaaggaccaaggattggcccgaaaatttaaaaaatagtcgtaaaaaacataaatttcttgacgcggaaaaccgagagtctcgaacatattgtgccgtctgtcccattgctcacattgtgccgtcacgtcgtcgttgctgctgctgttcggcattggcggtggcatcaacagaaagcgttggggctgttgctgttgttgtcggtcgttggtttccggccacggcaataacagtgttttgtaaggaaga

SEQ ID NO: 1467 - DNA, 2150 bp, Heterodera glycines
  misc_feature (2052)..(2052): n is a, c, g, or t
  misc_feature (2066)..(2066): n is a, c, g, or t
  misc_feature (2090)..(2090): n is a, c, g, or t
  misc_feature (2123)..(2123): n is a, c, g, or t
aagcattaaaaagaggtcaagagtcccgaatcctaaaaattgttgccgaaaagtgaggatttattcgagaattgtgtttttcaaaaattgcagcattggttgtttgatgactttgttccagtgcagttgtcggaccgttgccggcactgtccgttcgcgaaatgccgttcagactgcgccgaacactttcataggcgccgaccgcggtcgctgccgacaaatggttttgtgcggcgaatgaggaggaaaatgcgcggacatctgaatgaaggaagtttaggtttcaagttccgactcaagaaaaggctcagttttttggaactcgagactcggattcgagtttcgacttcggagaggtctcgagacaatcgatctcgagtctctgtctcgaagtcatctcggtttcgagtctcgagttcagtaacgttttgggatgattgatctcgagtttctatttcgagattgtcttggatctgagtctcgatttcagagagggcctcggaatgaccgatctcgagtctcctatcgagtagcggtgccgaccttcgttctgttcgcgcgccgaatttgaggaaactcgctgcaacttttggcgctcaaatgtcggccgtcgccgctttgtcagcgtttcgtcgcgcaatttgtaattgatcaccaaattgatgcaaaaattttcggcgaattcgggatacatatcgccaacatcttgaaaaaaatataaaagattaaaaactaaattaaaattttaccgagcaaatcgtcccgcaaaatcacatgcaaatcgcagtaagtcaacgcccggacggaacagttcgccttgccaacctcttcataaatgagtgggttttcgccaaacacatcgtcctttccttaggcattaaaaaataaaatttgccaaaatttaattttaaattattcattcgaatgagtgataataaaaaattttagtaagttagaattttgaaaagaacatatttcacccaccacaaataccaacgaccaaatcatcttttacaatttcaacagagccacgagcaataaaataaagccgtgccaaaatgtcaccgctaaaaccaaaatttaaataaatatttgtcaataaatcattccgaggagagatattgatgaatatgaatatttaataaatttaccgatggactaaagtgtcgccctaaaatgttttgaattcattaatttaaattaatcggtttaaaaaatcaccggaggcgcgtgtgttgtcctaaacattttttaatggttaattaatggattaatttgtttacctgaagcgaattgacaatgcccgcaggcacccgggcgaacaatttgcaaatgccgggcaacagttcagcaaattacggtttaaatctgagcaaaagtaattgaattagtgaaaagataataatttaaaaattttaatttattttaatttaaattttgcgcttgagaaattgtgactttaatttttcgagaaaatattaatgagagataaaatagtaaaataattacggagacaaatgtccgcctgaagacaatcaggaaagcccttcaaaactgtgttcatgtcgatgccatttgtgtacgacctaacaataattaggacaaattaattatttttgaatttttaaaaattggctaaaaataaaatataaaagacaatttaatttggaaaattatatctgaaagggaaggtatttttaaactataaataacaaaaaaaaatgcccgaattttttctgctctacccgaaaagcagattaaattaaaaattttgatgggattatcgaaatagtcacttaaaagaattttgagaactttactataggctattaatcaatcaatataaatatattaattaattaattaattaatcactgaatcaatcaatgaccatgcatgttggaaatactcctccaatcgctggcgcaacggatttgggatttggtagaaacggatgaattcacgtaggcgactgaaaatgaaagaaaaaatttgatcagtgataatcagcagcattctcgatctcgatgttcaataatagtaaaaatttangtttttattaattnaatcagaaattgaaattatgttanggaagaaaaaaaaattaaattaaaaaaaaattnaaagtcggtagtcccccaactgctgtc

SEQ ID NO: 1468 - DNA, 1838 bp, Heterodera glycines
cctcatttcggtgtgataccgtgccgttcccgaatataaccgttgaatgatggcagagactgtaatattttttgtaattaataccacgacattattagccaaattaattattaaaaatgaaaattaataccgtttccgaacaccgaagcgtacattaagctgaaaatggaattaatttgccaccatcgcccgtccgtccgtccgatcaccttccgcagatcatcattattatggtgaatattttctcggaatcggtcgttgcgctgacattgccaaagccaatggaagtgattgtgctcagagtgaagtaaagtgaggtcacgtaacgcgatttcactgcaaaattgacacaaaaaatgcttatgataaagaggaaaaaaacgcgaaatcaaatttaaattttgccaaattttggtcgggctttttatggcaatccaattaaattaaatgcaaacccataaaattggcaaaggcctgtcaaaatcaggcaatgctccgggtattccaaaaaaagtgaatcagtgatcagctgatttgacaatggtttgaccgaattatgtgatcaaaaaatagtttaaatgataaaattattagagtatctgatcaaaggaatttgttgccaaaaaaactttcgaattaatgccacccgaaagaaaggatttgccctcgaaaattaaggcttataacagaattaattaggcttttaacgctggtaaaaaaaaattgtcaaaatttgattctcgacataattctcgacccgttcaacactcacatgacggaccgccgttcgttaaggacccattttgccgatatggttcattcaggtgccgcgcaagctgtacaatgaatgaattaattaattgctgatcatttttactccaaatgatgtcactattttctcacctgatgaagccatgtgatattattctgaaccaataaataattaattaaattttaaaatttattttcgatttatcactttgtgaagcagttcagccgacccaatggcgtaccaaatgcacgcgagccaatgagcaatcagacaaaataaggccatctgtgatcgatcacaaacagtatatcatttaaccaatttatactttccgaaattaggcatttaataaatatggttttatgaattttaaaatattttggctaaccaacttttaaaaattatttaaacaaataatgccaactttaccaataaaagtaacacctgttgaatgggaggaaaataaattaaccaaatttcatttaatttgatgttgtcactcactgcagctccatattcggagtatctgtccaattttcgtgccacctttaaaaaattttaaaattttattttatggattataatttgttttgtttacccggactaagcgaagaaggcgagcagtttttaagagtccaattaaagttgtcgtctaaattggggacgataaaaaagagtttataaacatttccgctgatcagtccccggctctgatcactttttgctgattaattttatttgtgaccaattttggcccttatttgttagtgaactatgatatctcttttttacaatttaatttagaagttaaaaaattgacacctcatcactgtcggtttcaacaagtaacaaatctgttaaaaaattttaaaataataatgaaaattatggccaaaacactcaccaaatggcacagctgcaatcatctgaaaatggcaaaattagtgccttttaagcagactcaaaatacaccgaagaataataaattggaaaatttggaaattatttatttaattaaaaaataaatattaatttgcctttaacaaagtaatgtcttaattaaatt

SEQ ID NO: 1469 - DNA, 1078 bp, Heterodera glycines
acgccgctgcgtaaggagtgaaaattgccgtgtaaagcaccacaaacaaaatcagccaatcccaaacacgctaattaagggagggggggagcaattaaattttttaatttaaaaaatattaattacctttgaatggggagtagtggatgattctgcaaaataaataaatggatgcattataagcaacaaaaaaaaaaacaaatgttttgcatttttaggcatataaatgacgcaaaaattacagattaattatggcactatgggcatggcgcagggattcacaaaatggcaattaaatgagtgattttggaaatgcataattaccctaattacggactacggttacagggataaaggaatatgccaaatgacatcaactctaatcagtagtaccacacttacgtgcaatgattcaatcgacttggctgaagtttgtactgaaaatggaaaattatagacatacctaattaggtaattaaaaaaatataatttttagctaatattaattaattaattattcacctcaggtagcacgtctgcgccaagcgacagaacctgaattaaaggaaggaaatatgagataattcgataagcaaatgccattattacgttttggctcatttttgcccagtaaaaaaacctgcgggtcccgtgggagtaccgcccccgctgacctctaatttggtttaattgtcataattaactcctcataattatataaagaacaccgactcgaacctttcttttatcaacacaagcattaattaaagtaataaaattaaataaagaattaatataatccgattttttcgtgtccgtttagacgaacaaattgcgcgaccaattggcgctttaaaatcagagacacccaccgaaagctctgcggaggatggcccggcaatggaaaatcggtgtgccgattttttatgcgccggcgccctttggcgggccaaccgatccctttttggccttattatcacagttttttgcttcatatgtaattcatcagcagaaacaacaaaaaatgaagggggggggcaaaaaagtggggggaaagaaagaaagaaaaagttgaaaa

SEQ ID NO: 1470 - DNA, 1619 bp, Heterodera glycines
  misc_feature (1503)..(1503): n is a, c, g, or t
aggcgagggtttttcatttttttctgtagccttatttttttttttaaaaaacttcaaaatcgtatattaaattaggggtactgttctgggtatttgggcaaataccgggtcagggtattgccgggtacagaaagcccggtcagagtcctagtttttaaaccgagtccaagtcatgaaaaatccaaacaaaaatctttaaaattttttcatgaaaattaaaaaatattttcatgaaatatatttattttagaaacaaactttattatttgtccattttttccaccttttttttgcggtgcgttttttaaaacttcggggacagttggggtcgggcggtgccggtaggcgccgccgaaaaaattttgaaaattgtcttcggatttgttaacagattttattcaaaaaatgaccaaaacttgttttttaaattttttgtttttaagtcgctttttttgtggcgctgtttttccaaaaaaaaattttttggaacattgggtgcggggtccggcggtgccgaatcggcaccgccgataggcgccgccggaaaaattctaaaattttgagtgtaatatattaacagaacttgtcaaaaaatgatcaaagttttggttaaatttgcagttttaggctgtttaaaaaaagaaaaaataataatttttaaattgaaatattttttattaattaaaatttcaattgaaaataatttaaagaaattatttaaaaaattctgtaccgttggggaattgaacccaagagaaaaataatgaaaggcagaaggtttagccagcagaccatatttgaattggagctatccaaaaatagagaaaacattaaggaaggaaagaaagagatttaagatttttttttcgcgtaaatttgaaaatttttctggctgctcaaaagttcaatctttaggggtgtattttcaactctcgcctctcgtcccaaaaaacgagaggcgagagacgagaggcgagagtaccaaaaatggcgagagttggcgagaggcgagagttgtcccacccctggtgcgtaccgtccacaaggcgaataagtgatgtcatagcaattgacctcgtcgccaacaatgtcgccaaagcgagaaattggaagccaaatggagtcctgtgatggcaaacaaacattttatggagtgaatgaagcgcaaatgaaaaagggttacccaaacgggggcagttcattccttacccgaaaatttttttgtaaaaattttaatttcagcgtatttttttagaaattttttgaaaaaaacttaataattcaacataaaatttgaaaaaatcagtgaaaaatcttagtacaccctaccgaatctgagtaggaccatctgaccaccgtttggttggcgccagacgaaagcaactccaaacgctttggatgccatgctaaaaatggaacacgtttagcgggaacagttcgtttcctgcccccgcccgtttcgacatgaattttaaccaattcctaatcccaaacttggacaanaacccgaaaattttgaatttgaaaccctgggacagcatggatttaaataatgtggatacgataaacctggtgtcagattagtgtttatcacccagtaaaatgcctactaattttca

SEQ ID NO: 1471 - DNA, 2606 bp, Heterodera glycines
  misc_feature (73)..(73): n is a, c, g, or t
tcctttatttacgctcaaaaacttcgttccttcccgccacagagtccgatgatgtaccaaccgtgccccgacngacctgtgcatgtgatgaaagttcctctccaacagtcccattgtgcacattgcggccaacacttaccaacaattggtggaaccatccgttggttcgtttggcacccaatgggactaacaataaacgttaattttcctttccaatttcagttaaaattgcgcaaaatttggtgttttctctgaaccggtggaatccgaactttgtgcaggtccaaactcagtcgtccggtaccaaagttttgaacgctgccgccgcctcagcgacagacaaatcgaccgcagcggactcgtctgcttcatctacagcaacgtcacaaatttccacctccgaactgccgatcactgtcgacccgctgctcgtggttgccaatccgtcacagaaagtgccgaaacgacaccttggcgaccaattggaccaacggctgacagtgtcatggagcaatttcatttgcactgttgacagcagcttcatcatcgtgtgcggttaccctgactacagtttccgactgattgagacgggcaatggtgaggacggacatttgggcacataaaactcatgttgtatcggcaccttttcagtacaagttcggcaagttgtgctcggtcatggcaacgtggtcacctgtttggcatgttccgagacgaggtgcggtcattgggaggaattaagggacagcagttcgtttagacacattattgtgttcaaaattcgagactttcaccaaggggaaggccagccaatcattttttcttaaaatcctccacccccttacaccgtgctgtttagtcttttcgccgattgttacgtcgcctcgagcagtgccgactgcaccgtggtactttggcacttcagtcaacacttgggcctgctcgtcggcgattacaatttgcctggggaagagccgtcgccacgtgccattttgactggacacgactcggaaatcagtggtgagtgggtgagaaatgcaaacagagatccggcttggattctaccctccccgggtgtaatttttcccctatgttttagcaatttgcgtttcggctgagcatggcattgtcctctacggacggtacccttctgatgcattccacacagggcgacatgctgcacatcatcatctgctcgaacggcaacggaacggacacattggcaccaatcaacgacattctgttcagcagagactgttacattgcggtaagccgtttaaaaagtattaaatagctgggaggggaggggggggggggtacctcccctcgggcgatgaccttttttttcttttcacactattcccgccacactaatatgctcattaacgaaactaattcttttgaattcccatttgttcaggtgtttttccgtgccggtgttgtggcacacatcgaagacctgcgcgatgctcggctgtcccaattggtcatttgcagtggcggataaaaaaatcaacgaatttgagtattaggtattgcacgcggacggatgatttcctggaaaattgggcaccactaaaaattgagtaaatcagtgttttcataattttggtgtccaattttttattgtataattctggataggcatctcaatttgtcctcatttttgttgtctcaccatttgtgtgtttcattttaaacgattgattaaaatcagatttattttttgttaaatatgaatttttgggaaaaccatgacgtaaaacaacataaaataacaattattcctcaattctatgaattttaacaatgcaacaacttgtagaggccatcaaaaaatgatcacttttttctttcttcgtgtcgacggcagaacaaaacctttaaaaagcaaaaataagtaacaaaaaaaaaagtttcttaagacttaaacaaaaaaaaatttttttaagggcggtaaaccacataagtaccgggggggggggcagccctaccgagatttgctaaatattgtatttgaaatttcttacattctccccccccccccccctaacctctttggtttgcaaaatttttatgtcataaaaggtcgtccaaacattgttattgggggagttttcgcggtcaacaatcacgcatctcacatctattaacccagtttcgattccctagactaaatttgagcaaaaaaagcggaatccgaaacacccaaattttcgacttattggattcgagttcgggtaagagatttgttaaaattagtattaaatttgggattagcgacccggaaattccccaaagaactaccttttatgacaaaaaaattaaaaaaaacacaaaaaggtacccctattgttttttcgagggggaggggtaaagtaaaaaaatgtccaaatttcttgaatgctccccccccctaacctatctcggattttccttggagcaatgtcaaccgccgtttggggagcaagcccgacaaaattggcaatttgtttgacttcttccaattcttcgtcatgttgttgttgttggtgttccaccgcggcacaaatgcgccacactttcagcgttttgtcccgtgagcaagtggcaaacaaatgggcgtc

SEQ ID NO: 1472 - DNA, 6100 bp, Heterodera glycines
agaaaaaaaaattttttgatgaagggggggggggggggggaaagggttttttgaggtataacttccttcatagttatcctaattgtaccaatttagtatcatcattcgatagccctaaatgtactccattagtgttcaaattttaaggaatttcatcaacattcgaaaaattttatggccaacaaaccaaataaaatatgttttcccgcatttttggcaataaattttttaaattttgttaatcttttgaaaattgtggtacaatttgagttagaacacgcaattgtttaaaatcatttgtttttgttaaaagcctaggtgttactgaaaacaaaatttgttgaatttccaggaaaaaattgtcgaattcgtgctggtgccttaggcggttatttacgaattgaattacgaatttttggaatttccgtaacaaatttgcgaatttaattacccatggcttttgccaacctgggccggacaaatcgcctcgcacagtttgcacgcaatgcaccgctcctcgccggacgggtagcgccgcagggcgtgttcaccccgaaaacgcgcgctcagcggacccttctcgaacgggtagttaatggtgaccggctccatgaaagtgtggcccacaatggtagcagcacctaaaaattagtggagggaattgaaatttgagaaaattggcactttttggtgaaaatgttggcataatttcgcagcatctcccaactaattttgtaaatttgttaaaaaaatcaaatgctttttcaaaattcatcggcgagcgccgtaccatttcattgaattgtttttggttttcctaaatttcacataaaaattacccgtcacctaataaaaacggtgtcattacaactcgtacaaaaaaaatttctaagaattttcaactaaaacttagaatttttagattaaaaaaatctaaatggattttctagcctataaaaacattttaaaaattctttaaagttttttttactaattttcagctgcttttttaaacttcttaaattatttgaaaatttaagtgttttaagaaatttttctaggctagaaaattcatttagactttttttaatctaaaaattctaagttttagttgaaaatttcttagaatttttcttgtacgagttgccattgacccaaaaaaacaccgaaaattggatcaatttcttggtatcattcaacagccataaaaattctattaatatgcgaaatagcaaaaaaaaatgatggccaaaaatatttggaaagcgggtttttgaagtttttccacagaaataaaaagtgcaagcaaacaaaaaaaaacctttgatcatttcgtgaaaaagcgcgctcgccattgcagcactggtatcgccttgcaaagtgccgtccgaagcggcagtttcgccaacatattctgaacagaggggacaaaatggcattgcgatgatattaagattgcaaaaattgacccaaacccgaggagtaccggggccatccatcaatggtaacaccaaaaaattggcattggaaaatggggggggggggaatttttgtcattgcagaatcccaaaatttgattttttttttttttttataatttgacgaaataatttactttcagactggtacaacctaaggttttttagagaggttataaggcattttttgtcgaaatatatgtagcacaaaccatgcttaaagacccgcaatattttttcctaatttttctgatttcatagttttttagggtatcgttgaaggcggtcgaacccctaaaaatggctgtgaactcactgtaggcatttcgagaaggctgccaaaaagtgttgggtgaaaatttgttcaagaaatgtttgcttgttcgactgatgtgttgcattgtctaaaaatggaacaaagttaagaaaaaaataagacagaaattgccaaaaaaaatgggggagtcgatttacaacaacccaaacgaatgagaaattatgaatatattagggatgtgattgtcaatgaatgtttaatgcgaaaaaagagagaatttggtagttcaatttcaaccgggctattcaggtcaagagcatcgtcataaatgaattaaaatgctaactcgtacaataaaaattttacaaaaatactgtaggtagtctaaatgtaagcaaaacggaccaggcccagcccaagattttgtggactaaaactttttttgtttccaaccaaatcaaacaatcttggcagcattcaaaagcccttcacatgctctattagcagtacaaaaagcaaagattttcaggcctgtaaaagttatttaagaaaaaattccgactttttagcataattttcatgttataacttttctgataatcatctaatgacccaagcaacagtttagcaacatattcaaaacatttttaagatttcgagtgatatgaagtcaaaaatgatggaaaaaacgagaaaaaccaattttaacacaaaaaacaaacaaaggattgattgcctgtaaatcatcaaaaaccatttgagaatgaatgctgaccaatttttttttattgcattgaattgaattgtcaaagtaaaacgaaacaacacaacatttgttatacaaaattttcgttataacatttcgtttactcgtccgattttctccagccgtgtgccttcgctcaaatgatccgttccaatttcactgcatatttgatgtattgtgcgacaatttgacgactctccaacggcttccgctcacgttcaatgccaccattcgcctgcgccatttgtgccgtgttcgcccgcccggcgtccgccgccgatgccgtgccggtcgcagctccgttggattgcatcgaataattttgtttaattagcgtgcgcttaacaaattttttaagtatacaatatttataagttattgtaaaaaatagagaatgaaaaaatagctttggaccaaaagacccaaagaaacgaacagcgaacaggccaagacaaagcattagatattttttttttgatgaaatttatttattatggcataatgttactattgagataaaattcaaaatttcgaatgaattcttgaaatacgatagacatacaaatcaaacaatctaatgccgcagacgcgcaagttttctatgttttttatgttgatggtaaaaattcatgagaaaacaaatactaaataatgaacgacagaattcaactatatagggagagattggcaaataaaactcagcaatttttgccgaaaattggccgacctttccatcaaattcactaatcaatcacaattaaaaactaattccatcataattagtgcgataataaaatgttcatcattcatttccactgttcattgttgttcttcaccggctgaaagggttgccaaattctctttggatttgtaatggcgatgtcctttgttgattgtgtggaattgaaaatgctgaaaattggtgcaattggacacaaataccgtatttcctataatatagcccctccccccttgaattagagccccccctgaaataaagccccccttttgacgggggtcgaaaaatagagcccccggtggttatattataggaaattcggtaaatttaatcaatatgtgtactgctcgagagtatcgcttttgcaattttggaaatttgggcaccgaaaaattggaaaattttaccgtatcgccatattaaggttcaccggttttgctggagcgcgggggagtggattacaaaaaattttaactaacaatcaagggcatagccctaaaatcgttttttgaaggggggggggaaagagtgttaaaaaagttttcctaaatttttcaaaattttacccaaagtattcgcaggtgctgccaaattggtacttttccgttttggggccaaaaattgaattttttttaaaaatcaaccgtgggcccgtagaattgctaaagctacacaccaaaatgatttgtgaggcaaaaatcaaactttggccccaaaacggaaaagtaccgccaaattttctgagaataattattaccaatttgggacaaaaatgccgtaaattgccaaaattgatttcttttacaattttcccgcatttcatttgtgccgtggcactttaataagcagcgatcctgcttaattattaaactaatcaattaatttaatttaattctaattaatttcttaataatttattcacctccgtgtccgatttgtcttcctttttcaatgattcgaccagttcaccggcagggcatggctttaccttattttggaattcctgaaaaacagaaaaaatttttagggaaaattttggaaattcacagaaatttttgccaagaaaattgatacaaatttcaaaatcttaaatgagtagcctccgctaagctctcgactttcatccattccctcgggactcctcccaatcaaaatttagtaattagccctttaattaggtaaactaaattttttgaaaatatttttgcaccgttctgtatccggtgatcatgtccaggctttaccttattttggaattcctgaaaaaatagaaatttttttcgggaaaatttttgaaaattcaaagaaatttgccaagaaaattaagacaatttcaaaatctcaaaggagtagcctccgctaagctctcgactttcatccattcccatcctcctcaggattctcccgatcaaaatttactaattagtcccttaattaggtaaatttaaatttttaaaaacattttgacaccgttctgtatccggtgaccatgtccatgttgccactcaatctgagtgccgtcgacggccgaatttgctgcgggcgttcaatgcgtgtgaaggactcgggcgacacttggaaatggtccgaatacattgtgttcgagtcgaatgtggctacaaattaagggcatttaatgaattaattatgtcggcactttgtcccatttcggcattttgtcttagttggttgttcccattaaatacatcgccccccccccatatggtaatatttcccgcaatctccaatatccccgatcttcacctcgctcatttttccccccgtttcgcccattttacttatctcggctatttgtctaagttttcatccatttgtcgacaatttcgcccatgccccgtttagcatttttctcccatttcggctttatcccccatcttcatctcgttcattagcacgcatttagccatttgtccctccctttctcgcattttcacttaattcggctatttgtctaacttttggcccattgtccccaattttagctcattttcacttatttgggctatctgtcttttggcccatttgtccaccatttcgcccattttttaattcatttcatctattttccatttggcttatttgtccgccattttggtccatttgtcccctctttcgcccatttgtcccccatttcacccatttgtctcacctcccggctccgtgatgctaaactgtgacccgtgcggcaccggcaccattcgctcgtacgcctcctttggcccaaactgttcctgactgtgcgtgtgcgtgccgtactcgcgtgcccagcggtccatgtccaactcgctttgcaacaggttcggctcgctgccgcccacatttctcgccgctcgctcggccgccgtgacgccgctccaagcgtcgctgtcgccgccgctcgccgcagccgccactttcttctcgccaaaatcttctcgtgatacggtggtgtaatactccagcgccggttggccctgtttttgaacggatttcgacagattttttaaggggaattttttgaaaattaccgtattttcataacacaggccccccccccgtaatccgttgcatccaagttatagctcctacatgaagtacagagcacggccaacgcgactggcagtctaagaaaatgatggatggatgcctgtttttttattgagcaattaacaatgattgattgatgatatgagagattgactaaatgatattgaggcgtaaacgccatatattttcttcttttgatttgaatggtactagagaggaaaatttatttgatgtctctagcattttggaccgtttcatgtcttaccacaacgtttttaaagtctctggatttt

SEQ ID NO: 1473 - DNA, 3698 bp, Heterodera glycines
aattaaattattatcgaataagttatttttttacattaagattatttttgttttatgtatcattaaggctaagatttaaggcacttaaaaccgccataattggcaggattatagccccaaaacccccgaaaattatattaaattagaaaattttattggaattataaaaaataaaaaatataatgtttatgtgtcatcttttataaaatttggactattttaaaatttaaattcatttattataactactatacctacctaaattaaagcctggaccaggacaagtctactccctgggtcccggatttaaacggtatttcccgattttttcccatttttgaccgatttcccggttcaaaaccggaattctggtaaaaatgatttttacttgctttttagcttattggtaaaatgtgttttgtccattagtttcttctaatttatattttaaattttgtgattttttttaaatttaaaaatcccattttaaatacaattctaaaaataattttattattttaaatttaaaattaatttttaaactccaaaaatcactgttttcacctcccatgcgccttggtccaggcggaattgggcctccggcgggcggtggcgctgcgcgcgctccgctcgcttctcgccaaactcgtcgcggctgacggtactcgccggcaccaatgcgcccggctcgggcgtcaaaatgtgcgactcgggcggcacgcgccgctcgtaacgctcaacacggccctggtgcggcacaaagtccgtcctgttcactgtgcccagctcgccaacggtgccctcgcgctatatgccgaacagaaaaaacattgttttcgagacgggaaaaattcggctcggccgaaatcgagggagttgagtcaacttttttgaaattatatttgtggccaaatatttatcttttcaatagtcctatcctttcgggatccggagcgtcggggtcaggatataccgtatttcctataatataaccccccccctgaaaggcccgcccccttctgaaataaagcctcacttttgagggagggggggggggttgaaaaataaagccctctggggctctattatagtataacttatgccgaaaatgacctaaattttcggggacggattgagggacccactcttcagaaccattgcgtcttaccgtatactcatttgtaaaacagtattttttctgcacggtcattagcaagataggcctcattatttgagtaaacgatcattagtgtctcattatttattttgcaaaatttaccctaaatatgtccgaatcgctcggcttcttcgcctccgcccgttcggcccgttttggcccaaactcggccctctgatggctctcccgggcaaatgagccgtgccctttcagtatgttggactcagttggccgtgttggctccgtccgttcgccccgaacatgtgaatagtcggcacggttgacggtcgttccctcaatggttccctcatgctaaatgcatttagaacgattaattttttcaaatacattcattggtttcgttggatattaactctaattatgtcaattaactaattagccccaagagattatttgtcaataatatttttcttaatcaatagatctaattattaattcattcactgtcttgataacagggcgcgatttatttacaaaaaaatcccgaaatattctaataaatatttaaggaaaaaataagaaaatatttatgaaaatattgatcaaaaatgagaaacttagagcaacaaaaaacggaaaagctcatgcaattttcggcaacaaaattaattatcgctcaacgccgcaaaaagtgattggggcatatttgtaaattatcagattattgttaaaagttaaaaatatttttgtaaataaaaaactgtttaaatggataaaaaaattcacactttcctgataactaattagtattgataaatcatgcactcactgatcattcacaagaatcaataacttccatttactcatttgatcagtttattgatcactcactgactatattataggcctaatcaattgatagttctccgattgataacgatcaaaacaataattatctggtctattttatccaaatcgaccaatttctcaatttaaatccccaaatcattctgatcacttccaaaacaacaccttccaaatgtccgacggctggggccgttttgcgtcaaatcgatcgccccgttttggctgatagtcggctgatttgcttgtctccgataaaaaagtgccatcgccgcgaaacaaatcggcaccttcctctgttggcactttgcgctgcgcgcgctccacaccttcgcgcgcgacaaattcagtacgatggacgctggtggcatggggctgatttgaatcaaggtccggctgaaaaagacccaactaaaagccgaataactgatcaagcccacctaattaagcctaactttgataagacaaaaacttggccaagaaatgagcaattataaaagccaaatttcgatcattatctcaccaataaacctaataaaccctataatgatggaaatgcaacagagcaaaagagttttattcttgaatatttaattgtttttatgtatgtatatttttttgaaattgtgaataattctatgtagaaaaatttaccctaaaatattcaaaattcaaaaatatgttattaaatataacttaagtttaaaaaatttcaagaccgcgtcatagaaattgactgtctcgacggaatcagcttgaaaattttatttttaaatttctgagatttttttttagtaaaaaaaacaaaatttttttattttttttaaacacggattttaaaaaaacttcctaccaaaaaataaggaaaaaatatcaaaagaaaaatttttttaattagaaaaaacaattatgaatttgagaaaactaaaaattcagttttttttttaaatttctgagttacttgttgaacccacctaggcatcaattattaaaaaatggtacagtgccccggttgtttgtatcgtgttatggaaattgcggcatttttgtggtaccgtaatcactaatgacactcacatcaaacagcggtgccgacgcttcgcggcccctggcccagctgatctcgtgccgttccccccgctttccatcaatggcatagtcacttcggttcaccgacccttcggcacccattgctccctcgcggtgccatagctctaaatttcttagctaatccttgagtgtcaagaccgattctgttcttgattatcattgctattccagacgggaacagaatgtgccggaatttggcacccgtcgcgactgggaaatgcaggagtaatacagtattttttggcaacaaaatacggtagtattatgaactagaaattttgagcgtcaattgacatgggaacaaacttacagtaatccatttacagtaaattaggttttatggtgaagcgggaagcagaatgtcgcgtaaaatgtaaattcaaatttcagtgttcccacaacaccaaattttcggggaatttaatagggatgtgcgagagtctcggttctcggttcccgactcgggaaatttctcgggtttttcgcttcccggtctcgggtttttagtctcggaaaccgagaaatttttacactgttaaggatgactatttcggggggaggaggtcaccagcaaaggggcaaaaga

SEQ ID NO: 1474 - DNA, 999 bp, Heterodera glycines
  misc_feature (99)..(99): n is a, c, g, or t
  misc_feature (148)..(148): n is a, c, g, or t
  misc_feature (170)..(170): n is a, c, g, or t
  misc_feature (978)..(978): n is a, c, g, or t
aaaaacattttgggacattttttctatatatttaaaaaaaaaattttttttccaaaagtgcgggaataatattttttcaaactttttttttggattttntattagcaaggggggcctcaattaatctgagtaccggtcattagcgtcncattatttcctggccccaaatntttaccctaaatatgtccgagtcgctcggcttcttcgcctccgctcgttcggcccgttttggcccaaattcggccctctgatggctctcacgtgcaaatgagccccgccctttcagtatgtcggaatctttcggctgcaccgttgcgtaccgttccgcgcgcgcaccggcgccccctctaccgtactcttccgcgttaactccgcgcccctcaaacgccgctccgcccgccccgttgtggcgccaaatctcggagctttcgtgcggcttggcctcaaaacggtcgccttttccctgctggccgtagtcgtcacgccgcctttccagcggctcttcactctgcaaaaaataaaaaaatggtttttttgggaaataatcggcagaaagttgtgatcgggagatgatcaggacccgtggaaatgttcggaatgattgcagcaattaatcgagaccaagtaggattgaggaggtgatcggaaacttcgcccatctctcttttccactttatctctgacattcccagatcacttcgctctttcactcattttctgtttctctctcactctctattactctttttatacatatctgtctctgttcttgaccctctctctctctcttattctcacacattctctctctgaaaacttttgatcgagctaaactgatcggtggacttgcattcggccaaaataacgggatacattcatcctgatcaatttaaatttaatcggatcagtctgatactctcagtgtattttcaaagtgggagactgaaaatttgccgtgacgagttgtgtggttggccnggtgccccaactgaggcccac

SEQ ID NO: 1475 - DNA, 8711 bp, Heterodera glycines
  misc_feature (43)..(43): n is a, c, g, or t
gagaacatttatttattatttatttatttatttattcgttcgnagaaagtggccaaaacgagtaattaataaatgaccatttttctttgctcatattttgttatttgttcgcatttcgcccgccgtttttccattttccctcttttttttatttccaaaatttgtaatttcccaattttcctctcatccccttacaaaaagttaccaaatttaaatacttttgtggcatttattcagtcgtaaaaaattgcaatttcctccgtttgaccttccttctgcttttttttgtttgttttgtcgaaattcgacttttggacggcccaaagtgatcacttcccacgtcactgtgagaagagaagaaaatggaagagaagggaagggaagagcaactttctccggtttaattttacaacaaatggaaattcagcgaacggatgggaaaaagggaaaaaatgggaaaaaagaggggggacgaaataggggacggcggaccaaggcccatttcaaatctattagtgttttcgatcacatgtgtgcaaaattaatttgttgaacacaacaaattgtgaaagaaaaatgccactggggaggccaaaggccattttggggcaaagatttgcgaaatgagcgaaaaagttcctttgaatggaattcgaattgtcagattaagaacggacgaaattgagatgaattcactctcattcgagacaaaaaaagaaagaaacaaacgaacgaacgaacggttaaaaaaatgaaaaaaaaagtctcgaaaatcgagaggaaaagccaaaggaacaggttggggggaccgagacaacgacgaccgtttaattgatgccaaatttaattagtgcctaattaatttttgtttattttccatgtgctactttttattgccactttttatttttattttttccgctaatttccctcaaaatgttcgtctttcccatttttgtgctttgcttctcttttttcctcgccttttacaacttttactacaaacgcagaaaacttcctccaggttaatttttgttattaaatttgccattttcgttaaatttccgccgtttattttaggcccaattccgctgcctttggtcggcaatattttgacactcatccgaaaaaagccgggcgaagacgcatttttggaatggaagcgaaaatacgggccaatttacacttattggctgggagaaatggtagaattaaatagaaaataatttaatttaattaattccttccccttttagcccgtcgtttgtgtcgccgactacaaaaatatcgtcgaagttttccgcaaaggcggcgaagaatttacgcaacgacaaatttttgtggattttacgcacgaattcagaggcacaagccaaacataagcaaagaattttaaagatttaatttgctttaggcaatatttatggcattttcttcataaacggcgacttttggaaaggttttaatttaacttaatttttaattaatttatttaagttaattgactgacattaaaattttattcagaacaacgaaaatttgcgtccacagttttccgtaactttgggctgtacagtaatttaatggagaaaaaagtgagcattgaaaatcgaagtaataaactataaaattttcaattttaaagattttggtcgaactcagccgaatgttcgaacgaatcgaccgcaaattggcaaagagtgaaagcagcgaaatcaatctgatcgaagacgtcgaaatttcaattggatcgatcataaactgtactctctttggctacggttacgacaatgaggcaaaaattcgaatttattttttggttttttatttattttgttttttaggaacgaatcgacgaatttcacgaattgctcgcacttttcgacagcgctttcaaattggcatatgaaaagaatttgggcagtcttttctcaactttgattgtgtgctttccgaattcaacaaaaaatttgccattttttcggtttaattcgaaaatattttaaaaattatttaaatatttcagagagcgatacgaagctctgatggaagtgagcagaaatctgcgcaacttttttatgaaacgcattcaaaaaagagccgaacaaatcgactttaaagtgagtgaaaatgagaaaaaagagaaaatcggagaattcacagagcgacgaatacgacgattttgtggaggcatttttgaaggaaaaggaacgattggacggacagggcattgcgcactcattttcgtaaatggcaattaactaattgagactaattagacaatcagagaaaggaatcccacccaattgacagaatggaccaattgtggaacatttgcatggacatttggattgctggacaagtgagcaaatttaattaaattatagaaatgcgaagtgcatgccatgaaaatgcaatttgactgatgccaaattcggaaatgccttaggaaacgagcagtacaatcatcgcctggggcatggcgcacttgctgaacaatccgaagagtttggcgcgagtgtacgacgaattggacaaagtgatgggcgacgaacggcgactgatcaccgcgggggacaaagcgcggctgccttacacaaacgcaacgataaatgtgacggaaaatgacaaaaataaataaataaatattacagcaaaaatatttaaaaagggaaaggaagcaaaaataaataattaatttaaaatgaaaaaataaaataattattattttatttgtttaagccaaactgtgccattcccttttaggagtttctgcgcatttccaacatgatcgtgcagaatgcctaccgacgtgtattcgtcgacgtgaccattggcaactttcaaattcccaagggcacttgcattttgccacaaatttcggtggttttggccgatgacgaagtaacaaaaagacaaaaaagaatttaaatttaaatcatttaaattttaaaaatttaggtatttgataacccgaaaatgttccgacccgaaagatttttggacgaaaatggcaattttgtgacatgcgaaaaactgattccattttcagttggacggcggtaagaaaatttgaaaaattcaatgaataattaaaattacaataattaaaatttaaaaaaatcattaaataattttattgctttgtatggtttggaattttagaaaatgttttgccgaatcaatggccaaaatggaaattttcttgttcactgcaaatattctcaatcagtacagagtgcgtttaacaaccaaagaaagaatattaaaatttaattgcatttattttcagctttcggttggcaaagttttgccctcaatcaaacgcgaaatgggcataacaattcattgtccgaatttcgagtgccgagttgagaaaagaatagggcatgaattataaattaaaataatgaaaaaacaaatatttaactgtccatttatgttgcttttttgtttttgtttctatttttgttttcatttaataaaacaattaattacccgacaagcgaatttaaactgagacagggcatttgagtcattttcggcacaatgaaaagtgctgtctttagcccgccaatgaatggtcgaagtagaatgatcaattaccggcccaattagcaaattatgcgcaatttgtcatttgggaagaggcgtacaaaagtttctccctccatttggaacaaattaaatatcggaatttgcctttaatttcgctgtgtgtgcgcaacccaaacgaatgttacggccgagtccttaccaatttaatcgatttttattcattgaaaattatttaattaattttatattttaaaaatattcaaatgatgaatgatgcgttgtccgctgaatgtttccctgcaaatgttctgatcaccggcggatgcggcttcatcggctccaattttgtgaatttcgcttttgacagatggccccaagcaaagtgtggcccattttattttcctttaatcattttcaaaaataaaggttcgtaaatttggacaaaatggcaccgggcgcctcggaagaatgcatcgaaaagaaatgtcgaaattcggaccgctatttattcgtaaaaggaaatctgacggaagcgacactcgtccgaaacattttaaccagaaaccgggtcagtttcagctgccgatcacaccgaactgatcagagagagagcgcgcgccacttcactcttttcagatcgacacaattgtccatttcgccgctttgacccacgtggacgaatcgtacgcgaacccaaccgaatacatgcaggaaaatacggtagcgatgaccgtactgctggaagcggcgaaggaccacggacagttggccaaattagtgcacattagcacaggcgcaattacgcaatttgaaatgacaaaaaaacatccattgttttaaaactgcagatgaagtgtatggcgactgtctgaacgccgaagagccgaaaagggagcaaagtccgatggagccgaccaatccgtacgctgtcagcaaagccgcgtgtgaactgctcttgcgcagctattgggtttaaccgaccgttaaaaaccacttttgggggatcattgcttccgtttgattaagcattcctacaaagtgccttatgttatggtccgaatgaacaatgtctatgggccaagacagttcaggaacaaattagtgccaaaatttgtccgattggcaatggaaaagcgaccgtttacattggcaggaggcggaacaccaaaaaggtggaatttagaaaattaataatttgaaatttaatcattttatgctaagaggctggatgtttgttgaggattgcatcgatggcatttgccaggtcacagaaaaagctgcgcttggcacaatgtacaatatcggcacgacacttgaacttagcaattccgagatggcctaccgtatccatcacactgtgaatcgcctaatcggacggtaattttctatgacaaaagttgcgattttcaaaaaacgttcagggaggaagccaaaccaagatttgaatttgtgccggatagaccacacaatgacctctgatattggatagatttcagtaaaattcacagagaattgggatggaagtgccgcattccgtttgaggagggcataacaaaaacagttgcctattacattgaggaatggacaaaggaaggaggagggaagacagaggaggaaaaataaatggaagagaaaggagaaactaaagagggagaaaaagaagaattggaagaggaaaaagaaggggaagaagaaatggaagaggaggaaaaggaggtggaagaggaggaaaaagaagcggaagaggaggaaagagaattcgtaatgggaggaggaaaagacggaataaagttgcacaacagtgacagaacaacataaattgtaaatggcgaaggtgtgaaagttgaagcataagaaaaaagaacactcattcattgccagaaacgaataaagtgatgagataaagcattgatttgtagagttctcaattaattgcctaataaaaaccatcataaccctttaaaggtggcattgggctatcctaaaatttttgtcgtctaaatttttaagaaatgactttgcggttttcaagctgagatttttttgttaaatcatttaattttaatgacaataaatttagaaaacttagtttgccgattgtgagaaaagaattttgtgagtctcttaagattaaaaatgtacttggcaaagtcgaggtcatctgttattttttgtatatttaaaattggcttaatgtcagtttttaaaattaccttcccttttcattagtcccaaagtttggggcctacgggaaacgcatacaaaatgtttttctaaaaccaaatcaaataataagcaatcaaaaaggattttttacgcaatgggtgatcataacccgacgacttcttcagcttcgataattccagacgattcaccggtaaatgtacaaaatcctgaaaattcagatagcatttgattttaaggtcgatgaaaaagatatgccggcaacggaccgcgcgattgaaaaactttttgatggaattgacgcaatttacttcatggaaaacggattcaaagcgattgcgcacgaattggaagtgcgtgccaattggaattcttacaaataaacataaaatttttgcagtagatttagttaaatttagaacaattttagaaactttccgccatttgttccgaattggaaattgacgagttggaaagggaacggtttaagcttaaacggcaaatgcaaattgtgtcgaggaaaatgtcggcgttaatcgtcaaaaattcgctgtctttcaatcgacaagtggaaaattatgaaagtgtccgaacaaatgctgaacatttgttacgaataacgaggcgaatgcgaaggtgcgaagaatgaatccattcggattttctctgcaaaaatgcgccgtattttaagttcgattgaaattgggaagagaaagtgccgtgttttggcctccgttttggcttccgattacaaaagaaggctttgtttggtggtgaaacgcgaattggcactgatcgccacgctgcgcgacagtgagctcaaagcgagacaactcttgcaggcactcactgcttttggcttcgaatcgcagtttaataaacaaatttcagacggatgacatttggccctttttgacggtcgtcgtcggagtgatcgatgctgcccgccattttcaacattactcctccgtaaagtgactcatttcattttaatttttattcttaaaatcattttttggttattttcaatttcgatccatgacttatttctaacaataagtttggaaaattttcttgaaattccaataaaaattcataattttttttcaattgtaggaaaagactcagataaaggttgtgggaaacaaaacaattttaggcaaatttctctgactcttttgggcattttgcggtcgacagaatgccaaatggacgcagcatttgctgaacaaacgaaactgttcaacttggaacgctacgcacttttgaacacggccaatcactttctcgggaacactgaagtcagtgaaaatcatttgaaaaattagttttgattagagcggcgacttcttcaaacaattaattacctcttccttttgcagttggtctctgttaaattgagaaggcatttcgaagggtcgctttgcgatgcgtcgagaatggccattctcgactcgttgacaatgcggacgaaccccgaggggacaacggaacaatcggacgaacgcacaatcgacaatttaccatttgaacaactttgtcaggtaaaagtctaattttggaattaatttaatttatcccacaatttcaaatggatttgtaaatcagtcaaacagttcttgttttttttaaattagcatatccatctgaatgactttctgcgaattctttgcaaaattggctctgttctcgtggaaatattgtgtatttaccacgcaattttgaaatttcacatggacgaggacaaattggcactgaaaaatggacaaaaggacgacacggggggaagggaaagcgaaaacagtgacaaacaggaggagcaatttgcagaagacaatttcgacacgaatccgttgggtggggctttttattattttcatttgcactttaaatcattcaaaaatttaaaaagcaaaaagcgaccccctaattaaaatagttcaaatgaaaggaaattaaagtcatttgaaatcaaaatataaaaaatgcccaaatacatctaattttgcaatttcattgtttttagttgagaaaggcgttatgcaaaagtcgctcattgacaatgccttcgatgtgttcgaatgcgcctcccaaaatttgaattgtcttttggccaatgccgagatgagtgccatcaaattcgaccagttcatcaaagttgttgagttggcggaaaggtcccatattttatcatttttattttgaatttgtaaatttactatcaataattattcaattaattcctcctcatttccatttgctcagattccggaccttcggtcgccaatattttggcaatccgtgccaactcatccgacacactttgatggaccaatcgcgcaaatatattgagcgataccatgccgagaaaatggaggaagttaaaatgtttttggagagcgaaacgttcactctttgcccggtgcccgtccaattcacactgtttgaccttccggtgagaaagaattggtcgtttttaagtcaatgattgacacttttgacggggttttccctaggttttcccaatggattgcattttaaaaaatgcttttcaaatttaggaatttttcttcctcaaagagttgcaacagaaacagcaaaatgatgaacaaacggaggaagagactgaacagaactcagtggagacatttgtccacggcaaatccatccgtttttcggtgtttcgacattcttcggaaatggacacggaaatattcccttattcgcctgaacaattcgacgaaagtgtgaggagaaaggcacaaaaaatggacatgaaaaacttttttgcgaagagaaagcattaaaaaatgattttgaaataaacaaaaaatatggaaaaacgaattcagccccgacgaattggtgacagacgacggataatctgcaaaaatggcgaagtctctcagtgttcgtcgtccgatgacggcactcgaaattccattgaagacgaatcactggcgccgtcg

SEQ ID NO: 1476 - DNA, 3711 bp, Heterodera glycines
aaagcatttgggaattagttaaataaaaatataaagtcacaaattgagatgaaaatggaataagatacaaaaaataaataaaataaattttatcaattaaaaataatcgccaaaattgagatttgatcttatcatttcttgcaaaataataatatttcggagccagaaagaattccaagttggccagcctcaacaattttgaccacagttccttaataattaaatattaaaaaaaatttattataaaatttcataaattgcggtagatttaataataattttaatttgaaatttatttgaataaattttattgaaaaaactcattaaaatagaaaaaataaaatttttttatgggcccacctctaataaaaattttgttgaactcatgaaaaccgcgaggtaaaattttgagagtttgcgccactttgattaaattttctgtgagccgagaactgaacaaatgaataaaaccaattaaattaattatttattattttttgtgtataatttttttttaccgcattagccacatgaaaaacggcgaatgtgaaaagcaatggtaaaatggcatgccactctcatgctgcaagtcattagcttggatcagttggaagccggctttatctgcttcagctaacagttcgctacgggaatggaggggcggcatgccacaggcaaattcaagttcggacagaagtttgctaaaatttaaaatggattaaagaaaaacagaaaaaatattcaaaattaaaagaattaaatttaaaaactcggaaaaaatcagcttaatatgaaaagaagaataaaaaaaatccaaagaaattcttttaaaattaaaagtgatttacaaaatggatttaatattaaaaataaatattcaaaaaatcggtaaaagctttaaaatgacaaaaaaaatgtaagacaataattttaaataaataatttaaattgaaagaaagtttattgaaagaatttatattccctaccaatgtttttcattgctcacatcaaatttgtccgtttttaacaggtcataaattagcaatttgccaccaggtttcatcacacggtccaattccgcaaaaatatggcccaaatttggcatatatttgagtgaatagagcgcaaatgcggcatctttgctttcattttgaatagaaagagctaaattttaaattttatttatgaaaaagtgaattacgaattgtgtcctttaaaaatattttaagtacggtaatgaagtaaggactatagagagaaaaaaaatggtgaagtgcagaacttttagtgcaatcgcccaaaagcaggaagcaattattgtcgatgccaagcgaacgaaagttggcatttccaatgtgaacctaaaaggaaaataattttttaaaataaatttaaatattttatgttgaaaagtatttttagatttgggttaaaatacttcattttcggcaattgttagcccagtaaaatgggctccggtaaatgccaaattctttatgacgtcaccaatgccacagccgatgtccaaacaatgctttcccgggcctaattcaaggctgaattttttgaaaccatttgcaatttaaccaatcattaagcattttcagtttcaatatattgtgtaagaaaatgaattataatttaaaaagattaattttcttcatttaaaaatttaagcatttttaattatggaaactccatagatcccctgctggtgtttatctttatgctgaagaagcatagcttagacaaatcaactgactctagccaaatttggataaaatctgttagaaaagtaaattttaaaaattcatgcattttgcataatttttcaatgtatttttatccaatatttaggcttatactatttaatttaaattttttcaaattcccttaaattaaattgttttcttataacatataaaattttatttttttcaaattccctcaaatattttatataatgcatttttatttatttttcaattccacacctttgcccaatgcgcaaatgcaattgccgcaatgcgacaggcagtgccattgtggacgatttgttgcacaaacatggcgacttttcatccgattgatgttccgggggaagaatgggcggcacaaaatgaaaactgccgcaaaaatactcattgatcacctgaagatgaaaatgaaataaaaattttattaggaaaaaagcgatcaaatattttaaaaaaagattaataaattccaaattaacgaactttctatttaccgaaattgaaagaattatttaattaaagtcatacatttaatctaattagataaaattgattaaagcgccagatttttttaattatttattttgacgaggtaattaagtaataaaatgcttttaataattttttatatttttatttaatttgcctttgacatgacggaataataatgtgcaatgcattcgccataatcaccactgatttgcgcttcagcataaagacgactatgctcattgacaaatgctaccttaagaattaaaaaaaatttataaaataaattttaattcttattcgaattcgaattctttttcttaatttaaagaaaaatgttgaaaggggaatctaagttaaatcttaggttagattagcctaatcaccctcataaaatgattaagcctatcataaaacttggaaaaatgaaaatttatagaatttttcataaaaaaagaaaatattcattttagttaaaaatttgaaaataatattttaaaaagcaaaatgaaattgggaacattgattattcaatcgatttgggagagaaaagcagcgctctgtcgctgttgtgtgctctgatgatgacagtcctctcccgactttactttgttgattttacgcaataattgcgtggctttttacgctttcgatttttgtaaaataaatatttatgatttttgtatttttaaatcgttagttaaacgaaaaagcaaaaaaatatattcaaaaatataattttaaaaattacttaaactttaatatatattgaataaatttattttttgatacatattttaaacttaaatttctcgatttaatatttaaaaagttttatgaaatttttagttgaaattaatggatttatgaacataatttttttttaacaaatctaatttaacaaataaaactaaaacaattttaacgatttttgttggtaaatttctgttgctttccaaaaaatgtcatacataaatgttagataaatgcagcgatttgtgtgtgtgtttctcagtttcccaggtaacccgaggagttgggcaaacattgggacaaaaaatggaaaaaattgccatttaaataatttgaaaaaataaaaatgataattttcttaccagatcatgtcgtctaaaatggagaagtaaattaaagaattgttgtgaaagattcatagaattaattatttttataaaaatatcttaaaggatattaaattttatcagtaaatgaattaaggttttttttttaatttattcagagattaatatttatttatcggcttcaaaaaattgtttatctcatataaaaatagaatttatcgtatgttaagaagaagcaattataaattaaaaatttaatctatctaaaaaaatgtttttttccataataattttataatttttttaaaattttaaataagacggaaattgagcatcttttctgtcttcggagatgtacatatgag

SEQ ID NO: 1477 - DNA, 2010 bp, Heterodera glycines
tgaaagattcatagaattaattatttttataaaaatactttattttcttaaatgatattaaattttatcagtaaatgaattaaggcttttttttaatttattcagagattaatatttattacaaataaataactgttaattaaaatattttaaaaagatgaatcgtatgttaagaagaagcaattataaattaaaaatttaatctatctaaaaaaatgtttttttccataataattttataatttttttaaaattttaaataagacggaaattgagcatcttttctgtcttcggagatgtacatatgagcacattcttcgaccaaacgcgcattttccgtagaaatatttcagaaaataaaacaggtcaacaactgcgacgtacaccgaccaaagaggaaaagagcaactcaacccccgaggggaggaaaagagcaactcaacccccaaggggaggaaaagagcaactcaacccccgaggggaggaaaagagcaactcaacccccgaggggaggaaaagagcaactcaacccccgaggggaggaaaagagcaacttcatccatcccctgagggtaagaggtggagatgcatcacaattcttcacttaatcgacgaataaaatgttgtgaaatttgaagtggtacaacaacagacaaaagagagaagaagagtagacaaaattgtcaaaaaaataaaataaatgataaaaatttgttaaaatatgcttaaaatttctaattttttgggatgatatggcaaatatttatattttcgatggaaaaaattcgaatttcattttgtccggagttcttagaaacaattttaaattccaatttgtccatccatgtctttgatacttaaacaaaaataccgtacctaattgttatttaatgggtttttcaaattatttatgatcatcaaactaaaaattcctttatgaaagaaattgtagaaattgaaatttttttttagaatttttttcccaaatctttcacgggcattgttctttcggcacacatttgtttgaaatcgaatcgcgcaccaatccgtcggcacattcacaagtgcaaggagggcatatcatcagagtgcaaaattccgggttcggattgtcacagctcggctcacatccattgcatttcctatcgccaggcttctcatttggagggcactttaatccgaagacaattagtgattaaattatttaataattttagtacaatggattattaataattaattggtttttaattcattatattaccatacaacgtccatcattacggtcgtcatcacgatcatcatcatggtcactatcatggaaactctgtacagttatcaatggtagaataacgaaaaataaaattaagcaggggattcggaacatttttttcacttaattggatatttttttaataaaaaaaaaattttgtaaaattaaagaaatttccgtaaaaagaatccacaaaaatattaagttctttaagcttaaaattttaaatctaagctaataaaacagaccatttgctactgcttttgctgctgcgcgttcattcgcttaaatacaacacattttggccccatttttgtgcacaaatatttttgttgtttccccccaatggattaggcttcccccccccccagtgccgcccattgttttgtacatattttgaattttatttattttttaattcagctgatacttatttgtttatttaatatttggtcgaaaacgtaaaatttttgtgatcggattaatgggggggggggttctcccctcccccgccggggatggatgaaaatgtgtccccgtcggcgggggcttttatgtgttcattagggccaatcggagttgcaggtctgatgactcatttcctgctttaattgtcccaaatcgattttcgaaaatgtcgcgcccaattgtgcacatccaaaaaacgaggcaattattcagttctatttcctgtctaattgatgggacaattaccagtgtcgtcagctgcagaaatg

SEQ ID NO: 1478 - DNA, 1831 bp, Heterodera glycines
  misc_feature (1720)..(1721): n is a, c, g, or t
  misc_feature (1741)..(1743): n is a, c, g, or t
  misc_feature (1751)..(1751): n is a, c, g, or t
tttctccatatacaataaaaacaaacaaaattttgtaatattttttatttattttttattttttttcaaatttaccaaaaataaaaaaagacattaaacttttaaaaacagaaaacaaaattttaaaaaatgaattgagttcactcattgggttttaaagcctctgctgcacttcattcaaaatcttagaagaaattcaaattgcgttgaagaattttattgttgattttggagtttatccgtagtaaaaattgataggaaattgaaaaattatcgttgcggtggcaaaaggccgagaattgccgcttctgcatcttcagctgtaaaatcacagggcgacgaccgtgtcattattatggactaattaaaaaccggaatttattattattaaaaaaaatgatttttgactggctttttatacatttttcctgagccaaattagtcagcaccaattaaagcccttactcagtcacaaaattctccaaattccccagaaagttttggtgttagtaagcaaatctttttataatccacctaattttggattcaaaaaataaataaataattaaatcgtaaaaatttattaaaaatatccaatagatttttaaaatatatataaatatttcttaccttcaaaaagatcatggtcaaatttcggctctgcgtccaatcagagactatcctcagtttcttagatcataacttttttcttactttgtcaatccatacatttttggtatcaatcgaaagcttgaagtctacagaagtttttgtatagcagaattctgggataaatgcaacagacaaaaaattattctgcatatacgcgaaaaataatgaatatgaaatcattgattggacgcataaactggaatagagcccaaatttatctcacattttaatgtcaccgtcgaaatttttttttttatgttatccaagcgttcatgaattccatttgatgacaataaatgcatgttaattttcatttgaaaaaaattgtttcaaaatgaaaatcgttttgaaattttcaaattatttctttctcgggcatcgtcttctcggcacgcatctgtttgtgttcaagttgcgcaccaacccattggcacattcgcaagtgcatggcgggcacagccgcagtgtacaaaatcccgggttcggattggcacagctcggctcacatccgttgcattttctgttgcctggcctctcattgaacgggcactataatttaaaaataaaatactctatttatgacagtgagttttattttgttttataatggattaaaaaggtgattttatttaagaaatattacccgacagcgaacattgtcattagcctgagcagttagtccaattacacaagaggacaacacaattaaaaataagaaaaagcaaggactttggaacattttctctcaaaattattaatttattttttaattaattataaattatattaataattgtctgattttaaaattaaataagtcaactttaggctaattgtaagttcacttaaatataactaacttaatagatttggtcccatttttatgcaaaaatatttttggttattatcccattagcctactctcgccattgccataaattaaaaactcggccttgcgtgaaattcattaattttgaaaaattaaaaaataatgtgtgctcatcgagaaattgaaatttcgccttttgacaaaaactttgcaaaccanncgggctcggttccctctccnnntataattnggtttttaataattttaaaatttactgttttgcgataagcaccgaaaatttttttttttttacaaaattcaatttgcacg

SEQ ID NO: 1479 - DNA, 8451 bp, Heterodera glycines
  misc_feature (1655)..(1655): n is a, c, g, or t
aaatgaaatgctacaagcaaaaggctaaagattagtcgacaattaagcaaagttctaaaatttcaaaaaatcacatgggcgtaaaattagcaaataatattaaaaaaataattattccaacaaaaaatttgagagaaaaagggttctcaaaatatgatatattatttaattgtataaaaagcattaaatttaaaattgctgttgctcttccggactaggtcgttttggcgccaacgtttgggcgccagcgcccgagtttttgtgtcctaacttttttaattttcgcccaaatctaacaatcttggtatcattcgacagcccttcacaagctctattagccttacaaaaagcgaaaagattttcaagcctgtgaaaaatatattaagaaaaaactccaaaaattttggcttttttgcatttttcatgtataacttttttggtaattgtctaattgccaagcaatagtttagaaacagcttctaaacatgtaaaaaaaatgcatttcaattatatcttcttttaccccatatatttgaaattttcaattattaaactacatattaaaccaaaaatatgtgctgcttctatcccattagtgtactttgggccgttcaaaatatcaacaaattacgttttgttttcgatttcttccaaatattctgccgctacacaaatatttttcttcataatacaataaaaacaaaaaacaaatattttatgcaaaatttatttttgattcaatttaatttaaaattagggtcatgaattgattttatgtctttattggcaaaaaaataatattgaaaatgaattatgaaagtcatcatagccaagaatctccgctttgcctcttcagctatagtaggtatgccaattgtttctcattgggcatagtttttccaatcccatttaacaaaaattaaaatattaaaataataattattatttcaaaaaacgaaaccaatgactatggttaatagaaaaaattttataaaaatttcatttcttaagaaaaagaaaaagtaaaatcattgaaaatataagatatttaattactgaaggattttgcacaccctttaattaattagcaattaatatttctgcggaagtttcacattagaaaatgtctttctcatttctaataagtccaatgtttttattcatcatgccaatcaacaccaccatcattatcatcaccataattactcattaccatcactaatatcattcatttcatttaaaacccaataaaaacacaaaaaaaaatgtctacaaaactttcattgatgcgtaggcgagaaaaataatacaaaataacaaaacaattcgctgctccatgactgatgccgctgctgcctgtgacattggcctttcatcacatgaaaaaaggcattttctcgatcgccacaaattcttaggggagccggggggaaagagatcaaagttcagcggcaaaagaaaaattgtggtgcgcgaaaatatcgtcggtcactgctgctgacacacacataccaaatgatgacgatttgcacacacattagcaaaattaattaaacaattatttaatagtgatgggccattaagtgttgaatgaagaaggtggcgaagtgaaatgcgcaaggaaaagtgatggattgtccacatcccccgggggnggggggggggagagaacgacagcaaaatgacatgagtgcttgccggtgacatttttttgatcagttttattccagtttttggagcacaaatcggcgactcaaattgagcgcgtagcagcgaaattcgccggatggtttcgattacgtaatgatcaaggttaaaaaatcttgatcgtccaaaaaaggtatgtattatgctcgaatatttgatgatgaagatgatgacggtgatgatgatgatgcccggagaaacgccctcacgctcccaaccggaccgtccgctataaaatgggcagatggacgagcatttgacaccacaaattacccacccaattagttgaaaaccaaaaattaattggccgtgacgaaaacaatatcatcaaccacagaaaaatgaactgctccagcgctgcaatgttgatgctgttgatgaccatcttcactgtgctgtccaatgtcaacgaggtagcagccgaggaacacgagctggtcaggtaatgatggaggatttgtgagattttcgtaccgattaatttacgggatttgcggaaatcccaaagcttttcatttcttcggttttgattcccggagactttttccattctgaatctcagggaaaaatcacatccaatggcatgaaaatatattttctccgctttagccgcattaagcgcaacggctacggatacagcagcggttatggtggtggctgttcagcctggtaagaaagaaaaaagcattttgaacattttaataaaaaaaatattaaattaagccaaagcagctgcaccacctgtggttacacatcctaccatgtaaattcaaaaattttaaaattttaaaattaaatattaaattttcttaaagaccgtgcctgcggctcccgctcccccgccaccaccgccgcctccgcacctgcgcccgtctacagccaggtgaggaattttcaaaatttctaatattaattttgaataaaatattttgaatccactaatttctggattatgaactaattacttgagagaatgtggtgggattaagtttttgatgggggatttcagtcttctgagtactaaaaaatgatttttgttttttggctttcatttctttttttgattaataacatccatgatccctaagattgctgaactacatcaaatttttagccaaaaaaaggcataatttttgtcatatttcattcgttcagtcttcctactcctcctgctccacctgcgggggcagctcctactcctcttacccgtcttcctcttactcctcttatcccgcttcttcctcttcctattcgtcctaccccgcttcttcctcttcctactcctcttaccccgcttcttcctcctcctactcgtcctacccgtcctactcctcctcttcctcctgctccacgtgcggcttgagcggctacagcaacagctggaacaacggtggcagctcgtccaacacgtggagcagcggcggctcgtccatgtcggcgggcaacggcggtggctacggctacggcggtggcagctgctcggtgtgcggaaagcgcaagtgagcgatgcgcagcgcgcgcagcgctgtttccgcacggacgcaacagcggcgagggcgcgcggacacggagaatgaactgacggaagaccattgaaattctcccaaaaatcttgaacccatccccaaccacaatacccatccaatccgtcccacattttgttaggctcagaaagcacacattttaaatggcataattattttaaaaattttaatttaccaattggcacccaaaacagcaccagcacactttgtttatttaattgtttaaattaatttttgtttcaataatgttattttttgtttgtgtgatcacaattctccaccaccccaataaatgataaagattcgaagttgattaattaattttaaatggttttttttatcaggcgccgctgggaaattttatcaggttttggcacgaatgcataatgagcgaattgaaaaagaagtttaattgaaaaattcgtcctgaatttcaataaagaaaaaatttgactctcatcagacttgatcaaattcctaccctatgacattcattttatctatggacctattaaggagtattaaataggcttaattaaaaatgaaactttatattttataaatgaaatagaaagcaaaacagacacaaacttatttgttataatttgaaataataatgctttacaaaacatttaaataaattaaaaatttcctaccttttttttagtcactagttttttcccaactccgccgatttttttcccgggtttgcaagcatatgagataattaaacagccaacctaaaatttctatcaaaaaaaaattggtcattagtgaacaaaggaaagctgatgaggaagacatcattttttttataaaatttgcaaaaatttaaatattttgtattaattttggtattttttaataaaaaattgaaatgtacctaaacaattgatatgcatttggcattttccggctttttcatcaatttttatgcccgtatttgtcaattaaaaaaatcttaaatcttttaaacttaatttgatttttattcatatgattttcttggggtctccctcatcccattgaatcgcatcaaaattttgttttgactattgaagctttgccacgtttattcataataaaattcgccatgaattcataaaaaataagtaattttcattatttatttcttttataaattatatatttttattttcaagaaatatatgaaaatataaatatttatgtttagcttacttctcaattaaatgaagctaattaatgcatttgagtttgctgtttgctccattttattaattgctgctcaattatttcaagtttccttttcgtgtgaaattggtaaattggaaatgaaattaatttattaatttttattcataattattcaatttttttagaaaaaattaacaaagcaattgacaatttgtacataaatttatttgagcttcaaaaaatggataaaagtcagcaaaattattttgaaaatgatcacaaaaattgggaaaacattttgttgaaaattgaatcaaaattattgtacagttcaatttgtacgattttgaagtctgcagaaatgccaaaaaatgcgcataaagaaaaggacagattgaaggaatttttagagaaatacaaaaaactttcatcagaattttcagattctatgctaaaaaattgcgaattttggaaagtttggagattagtggccaaaaacttcggtttgttgactaattttaaagaaaataaaaataaaatttaggaaaaaatataaaagtggcaaatggtgaaataaatttcgaatgccaaaacagaaaaattatccgacgcctcgaaggtgccgtagaagatccatttgctggagacattttaacgggtcatttaaatgcactttcgcaattattgacgccaaaaaagggcgacgaaaagccaattcaaattggaaaaatgagggaaaaagaaaataataattggtgaaataataaattttgacaaattaaaataaattttcgatttttcagggattttaacggattttttaaaaaagcaaaaatgaaaagtgagtcaaatattgcttatttattacgcaaaaaccgcgttgaaaaaaacataaaggggataattgaaataaagcaaagaattgagcatcattttggcactcaatttttggagaaaatggaacagttgcgaccaattgaaatgacattcggtgattatgatagtaaatatattctctaattatatccccaaatctccattaatccctcagtctccaattatcccccagtctacgaggaggatgaaaaataatcccccatgggggataaaaagagcatatacggtaacaagatcttttaaactatcaacaaaagtcgcatagaatttcaaaaactaaattctcggaggcataaatgccatagctgggctcagaaaagttcattcaattttcaaaaaattgttaccaaaaatgttcaaaaaatacgaaaactttttgaaaagctgagtgaaaaatgacgagtttttcactgatattaggtacaaatttaaagcaattttttggggagggtgcggctgtgaatttttgtaaattattgtataaacaaatcattaaaataattgtttcatggctatcccaacatacataagaaaataggaattttggcaacaaatttcaacttttacaattatcgattttaaattatgtagatataattgacgaccaaagattggccaattcatatgtaaaatttctgcaaaaagaggaggcggcgaaattggcacaacaaaatgaagcgcatttattattatcaacacgaatgttttttggccaaattattagcattttttcaatgaccaattcatatggaaaaatgaaaacaaaaaagcgaaaggatgtcgaaaatatgaagagaatttgtgcggaaattgaaacaatttggaacaaaaatttttacgaaatttgtacacaaattgaaacaaattcggcatattccgtcgagagcatttccaaattttggcacaaattggcgaaattattcaacaaaattccatttttgaaaaaatgcgaaaagtttttgattatttacgaagaattaacccttgagaaaaccaacggacttgaagaatttttgtggagggcaaaagaccaactgatgtcagagcatgccaaaaatgtgatcagactgaccgttggccaatcagccgagtgccaaaatgcactcagtcgcttcttggcaaattcacttggccaaatgaagggtgccaaacatcggctatataaatttttcacctcccaattcattggcatcacatatttcgataaattattgcaagaaaatgcgaattttgcgcaagtgttccgttctggtgatttttttatattttcggatgaatattaccgtaattcaaaaataataatcatttaattgcctttccaataaaatcagatttaacaccaagcgaaataaaccaattacaactcaaatattatctaaattatatggacagtgacagtgaaactgatgtccacacgagagcactttttatggtcgattatttggcattttatcaatggtaaatagccaattaaccaagacataatgggctaaattaatgaggaatttttttaggaaaatttaattaaaacactaatcgttcaatgagtttttttttaaatttaattttaggctcaaaaattggcaagaaaaattgtcaaagagaacacagccttctcttgaacagcttctgttccaaattgaactgtacttggattttcttgccagcacaacagaatcggcgacgggcgaagcggcaaaaatggaacacaaacagaaaatgttggcactgaaaacagcgaaagacgcatttttccccgatgaagccgaagtaattgtaattgacggaagaggagagaatacggcaaatctattagcaattaaaatggaattgttgctaatgcataacgaaatcatcaaaggattgatcgaaaatgaagaacactttttggacaaagttaaaagtgagtgctgacgcgtaatgaataattaaataattaattaattcatcattaatgattggttaattgttttaaatgtttcttagcaatctttattgaccaaaaacgactgcgtataatgattccacgtatgtcacaggaataccaaattttaatagacaatgctaagggggaaaagcagcatgggaatgaaaataaaaacaatggaaaagaggatgaagaagaaaagggggaaggaggagaaataggagacaaaaaaagaagtgagaaagaagacgaaaggggaatagagaaagaaaatgaaaagggaatagagaaagaaaatgaaacggaaaaagaagtcaaaaaaagaagtgagaaagaagatgaaagcataggagaaaaaggcgaaaatggaagagacgaaaaagaaaaagaagaaaaaaaaggaaaagaaaaggtggaacaaaaaggagaaagtgaagaagacgaaaaggaaaaaggagacaaaaaaggaggagagaaagaagacgaaaaaggaagggaaaaagttgaacaaaaaagaggaagtggaggaaacaaaaaggaaaaagaagacaaaacagaaaaagggggagaagaagacggaaagagaagagacgaggaaaacgaagacacaaaaggaagagacggaaaggcaaaaggagacaaaaaagaaaaaggaggaggagaagacgtaaaggaaagagacgaaaaggaaaaagaagacaaaaaaggaagagaaaatgtggaacaaaagggaggaagtgaagaagaggaaaaagaaaaagaagacaaaaaaggaaggaaacaagttgaacaaaaaggaggaagtggaggagacaaaaaggaaaaacaagacaaaaaagaaaaagtaggagacggaaagagaagagacgaggaaaacgaagacaaaaaaggaagagacggaaaggcaaaaggagacaaaaaagaaaaagtaggagaagaagatggaaagggaagagacgaaaaggaaaaagaagacaaaaaaggaagagaaaatgtggaacagaaaggaggaggagatgaaaaaggaggcgaaggaggtggagcagaaaacaaaggatgcgttgattcagatggtgaaattagcctttaataataataataataataataataatattaatgtgtttaataatttgtttatacttttagcaaaatccaatatgcataagataagcttatgtatcaaaatactctttagct

SEQ ID NO: 1480 - DNA, 11414 bp, Heterodera glycines
actacatggtaagactacttgaattatcgattgattttctccactgaagggagagaggatcagctgggcgggtccgtgcctattgggtggttgtgtgtgcgtctctgacgggaatggggtggggggtgcgtcgggaaaggtgggttcgggataggggctggtgcgcgggacggagtggggtcgggatttgggggtgtgggatgggggttgcgcgagattttgggctgtgggcattaaatgcgcgggagtttcgccgcgcgggattgaacccgagagtgtggttggcccgacgcgttaaccagtcggccaccgatgcagttggcggggccgtgatattttgcgttaaatagcgcggccccctccccgctggacaccgccgccctttcgccgggcagcgcggacctcctctcttccacggaccccctccctccactgccgcggaccccttctcttccacggacccctccccaccattccgccgtccgtcggcgcggacccctctctctactgccacggacccctccccaccattccgtcgtcagtcggcgcggaccccctctcttccaaggaccccctctctccactgccgcggaccccctctctccgacggcgcgaaccccctcaccccgccgttcggcttaaggagtggtggaatgattgcctgttaaatttgaagtcaatcgtacaaggggtgagcgagttttggtgcgcgagtctcggtgtgcgcgagggggcggggcgtcgggacagtactgcttgaaatggtgcctgaggcgaaattctttcgccgttcagcttaggtggtggtgctatgacggcctgtgaaatttgaagtcaataggacaagggctatgcgagttttagcgctcagaccccccccccccccagttctgtacttttctaaacgttaaaatttttttatcataatttaaattgcaaaaatgaaaaaaaaaacatacgaaaatgataactgattggtcctcccttttcattgctgattctctgcgtattggcgcaaaatttcggcctcgcgttcggcgcgctgaagaagcgcggcttcgattcgacggtgtccaaaaagaaacgaatctgaaaaaatgtgatgaaatttaaaaaatgctaaattgaaaaaaaacaagcttacaattgtcgggtcttcacgccaccaattcaagagcaaatcctcttgagtctttttcgattttgtcatactgaagaaagatttcattgtcagttttctctaattttgcatcattttgttgcgaaaaatattggtggttgtcgagggatatttttcatctcttccattactgtctcggcctcgctgggcgagaggtgaccatgacttttaagccaccgaattaaaacgaaccaaaaaagcaaaaacacaggaaatgcaagaagataatgagaaaaaagcagtacatgcaaaagagtttcattaggctcttctggggaattcaaaatttgtatgtcaggttttgttgtgttggtgttattcattttaacattacataataatatttttatttatttatattttatccaagctttgagtcggtcacaatgtgccggttataatcaaccataatcatttggtcgaattcacccaagacaatcatctctacaccaccaagcggaattggtgaattgaatgttgctcgtacgtttgtcgtaccgtttctcaacagctcaaatccacagctgtcgtcaagcgtggaagtcaatggaatgacaaaaaaggtccacccttttttgaactgggccattgaaatgtcaaatgaacgttccgagttagccattccgagtgcctcatacatgtcaacaaaggcgctgacaaagtgatcatttgaaaaatttagtttataaggaacagctgggtaaactacgccaccagcatgtaccgaaatctcacgcaaatcaaacggctcaaacatgaagggactcagtttgtagtcaccatgaaatgctgaatttccaactaacgctattgtcacacgtcgaggaatggttgcactgaatacattgtactcaaattcgtatcgaccaacactgatgaatgacgacttgatttcggtcttgcgtactgcgtatgtggcgggttgtttttcaagggttttgtaaaggctcatgtttagtgaaggttgtacctcaaccattttggcataaatcttgacatcgtgaactgtcaaacgatatttggtggaatcatttgcttttaatgtttgcaaaagaaagacatctttggccttgtaaattgtgaagagcaagtccaaattatttaagagataaagctcttggtttcccaaatcaaagtcgagacgggagaggaattgcgcatttttaccacccttaaaaattttacaacgctctttatacccatcgtctgatgaatcatcttgatttacggtgtgataataccctgttgaaccaagaaaatttttcttggcatttattggaaagcttaactcattggtgatataggccttgaatgggtataaatttccgctatcgtatacttccgtattgccaaccgtaacttttagttgctggacaaatgtttgaccaatcccttgaatggcagagacactagtatccgcatcatctatcgcaacccatttatcgtttgctcccggtttttcaatggacagttcgagataaagatagacccgcgataaatcggtccacaaattgtcactgtaaagccgaaataggtaaggcgattcttgcgtgattgttgctagcggaagcacctgacgaaagaaagaacgcacaacagacacattggtcggtggaactgagaaaatgtttagaccactgttaattgctaggggactgctgtcgctgattttttgtgggcaagtcattttttaataggttcctaatgagtcaacacgcagacgtttatttttggtctttacaaccattggtggcccgactgacgattgaagtttatttatattttttcgccttatttttccaattttgggagccgagtcttttttgtatcgcttaaaatcaaaaccttgacccttctgagtgtttatgttgttggctgctttttcgagaagattctttagtcctgccttactctcactaacgagagactctttgaggtcttttccctctagcacattggtgagtactcgatttccgctttccattccctgacgtccaattgcggagccaatttgctttccaatcggcagcaaatatctcataagacttctgaacactgcgccaactcccgctccacgctgatagggcaacccccgataaatgttgtatccaccaaattgcacatactcggacgagaatgtggaccaatccacttgtagaggatcaaaatcaacatgcatttttttaaatttgacgtttttacattatttatattctttgaaaattatgctttttacaaagttgtttacgagcttatccggttgcatctttccaaagtgcaaaaagctgacaattttttcaaaggtcattccaagacatcgacaatacaaaaagaaaatgacatgtcgaccacacgcacttgagttggcagactgaaggggaagagaattatattgaatttgtttgtagcgtgacaaatgattcacaatgtgaacactgggcggtggccacaaccccaatgagtcataatactccaaatgcaaaggagaagcgcaatatatgcccacccaatgagaaccatgtgatgtgctggggtcaagattaaccaccatacagtggggaaatttgacaattgcaccggcgggtatttgatctgctgcaaaacaaccaagatagtagtggcgagtcacgttgtttcttgtcaatgttttgttaatttccaacgtgttcatcatttaaaaataggacatttttctaaagtgtaatgttaatgtacatgttccgtattggaatggcatcaagatgccgctattggtacgtatctcaatcagaatttcagaaaactcctttaataaaagtttatgatactgtatggcaaaaaattgttcttcaactacttggtcggggtttccgcgtatggtcactatgcgcaacactggggccgtcacatctccaatcatcattggttcaataagatccggcgtgtaaacgtggaatgatgacacaccacgctcatgtccggcatgaatcttgcctcgttttcagattgaataaactccgtgttgttgaaaccgagaatgtaagcgagttgaggcgagactttgacctttttaacgtaccgtgggtcgatgttcaggacaaaacgattcctattgacgtcgtagttgaattggcaaacaagacgtatctcacggtacgcctgaatccatgcttccgttcccatttcctttgtggcttcaaggatcacgcgttcctcttcggtcaaatttttgatttcggcgttcaattttgtcatgcccaattcatcaagaatgttcaatttttgtcacttaatttcgaaaagtactcatccaatttttcttggtacgaattggtatcatcagctggtattctcaacggtacattactcgttgcagcactcttttcgcgtgtcagaaagccttgggccacgctgttgaggtcaaccaatgttccagtatctgtcaacatggcctgtaggagcagctcttcgtcacggacgccccgtttttctttagtctttcgcttaatgtactcttctctagcccatcgccgagccttgtttatcaaaagcatgaaagaattctgtgttgatcgtaccttttttgccaacggatcacttccctcacccaggagcctatataaatttttgctaagctcattggggtttgtgacatttgatggtggaacttcgatacgtaccgtattccccgtctgccactcaatctgaacaaattgttgctccacggtgcctatggaaggccaagagtgggggtatacaataacggcaagacccacctcccattccgaattgaattgcaatttgcgcggtaaacgcactcggaaagaatttgtcctatttccttcaatattggtgtttgacggaagaacaacataaaaagaatttgaaggcatttttttttataaattttattaaataatgctttttatatatttttctcgctaattgaatttgcgggaatccaactattggagcgagcgctgtaccctttccatttcacaagtacatattccacaccgttctgcctctttttcttcaaaatcttttcaatttcatacattttttgttgtttgtcttctagtgatttgcataaatcatttgcgtaaaaccagccactaataatttcattattgtcatcacgtaaccgataaacaactggcgaacgctcagagtgtacctctgccaccgtgaaaagttcattggtgaagcgtgggaggtaacccttttggaacacgtgcttgtacttttcaatgcgcacgcgatctcccacacggtattttggcttgcgtcgtacaacattttcaacggcatcatgtaatttttgtcgcaatgcttctgcgtttttaaagttcacgtctgctgggcacattccaatgctcgaatttgtcgagtggttaattgcgcaaacaatgtcttgcacaacatcaatccacttgtacgtgttacgctccgtaaagtagcggtaaaggcgctctttgatgctacgattcgcacgttctgccattccggcatgaaattggggagaagtgagcatacaaaagtgttcaacgtcttttgtgcggaagaactgctgtactgcgcgggcagtgaattcctttccctgatctgttaacaccttccacgggatatattttgatcttttgaatatacgatcaaaggcaatgaccatgttagcgctcgtcttggtctttacgggctcaacaaacacctgtcgactaagggtatcaatacagactaataagtacttgaagccacgattttgtttaccaagtcggtcaaaaatagccaaatcggcctgccattcagtatgcaagccgggcgccaatgttggcaatcggcggtagcgccgcttcgcctggcgatgcagtgtgtatgtagcggttcaacgctcgtgaatgcgacaggcgaacttaggtccttgtacaaaaactcgagcaaacgaagctttttcaaatccataatgatggcttaaacttaattggggtgtttttataatttcctttaccggattggccttcgggaaataaatgcctactcaagagcggattctgctttgccctttcaacaaattctttgaatgcagttggctctttgttttgagcacgcttgtccttgttaaacaggtgactaacaatgtcatcaacactgctggttataaatggacgcccacccgctctcaagacctgtccttcctccgacacccctagagattgggcgtttttataaattaattttaagatttccgtttgtgtgggttgtcgtttatttgaactcgacgaccgtgggttttgataatcatcatcatcagtagcttctaattgtttaacattttcttttcgcgcacgcccaattttaagatggcgacgcgtagaaacaacaattggccttgtaacgttgactggttttggcatggcgtcaaccacatcactcaaattttctaatttaacacccacgggacgttcatcttcgtcctttgtgagcttgttgagacgcttaacttcctgctcatatttgactgccctttccgcctcatttatggcgtcatcattttttatttgtttaattcgggtacggaccagcccaattggtgttccgtcagacggtggcggtgctgccaaactctgataaatctcttcggggacgagcagatatcgctttgtatgctgcattttttcttgtttttaattttttggaaactatttatatttttcaatgacatcagcaataagcgggagagcaattgacgcaatgagccccacaatagcgggaaggccatctccgtgttgtagcaaaacctttttggcagagcgcgagcagcgtgtgcgggcgagacggcgaagcacctgtgcatgagctttcagcttattcaaatgccggggacgcaaagggactcggccctttagaatgttgagacatatttcgacaaggcacaaaagctgctgatcagatgcgtctcgaataagggcattcgcctttttggcattacacaatgtctccaaaaaggattcgtttcttgaaactaattgtgaccctttcattttggtaggtaaactatttgtttttgttcatatatatttgttctaaggcggatctcttccggactctctgggtccatgtccacgagaaggtagccaacattttttgcgcatgcgtcacgataggtctcaataaaatgggcagtccttgacgggaagatgtgggtggcgatggtgcgaatctgcaacgcccccgcagggtttcgcattaaaactaaatagtgagaattagtgcgcgccacacgcaactcattgctgatcaggtgctgagtcaccaaaattacgctgacgccccaattgtgtgagccacgggtgaagagtgcgtccaaatattgctgactcatacccaccaccaaattatccagcaccagcaaggttttttcttttttggcgcactcccgaacttgctctgcgcgtggaacaccgctatggacagtgactggcacattgccaattttgccggcgcgctgcagattcatcacatttgtgttcagctccccatagctataaataacgcgttcaacaggggtagagatcattttatccacatttcgcaacagacgcattatccactctgacttcccactgcctgtgctcccagacacaatcattgtgggatgacgaaattgtccatcctcccttttaaattgttggaaagcttccattttacttttttatggaattttctttttatttatagtttttcattttcatagattttaaatggatttaattcttgccactgactggataaacaacgcttatcctgaaatggacctacaggacgccaacaaagagaaaaaaagagctaacgaaaaagaaagaggaggaggcggatgatcccagttggatcagcctgattgacgaggagatgatgcgcgagccgctcgctccaattggtgaggaggcgccagcaacaagttgctttttggttttcatttgacatttaaattttaaatttaggcactccaaaaaatatgcttgcgctgaacgccgtcgccccgtcccgcttgtggaccacctctgcatgcggttcaaatgcagcgcccacgagctgcatgtgcttttcaaaagcctagagaaacgccgggacattgtggagcatttgcgctccgtccaactgcgcactgcccacctgcgcccgtccgtgcgcaattttccagtgcgttgtaatgacctgtccatcctagacacccactcggccccagcttaccgaggctatcttggcataacggtatttttatttgctttatttgtctgtaccataaaattttcatggtccgcatgcactactacataaaacacggtatccgcttgcgccaccctaatttgccgtgtgtagttgaatttggaggcggagatcacaaaacttttttccctcttgaaattttgtccattgttttgtagatgtatttaatttccaattgtactgttgtttttaaaataaatgttcaacaattaactcgagagcaatttttggcaattgcgcaacgtggtgcaaacacggagtataaccccaggcgcttccacgctatcatcatgcgcatccgtacaacaacgggcaaaactgtggctgcactggtcttccaatctgcgcgtgtggtcctcaccggagtgtcccacccaagcagtgcaaataaaatggcggcacgtgttttgcgtcgcatccaacacacacagagcatcacactgggcatccaccagctgcgtgtggtcaacattgtcggtgttcaaacctttccccagcgaatcagtgtggagcgacttcaaaacacgctgggtggcatctatgacccaacaattttcccagcccttcgtagtaaattgttgaatggagtcacgtgcctagtttatatttcggggaagatcattgtcacgggggcccagtctcttgatattttgcaccagtcatttaccaatttgtctaatattataccaaactattttcgtgcgtaatttattggtcacactattttgtacaaatttaaacataatgaataaatatttaattaaaggaaatattacaaaaataaataaaatcacaataaatcataacatcagaacctttccggtgcattccacgggaggggtgtcgttggtggacggagcagcacctcgcgcgtcaggacccgtgggttgcccacagggaagcgattggctttcagcttttcatcatgaatatgcgcatgttttaaaagaaaaaaccgaccatcacgtatgggtagaggctgacaatgtcaatgcacaatatctcctcgtcgtcactgcacacgtggtgcagcttgaacggttcagtgcgccctcccctcagtgcgtcgttgcgcgggtccagcgggcaagggacgaacacggcatcgtaacggcgtttcaggtccgggtcgtgacggagccgctccgtccactggcaggcccacaccttgtggatttcgcagccgtggtcattctctagctcaaagaggcgccgctccgtccgttcgtacagatcttccgctgtccgccctgccgccaattgttgctgccgatcgggaaagcacacgggacagcctaaattttaagatattttgtatacgagaaaaatccgtttaccgtgaaaatagcatccaagccattcaatggccaggggacggagaggcgcttctcgtcgccaaagtccgtccacgcggtagccgctgtcatcaatgtgcgcctctccgaccgaccagctggcgcattgcacttgcgcctccgggtgctccagctcgaagaagcggatgtagcgctgcgattctgccgaagcacggcgtccgcgcaggtatccgccctcgggtgagtgaaccagacgattggcgggcaggaaacagcggcgaaaagttgccagcgcaagaccagcagctgttgacgcgtggaggaatgggtcgaggccttgagtgttgtcggcgatgagttggcggaatcggatgaccgactccctcaaaatggccacgtcgttgacgcagtacattatgagctgctcgcgtagctggaatccattgccgttgttgtcggcgtgccaacggtgaaattgcgcccgtttctctgccttcatcgtgtccggtgcgtagaactcttgagccggtagaccgttgaggcgctgcgacagatgttgtcgtcgaatgtagagatacgggaagaagggcttcacagtggccagatggtccggcacttggaagctcttcaccaacgcgtccaaggcacaaaaaaagtagttgatggaatccttgaaggtgattcgtctttggttacgcccggacagacgcatcgagtagatctcaatccggtggtgcacagatgcttgggtggacggtttcggcggtgtagtgcctcaagtacgagatggaaatcgtactttccaccgttgtgggcgatgcacaccgtgtgtgccttctttgggccatgctgcagcaaaaaatccaaaaattggtccactgggtcgttgccgtcgttgtcaaacgaatggaagaagaagcggcgctggttgaatgctggtgctccaactggcgaagcgctgttgtctcccggtgcattggcaaagggtggcgaagaccactggcgaaacagttgacctctcaccattcctgtcatgcagacgcagccaggagcccgtcttccaaggccatcgttcacgctgatgccagcctgcagacaacgttcgcagatgacttcggcgacgatgagcagcggcacgtgcttctggacggtgcggttgttcagctgtaatggcgtatcctgtgacgtctcagcgtcaaagaagcacagacgaagcggcaattcttcatcgtcctcgtcgtcgtcagaatcgtcgttgtcaacagcaatcgatgcacgttgtcgaactgagccgtcgtcaatgggctggatgtagcaaggctcatcgacggtgtggggcccattgcagcgccgacagattccatcgtcggctggctggtcatgtgggcactgatgtgtggccacgtaggcgatacgtccacacgcacgacacacccggcgccattgacagatgggccgacgttgtcgctgaccacgaccgtccatcggagctggagcgtggttgctgagatggtagtcgtagcacccaccatttgggaagatgaacagacattcagcgcactttcgagcactacttccaccattcggtagcttaattgggtttttttgctattgtttttgtagttttttggagcttaatctacctgttcagtttg
